United States Patent 7,491,813 (PROMOTER POLYNUCLEOTIDES IDENTIFIED FROM ZEA MAYS FOR USE IN PLANTS) - sequence listing, part 4

SEQ ID NO: 8000 - DNA, 594 bp, Zea mays
cctatagcggcggcggcggcagccgcagctggcccgccgccgggtcctctgtctctcagcagctcgcagaggtctcgccaccttgtgaccctctcgagcgccgtaatggagagcctgaggaagatggggaagagcgtgttcccgagcaggatgtgtggcatgaccaggaggagcatgcccgggaaggacttgaaggacaccatcccctcgttggttggcacgaagccacagtttgcgaacgacgagacgaccgtgaagacggagaaggtgctcaggctgatcctcttcctaacaagcactgctctcgcgctgccgaccacgctaaggtagattagaatgagcgcgtagccggcgatgtgcacgaccaagatgtagcccagcacgataaacattagcaacctagccatggatgcgaaatcgccatggccgtccttgttgaaccctgcaagctccatttggacggcggcggcctgggcttccatctccatgggacggtgacgacgacgactctgctctaagctattaccatggagattattatgaggtgtttctctcttgtttctgagcttggtgcaggtgaagtggagaccaagc

SEQ ID NO: 8001 - DNA, 761 bp, Zea mays
gttgatatagccgttactgctgaccgttgtgatttcagccgttgatgtacaagggcggaccgtctgcggtcggcagaattggagcaacggctaggaagtggttggtggctataaatacaaccccaaccacctccattcatggcatccaagcattccaaccttccactttcaatacaagagctagcactccattcaaagacacaatcaaagtctccaatctctccaagttccacaattgagacaagtgatcattaatgattagtgacttgagagagagagagagtgatccgtgtgttatttgtcgctcttgtcgcttggctttttgcaatcgtgctttcttccttcccattcttattctcaagtgacttgtaatcaaagcaagagacaccaagttgtggtggtccttgtagtggactaagtgtcccgtttggttgaagagaaaagctcactcagtctaagtgaccgtttgagagagggaaagggttgaaagagacccggtctttgtgaccacctcaatggggagtaggtttgcaagaaccgaacctcggtaaaacaaatcacggtgtcatccgctttatttgcttgcgatttgttttcgccctctctttcggacccgattatatttctaacgctaaccccggcttgtagttgtgcttaaactttataaatttcagatttgcctattcacccccccccctctaggcgactttcaattggtatcggagcccggtacttcattaagagcctaaccgctcgaagtg

SEQ ID NO: 8002 - DNA, 1186 bp, Zea mays
ccaatcatgattatgaggtacatgtgttcgcatttgctgaatagctaagagatggttagaacgtgcgtggtggagtcaccccagttagttgccagcatctttttgcatacttgtaatttacgaagaggtgcgaaagggtctcttttttttttgaagtatgcaatttttcacatgtatacgaatctaactccatatttcttctttcggctgagcagaaacttcgtttttagtttatttttttcaagaaccaccagaagaaaacctatattccggttgacactttatcttccacaactaagcataagctagatggactgtcatagtcacaatcatatgtttgtgtgctttttgtgaagaatattgttgtgctcctcaattgtacgaccatttgtcctgttgatcagatatctgttggctttataaggcctgcgttagactctaatattgttcgagatggcctaatatcggtagattagcttgtcctcaaggtaggctgctggcctagccccgcgtgacctatcttttgttcccttccacgtgaagcctaactaggattatatctttatccttgcccggtgtgcttgcatgtgtggaatggaatgcgacagacggagacggttattatatacacaggcatacagccatccaaaatcgtcgatctactagcatgctgtgaaattgccgattctcgccccggccgtagacaaaacgagtgagcattgacttttgagggcccgagagcccttggctgttggctcacgtcggtcgtctttcaacctcgagtaaaaccaccacagtggactggactggacaggacacacaccgatcccttctgaaaaatccccctcccctccccgaggttgcagcggcgagggaggggagagataataataatcgcaggagggaaaagcagcagcgcaggcgcaaaaagcaaatcaaagccacaccaccaccaccaccggcagctgccgagagctgcgcccgcgcccgaacacaagggagagcggccggagaggaaagccaaatccatccactccacccccgtacgccgccgcagctctagcagccgccgtcccgcgcgcatgggccccaaatcgccagcgccgcgacgagcgcgcctgcccccgctgctcccgcggcggcggtagcagcagcagctgctgtgtgcctcacgtcttcgccgggg

SEQ ID NO: 8003 - DNA, 903 bp, Zea mays
ttaatatccttcgtccttcgaagcattatttccctaaggatataatgatttccggacgaaggttatgaaggacataccttcattagcataaaatataataatgaggaaggaatcatatgaaacatataagttaacataaacgattatgtattattgacaatccattcctattttattatgatgaaggaatagaaatgatgtcaaattacaaatgtaccttcagctcgtgagaaggtaaaagtacaagtgtgacgcaaaagccaatgccaaatcagcgtgaatagtacggggatactgttcacctatttataggcatgggtcgcagcccatgcaaaattacattaatgccctttacgtttatcaataactctatgataattcttcgaggtctaatctggtttttcatctttaagtcggtttcctttcccgccgttctcctgaagctcttctacacacagcttcggctctgcgccaaccttcgtattccttgtgcttcgtcctaccgtggctctgatccaagtccgaagatacctgttaatgtactttactccagaaacattgttaaatcatgtttttgaggaccttcggaagccgaaggcccctaacagtagcccctcgcaatattaatttgttagaataatagattcagattgtgaaatggacgaaggctatgagccgaaggtccgaaaaaacaccttcctcttgctagaatagcaacagtcattggcaactgggaccctccagtctccaacataatgggtttataaataggggctcgccacaatttatttgacacgctctcttgccatccgttttacctgctcagatagttttctgcctacaaatatttggttgcctccctagttttaagcttcggaagcgagaggcaagaattccgaagga

SEQ ID NO: 8004 - DNA, 489 bp, Zea mays
ttaattcatcttttttaaatttatattgatttgatatatttaatttatatccgtatttaaatactgtattttgtaatggaacggattcttcgctggacaaattattcgatgaggatagtttttcaatgaacattcgtagggatgggatagaattatttttttcgccgaggatggtgagccgacggcaaatcctctttgacatccctaaccgtgatccagtcacaaatacggcccaattcgcaaaagtacataggtacacctcgaaaaccccaaaacaattaccagcccataaaatgatcaggcccatcaacgacagcccacgcgatgtagtgatcactacaattcagaagacaggcccagcgcacgaaacaggcactcgccggcgtacacgcggcatacctaaatccccgccgccgccgcgttttgtggggccgcaattcttcccgtcccaccgtccggtcgccgtgagcgcgtgatcctttcacaacc

SEQ ID NO: 8005 - DNA, 915 bp, Zea mays
attatccttttccatgttaggtactaactagatatactgaatatgttgtgttagggaatttcattgaaaatagcttttagagatattaccaaacatgccagtatgctgcatcggagcgcgcgacatcatctgttccaatacatattggtatcggatatcggaccaggctagacacacactattctaacccatgagcaccgcttgtgagaatcaggattcttatctctaattcatcacatactaccagttttagtaaaactggctatacctattgagaacatatctaatgcacatgaaagattggtgcacgtggtgtatatattaaattatcaccactcattttagatctaacgtctctaattgtttggtatattttgctaagaacaccctccaacgtggtggtgtgtagtggtggaaggtgttatttgtaaattgaatgatcaattagagacattagatctaaaatgagtgatgatgatttaatatatgcaccatgtgcaccaaactttcatgtgcccgagatatgtcctcaacaagagaacctcactcttacctgagcaagaaatacgggatttctacagggtgcttctgcaaaatctttagaagaaacgattatttatcccctctccttctccggtctccgcaagaacccgtgtgccccgctccgtcctacgccaccgccgccggattcgctcccacctccggcggtcacgcccgttaccaacacccccacctcgcgtcgtccgccagctcctctctgccgcggcgcaaccatctccatctcccacgattacagcgaccacaagaccagcgacgcctccaccaacgagaaggatccattcaattcatccagtccacgcacacccccgtctttgactcgcactccgcttccagatctaggcgggccgaggaacg

SEQ ID NO: 8006 - DNA, 1500 bp, Zea mays
agccatatttgcccatctctatgaagcaaacttaggggagttcgtcattctccctcattcaacatatgttcttcctctacccccgacctagactatcccttgaaaacttaccataaaaaccggcatatgtgttggttctatgttgaaaatcacagaccctaactttccagaattcatgctcagtgttcgattccacgaattgagtggatgagtgacccaacgttgacatattgtgagattgttctcgcgcctatgaagaggattcaacacatggagctcgagcttaattctatgcatgtgatcggaaattggatccaacgctaagtcccccattacacgagatgacaaattatgcttgaaagtatgagaatgtactattaaaagtttatattaattgtctagtatcttaatgatcttaaataaaaatacaaattataaagttgtagatttcatcgagtgctacaacattcatacaaaaattgttctcatttgacaccatacaagaaaaatatagaaaaaacatgaaaaaaggctcgaatggtacgatccttccgtcacccgagactatatcactaaaaatctatattatttatcttaagtatgttaataattttaaataaaaagaattcaaaaacataaatcttataagagctacaactttcgtatgaaaaaaatctctatttaacatcatacaagaagaatataatttttctaatacaacaaacactgtacgtgattaatatattcctaaaattttgtattattttttaccattttaacgaccgcaataaaagaatttaaacttcgatcatccatttattttgactatttaacaacattttgaataacaatgttatagaaggcttaacaaatatttgatgaccatataatagaacatgtaatatgttttgttgtactattatagtgttgctactttattcaattatccataatgttgttgaatggatgaatgaacaatgttagaaattttgtaatagtatttagatagatatatttcacgcttgtataatatattattttgattaatgtttaatctctgtaggtacgggtgactcatacatacatggaatggttatgaggtaaattcatactcactagtgtatatatgtagtgtatatatatatatgactcgacatttatttcgcgagatagtaccgtagacatttacccagcagcagcgaacagcctcgctattagtgtcattgtatcaatgagagtgttaaaaatcgctatccactaatagtgccacgtcaatgcatgtgaacatgccatatacacgttgagggttagaaatagaaataaaaatgagatggggttattttaaaaatgattaataataaaaaaattcctccaacctcgcaaacatgacacaaccacaacaataaaaaaaaacagatcccagcctccatttccaaatccacacctggcccggctgccccaaatgcgtcggcatcgcgccgtcgctgctgcacaccgtcg

SEQ ID NO: 8007 - DNA, 1400 bp, Zea mays
atccatcgaacgaacaaagatgatttcagcaaactctaagcaactcgaaatttgaatggtaggggcaatgctacggcctgtgtgccaagtcaaaataaaaaaaaataggaccttgtcgtcgaaaatgactgagagacactaaaccgaaaatatttcggcatcagggatcagccagcctctgcaggggcatataatatcagctgctcgttggtccaaagtctgctcgcgcatcatactacatcggtgacaggcgcttatttcaagctaatcgcactcgcacgcatcaacgcgcccagttccaagagaaacacaagcagaattgggaatttggagtggttcagagggtatgattggacggttctgaacttctgatgtatgtaacctgcatgaatcctatatattgactctaaaatattagcttccgatggagtgattcagagggaatttgaactgacgacacgacgcggccgcgggcaaagagtacccaaggacagcactgacccaccaggccatcgctcgaccaatctgctgtgagagcaggtaagagatagttatcgctttgctcggaccaggcatgctgatgccgcaggccaagtcggcaaaggaaaggaaagggtggagcccggagcaggtagaggtgtaacagcgaaaggcgttgatcgggatggaaggatatttcgcttggttgatggcgtgcggaacgtgtgcagccatagaatagttttcttttccggatcatgcacgatgaaattagtgtggagatgactcaggcaacggatccgcgtcagccaacgaatcacggtgctgaactgctgatgattgatgagattaacgaaacagaaagtgatgaatcgtaggtgctatatccctcggcctagaataaatcaacttgagctgtcctgttttttttatataaatggctgtttttttctaaaaaaatactgctccctctattccaaaatagttgtcattcttacttttcaatgcacatttctyctttcaatgcaccttatcctaatacatctatatctttttttttaaaaaaaagagatgttttggtcttttgattcctacgctggtctccatgagacagtctaaaatatcagctattatgagacgaagagagtagtattcgtgacatcgaattagtacaggtagatagatcatgaaatatattttcataatataacattttcgggtcttagatggtttgtactctttttacttaaaatcaatcaaagttaaagcttgacttagggtctgtttggttgggctgtggctgtggaaaaagttgctgtgggctgtgagctgtggaaaaagctgctgtaggctgtgtgctgttaaaaagctaaaaatcgtttggtggaaaccactaaaagtcgttaaaagttcttcgatat

SEQ ID NO: 8008 - DNA, 731 bp, Zea mays
cgtgggtctaacgtggcagcatctcgatgccatgacccttgccgctgaggtaggtgacatggatctcggcgccgacctacatatctataaatatcccacttcggtcgtcgattctttctactcatttctcttcttccaaatcacaaacatcaacctaaatcagcgacttggatccattgttcatgtgtatcaaggtaatctatcttcatttttttgctcttttgttatgtctgattaatggggttagggttacagtttggtaatcatttttagaatcagattatcgatttgtaggaagtctaggcgcggtaaatatgctaaacaaaggtaagcgttgatttatatgtaataactaatatttgtgagtcttataaaacttattgaaatttaggaaaggtcatttgaccgaaactgccttcaacccgctacctttgccaactggtgttctagtgcctatgtgtttttatggtgatccttgcaaggttaataagtccaaggatcatgacgcctgtcaatagaattatagaatgtgtgctaactatgcatttgagccaacgattgttcagcgccggatgaattttgagagcacctagagggggggtgaataggtgatcctgtaaaacttgaaacttaagccacaaaaacttagttaagtgttaacacaataatcgccaagtggctagagagaagtctcaacaaaacacaataaccacaagagatcaatcacagag

SEQ ID NO: 8009 - DNA, 1500 bp, Zea mays
agatgtcgaaaatatttatgtgctacatttttactatagatgaagagtgtcatttaagttacagagtagaaacaaattctactaatgcataaaatcatttctcatcctccaccccatgaatttgagatagacttatatctgaactttggaaagtggtggaatatcaaatttcaaactaaataagttattttattgagtgaattctaattcctctaaaatgaagggatccaaacgccccctcacactaaaaccataaaattcaatcataaccaaccatcttcttaatacttactcatcatactttaatatcatggcatgtctcaaccatgagcatgcagcagtcgttgccagtagggttggaaacgagccgagccgagctcgattcgactcgattcagtgcggctcgttgacagaccgaacttggctcagttcgttcacttaacgagctaaaagaggaggctcggagttggctcacgagccggctcgactcgcgagctggatcttaataaataatattgcattatatattaatttaataatatataaatataaaaaatataatcatcattcaacattataagtgaaattatccattatccattgttattgtatagtttgattaatttggcacaactcgcgagctggctcggctcggtggaccaacgagctcgaaaacgaggctcagctcgactcattcggggctcacaagccgctctgagccgcccgagcttaagccggttcgcgagtttcgagtttttttttttttttgccctagttgtcagtgcatcatcgctagtgccggtaaccaatttggatgggctgtatgtctgtatgggctgaaaatgrttttggtgggctgaaagttgatctaaccgatggaatagataggatgtgctgcctggcctaccggcttccgtcacaaccctttgcttgtaggccgaacttgtacggtgggcctcttcctcactactaataaattatgcatttggagggcgacgaaacgatgccgtcacaaccctttgcttgtcagtcatctgtctggtgccgactgctggacccctctttgtttgtgcctggaggctggaccgctggagccctgcacagtgtacagtgacgttgtcctctttgtctggatctcgagacttctgtgtgctgcgattgcgacgaattaaagaaacaggtctgtagtagcaactagcaagtgcagtccgcatcatcgtcctcattgatcatcgtggtcgtcatcatcataccatacagagaatatgcatggtttgtggtccttctaacagcgcgaaacatctgtcagttttccttcaaaaatggaaaagcgaaggcaaaaccaaagtttgttgtgggagtgggacgtgacaccccgcacacatcagttcatttcagtttcagcaggtcagttttcgtcctgatactctgtcgctgcagcggtgccggtgcagcgctagctgcagttgggttgyggccgcagagcagcaggaaggaagg

SEQ ID NO: 8010 - DNA, 654 bp, Zea mays
tatattgttgggggcctacttcttcaccgaaggtcctccaagcaaaaacttttcggcggtatgatatgcgaactgacacagcatgaaggctcaagccgaagctacaacccagaaagcttcgacataatgacgcgccttgagatgaagggtgacaccaacttaaagaggaaatgaccgttcagtccctaatagtttgtgtcacatttgtaatttattatcagggacataaatgtaatttcgaccgggctgcgtcccgcgcctataaataggtgaacagtaaccctgtactattcacgctgacttgtattcactcgcacgtcacgcctggatttttaccttctttcaagccgaaggtataaatgtaactcgatattgttcatgtttattcatgataatataatgaaaatgttctgatgatgtcatatgattattcatgttattcttgtttcattattgtatactgagatgatgaaggtatgtccttcacgaccttcgtctgaagatcgttatatcctaaaggagataatgcttcgaaggaggaaggtctttgactattaacattttgtgttgccttgttcttaactcatagcatttgagaacaagtctccaacattggcgcccacctccggtgaactcacttccactgttgagctg

SEQ ID NO: 8011 - DNA, 1500 bp, Zea mays
accacggctagcggccggccagccagccagccagcgggccgggcagtagtggtgagcacgcgagcaataagcgtggaggccgccgttcacgagcgcgtcgtgaaggccggtagggccgcctgcagctgctggcggccgcagcgcgagcgcgacgcgcctagccgcttcaccaccagctggcggccggtcgtacgcggccgggagagcccacacggggcgggggcccgcgcgcatacggcctctggccgctgtccgctgacgcctgacatgcgggacctgtaccttcgctcgctttacgccaaccgccgtacgctgacgggcctcgtcggagaccaccatctcatctcattctcatccgatcggatccgatcatgcgcgtgcgtcttccccgattggatcggcagataaggtgacgggtttcgcctgtcagctgctcacggccttgcatgctgggatccgtggtctgttatatgtacggtacaaagacgatggtgctcgcctgctgggatcatggtggaccactttgctctagcattggcttaagccatggcgatttgggatcgacgggggtcccgacccaggttttgccgtgtgatgggaaataacatggcagggattacacgtcctagttctgtagcacagagggactgctatgacctagagctagaggtaggccaacctgtcatccatagcagtccccaatagtactacccattgatgcaggaggccagctccagcctggctggcaatttacgagtacgtggtggatgaggaatggcctaaccctgatgccaccggcgacggcgaggcttgtgactgcatatctggaatacagtcgtaccgacaaagtgaacagtgcgcaccaactgttgtactcgtactcactggctagtgggtgctgctgctgctgctctgttcacagcttgtaatgtaataactggaaaccgggcccataaaccagtgaaccaacgttcgtatcccagtgcctaaaaatttcaagcgcctcgagaggccaacctgcttttagccactccggggcagtgcccactttgcccgtcccacccgcaatccccaacttgcccctgctttcctcccgccgtcccggaccagcagccgtttccccggcgccaaaagagccgtggcaaaacggtaagtgctcacccaactacagctggaagctggcaggggccaacgcaaagccagctgtcagtgaccgttcgggcagcgcggccaaggacgcctctttactttggcccagaaagtgccctcccgtcatacgtcacgcgccgcgcgcagcgtcccaggccccggtcctccacactccactgtctcacactcacacaggctcgtggcctggcctctataaatccccgcccagccggtcacccccaccccatcgcaaatcctcgggcaagaagagccaacagaaaagtattcatccaagaacaccacccccacccgctccaagcagaaattttgtcttgaagagagccaccacca

SEQ ID NO: 8012 - DNA, 278 bp, Zea mays
ccccccccccccccgccgtcccaacgccgtacccaggggccaggggtgggcgggcgcaccgcaccgcacgtcgctgtcgcgcgtcggcccggagaacgcgtacgccgcccgtctcctccctccccgcgataaaaggccttcccctcctccccagcccccaccagctcaggccagccgtgcggcagcttctcccctcgcctccccccctcgtctccgcacagagagggctcctcgctgccgtgtgccgggcttcactttcccctctcgtctcctctccc

SEQ ID NO: 8013 - DNA, 659 bp, Zea mays
gatcttcatctcatgctttagaaatcagcatttcgtcttcatcccatgctcttgcgaattcaagcagtagtatctgcccataccttgttaggtttgaaatttatttgatcagtgatagattagacgtctggtagatggctcttggctggtcttcaccccgctctgtgcttcaatgcctctactgactagacttgcagttcagtagctatatttggatttcattcgatctatatcgatctcttccttctgtctcaatatattcattgcatatattgtatggatatgacttgttcagaaaatctattgaaaattcctagccgtcccccccaatgggtgtgaccaagggacgtcttggtacgcagagcgtttagcacacagtcctagagtagtaacttgatgtgaccgcggggtgtaatcatatcgcccgagcagttgacctcaatccaaatggtgtcgtgttacgcaaagcggcgtctgttgcctgactcattttcagacggcttgaattgcttattgaatacttgcgactattcggcgagcgtggtaggaagcggacggtcacttctagcctctataaatagccttcttgcaccgttgttctcttcactcatccttcgaccatctcttacttctcctttcatcctcttctccatccgacc

SEQ ID NO: 8014 - DNA, 657 bp, Zea mays
gctagtaatttatattacattcatacatattgcaacatatattataggatgaacttactaatttttccccaaattatacaatcaaccataaatatcaagaaatctaaacaaagaaaaaactatttcaaatatattatttgagaggttgtacttggtaaccttttttcacacttaaatgagtgctattcaacaaattctttgaaaaacattggacagcaccctcactcttttcagcttctggcaatataaacagagagctcatatgttttcttggcgccagctcaagaaaggaaagagcttataaaccaaaaacattagtacatgttggaagtttcaaccggtactaatgtcatgactttagtactgattggtgtcttcaatcgtattaaatctctgggcaattaaaagtggtactaaaaatgttgatggtgctttctttatttaatttcagtatcagttctcaggaaatcaatactgaaattaaaggatggaagccccgttctcctgttatcctgtagagtttgaaataaattatcgatacacgagttgctccagtttatatatttccaaaagaaaacaacattgttggtagaaactactctctgtttttcatgtatcttgcgacaaatttcaggtttctaatctgcgtcgcacaac

SEQ ID NO: 8015 - DNA, 257 bp, Zea mays
ggtggttactttgagccttgcaagcatcgcaacaaagaatacacatcggtctaatcaatgttttcttaagcatccagagaagttagctatgtttcgctctcgctgtactaaccaagggtgtgggccatccaagggttcagtgtcagttgctgctatctctagtagtgcttctcagtccacatgggttcttgattctggtgcctcatttcatgtaacttcagatcagtctccgttggatacatgtgcaccaatcacta

SEQ ID NO: 8016 - DNA, 888 bp, Zea mays
atcgatgcatgcatggtttcacattccattctccggcagcagggtaaatcggttgctgctagcttcattcatgcatgtgtgtggtgcttgattttcttttttggggtctttaattgtcgtccgtcgattattgtggtgcagtggagatgtgtctgtgctgttgctagcatccttttcaggatgaatctaaaagtaataataataattatatatgatgatcctgtaataattctggtgtcgatgatattcacagccaacgtataatttgcagtgcctgcctttcatttcatatactccaattcctttcgagttgagctgtccgttctgagcaccaacttccctccttttttttccaactttataatctgtttgggtgatccgcatgcatattcggatcagaccagtcactaataatctttaggccttgttcgtttgcgtcggattgcacccggaatcgttctagctaatcaaagtttatataaattagagaagcaatccggttaggaatcgttccgacccatcaattcgacacaaacgacaaggccttagctggaacgatttcgagtataatccgacacaaaggaagtgaaattcccaaatactccatatgccatgccaacgagaccaaaagtgaaaaattccccacccatgattgctatatatataaatagcctcctcacagtcctcccctcccgtagtcccgtctcctccacctttaactttccagttcaagtcaaaccacattcctggcggtcgcggaggctcacgccaagctcgctataaccgctcccctcctccctcactccctcgtctctccccccgaatcctcgtcctcctcgacacccaaagcccaaaccctagcacgggcagcggagctgcgtcgggcga

SEQ ID NO: 8017 - DNA, 294 bp, Zea mays
gtcggcctagctctgcagattaattccatttgaccgctccatgtatgttgcccaattcatttgaagttcatgctttgtgcttttggggttaacctttcaataccctttgcccatgtccttggaaggcattagtgcatgacacccatatgagggtcaacaagctgacaagacatgattttttcttgagtcggttgcctgtgatttaactttgccatttggttaatagaatactttaacgtgctattgctagtaggtatctaaagctctctccctcctctcttgtcatatactcac

SEQ ID NO: 8018 - DNA, 147 bp, Zea mays
agggctggaagccgctaggcgctagagtcagctcgttgaggcattcagtcaacacactgacttcgtccccgtcccgtcgtgcccgggcctctctctcacatccactgccccgacccgccgccgctcgattgcgacctgacggcggca

SEQ ID NO: 8019 - DNA, 90 bp, Zea mays
gagaaggaacggtcttcggagccgagcacgggagaggaaggagcatcgccacccgccggaggcatgagatgagaaaagagtcacaggatc

SEQ ID NO: 8020 - DNA, 700 bp, Zea mays
aatctgtggcggttcctgcttggctctggccagattagttttgtcaagggatctctgatactactagttgcttcggatttttgttggaactataggtgttgttggggcttttcccctaggcctagtcctctagtgcagtgcagatctgtctgtgtgaactgaagaaccatgttgctgcccaactttggtttccagtattcctaaacgtttccagcctttctgtgactaatgacgctaaacaccatttctatgtatgattcagattcttttgatatatagggcatatatacacgttcagagcatatcggactagctcagtaggattaggattggatggtcgatcatggcatgaatacacgtctttctgttgtccagtttggcaacgcaagcagaaatcagctatgtttaggcctttaggggccggggagcgagaggctaaaaccaagctaagagaccatggcggccggggaaccacgagacgcaaggaaaagccatggccaaagctgtggccgccatcgttcgtctcccctatataaaccgaacgacgtttggaagcggaagcggaaccatcagcctgtacattctctctctcctctctcggccttcttcgcgtgtttccctctttttcttaggccgccctctacacttctcgacataaccatcgagagggcggtcgagagaaacgagagcggcagacacc

SEQ ID NO: 8021 - DNA, 793 bp, Zea mays
cgaggaaccggagatagataaatatacagaaaaagcacaagggaaatatatgagaataattaggaataaaaagagccagagccatatacgtttttttaaaaaaaataaaaaaaaacatcacatggaatcaaaacaacagctgctgtactatgtacgttgtccacaaacgcagaatggcaagaaccgaaaaggcgactcggaacgaaccctaaaaaggacagtggcgccctggcgcgcgtatacacgcggaatgcaccacggcaagaaacaaaaaacggccccccccaccccaaccccaccccaccgatggcactggcagcacagcagcggcgtatagaggcctgaataaacggcaggaaatatgaaagcgtaataaaaggaaaacgaaaggaggccgaaaaataggttaccatctttgcactgcatgagctccctccaatccaatctcccgttcacttcaccttcctcttcccctctctctctcacctccctcctattattattgggttcttcaccgtaccccacacacacccttctcccccaaccccatctctctctctctgcctgcgttctcctggtgctgctctcgctctcctcccctgctttgacctccccgcctttccccgccgtttcttggatttctaggatccagacaaccgcccttgtgagcctgccttcctgcctactacctgcgtacgtacaggagggtccttgcttgggtgatccgggtgcctggtttctcggttccgcggcttccgctgctgttggattcgccgagccggagccgccggag

SEQ ID NO: 8022 - DNA, 1500 bp, Zea mays
aagacgtttggttcaccatcacacattatgcgagtggcaaatctggagcaaagcctgggagctgctgtgatcttattctacctatagttctacttttcaccttacatgtcaagttttgggtgccgcgaaaatgatctaaccctaggatggattaattacaatttcatctagattatacctgttattattgtcttgaggtagagcggaaggttgactggtggtggaggaggtagccgactgccttgcgctatcaaatacctcctcgtcggtattaattctatcaatcgaaaaactcacatcccatcagcacttaaatgaaatcaacaactcaaatgttcagtgaataattgaatactagtattatactatcaaaacttcaattaacagctcactgtcactgggcgtgggtgctcaagcgttggcaggcgggcggcgactggccgcttgggcgggcagagcggcctgcggcagtttagcgcctgctagcctagtggcctgggcgtttgtcatggccgatggccggctggacgagcgggactgctgcctgatagatctaggcgatggctagagcatagaggcgtggattaggcggagcagaggcggatcgggtcatcgggctagccgctggcgcgagtgcgaaggaggcggacgacgtaccatgaaggggtagagattaaattaggacgctttaattttgttcaacggtttagctttcaaaccgtcttagaagtgtctgtcgtgttttttcatgggcttaacttaaataggtgaggggataagggcattgtatggttgcattttcagacatgttagaccgtgggtggatcttgtaaaatataaggacgtgtaattgtatatgatattgtttgtataatgaaatttaaaataaagaacgggacagtggattagttggcggtagccagtacggccacgtagagccgtaaaaatacagttccgttctgtagtctgcgagcgagagagcagcattgcagcaggcggccacgctagaacgaaaccgacgccgagccggcgagggcgcgagccgttgcttcccgggtcacaacacttttgctcgctcgccttccctcccacttccacatggccgatctcctccacgcgcgcttcctctcgctccccttggccccgaaccctagccccgccctccccgcgagcggcgcgcggcgggtgcccccggtccccgtgcctcgccaagctcctcctcgccggagaccgagtggtgcccggtgcagccggagcagcgccccgtgaagtgtgaacgagtacgaggcgcttgcggcctccctgcccttctcctgggcggcggggggcctccgcgtctactgctcccgcctcgcgctcacgggcgccgccgtcgcgctcttcgtcgggctcccggtcgccgccttcgggggccgcggcggggccggcggcgacgctctgcacctcgcgctcggtgccacggggtccgggatcctcgccgtcacgctcgctgtcgtgcgg

SEQ ID NO: 8023 - DNA, 925 bp, Zea mays
tgttttgaaccagcgtttacggctaggactactggggtctttaatcccatttgctcccctagctttcgtctctcaatgtcagtgtcggcccagcaaaatgctttccccggtggtgtctttccgatctcaatgcatttcaccgctccaccagaaattccctctgcccctaccgtactccagtttatctgttatagtgcaacacaatgataaaatggttggtgagatatagttgcttaagatggcaacaggggcggcacacatatatgcttttgtggggaatggaggcttcaatacttagagataatcatactttagttcctgttgcatcatctgcaaacaaattcccgtgtttagaaaaggatagctaactagaaatttgagctaatttatctgcaaatagggtgttgttcatttcagtatgctagttaattaagatcacaccatccttttgtaccatattgtaatattgaagtaaataatcagcttggtcaaagatgctgacacatctcatttgaatgaacatgattatcaaccctagtagtagtaccctatgatgctgccgcacgatttgtaactgtttttttagcaagggcttgacatggtacaatttattataggtcagacttaaactcttgcttccagtttactctaaagtaaccaaatcaccatcactttctacatcagcaaatagaaaagcatggaatgcacaggacattttttttagtgaaattgcacggagctatacatacatgtgggcagacatccactgcagttgcaatggagctttcacaacccttttgtatgatgtttgtctgcggagtttggtggctcacagcatatataaaatgcaatagaagcgtactgatagccttgttaactcagtgcttaatctagcacaagttgccarctgatagtaaattgatca

SEQ ID NO: 8024 - DNA, 1500 bp, Zea mays
tgccacccgctccccaggtgcatgcacctccccctacctgtccacctcctccctcccctcccctcccctcccctcccggctcccgcacgctataaactgtagctgccgcggcgcctgcttctccccgatgcgtcaaacacttgacctgcacacggacagcggcggtggcgtcccgatcctgtccacccacccatctaatgcggccgcgaggaggatccacctgattctgctgctcctgctcctccttctagtgagttctattcccgtccccctccctacccgctgcgcgctgctaggatcttcgcctgcgaaaattttcggttcagtcgtcaggaggtgagcttccaggaggtcattgcttgttttgcctgctattgggtttccgtttagtgcattattgttactgctaccgcaaatccgttgccgtcgcttaaagagaacagtgttgccgtcgcgtgaagagaagcaacatgtgacagagtctgcaaacgaagttggtgtgtagtttgcacgattgtttactgtgttataatctggtgtgcttagttgcaagatgttctcgtgagagattcttcggaagtttagatgacacacacacacacacaaagtacactgtacacacccaaaaatatccgatcctgtttgcgtgtgtaaccgaccagtaggaaagcgatgggctatggcgctggacttcagagtagaaatgaatgcagaatgcccaatggctcggtggaaatggcatgcgaaagcagatcaaatcagtctgaaactctgaaaccatggctactgcctttaagtgaagaaacacttacctgataattggtttttttatatatatcaggataatggggcataagcttatgctgctgcttgtaacacctgaatattccatttttttttctcacatgtgcgttactcttaataaacctttgaattccaggcgtggacttcgtttatgctatacgcttgtctcttctcagtttctttgtcatttggttagtaacaaaccggtagcattgttatggcagtgagttactgagaagtaatagagttaccccctctatagccgggggcatgaatatcagcatgacaaaaggcaaatcaaatgctaggtgtcgtcccactcccattactgcttctctttatacttctagtcagcgtttgacatttttgctgacttgtccttgtcataacgatatccgaagatttgctgctacctttcttcaatcatatactgtcatcttcttttttttaaaagaaaggccatgccgttgtgttcatagagctgcgaaagcgccatatattatgtgggcatcatttgtaatgttttttttctgtcttattagagtagaatgttcaatgatcacgcaaattaatgtgcatagcttgagtggggcttgatacttttcaggtcgagagaccatgacacggaagtcagcagtagcggattatgtttagtggcacaaggatcattcgtgtagctgaaaggatttgccttca

SEQ ID NO: 8025 - DNA, 636 bp, Zea mays
gtcaccatcacttgtcgctgtcacggcaatttttctttgccgagcactaggggacacttggtaaagactttgccgagtgtccgacataatgctatcggtaaagaggtcgttgctgatgtacagttcactgagtcctttttactaagtgtcacactcgacaaagagtttgttgagtgttttttaggctttgccgagtgcttgcgacactcggcaaagcagtatgttttggtagtgaggtcgttgtcgataaacagttcaccgatccctatttgccgaatgctacactcgaagtgccgcaggcactcgggaaagaaccctgtttcggttgtgacttggtattgttaggctgtgtattgaatccaatgctatcacattagatataaactagataaccgcgtatacagtgttttattcgataaaactctaccctctcctatgaaactgtctctatatctttcctcttaattacagtcatgttccgcacatgatgctgtatcaccgcacatggagagagagaaaaatagattggtcaggctgtttgtatatgcaaggcctacgcttctatttaaagaccgtatcgtggttgcaggcagaagcacacaagctagcaattgaaaaaaaaaacaggcaaggaaa

SEQ ID NO: 8026 - DNA, 450 bp, Zea mays
ctttagcctcaagagttctcaattcttaagttgttaattatttttaaattatgataatttgatggtaaattcatcatttttgtaacttaaatcatttaaaatatatcacttgtacactagtgtgaactcaatgacggacaagtgatttcacagtgtggtttataagtaaaacgggctattgagagtacaaaacaactccaattttagggaccaaatagtgatatttagaatgttagcatatttagggatctcatttaataaatcgttggaatatgatttttggttgctaccattataaatttaatttatggtgttttttgaactagattcaatgaacttaattaaagcggagattcggagaaacaaaaccaaaagcaacgacaattacaaaagagagtaaaaataaagtaacctaaaactcggaggaaagcagaaggggaagagtcagca

SEQ ID NO: 8027 - DNA, 476 bp, Zea mays
taaaaccatttgtccgcaaataaaatttcaattctggaatacaatatttttattgcacgtatggttcaccatgtcactttcactgatgttgactcgcttctttctcctacgaccgcgccattgcagctattgccgcttccgggctgctcaaattaacaacctcccccagaatttcagctcccaatttgcatgtgtgatccgtgccgatctctccggattttatatctgtagcagcttgtgttttgcttctttcttcatgttctgaactttcctgaactccacagaacagatcagaaacacgcgcgcgcgaaaactgacagacaccaccaccgttcaaacccacttccatgagagcgacctccatggcctcaccacgatcgagctatatgcaattccatcactggagtcaagccgttggcattcctcgtcgagtcactctctagctcactgtccacggctcctctctctctctctcc

SEQ ID NO: 8028 - DNA, 104 bp, Zea mays
gcggggaggaggaggaggaggaggtggccccgcacgcggccccgcccaggtcgttcccgccgccgctgccgtcgctggcgcggcgcagggtggagcccaccacc

SEQ ID NO: 8029 - DNA, 513 bp, Zea mays
ccatattccacacaacgccctagtgactagcgagagagatttgccgtgttcttttgagctcttgcgcttggattgctttcttctttcttgattctttcttgtgatcaaacactcacttgtaattgaggcaagaggcaccaattgtgtggtggcccttgcgggaagtttgattcccaagtaatttgagaagagaagctcactcggtccgagggaccgtttgagagagggtaagggttgaaagagacccggcctttgtggcctcctcaacggggagtaggtttgagagaaccgaacctcggtaaaacaaatccgcgtgtctcacttcattattcgcttgcgatttgttttgcgccctctctcgcggactctattatatttctaacgctaacccggcttgtagttgtgtttatatttgtaaatttcagtttcgccctattcaccccccccccctctaggcgactatcaattggtatcggagcccggtgcttcattagagcctaaccgctcgaagtg

SEQ ID NO: 8030 - DNA, 1500 bp, Zea mays
aagcgcgatctaggttttgtaggagctcattgttatctctgtgcacatcgtggacggtctggtgacttaacgcagacagtccgccgcctcacagagaggtttcccaagatcttgttccccgcgagcgagatctaaggatcataggtgtttggcccaaaaaacaccaacaacaaaaaaaagtttcgcattttaaagggacataaggcttgttatagagatcagctgaccgtgacatattttgaaaaacaaagagagaattttattgtacccttgctcctaatgatttcttcctttctttggcttagaccacggtggtcttctgtatatatggtagtacaaagcagtattttatactgtagattataatatttatatagtggagtttgaaatagaatatacgataataaatagaataaataaggtcatatttagaagcaacctagtttttaagaatctagttcctatctctggtttctataaactcgtttataatgtttgtaaccatcataattttcataaactagttttagctaggagatgctagcttcttgatgtttttaaaaaaactaataatttagtttctataaattggaatataaagtgatattgaaatataaagtgatatgtttagaaccagctaagttttaataaaccaggtttttaaaatctgagtgcttccaaacagatccctaagctactcgagacatcctgataaacccttcgatgtgtgatcacgcgcggtggacgcctcgcgccccagcagctctcctcatgctcccacaccggcgccacctctaggcctctgctcccgcgcgaaccacgccggcacgccgcggcggccatgaacttgtgcacgaccacatggtgctccgcgaggacgatgtgcacgaccatggtctatagtcggcagcgaagaacaatcatgtcaacacaattgaagaaatgcgttggcacttgttttcctttttcaaaagcctaaaatgcagtcacatgtttcgctagagaatgcattaacgtttaacagtttgtttgttattttcctcccttttttgtcatataccaacccaaagtgcgaaaggcggcgccaattccgtcagcgttcctcgtgtttcgactagacattgacaaagagcgcgctccacaacgctttctgacgtgtgttttcgacgccggcctaatcaataaagctcgctcgaccgacgacagagccgtccatcatggaaaagaccgacgactcgcgcatcaacttgagccttcacgacaccaaccacgccttcaccaacttgagccctcacgacaccaaccacgcccgctgccttcacaggcacagccgcacccgcacagcacaacatcctatttaaatcccttgttgccgctcgtttcagccagcaacacaagtaacagcagcccgatcttgcatcagctagctaactaagcaagtaagctaagctagccctaggcaacgagccgagccgtcaagctcatcgcagaccacgagcc

SEQ ID NO: 8031 - DNA, 164 bp, Zea mays
tggtcggctttgcgccactcacctcgtgtggctcgcagcagtaccgtgtgctcaccgtccctgagctaacctagcaaatgtgggatgccatggtcgctatctcacagcctatgccatattccgtggcaagatgagcactaaggaggttgatgagcaaatgatta

SEQ ID NO: 8032 - DNA, 1500 bp, Zea mays
tcatttaattggtataaaagtgtaaaatatgccaataaaattaaaatttgttattccaaaatgaatgaatactctatatgaatgtgggcaccaaaatttaaatgtaaataatgaagaaattaatctatatattgtaaagtggagagttttagttgaatgtttatgaaacttagttgaatattatatttttttaaaaaaatatgtataccaagtatatttgtattttggactccaaatatttattttacattaggtatatttgtatcttggactctaaaatcccaatattgtaatatatttacaaataatctttttaatattaattaatttatcattgtatatcactagtaatataatattactctaattatttatttatcatataatatttttacaaattttaaatggtgtgcataatttatctagcatattatgaaaaataaaaccatttgtaattagtaataaaaatatttttaatggtttcattgaatacttttttcttctcggatacgaataatatcgaatattccatgattttgtcgaatacaaataagaaatatattataaatcaaattacatttttagcaaatacgaatacggatacttcggaactcagacattcgaatccatccctaaaccctactcgaaaggacctttatgctcctccaccaacgaccctgcttaactcggaagtaattcatatgacatatcaccrtgggggtctagattctgaggatttctaggccccgtttgtttcagcattttcagcttctgactaccaaaaactgctacgactgtcaaactctcatcttttcaacacacttttataaaaatcaatttggtaaaaattgtccgtcactttctagattctaaactcaataaacatattcatcttccttcgtacgtaatcactatgatactcgggtatttcctacagccaattttcccatgaccagatttagattctctgaaaaaaaccggccaaaaaagctgaactaaacagtcccctaaatagcactgcactcagctacactttatggtcgtcttctttaaatataaaacgaacacatgctaatgggagtggatgtttgatttgcttgtcagtctcttgaaaaggaaatgactatccaaatcatggtctccgatcctcaatatagtaacgactaacgagagggggtggggtggggccgtgggggttcgcatgcagagaaaaagggggcagctgccagcctcgcgaaaggaggagtggaggttgagatgaacgtctctcgccaaaactccatctaaaatagcagcgacgagacgagcgagaatatctgccaattcaaaaccaaaaaggagaggaggggagccccggacggagaagagaacagaagaaaccccgcggccaccccttcctgcctatatttctctctctgtcttgcgcgacagggagagaccagcgccaacacctccggtttcttgattgggtggtgatcggtgaaggaaggagaaattaag

SEQ ID NO: 8033 - DNA, 615 bp, Zea mays
tcttcggttggaaatatatcataaaaaggcagcctgtcgatcctttcttttttatatctaaagtcttaaaacttaacccggtttgagagactctccgcacttggcgggcactcggccgcatgcgtgccggcgcgtggccgcacgctctcgcggcacgacgcgtgtgcattgattcggacccaaaaacttactccatttcgcctctaaacggtcccatgccatccgcccttcccacgcctgatcgattggaccccaaaactcgtttcattttggctctgagcggtcctggcatcctgcacgccgtctctctcgttggctcgccccgctccgcgtgctccaccgcctcgccttctccccctctccctcgggagccgctgtgagcgacccttcctcgacgacgtctactccgacgatgccaccctcatgcatcgctcggatctctccgatcaggtcccttctcacaccatagaccctcaggccgcttctctcgtcaatacctcgacaacactcctcgccctcctcgcccttgcggtggccagtggactggcggccgacggcttggaccaccggtacaagatgtacaagcagacaagctcatcccgctgaacggcaaca

SEQ ID NO: 8034 - DNA, 103 bp, Zea mays
cccctgctcatgctcctcccagtcccctcctcctgcccccaatcctcttccgcccctccctcgggcctcttccccatctcctgatcacactcgctcgcgcgcc

SEQ ID NO: 8035 - DNA, 194 bp, Zea mays
agtgtgcccaggccgtcgccgccgaccagcaaaagggctggaaagcccccctcttttgtgctgtgcgtgcaactcggctcctgccctgccatcttgctttccaagacccctgcgcccccagtcccataattagttaggattaggatcaccaccatttccaaatccttgcagagctgccgaagcgcggatcacag

SEQ ID NO: 8036 - DNA, 1500 bp, Zea mays
aatacagagagtctccaaattggatattgaactgaatatagaggaattgaatatatatacatttgtctaagttttctcatcaacaggtgatacacaagggtttttcatcaacaagtggtcgccagaagaactgaaacatcaagatggcgtttgcttttaggtcatgccattcaggagatgatgctaagctaaataatcacatctatgtgtacactgagactgttttattatgagactatgttttattatgatgcactgagactatgtttgtgtacactgagactgttttattatgatgcactgagactgttttattaagcagtgtggagttctcggctgctgttctcatttttaatgcaagtgtgttcaatgagcagtgttcaatgacaaacagtgttctcagctgctgctcatttttatgcaaacatttgtgtcatagttctcaggttgacaaatatttttatgcaagtatgttcaatgagcagtgtggtgttcaatgagtagtgtgctgaaataacacacctgctgaaagagcggtgtggagtttcctgctggccgccaaagagcagcaggggaaggagccccgtccgggttgacctgcccagggaatctggataacagggattatggcccctaggtgctcactcccctgggttatcctccctagctgccaaaggagccctacgtgtcctctactgcgagatagtcacgtgggccaccaccactttcttcacgccttcttcactcgtttataaattagagtcaacggacattcctacggtttgccgtcgagtgttttgctagcgtttatttctccaccggtttccacgagtgaagaaattagaatcccctatctcctttgcattgcatcctactgcgtaccatttttccacggcgctccagtgtcctagtttggccggccggggccggggggggacgtgtcaacaaccacggtcgacagcagtcagcgggcgccgcgccagcagcagcgccgaacggtgagccgagccgatccgaacccacccgttggagcgcgagcgagagcgcccgcgggtcacggtcacccccggacccggtaccacgcgcggaacatccgacagattccttgtcgaaactgtacttgcattccattgaggcccgcctcagcggcagcgcccttcccagtctcagatccgcgtcgtcgcggcccctcccccctctcccgtgcgctgcgcccccaattcccgctccccacgcacccagacacgccgagcgggagaggaagcgacagccagcagccgaggcggccagcgccagcgcaggcatgaccactcccactcccagtggcgacggctcgcccccgggctcctccgacctcgtgcccccttcctaccccgaggcaagcctccctccctccgttccaaccctacctctttcgactcctctccgctactcctttccgccagatctgcgccgatctgcggaatcgactgacccgtgcgcctgccctggctgctgcag

SEQ ID NO: 8037 - DNA, 124 bp, Zea mays
ggtttctcaacctcaaggacttaaaatgacatctcaacaagggccaaccgcagcatgggattggcgttcattcagcatggaaaaacgccattgtcacatgggcaacaaagtcctttgttgaagg

SEQ ID NO: 8038 - DNA, 776 bp, Zea mays
gattaacaccctttaattaggttccattaactctcgtctagtcaccgactttaatccttcgacgcgaaaattacaataagaaaaaaagagaaataaagaacacgattwwtttttcctaataattataatttatatttcttatttaaaacttccttctccttaatatttttatttattgtacgaagaaaagaaggaataaatttaacataaaaccctaaacccgcaacatgactagagacaaaaagcttttacagttttactagaaaaaaacaggactagacacaaaagtgaaaaaatatcttaaaggcttttgcggattgaggaacggcccagggcggcccatcggcggcacttccgtctctagtcttccccgtttcaccccgtgtgcgctctccttttccttttccctctccctctcggcgacgactgggctagcgccgccgccctacgccaggtgccgaggtccccttagcgctcttcgctgggtctcagtagtgcccttcgctgttggcgagcaccctccaagtatgccagcccttctcttcctttcctgctgcgcggaaccgggcgcccaaaccctaacataagctgtctcgctatttgtcttcggatctgttctgattgcaagcttatgcatctataatgcttacgaacttggatcttttccctagctggctccgccacccctgaattttactggtttgcagggcatttgcattatggttgcagcgtaggtggggagccattagaaggaggggcaagaagagttgctgggc

SEQ ID NO: 8039 - DNA, 1500 bp, Zea mays
tactataagtaaagtttgaaatatataataagataggaggtatgatgtgtaatctgttggagacagtattaggccctgtttggaagcaacctagattttaagaatctactttctatctccactttctagaatccggtttgtaaaaaaactggttataccccatttggatgtagatgttggcgcatagaattgagaattggaatcaactttcctaaattctattgtttggctgcacatagaattaagatttggaatcagagagtcaattccgcggtattagactataactagaaactccctctccaatacatagcgtcacacctctgtattgtgtggaattgggacaattctaaacttcaatacattggcatccaacaacagaattgaaattgcatctcatttcaatactatgtctgatttggtattcaactcattttaattacatgccctctaatatcgacatcaaacagagcattaatattatttgaaaccacctcaatttttataatctgtttttaggtatgtgaggctagcttcttggttttcaaaaaactaagaatatagttttataaactagatcataaacttgtatatttgaaaccatcttaatttttataaaccagtttttttttaagtttgagtgcttccaaacatacacttaagcagatgctagctgttccgtttttccgttggccaaaagcaataggtgacgactgcgcctctactggaccgctcctccattatcccagtcgaccgttgggcttgccaacgttccaaatgtcacgtgatcttcttttccccctttcccatcccgcctcctcttctttcttctcgcctcgcgctcctcccttcctcgtaggttaccgttggtgcgagtgcaacgcaaccccaccccagctgctaaacccgagaccgaacctcgtatcgtccagcttaaccgcacccacctttcgcgactgggatttttctcgagatcgatcgatcgctttccatcagagagcagcatcaccttcttgccttgcccacgccccaggtaaagctcaatctcagctcgctggttttccaatcgcttcttggttctatcggtcgatccgattcttggggcttgtcctctcccgtgccttgccgcgtacggttcttcttgatgtcaacgattgcttcgtcctgagaactttcctcggctcgaattcatgcgatttcagttctctccgtgcaaaattggtcccgattttacagcataataccgtttagtttggctactgtttcatcttcttgttctttttttgggattcggtggcgagaagaaacccccgggttcgatttcgccaagaacagcgtttgcaagaggaattctttcttcgatcgcctgaactagatgtttactactaaattgtctctttggcgaatcgcctgggcttgaatatgctgtgactgactgcccctgaactaatcgcctgaactagttgtgactgcctgccggttgcgaatcgaagcgtaaac

SEQ ID NO: 8040 - DNA, 1227 bp, Zea mays
tgtcttagctgcacaccagcgccctcgaccatgcccaaagctctatattggatttgtcagcgtgctactcgtccgctggctactcatcatcgactctcggcaccacaagcttattttcccttgtgcacatctccccagaccttgtctcatcacgcgtatgtgttatcgatctcatcgttgtttcgtgcatcctcaagaaatacaaagcgtcgggtgaagacgaagctagcagcgtgatgttcaccaagtgcgcaacaaaaagctcgaacaagtcgtcaatcgtcatcctcgtctacgccaagcccccaagccgtgaagacactctggtgctggccacacatcactagctcgacaaaaaggaatcccatggatattcggtcaagaatggaaactatgtgactcgctcgctagacgtatataatcaacggcgtcaaccggaaccatcgtcgtgcttgcgactatcgtgtcgaattagtcagggtaagttgattcgtattcccgttaactaggtctatatataacttaaatagaattgttggtcacaataaatgttattaatttagcatgcgtatattgtgatgatcgatttagataaatatgtaaatcaagtaattaagatacatagtttaaagagttaataaaaagctaggaataaaaatagatattctagtgttattatgtcaatttgattaatgaatgtagtcgatgccctgctgtgatatccatgatgcttaatacttggttttaagtgtttcatcctttttagtgtagattatctatattatactcgttatacttgtgctcatacatgtgcatcatgcatctcatgaggtacgataaataatcacgtgatgcaaaagacaatccaagtcgaccccaagcgcgggctaatccacaggatgaagctgatggaccaacctgaagatggttaaattaagcaagtgctcggtcgagggatactcgtcaagcggacatcgtctaaccaacactaacgtagtgttattccaggcaagccccggtgcatttgccccttccttgtgttttaaatgctttttcaccttatctgatgcattaggtgataggagttgtgtgataaacaattgatgcattaccattccttggaaactccttaatcycggttttayaaaaagaactgataatgcttagccctgcttagaaactaaaaaatcatttgttttcaaaaagaatgattgtggaacattggtt

SEQ ID NO: 8041 - DNA, 1500 bp, Zea mays
aaaaaaaggctaagctgaattatcaattctacaatgtagctcattttttttaggaaacggaaaaaactcaaaaggacgtgagagagagacggcgcgaaaagggtcgtcgcggcggaagataaataagacgtgatccacactgcacagaaaacggacggtgtgtctcctgacatgtgggacgtcacggaccgtccgatgcgacgcgtaccggagagccgagccgagcgggcgtagcgcgtacgagacccgtcgccgtccggtcgctttcgcgcggcgaaaagagrgaggaagaacgggtcaagaggctataaacgagggtgggcccactcgatttagccaacaccaaaactaccgcggcccacgtcacgggggcctggagagttacgtgggcgcggtccatagaccaatctccctccccactccgaccccgcagcgcggaacgcggcgtggtccacgaggggccgcacccgcacggcatgatgggcttaatagaccgagtccacgccacgcggacgctcctcccactcctctcttgcccgcccgtccccggtccccgtcgtccctctccctagtccctcccctcgtccgtcgtccacctctgccactacgagctcgtccccgtcttgtttcgtctcctctcgtctcgtcacgcgagatatttctacgggacgggacccgcgttgcttccccgcctcgccgtcccgcgcgcgccagccgggcccggggaagccatgaactgcctccagaacctgctcaagtaagcgcccctccctccctccctcctcgttccgtttcggtccgtcctccggtaacgcgctcgcctgctccgcttggctcatggattttcctccagggagcctccaatcgtggggtccaggtcgatgaggcggccctctccgctgaatctggtgaggcttcggacccatccatccctgcgtttctgtggacattctgttctgttctgcgttcccccatctcaatctgacttggttatctgtgggcggttaggcgatggtccgcggcggcagtcgccgatcaaacaccgtcaaaactgtaagcattagccccccacctcgtcgtttccgatttcattccgacaacggaaatcttatcctcacactgaggataaggtgtcccgatagaggctggcaggctgcaatgggtgctgaatcgtcggttactgttgctgttactgtcagtgcggatgtcattccgttacctcgttgacgcccgctcggctgctgaaccaatgttgtgggttgccagttgcaggcccctggggcgtccacttccggtgccgagagcagcgccgtggagatgggcaccgtataagttttaagtgtacagcactaacatgacgcaggctatgggagcaggtaaacagaatgtttgcttctgtcctgtgtgcgctgcttgtagtgttaggccttgttagacgctgactgtcttatcgcattctgggcaaattggttgctgactggatggatttgtagccggaaa

SEQ ID NO: 8042 - DNA, 208 bp, Zea mays
agccatggttcatttaagctgctgctgtacctgggtatctgcgtcgtctggtgccctctggtgtacctctatatggatgtcgtcgtctaataaacatctgtggtttgtgtgtcatgaatcgtggttgtggcttcgttggtttaatggacctgttgtgtcctctgtgttgtacccaaaactcttctgcagcagtatggcttgaatcctt

SEQ ID NO: 8043 - DNA, 1134 bp, Zea mays
tctgcatatgaagacatcatggttggtttgtgaaagaaacgttgaaagtcctatgttttgtttttggtaattgagtggcaaccagtggactgatcgttgtcataagtgttgaattaggctacgtgatatccaccacaccaagggttcatcagagtgcccaataaaagcgtctagatccctactaggtgggttttagtgatcgaccaatatacaagattattgagacaaacgtttatctttatagaggtgttgtgagttaggtcataataatgatgattgcttgggcaatcaatgagtttcacgccccctatggatggattgtgtttcatttttcaaaggatgggcaactgattttaaatcttatgcaagtgaagacaaatattagaggaatcccactgttgattacttgtagggtcctcgcaagaagcaagctggccaagacggtttagcgaatggccttcaagtacatattgattaacaatgatcttgatcgcgccaaatgttgatggtattcttttgaagttatcggatgaggaccaagcgatagttttatattgattaacaagtgatgatgagcctgagacgagcctgtctcgcaacaactttaatgaactgaactggttcactatcaagcttgcatgcagtgcgccaaccgatcaaccatgacccatgggtctcaactactgcaacattgggccaactccagtagctcgagctcagtcccagtcgacagaccaggactggcagcttcagcgagccgccaaacccccacccactcccggccggaaccgaggtgcatggtgacctgccagcggcagcgccgatatgatcaaacctgccccaccggccggtcgcccgtccccctcgcggccaaccgcgccccgccgggcgccggccgatcccagccctgttccttactaaaccgacggttgccgcgcgcccactccacctcaaaccgtctgcttctgctcaggcacgtccgcgccccacgcccatcggctcccactctctcccaccaactttgaagcactcacttcactcgcgcttgcttcagcttcacccacgccaacgcaggcaagtacgcgaccattcccccctcgccaagcgcgcgggaagaaccaaccaaccagaacc

SEQ ID NO: 8044 - DNA, 91 bp, Zea mays
ggttcgtttttttatttgtcagtactgtttttgggtatgagtaaaatgtataatatttgcaatacagacagttggtcaagcatatgaagac

SEQ ID NO: 8045 - DNA, 1153 bp, Zea mays
aatggcaaacccaatccgattgtcgtcgaggattccttcacggtatgcgcggaggaactccctgatgacggcacggcggatcacctaaacgacgcgtcgaagagtaatcattggcattttacttacagtattatttcgatcctctgcccgttcttctgttcttcgtattcttcagttcctcgcgttcttccctccgtccaaaactcagtgattgagtgcttgcaggttcggcatcaacgatccacgatgaaaactgtgttagcggtgctgttgggcatgtgatggccggggggcgctccaagaacgatttctctgtggccttcgtcgatctgctgtctgcaactgtgcgtaaccgctcggtggacgctcggtggagagacagtgctgataacgtgttaaatgtaaatagttgtgtgaacagagaatgaaaaactcgtagtcgctttccattgatcttgtacatatttatacatagtgaaggggtgtctttgtaccccttcgtggattacagagagagaaagagraagagtcacaacttttcactaatagacatcttttctaacagacacctaatcacttgttatctctatttcccgaagtcctttgcttcatgtatgctggcgccgaatgattgtaccttttcctgaacgggtgtcttttcacaaggatgagatcaccattgaattaactcttaacagattattccccaatcaagataacttcctgtggtgaaagttaggaagcttcggtccccgcggtaggacgaaagagccacaggtagagtcgccatcaacaagccttctcgtatctggacccaattgcatttgcgcttcatccgcgcgaggcgcagcgcaggcagtggagctagagcatcaccatggtgacgtcgcgtcccagacgtcacctgcgtgtcgtcgtccactcgtccccgtccccgtccccacttgctaccctctccctctcgttccaggatggttcccccctcgccaagccagagccagagccaggctggcgcggcacatgcctacccgactagtaacaaaagcttaaatttcaccgggcccgcggcgtagaaaaccayggctggcgctcctccgtggacgccatctaccgtggacaagagcggggctgcccgtctgcagtgcatccataa

SEQ ID NO: 8046 - DNA, 643 bp, Zea mays
ggtatatagcactgagatgtgtaacctcggcacgagttatgacattgacttcctaggttcaaagattgaactagggtgcgtttggttctgtcgtctgctgagaaaagttgctttttaatgtatgttacgaaaaatatgttgtgagttgtcttctgtgaaaaaggtaaaagcaagtcgtctattataaacaattgtatattctttatatgctctttgtttaactatatcttttaatcaatatatctaattgattattttaattctattatatttttctatttgtcatatttcttcataaatatatcaagttaataaatcaattttacattctattttaacatttttatttaaaacattgttatttattataacatttaattatttttaattatattttagtttttatttattgcatctctttattagcatagcgaacgtggataactagcaaaagcaaagtacaagctgcttttaaatttgtactaaaaactatttttttcaaaccgacccatcatatcatcacctgagagatccgtcccaacaatacggaccaagcccaataaaccagggtttttgtaaggaaaatccccgtcgttctcgcgtctggagctcggcggcggagcagggcggcagggggagggcg

SEQ ID NO: 8047 - DNA, 810 bp, Zea mays
ctgggcgggggcaagggttgggaggtaggcggtcggggagggggcgctggggcggagtaggcccgagaggctggagccgttgaacccgacgatgaggaggccgtgaagacgagcacggcagcggcgtggtaggcgaagaggagagcgaaggcggctaggaacttggcggcgagcctccgccagacacagggcacaacgaagaggacgcgtgggaaggtgagagtgttgcgcttggtgtagacggaggcgacagcggggaggagcgatagcaggaggagggcggggaggtaggcgagaaggcagggggcggtgctaccggcggagcatgcgcacgggtatcgcacgagagtttgtcggcgggtatcacggggcagcgcgcagcggggagcagaggcggtttggcatcgcgggcgggggcacggacgcacggtgttgtggacgccctctttagattcttaagaagtagtatatagaaataaacaagcaaactgcctccgctctggcaagataaatacgcactccaaggccgcgcacacacgcagaccgaaacgcgagcaccatcaacaaagcaggcaggcaggcaggccgcactgccgcaggcagcagcagcgttcgttcacaatgacagctagtcttgcctgagctccaaagagcgcgagcgaggggctacagaagcgcattggcgccgcgcgcccgcagcgtggcctcccgccgccgatcgccggcgcccccgtcaccgcgttgtgttggcggaacagcttaagccagcttgctgcgccgtcaggaagccgaaacgcggcgtccccgcgg

SEQ ID NO: 8048 - DNA, 1500 bp, Zea mays
cgtatgtttattatatgtgactgttactgtctacaccatgatttcttcaaaaatattatgttcgaaactacaaataaacacagctattatataaatacggagggaagagtgcagtcttcatatctgacgtgtgatgtttaaatcgttttcgtgaattaaaatactacaacaatacatgcagtactcctttataggactgtttggttttcatgggattgttagaatctaagataaaaatatctcataataaaccaaacatggatgacaacagatcgaattctattgaatattgtaaatatcaacgcgcaactatatacatggttgtaatcaatatctgtccacaaccacactcacatgtagaaatttatatatttatactcgtacccatcaggttacagacgggttttagatatcaagtcaaatacgatagacacaatcattttgaacaaggctagaagggccagaggtactggagcttgggttggccagatgccaacggtgctcgacctataggacttgataggcgcatcgagtacagcgtaggaagcgagcaaggctagaatgaccgtcaactatagaaattaggagcgttagggtggggtttatgaagttaaggtttacactttactgtgtaaaatgggttaggcacaaaaaaatctatggatcaattttgaatatccaacggcaggtggaaggtaatatcgtaatccatatccatatgaggttgattcacaggtatatccatactcggctcccgcatgtgagatatcggaagtatatctgaatccgtggatcaaattgacatccttagaaccaaacacattggatattatgtgtaaggtagtgtccttgtatataaaatctgtgagataatatattggatcatgtgcaaaatcagatatttgcatcgttgggtagtgggaatgtgggggtgcacatagcaatttggtcttcggtctctagtagactagtactacagtacgtcttgcgaatccgcaggcagcgcagcccgccagaagccacaacgtgtcctgacccggtagcggccgcggaccacctcagtcctcagtccacctccgccaagcgcttgccgcgcgcagccgctcgttacactccacgtgtctcgcttgttcgtcgccaccccgaacctacacgtataggtggcctcatgtgtcagtgacgctcctcgcatgaactgcctaccctaggataaggccaccagagccagacggcgtcagttggccgctccctccggacacgtacacctccttcccgccagttaattcaaccacggttagatagaacagcccccagagtaaccacagttagatcacctgtttataaaccagcctcccctttgccccctcttccccgtccacgcctccacggccaagcgcctcgaaggcaattctgtttaatatccacaggccaacgaaatcgcaaagcgaagctacggccaccgaccgacgttccaagaagcgaaacgaaacgaaaatgatg

SEQ ID NO: 8049 - DNA, 867 bp, Zea mays
catgatatttgagtgtctgttacacaacattcttttttatgagaatgcttcataattgttgaaaaagaagatgctgcctactgaaaaatgtgttacaccttaaaattgataatcatgatagggtttctgaaggatgcctttgagacctctttgaacaagtagtttgatcactgttgtgttcgctatcatttttggttacttcttaattttacaatttgtggaagcatcctgcagggtttaggaaatagccgtgacctttattcagtcgtgaagattgttgtggagatgaaatcttcactaatttcaatcgacaggactgcatacactgctatggtagatgctttgctagcttgtgggtccatcgacggtaagttctataccatctttttagtcactacagtgaattttcctaaaaaacaatacaatgaatttgcaagttggaaaacaacgttggtgtttgactaagaactaacaagtggcctagcacccacttttcatcctcacatttgatttattttcaaactgacacttctcttttcactttacagtggttcagcatttagcgttccatttgacgctaacaagtgacatatcacattcttatctgtacccttttatgtcccagttgcccaagcagcatatccagtctaaagtatctaaaatggtgaaactgttcttcgtcagttgtgtttgcataattttttataattacatcaccgatgtgtataacctagttgtacttctcaaatcatcacatgcagtgactataagttacaccaaaatcattttctgaggtatagactatagatcacttgttagtatggttcatttaaccttactgttgtgcacaagcaaattgcttgacaa

SEQ ID NO: 8050 - DNA, 1110 bp, Zea mays
ggatggtctacacatagtcttaatagttagtagagattctctttttgttgctcacgtttctggaggctattcattttccttcgttcaccaccatacccaacctcttcttctcgatccttctacctctctcacattcggtgctcaggatgccagccctagggctcgccaacttcatctccctgctccagccgctccctccagactgctcaaccgcttgctggattgcgcaaaggtgtcaaaagagctgctgataaatacaagatgtcagctcaaaaggctaatgtctcacyagcccctaagcagtcctgtcccgcgcagcattcagcacctccttctccagttcaagttttagcttcagcagcaccagcgtcagcaacagcatcatcagcagcagtgcagcaccagcttctccagttcctgcacacacagcatcagattctccagaagcaccagtttctgtttgtccttctgttttttctctcccagcaccagcttgtactgctgtagttccagcaccaccacattctcctcctgctcctgttacctcagcaccagcttctcccctgcaccttctgcagcagctccagatactaaagatgaaccagtacgttttttatccgcaatgacaaaatattagtaacaataatattaacttggtaacaattgtatttttcactagttttgcttctctaaatataataatatgtcagtaattttggctcagttcattttggcagtagcaattaatatttttaatatttaatgtcaaacttcagtaacaatgtttttaaatcagtaaaagtttcccattttattagttttgtctattaatatctcagtaatatttttcatagttcactttgacagtaataattaatgttttttctagtgaggtgccatagtgtgacaaataaaagctagaaatcaacattcagtaattatccattaaactcattttgatacagtgtatttttcagtaattattgtttctttttatgttaacagttgcaagataaaacagttgaagaaagtacagatgttgtgactggaaacatatctggttttcctgccagccaatttgatcatagtgcatgggcatacaagggtgcc

SEQ ID NO: 8051 - DNA, 364 bp, Zea mays
gcgtcttagaggcaacgccgagctactgagaggcgtcatcggtgttttagaggcaacgccgagcgactgaacactgtatcggcgttttagaggcaacgccgagtgatagcgggcagcgcgaatcactttgaggatgatagccgagtgatgaggtggcgcgccggttttctggaaataactgccggatgaccacgtggtacgctgggtgctgactgggcactttttgaaacggtatctggctcgagaatatcccataagagctgcgcttttagccgcctttgctttccgtgccctagttcttgattttccgctcccgaatcctttctgccattcgccttccgctctgctcgctgttagaatcgag

SEQ ID NO: 8052 - DNA, 1254 bp, Zea mays
ggggggggacacgagtacaagtaaaaaatgagaaaaacatcacaaccaacttttagaagcaaaaatagcccaaaagcacaactaaacagagcctcaacatgtgatgctcaatgatcactgagtgtggtgtgtttgattcgtcaaacatatgtgctaagaaggatgacatatgcgctaatttttttactacttccatcgaccttgatcttcatttgggtagctttatcatttgaccagccaaaacaacagtcatcaatttggttaaaaaatatcgccagtgctaaattttggcttgactaatgcatggcatattttggtgaaggcgccttggcttctggacaaatttgtagctaggtagggtggatctctaccactatcaagtcagcagtatatggcgctctccaggtagataaagttggccatgggattgtgagacagtataattttcttttctttttaatttgcttgtgaaaaactagatacgaaacccaagattctggaaacaacttttctggagtcaatatcgagttcactaaaaaaacggggaccttattttcaaacttcactaccacgtgcaaagatggagttgaacaaaaaggatatggctggtcttagaatcttagtccccaaaaaaaacgagaaaggatagctgatactgttgtaatataacatctcgtgggattaattaatttgaaggcctatgtaaaatactagtgtcctagaccattaatcttgtattgctaacttaaagaaaagttattaatcaacttaaatagcatggtcgagtggtcatctattaattactgaaaataaaacagagatccgagtagacggctagagttgctctacttgagaccactatcttatcctctatctcatttttttattttaaattttattatacaaaaaatattattattacactgtaaaaaaaatcacgacaacctctccccatatcccactgcactctggacatgtcctcacgtgctcccgccacacatgtaggccccacagcgtgccgacctcgaataatatccagccgtcgatccattcacgtcgtctcgtctgggaccatcaagacgttatcgcagtcgcagcgagctgcgagcgcctcccgatctcccaccaccaccactgaacccgctgcttcccctcctccacacctctcggtttcgggaaacctctcccccgttcccctcgaagcctacgggctcggggggcttcgatcgaatcgaatcggatcggatcggaagc

SEQ ID NO: 8053 - DNA, 418 bp, Zea mays
tcggtctctgcycttcgcccatctgacctagttgcttagagccatacaaaaggagtttttgtccatcgtcactggttcttagggtttagaagctagaaagtgacatatttctactttcatgatgactcaccgattttttattcacattgattttatatagttatcattctcacaaaagctgacttaaaaactaggtatttggtagtaagaggctggcctgttggaaactaggtatttggtagtaagaggctggcctgttggagtcagccaaagtgctgctgcacttcaagagtcagccaaaagagctgcttcactctgggtgttgttctctagggttttctgtagccgacctaggccacgcaaagtccaaaacccagagccatcgctgccgcctcggtcgcgattcctaaaggcggcg

SEQ ID NO: 8054 - DNA, 271 bp, Zea mays
ttgatgtgctattcttgagcggagattagattatcggacgaagatttcctacctcctccccacaacccttttattcgttgtggatctgctgtttgttggtattgctctggatctccgttccgcagttttgtacagatgtgttttaggtggtaaggcttattataaattggtggcgccctggttgccgcggctgacttgatttatctggcctgcttccagacggtgcgagttgatgagtaaaatcctcatcttctagaacggtcgaagctca

SEQ ID NO: 8055 - DNA, 935 bp, Zea mays
cgtcatgatgacctttatgaatagaaaaaaaaaatgccgcaagggggcaatagaaaaacgagcaatctaaaacttttttttatcacattgtgggatacaacattcggcaaatatgaatgattgtcagaaatttctataagttcagtagttcaaacaagcggattccatacatcagtctcatcttcttcttccgtataaatcccaacatatctgggctcgcccacatagcggttgaggtctcgtgttcaccggaatggcctctctccgtgggctcctttgggaacaaggagagacaaaccccaaacccaagaagacaaacccatagaggaaaaacacatataaataactaaatatcttatttaaatggcatcttaagattaatactatctccaacaaaaactctaaaaccgagtcctaaaacttgaaataagaccgtgtttagaatgttgtttgattccaaacaccattagctaataaatagaaacttgactccatctatgcaatgccctatataaactctaaaatcgtgagaaactctaaaatttatgcaaggccctatttagaaccttcagagctaatatactagctactcaaaattagttgttggattccaaacaccccattagctaattgttagtgtggtcccaacagagcctaagactagctaaccatgtgcatggaaacgagcttgtgaaatgcccggaaacagagtttacttgcataataaacatagagctgacaatgcaacaccgtctcgtcgcgcccgatgcaatgcacctcggcggtcatcacgtggacatggctcctgtcctgcccccggccggcagatcgaccgcaggcgtacgtgtcagctcgtcctgctgcctccatggtcatcccctgcctttgcttagtcactgttcttatccaagttttatgatacggaatacaaattt

SEQ ID NO: 8056 - DNA, 1500 bp, Zea mays
gtcagctcgctccgcgagcttcttcagccgctcgccgacggcgggtagcgatgcagttagagactgcgtgaacggctcaggtaggtgaccttcagggaccttcccaccaggatcttcgacctgctcctgtcgtcgctagcctcttgatgttgtccatctacaacacggtgccatcccaccgaagctcggcgactgcgccagcytcgccagcatctacctctactacgggcctacagccgccgtcgctcggcggcgcgctgcacggctgtagaaactgctactgtggcaaaacgcgctgacaggccgcatcccggagcccttcggcaacctcacgtcgctcgtatgaatccaacgattgttcgatcgggcggactcgtcgacgtacttgtcatcggccagggaaggcgctagctcacacgggagcaggcctaagctcacggcaatgagaggcggcacaagtagatatgccatcgggaagacgggggagagagagggcaagaattgggaattgggtggctcacgactcacgagtcatacggcttgtttggttaagcttttttctgatcagcttttctaaaaatctggctatagagagaatctggctatgagaagaatctgagtatcattacgattacgtgttgaggaaaataaagttgtttatagggctcaggatatagaaagtgacggattcatattattacaacgacttgaccgattatgtgtttatgttgattttggatagtttttgcgccaacgaattttatagaagttggctgaaaaactgagcgtttggcagcccgcaacagcttttggtggctagaagctgccagaagccgaaacaaacagtgccaaagttctccctcccaacaggtgcacctctacagaaattgtattttagaaataaggaataataaatcgattacagacagtgcgatggtgctacagccacacttatttgtgacatcaattttaaactctgcaagcgtgtttgaaaagctggagtacaccgtcctgtcgtagagttggggcaacaggtgtaaaaaaaaaaggactgattattattgctacaacggcaaaccttagcaacgaaggcgtagactgggcagggggtgccccgcgtgccgggacatccacgtctcgttgccacggccgcgacgcggttgcgcgaccttccccgaagcttccctcccgctcccggcaccgggggccacgtctacggcctccgtgccatgccaactgacgccgaacgcacccggcccagtcgagtcggcgctagtcacaatcaccactggcgggacgggaacgagacgcaccaccaactgaattgaaggaagcggtgataaaacctccccctcggcactcggcccacgcggcgcgcggcacctcaagctcctgcttttccattgctctgcgtctgcgtctgcgtctgcgtctgcactgcttcgcgtctccctccccccgcctcaagcccccgccccggcaaaaaagcaaaacacggcc

SEQ ID NO: 8057 - DNA, 1143 bp, Zea mays
gataaattttgttttaataaagcataaaatatatgttttatattgattaggcgtgtgtgaatgtggaggcaacaatctaggttcaaacactcacttatacataatttcaacttatttttacataaactcttctattataatagtaaagaatagattataggagtgcgggttgattctaaagaaatgtaggtttttttttgaaaaatattgatacgggatgacctttgaaactagtgctttaacatagtaaagaactcgattcgtggagaatccagatgtggcaaaatctaaatattgtgggtttacgtgtggagaaagatggtgagatttatagagtctaggatttaggaagttgatagattttgtgttcacattaatttagttattttaaaaaaaaacgattcttatagtarcgattgaaaaacaaagtgtttgaccaccaaaaacatattttgatacaaacaccccagtgtggcttgcaacttgcactctaaaaaagacgaaaaggcacaacgtttacctaaggctccatttaaatccttgcaattgaattacattttaataaccctaatttaagcatgaatcaattaaactaatatagttttatatagaatatatttgtaagccactattaattatatattggttatatgagagatgtatttatgtgctatatttatactataatgaagagataagtgtgtcataagttatagattagaaacatgaattagtgatacataaaatcaactttcacccttttgttctataaatttggaatagacttaaatctaaattttagaaagttgtgaaatgtaaaattccaaaccaaataactttctatactgagtaaatttcaaccttttcaaaataaagatatccaaacggctcctgatgcaaatgtcacctccccgattcgtcgatttctccctcccttcatccaatcgggatttctgcttcccgcgctctcctcgcctcctccttcctagaaaacccacaaaaatcatctcgccattcctctccttcgtagaaaactcacaaaaatccctccaggttccagggggcgaggggagagagagagagagagagagagagagagttgagtgcgagagaggcgagggggcggcggcggcggcggcgaca

SEQ ID NO: 8058 - DNA, 202 bp, Zea mays
ctgctcacgttgccgtccagcctgggcccgatggcgccgccgatgccgatgctgatgccgctgccgatgcagatgcccgtgcccggcgaccacgtgtaccacccggcgctcgggacgatggtcaagctcgagggcgccggcgcggacggcgggaggatcggcctcaacctcggccgcgcgcacctacttctcccccggggac

SEQ ID NO: 8059 - DNA, 932 bp, Zea mays
tggtcccccacttgtttagtccccacgcccgcccaacatttatgattataattttattaatgtctgttagtcacttcttctaaatagacggtgactaaaatttagcgagtaattttagttaagccttatggctcaaacagttatagatatagatggagagccatacgcgaggcatgcgagtggccgacaaggcgtcgaggctggcacaacagttgcatacgttatcgtaaatctttaattaaattagaaagggtcacctagaaggagcttggccaccaagtattggcgcctggtcggtcttgccgaattcaaaccccgtggccgtgattgcttcgcgaaacttctcttcgaccatcttcttttcccagaccgccctccgcctacagtccaccagccgctccacgccgttggatgccgtccaagggccccttcgcgccacgtgtagaatggtcgctgccgctttcctcgcgatctccaccgccctcctgacttgctttgcttgccctgggtccccgttccccgacgacgtgcccgacgccgcggcgcctccttgtccacgcgttcgtgcttcccaattcaagtactaccccatttctgcaccctcatgtgtggtgttagtgtcactgccggtgggcctgaatctgtgcctggcgccttgattcaccgttagcgaaggggtaggcggcgggatccctttccgtggggacaccctacttgcgcggacaaaacgagccacggtgttccaacggcgggcgcccgtgcaaacgtagttcgacggtcaggatcgcatccatcgccgtttataaaacgacttggctacgcttcacgcacacggcgtctttgggtgagcacaccgcgcagcaacgagaggggcaaacaagcttgctactgtgatttctcgtccgagcagcggcggaggagagagagagagc

SEQ ID NO: 8060 - DNA, 549 bp, Zea mays
cctgcaccgagagagggtaaataaggtttttgggaaytttacacgaccgatctctttcttctcaacgactaatagtggcggagctagccaactatggaaacctaggcacctcctccgcaccacagatggcgcctgcctccccctcttcttccttcctccatcccctcgcgtgccacttcctcccctcagcctcgccactcgaacacgatcgtagttcctctcctcatcgaacgaagaaaatagcacaggaggagcgcaaccatgtgagtgttgcggcatatggagaagagcacgagcaccatgttgagcttaagagtcttcgtggcacccttggcagtgggaacatatctagtgcacatagaacattggtgcacatggtgaacatattaaatcatcaccactcattttagatctaacgtctctagttgtttggtctattttactaaggacacccttcaacgtggtggtgtgtagtggtgggaggtgttatttataaattgaataatcaactagagacgttagatctaaaatgagtagtgatgatttaat

SEQ ID NO: 8061 - DNA, 1057 bp, Zea mays
cctcgtagaatcttcacacaaaaaatccatatacaagacacttgagcagtacaaagcttcattacttcacatttccttttcagcaaaaccaacagtagtcaaaagaggtatcaaactcaagataacaataccgtcaacgaaaccaggcacagaataaaaatagtatttaacatagattaaggcagcattaaacaaactctttcataagttcatagcaaggtatgaacatggacccactgtgcacgtccaattccacacaaaaaggagccacattctccataaccatccccatgacgtttgatcacaaaattcaacgactttgaagcaccaaaagctctacatttgcatctgatactaaactaagcatacacaaaagcacacctgtttgatagcgcagttctcagtttcccaaccaaccatcgacccagttgagctgttactatgtaggcagaattaacaagagcaagattgcgatcaaaaggcacaaccttcccttcatcaacccttgatcggtcagggcaaatcgtggagcactcccatctcgtcgacgcggaagcccaactcgctgaggtccaccgtctcgttgatggcgatgccgctgtcccattgctccccgagcacacccgcctcggcctcgacttcgagatcgatggcggctgcaacctcttcctcctccgcctcagcccgtgccctacccttgaaacatacgcccatcttcctcctggaagtagggcctgcgatggatggcgtgtcggcggatgtggcgacggggtttgggrcgggggagggtgacggcggaggattgaaggggtggaatgtagtgaagggcacccaactctcggcggttacgggcgggcctagtggaaagaatgcccaggtgcagaagtacatgtcagagccagggacgataggcggcggcgcagggagctcagcggcgacgaaggcgcggcggcaggccgatgtcgggcagcggaggcggcgcccaaggtagagacgcgggaatgagtgcacgtagcagcagtgcgggcacgcggtccagaacgctacctcgccggtg

SEQ ID NO: 8062 - DNA, 717 bp, Zea mays
ctgcctgcatgctggtgagctggtaggggagttgcgatgtaccattattttttgccagacaaggaacaagatacttgctgtcttgttgctgtagagaggagatgcattcatatacatgtctgctatttttttttcacccgtgatgcatgcatataagaaattgaacactctgctggttggtacgccataataatagcagtacatcactagcatcctttagcacacctgtttgttcatggccctagttcggctaattcgggatttctcggaatttcggatataatttttgaacgggtacatttcggatcctgatttctattacctgaatttctaattatcggacccgaaaaatttggataaccccaggcctagtccaacttcttcattttgtactaatttgatctgatacaagaaaaaacagtgaaaatgaattatgataatatggttaaaaaatatggatgataagttatagacgatgaaatttatagaatcctgctgtagatattgaagatatagaggatattgtaagtgtaaaggacggtaaatattgatttagagaatgaaatttaagggacgcgcgcgttgctagaaacagctaccggataatcaacccattcaaatgacaagagtacaaaactattcgtcgacggcatcttggctgcttacaaatacactagcccctgtctaaccttgctacactgcacacctgacaacttc

SEQ ID NO: 8063 - DNA, 59 bp, Zea mays
tctcgtagcttcctttcctcttcgcttcacttgcgccgccgccggtgggtcgatggaga

SEQ ID NO: 8064 - DNA, 1500 bp, Zea mays
ccatccatacagaaaaagtttcagagcaggccggtggtggccgccagtcgccagcgtctcgggcccacgccacgttgacgcccgccatctccgggcaccgcaccgctccacagacgctcccctaccccgaatccactcggtccgatcgggatccgacgctccgcgaagggaggatcccgaatccctcggcgcaacgtgctgggtggtccgctttgctttgcggcccgtgggagtaggtgggggcccactccggtcaggtcgggcgcatctgtcccgttccggtccggatcgcaccctcgcctcgcctgcctgacttcagtactggctggctcactggctccgccggatcttctactccagcctgcccgctcctcctcctcctcctcctcggtatccatccgctcccgccttctcattccaaagctcgccccgcgtcgccgcccctccgcggatcctccctccccttccctcgtgtgctccggcggcattctccttcccgctggtaaggaaacgcacgcctcgttctctctgatgggttccacatttccgcttgttccgatgcaacctcgtccgtatccaccactgccctccgcgccgccaccgggagaagctaagctgctcgcattctcagtcctcacggggtttcaggtgccaacttcctgtatctaccaagtaccaacgcggcttatgcggaaggaaaatggccggaaacggtgggtgccgtacggctgtacctcatcgtccggtgttggttgcctctgagctgaggtaccacttcgaggtcaagtttcgtgtgaagtgaagctgtggatcgactaggtgccggcggcggtgccgccactcgagtactacatatttgctaggccaatgcgtttcagcatggcctttttgcctcccctaagaactgcattgttctttttttaaattttttttacacttcgttcgggaattccaacgcgtgcctgttcgctgctgtatgtatgccaaaatttcgctttcgaccatcctagtagttcgtccggtagtcccttttctggttgattaacactgcagggccgtacatggaagtcctcccaactcggtggacaagcttgcactggctagtcctgctgtctaactgtcccgttgagtggagttcaaggcactcatgttagtagcgcggtcgggttctcctgaactagctattgcttccgctgtggatttggactcctgttcagtggactagtgctgggcagtactccattgtcatgtgattctttgcgcatcgcatctcataagggtcggcagtttttatctgctagcacaagcattcacctatgcgttgtaattgctcttctggcttccccgccttttgtcttctctcaggttctgcattgcagctttattttgctgttaattttagctatcccttgaatggcacttttagctgggtccaattgctattttttggtgcactaattctctcacttttgtgcagccagggtcgaggatttcttgtag

SEQ ID NO: 8065 - DNA, 692 bp, Zea mays
cttcactctttattttgggagctctacatgaaatgacatgatcatggatgcttatgtttatgcagtttgcaacaaaaatatttaaaagcattaccagactacacctacaaactatgactaccaggggactagaacacattagatttcatccataaacttacttcatcttttctaaagggattaatccatcctatttgtaactttacaatgctttctaagcaaaggatttccaaatagcccccaaattttaccaagtgcttaaatgaccaaaacaaggttattcaaacattgccatacttttttttggcactgcacttttatttctaaaatccaagcctattaattagacctaatagccagagcaatgaatcaggtcaccctaatccaaccgaactcaacaaacgtgaaacaacatggttctctagtccagaccttctgtagaatgcttggcgagtgctatgctgatttcaccttcatcaccacaaaggatcttcaatcacgtatctagggcctcgaccagaacatagacatgacgagaacactaggtcaaaccacagatcgacacatcaattttcaactcatatcaacagattaagacgttctcacgttcaacaaaactggtgcttgcggccggtggcgacgaacagatcatcgacttcgaatggcatctcagcccaaacacatctgaaaac

SEQ ID NO: 8066 - DNA, 468 bp, Zea mays
tgcagaggaagaagcttccatgtaagttcctccttccaaatttccatcgtttttcctcacatcagcacttataaatacttgctgcatcagtcgcgcacaaaaaagctaggtgcttcggcttcctttcgcgcccaattggaggcgagacacaccccgaaataaaaaaaagatgagaattcgatgcgacaaacaagctcaaatgcttggtcggtgtccttttgaaggttcgagaccagccatgtcctcggcgccctgctggcctcctcgccgttgctggcgcgcgcctgggaccgctgcacagccgcctccgctgcagcgccgtggttcgttcacggcgaagacggcggcaaggtgtacgtggggttctctggggtgcaggctgcgcttacggcggcaggcgcggcggtggccggcggcggcgccgacatcttcgcgccggtgagtctcggcggggacgcggcggggcgg

SEQ ID NO: 8067 - DNA, 1155 bp, Zea mays
gactagaagccggcatgaccgatctattcatgaacgcaacgtgtgggccaccggtggggtgggtgtgtagtgcacgcgactggcgcacgagcctcgccatcggggtgattcgtacgacccgcggttagtaggacatcgatggctttttaagtaaaagtaatagattggatatattaagcaggtcaaatcatcaggatttaacatgctagtgtatacataaatcaatctacaatatgtatctgacagtaagaaatcactctacaatatgtatctgaccgcgagaaaacaatctagtttgaacaaaatctactaaacaattgtctagagcggtcaaaaacgacataccgtgcttctttattcagcgaacggaaacgaagcctatcatgtaagacaattaggcaaggcgggaggacttgctgtggtgcaatttccaaattcagaccttgaaccctctcctcagcaatggagggcttattctctttttgtcgaggcagaagcacaaaaaactatttccttgttatatagaagactagagcttctcgtttgatattagcccacataagattttttgatagtataaggccatctccaactgatcccctattgtatcctctattttattcctatattaaacgcaactctgtaaataatatcatctaaaattctgtgttacctattttattggataagtgagtctaatattttgatccaaacagcgcttaatctcttcccttgctgtaagttctcgacagatttagctgggttaaaattcagactcaaagacatataaattgatgggctggtgttatttccacgtgggggtggacccctcacgggccgggccgcattcttggccaaccatgggctatccgcaacattgcagactccggaatccggattggccgaatgggcccggcagccgaaaatgaaaaaggaaaggatcgaccctctagcgcgatcgatccccgtgcgctggggcccaaattaggagaacctcagtaccccacgtgatccacggtccgcccgccgcgcaagctgggccacgggctcgcgggcgggcatgcgccggttccgcgagcgaccaccccgccatccgcggagcctgccctgcgctgcccaccgctcctccgcctactccggcctcagctaataacg

SEQ ID NO: 8068 - DNA, 224 bp, Zea mays
tgcccgcaatggatgcaggatcgaacggttagaactgtttgatgagtttgaagagtggtatatgatgcaggtatgtgataccttgagaaacactgtactgctcattgtttgaggaatatttttttttcttgatttactaccatatataaagaagtcgatcagttaagtgtgtttctgttctgaaacctttgacttgtgctttcaggaacactactgtgtggcct

SEQ ID NO: 8069 - DNA, 273 bp, Zea mays
aacatggcacacgatcttcacgcgcaggaagtatccaccggaatcgggatgctcacaagttgcagattttaagagtcggcttgtggcgtctcgcagcacgatcaccattcaccgaacaggggcatcgaaggaccaccattttatctggacctttccctctgactgttttttttttctctcccgatgaaacagcataaggaatcccagctggatttttaaggctgggacaaggatggcctctgtttcaaccgccatccttgttgatattccgac

SEQ ID NO: 8070 - DNA, 1500 bp, Zea mays
gtgcttgtgcagcagcagtccaggcgtccagctacgaggtgccatggatggggacttggacgggtctgggtcaccgggacagttttctagagctgctgggtgagggacagacggcaaaaggccaaagggacggacgacgcagcatgatgattgattgaagggcgcggcgggcggtgtgactgtgatgaacaattgaacagctggtgaggtgatacagggggcggccccaaggttagggctgcaaatccgccggcagccgcgggggacgacgactgccgtgcaaaccagtgaaaccgctcacgctctgccggttttattaggagcactcggcggcggtgccggttctgctctgccttttttttccttttaattacttatatatattatactccagtactcagtagtcagtactcagtactgtataggtttggctaatgaccaggctttatgggttgggttccacgtgaacccctaagggcccgttcggttgtaccggaataagtcaggattcatttcagctcatcaaaatctatataaattagagaagtaatccggctaggaattaatctggggcttcaatctcaaacaatcgaatagggcctaagacgtccaatttcctgatcagagtatgtgtacatgtacattcaagaaggtgcagatgtcaggctactcactccatctgctaacacttgtattgaattgtaataatatgaaaacggtgttgattactcgtgtagtttcatcacccagaaaatacaaattttgatcggttacattccacggttccttatggtcccgcacagaagctggaagcaacaaaagtagcctacagtacagcactccctatatgttcagacttgggagcggttcacgattgggtgcgttttcagttttgggaggaacgagcagttcacgatttcatctctgaaactgaaacgataatgtgagctgatactgcaaacctactgagctcatctgaggcagggaaattgccaacagaatcatcaggaggagacagacgatttgctcggcatgcaccactgacggagcagcccctagtcctagtgcgcgcgcgcgccggcagcagcaacttccttgcgctcactgtcaccgtcgtcatcgtcgtcgatccaatcccagtagtggcgcttcacggtgatggcaccggcggcgtcgtcctcgccggcctcctcggtctcgaactcgccgtcctcgggcacgccgtccaccacctcggcgtcgaccgcgtggagcacgtagcgggcggggaggcccgggtaggacgcggactcccgctcctccacgcgcgcgccggccccgccgaggatccggacgcgggcgcgggcgccgagctcctcccggacggcgcgcgccgcggcggcctcgggggactcgccgggccgcatcttctcggacagcggccgcgggccgcgccgccggaccgtgccgtcggagagcagctgccgggtttccacgagccgcgcgccgcgccggttgcgg

SEQ ID NO: 8071 - DNA, 142 bp, Zea mays
cgacggcagcccccgccgcggcgccggcgccggcgcgaagaaggggtcggcggccgcgggtcccgtgcgcgactgtctggagaatctagcggacagcgtgggccacctccgcgacgcggcgcaggagataggcggcgccggg

SEQ ID NO: 8072 - DNA, 154 bp, Zea mays
gtaaataataggaaggggatagatttgcttcggcttgtatacatgatagctacgctgcaacatggctttgttctagttttgttgatgggatcgtccgatttttacttctttttaaattttcagctcacggctcacgcatttctttgaagcaaag

SEQ ID NO: 8073 - DNA, 1283 bp, Zea mays
ggccaccgagggcaacggttacgctcaccgcgtcggagagctcactctactatcccaacctcctctgcatcaacggaggagtggacaacgatcatgtgtgcaacgatgagccaaccctgctaggggaggagccccgcagcgcgaggcgcatcgccatcgcaaccatcgcggcaacatccgacgacaccacgccgtttggaagcaggattcgagacagtatagtatgtttatccggacgaggcgtctgatgaggacgacgaaactcccgaggaaaagagctccgcttacaaaggaacttgatccttggtggcattttgttattccatataaatgctgctaagtcattttttgtcctcaccggccgcttcagaaggtcatacggaacggacgtctgaaacttgccttgctgactgaccaagagacatcttgtatctggctgttgcgataggcgtacattgctgatgatgtcttgtgcttactatagttccatgtgtgcctgctacgacagccgcggcatgagagggataccatttgccaccacattctccacactagtttgttttaccatcatgccaaaagttagtgttgcgaccatctccaattgttgaggaactgacagcctgcctgatagatgggtagcagcgcgcggtacattatctcagtgtgggccttgtargtgtccttccaaagttgcaaggtttgcgtgttcccttacccacactgtccatgttgaatcagttgccgagtgtagtctgcgtattagcttcaccatcagatattcagataggtgttatgcggtcttagatccttcgtacacagccctccatcttcctttggtttcaaaaatacaaagacaaataatatattttttaaaaaatttacttatatcagtaggttataaaaatatgttacacgaaattacttgacgtacgaagaggagtataaaaagaaaaggctttggattggatggccagatgttgctatcttgtgctgggagcactgacgtcctccgctgtgcctgttgcgtgtcaggtccaactcccgaaagccacaagaagtccgcaaggcgacatcattttattttttattttattttatctgtttcgtgatgggctgatggcgggtcaaggttgaagccatcaaggcaacgtacgcctaggagtggagacgacgagagtggaggagggctgctgatgggcggaggagacgaccggagagcggcggcgctccagcgatcctcgtcgccatggagcgtgggcgagcggtggcgggcgcacgccggg

SEQ ID NO: 8074 - DNA, 1000 bp, Zea mays
agttcccataaagaacaaacaaatcacaccattcgagaaatggaaaaagaagaaatttaatatctcttatttgcacacttagggttgtttggctaaagtgaatgtgtcaattaacaagaagcacaaattagaaccgaaaactgtcgattgtgttttccttgggtatgcttttcacaacattggatataagttcttaattataaactctggagtaccggatatgttgaatggtattattatagagtcaatttcctatgaaagctacacatgatacgtctaatgacgaaccagcgataatcataagcattttatttcggtagaatatactgaggaatcacatatacatatttctatagaatatgacaatatatcaactcgaaatagtaatagactaagtattgcaaagtactttggtgataattaggcggacgacaccattgtccattggcgcgcgcggcaagcacccaagccggcatcagcgtccgtgccatcaatcaacctggacgccagcggcggcggcggttctctgcgtctcgggcagctgcgagctggcagagacatcctcgatttggcgagggccaggatgcggatgcgttccgtttggatttggtggcttccccggcctcgtcgcgccgtaatgattcgcagcgacaccacacgagtcaaccaaaaatagctagcgtggcctcgcgtcgcaccaaccgccaaaacggcggtgccgtccttaggtgcagcggctgcgcgcagccccggtccctcgtcctctcgtcgcaggtcgcagccccgtcccccggcccgcctcccctcgtgttggggctcctcctgttcttcaggcgagcaacggattcgattgcctgtggcgcgctcatgatcctgctttgagctgtttcttttcttttatttatccgaggatgatggctgttaaagatcaggagattattaataaacacacggacgattatctgaaacgtgcatgccatggctgctgcaggacgtggtc

SEQ ID NO: 8075 - DNA, 551 bp, Zea mays
ggcattcaattctagacacacccaaagagatcaaatcctctccaattccacacaaaccctaagtgactagtgagagtgatttgccgtgttcatttgagctcttgcgcttggatcgcattctttctttctcttttgctcttgtgatcaacactcaattgtaaccgaggcaagaggcaccgattgtgtggtggcccttgcggggaagttttgttcccggttgattgagaagaaggaaagctcactcggtccgagggaccgtttgagagagggaagggttgaaagagacccggcctttgtggcctcctcaacggggagtaggtttgcaagaaccgaacctcggtaaaacaaatccgcgtgtcactctccttatttgcttgcgatttgttttgcgccctctcttgcggactcatttattattactaacgctaaccccggcttgtagttgtgattatttttgtaaatttcagtttcgccctattcaccccccctctaggcgactatcaattggtatcagagcccggtgcttcattagagcctaaccgctcgaagtg

SEQ ID NO: 8076 - DNA, 775 bp, Zea mays
tcattgcggatgcaattgtgagggaaatctcagaatgttagatttatattctgtgaaaaacaaacttaattgctggaaatgtccagattgaagtagttgtttcatttgcaaaaaaaggtacagttgtttcatgattgggaggaacattactgtttgcagaacaaattatttattcataagcattggacttgtctcatctaggatgtttttaatgttcaaatgccttcaatgttgaaggagggaattgcgaagttgttttgtgatgatatatataatatattgggcagaaacgtggagctcagagcattggtgcctctttcctctttcaccaaggattccggtgccttatttcacaaggttagacaagtttcttctgttgtttcagttattctatgaccctgtttgcagtgtcccagcaccaagatttcttggagttgggtattactagctccataaatttctgaatgtggagctagggcttaggggtacacctgacttgctttctttctattctagacaaaaaaagtctcaagggtcttgattcttgtatgaactcaagatttatggtggatcttggagctggtatgtgacaaacagggtgtatttataattaacaatggtgtctttctagttaacaatggcatcggctgacctgtccttttctttcagtgggatgctaagcctggtctagctactagattatgaactctctgctgatctaatagcatttctacaagaattcttttgctggaaggtttattagttatttgcaaca

SEQ ID NO: 8077 - DNA, 828 bp, Zea mays
tccaggtcctgctcctgcctgcctttgcctttgcctttgtagcgagtatatcactagcaccacagagctctgggctctgcctcaaatccctggtcctgcaaccgaaaaaccggtgcgattccgagccgttttctccggagaaacgaaagcggccggagcccggagagacgagccgggccgagctgaattaaaaactcagataagttggtgaaggcgacgttgcgcgctctggtctcttcgctccgggagcaaaacgagtggccctgctgcgctcctcctgccgcccctccagacgcccggacccgtcccgccacctacacaatgacagcaggccccgcagagacgcggccccgcgagtaaggggagcactctggccgccgtcgacgtcgtcgtcgtccacctctccccgctcctccttaatgacgtgctaatcagcgagcttaacccactggctcgggcgagcgccagtgcctttgctagcgcacaggcacagcggcgcacggcgcgggcggggcggcattcgcgtgcgtctcgccgtctcgtcacatggtggtgagggtgggccggtggggcttgtacgctagccattaatacggcaggtcgcccatcccatcccatcgcggccgccgcgcccgccggtctccacccctccccccaccccctgcttaaaatcccgcgtcccggtcgcgcaccccactccgcctccgctccccgctcgccgccgcgattgctggattggctgccgccagcgccccggtgctagctcccgttcctcgcggtggtcactggactagcctggacgccgcggcccgccgcctggtcgaagag

SEQ ID NO: 8078 - DNA, 1356 bp, Zea mays
cgttccgctcgcgcccctgcatccagctgcacaccccgacagtcttcgccatccatgcatcgccggtcaactcgcgtgggcgtagggcctcctagggcgagacggtgccccgtgccgtgtccctctcgcggcaccgacgcgacgcgacgcgtactggtggctggcggcgttcacgcctccttccgccgcgctttatcctccatgtttcccggcccttgtgtcgtcgtgtgtccagtccacacgccggtttctgtttctcctcccccccgcgcgcacgcgaaacacgccagcagcctcgtctgccatccgcccgcgtatgctacatcagtcatcagacagacttgtgtctgtgagggacagagaaagtatcgcggtgcagccactagctatttccctcaaattttaatggatatacggttccgagtccgatccagtgtgccaatcaatccccaattccatcggtgccatctactagtacggatctaacgaacctgaaacgtgtgcaccctgcaccggcagctagcgtatgatctcgtctggtggtggggcgcacgacaacgacgaccgcctgccatgcccactgcactctggtgacgactggtcgggttgcgcggggcggacgacgcgggccgctggaggcttccgcggtccttcccaccaccacctcgcgagctgcgaaagcagagcaccaccaccagtccaccaccagccaccagccaccagccaggcctagagatagaaataataatttgccgtcgttctgccgcagaaacgagaattccttggtccctgaaaaggcatgtgtatgtatgctcttctcgatgcctcgttttcacctgccattttgtagctgctgaattgaaattcgctgaggtcgacgtgagcaagcgcacaagcggccgagggacctgtaaaccacgaaaaaatggcagaattaaaaaaaaaggctcctggtcctggtaaaatatctaaagccatcctctagctcagatcctcggaaaatgacagtgatatgctttccccactaaccaaaagctccaccacctccctccccaatattacctccatggctaaccaaatctccaatcaccgagcaccggttccgcgttcctgtgggtaggcagctcttagggtacctactagctgctgcccctgtcctgccagttcgcagattcactctcagcacgccgccaaacagcagcagctcctgtcctgtgctaagtaaccaaccatccaccatgactcccatggggccttgattcatgctgcctgcaactgcaaccctcgacgtctctgttccacttccagggacaggtccatgagctgcttctagagccactcccttccgccacgtcc

SEQ ID NO: 8079 - DNA, 482 bp, Zea mays
gtctgcgttgcatttaactatgtagtagctgtggttccgtagctgaagttctttggtatggcttgattgtgttctctgatgtggttctaggagaagttttggtaatatgctctcttttgcaataaatgatcgtaactttgtttgaagctaaggtcggaggatttttctattatctaaaaacaaatccaagcagcaccctggtccagcggaggcagacccacatccgtccggcctagtacggtcccctcccgaccgttgcgttcaagcgcgccaatccgaccgttagagcacagacacaccaaatcccctacgccgctcctcgtgtgccaaactgccaatctacctcagacaacaaagctcccaccatgctctgttccacctctgctcctcgtgttcgcaaaccctgctcgcattaaaccataatacgcgagccccacggcttctctcatgaccccgatctcctttcctgcccaccacaaccg

SEQ ID NO: 8080 - DNA, 80 bp, Zea mays
ggcatagtggacatgtttcttttctttttttaaaaaaaaaaattatatgttctatgtttgtttgaaataaagtactggtt

SEQ ID NO: 8081 - DNA, 1500 bp, Zea mays
tccatctatgatcacccctcccgaacatgcatcattgtaagtgcctagtctgtgccggttagcgctaagcctccagagtttggtaacattaaagtttaagttaacagattaaggcaggctgcatcattcaygcaaggtagcaatccgactttgcggtcgcaatttatagaatctatctgattttctagaagcaaggtagcaataagattttagttgcttctaaattccttttgtctgccaccgctaacaaccgtgcatcaacggttcagcaccaggcaccagccatgtgtaatgtgttcaacaatgtcagttacaatttattgttgtacttggttgcgccccccgcacgcatagaaaaccgactctaacattgcctcaaaattatgaaactgattgtgaatcatacaaatctaacatcaactaaaaaacatgaaactggttgtgaattatacaattgaaagtaacaatgcatttaacgaccagaatatgaaaggcttacccaaacactgaagactcaatctgcaaatgtaaataggtgataattttttcactacaatggattttgtaagagtatatattataacttcaagagtaattgttgtagaaggtatgcctctctcaataaaaaaataaaacatgtatcttgtttttcatgttctttggctaattgtagcgattcactcatgttctattgaacaccatgtagatgtccatgtatgtaaatacgtatttggaatgaatgtacacaaattaattcagaacagtaatgagtaaaggtactgttgggggccttcggcttacgaaggtcctcaaaaacaggatttaacagtattgctggagtataatgtgtgaacaggtatcttcggactcaagtcggtgtcacagcagaccagaataatacgaaggttgatacagcgccgaaggtgtgaaccgggaagcttcggcgtggtagcaacaaatgaaaccgacttaaagatgaaaaggctattcagacctcgatagattactatagaattattatcaaatgtaaagggcatggatgtaattttgtatgggctgtgtcccgtgcctataaataggtgaacagaacccccgtactggttcatgctgactggccattcgctttttgcgtcacgcttgtatttatcatctccttcccagttgaaggtacacttgtaattcaacgatatttctgtttatgcttaatgataatacataattgttcatattgtcatttatgttccttacatttcacccttcgtcattatataatgaatttgtgaaggtatacccttcataaccttcgtccgaaaaccattataaccctaagggaaataatgtttcgaaggacgaaggactttaacgattaacattttctatgttgccttgttcttaactcatagcatttgagaacaagtccccaacattggcgcccacctccggtgaactcacttccactctgagttttttgaacaccttcggcgatcataaaccttcgtt

SEQ ID NO: 8082 - DNA, 214 bp, Zea mays
ttgaccttctgtaatcattctgcccgagacgctctggctgctaaacgcatagcattcttttatttttaactcatactacaccgtgtacacaattttcacccctggatgatgagcagagtcgttcacccttttgtggtcatgtaaatcgggaggagttccagtacttaagtttactcttgattggtaatatctccactgtatttgatgtatcagt

SEQ ID NO: 8083 - DNA, 1500 bp, Zea mays
cgactcccaagggttatcctattcactctgcctgctgccaaggtgagtgcgctgtgcgggctacgctctcttaggttcggtttacttccctcctgagctccaccccgtgctccacctctcgagctccgtttccgttggtttcgcgtgggggaaagcgcgggtctacggttctagatagagtaaactttcattcttggcatgtcgcgttgcttttggcgattctggcggcggtgaaaaaagctttcttttttctggggactcgtgaatgaaggtgaaaaaacgctaatctattgtccgtcccaccaaggcccgagctcaattcgaaaatccgtacttggcggacttgtccttcctcctttgcaggattggaattggattccactgtgctggcggctggcctcgtccgccatttctggaatcgtggacgcgtgactggaattggatccagctagcctctcgtggatttggtgggtgtgctgcgtgtgcgagagtgggatgcttggtgatgcgatagtactagctcgttgcgtgatccatggccaggatgccaaattcgaaactctgtttttttggcctttccggaaaatttttagatttcagtggcacggccggagaatccgggcgtgattcttgccttgctctgctccgtttgtgtaatctgttatttgcttctcctcgccccaattcttcccgtccctctacggtggatgtttcgaccagaatagaagtcgcttctgtcgggaggcttacaaaaagagcgtcttgacttcagtcagcctcttgcaaattgcaatcgcagctactctgcgaggttttgccacgcttttgagattgtgctctgcttgtaagttgtctctttttttgagttttggtggtgtggccttcagcacgtgtttgccaattttgctctcatcttgatctgttcaaacgctcggcacgttccggaaactcactatgccaagtttgctgtcctatgctccattgggtgcgtccagaggtgttcctcttgtttgtttcgtcaagaccagagattgtcggtgttgttttttcgtctgttacgtgctctcctctttttaactcttttggattcatttgtcttagatgaaattcatcttgatccagtcatatttttgcattttttgctctatacaatagctttgatctctctcgggttgacctcctttgctgttcagtcatgaatccgttggttggtttctcgcagtaaaattccttgtaataatccatgtgcgctttatttgactgctgccgtgcaatttgggctccatacgtttaccatccaactgctgccgtgcagcagttatttcttgtactgtaggttttgactgttaatgtaattggacggattaagattcaggagatgtttgccctatttgtctcaccgtcgtaacagatagcagacgtctcatttgtccaatgcttgggttcttttgcctattcatcaggccaactaggatatcaactaggaggagttgaggagga

SEQ ID NO: 8084 - DNA, 194 bp, Zea mays
tgctccccgaccgccgcggtgggaccccggcgaggctagccgagcgaaccacggacccgaatctgaatctgccccgcccgccgatctgcggggacgagtcggcgcgggagggtcctcgccgcctggggaccgaacttggattgggatttggggtagggatggaccgatggaggcgcggttgctagggttttgag

SEQ ID NO: 8085 - DNA, 212 bp, Zea mays
ggtagcacatgtgtgcactactgcactcacatgcgcaacacagcatggctaatcaagccgctttcggcgcatagaagcatatggctaccctttgaccggcttatcttctacgtagcacgatctactctaactattggtctcggatggcagaaaccagaaagagcaaaccagagagcataggccatagcaagcggacgagccagccactatcc

SEQ ID NO: 8086 - DNA, 525 bp, Zea mays
ctgcagtctggtgtagaaatttctgtaacttccataagctcaactcagcctttatcactcttgtgcctaaaaaggaaggtgctgatcttgtaaaagactgtagacctatcagtttggtgcatagttttgctaaaaaaatttactaagctgttggcaaatcgtcttgctagtcgattgcatgacttggtctctctcaaccagagtgcctttattaagggccgttttatccaggataacttcatgttagtgcaacaaaccgctcgctttctccataagcgaaaggctgctagtctattgttcaagctagacatttctaaagcttttgatttggtctcttggccatttaattggaagtcctgagaaaccttggttttggatagatttggagggatatcatcagtgggctcctctcttcatcatctatgcggattgtgttaaatgggtcaccaggggacactattttctacagtagaggccttaggcaaggagaccccttatctcctatgctatttattcttgtaatcg

SEQ ID NO: 8087 - DNA, 1500 bp, Zea mays
tgcctcgccatctctgtaaaagcacgctataaatacgatcatttgaactagttacaacttaacatatttttactatatacttatgtagactatatttagatatatagtaaaataatatacatagaaaagctaagatgtcttataatctagaacgaatggagaaatttttatcatatatttagtattttatataaatttggtcaatttgaaattttaaagtgatagttagatatattttatataaataaagtatattgttattttaataaaatccagaacgatacaaacgaatagaccgcgaccggtgccgagatgttttgttaaaaaataaatgaaaatgaattcatgtatttaaaagaaagacccctacgggtcatagacattcatgcccacaaattccttccaaacagaaacagcaccagactcctttccttttcctctcgctccctcgctctttctcccgcaactcggcgtcggcgaccgctgccgctgccctactacgccaggtgcactgctgctggtctagtagcctcgtcggtcccttcgacaggttttcttcgggtcttcgccggcgacgagcacccgccaggtatgcgaccttatcttcccttcctgctgtgcgaaaccgagcatcagaactctatggagtaataagctggggccgccgccgccgccggccgccgccgctatcaggttgcagaatcactcgtcagaatccgctgggttgtcagaatttgatcaacatactgctctttccaatactattttcgctccacatatgacggagtagttcaggatccgccgagaatttccctcgaatataacaggatgtgcacctgtacaacgaagaattcacctgctaatctactatgtaggtcgaaaaggggggaaaaggtaagcggtgtttaacgttcatgccgacgcaatagctttacttgattgcgaggcaagagtagggttagaagtttggagtatgactgtgacgcacgcgtttcactgtcttcgatttccaagagacgtctctggttccgcatctgtcacgtcatgccattatgttgcgaatagtatttcgatccagaaaggatgtactgtacgtaggtttaggggaacaaaaagagaagattagtcatcgtgaagttagagttttgagtgctgctatacgtagtagaactttatttgtacagccatgtgagattgaattgaagatcaaatgttgatcctctttttagttagaggatacggatgctcctctatactgtcacattgtctaccgttcaaaattgttaggcattccaaatccgaaaatacaaaaccacaatatctgggatcttttcgttcacatgattcggtaatcgacacgtgtctctctcacgtacgcatcctctgatgaaaaagtacaatattgtgcgcgaacagctcctacttgattatgctcgaaacctaatattttaattccttgaacaacttgtttgctgaattgctttccctagttttcactcg

SEQ ID NO: 8088 - DNA, 1500 bp, Zea mays
gacactgtttgttgaatgaagtttgaaataggggatggataggagatgagataggggatctgcttcctatgagtataattttgatatcttaaattggtggcatgagcataaactaatctatccaattcttttaattatggctagagacattatgtatgttcctgccttaactactttgatgtctactttcaatttgtctggcaggattcttgaggatcggcgacgacgcttgaacgcagagaaagtggagatgttggtatgcatcaaactttgagagttatgccaacaacgggcacaacatgctgtggtggacaatgagttagaagagtccttcaaggagctcttgatggatgaagaaggattagaaggtgctgctgctgctgcctgagtttgtattgatcctgcgaggctatgactgtgaagtgtaaagtgtttatgaattctaatatgatctaacactttgacttgtagcaactttgaatatttgaattataaactgtgccggccatactcgtttttcctttctaggttttcccacgaggtgtaagttttatctagaaaggtttgtaatgagacgacactgcactaacagttcaaaatttctatatattttgttcaaactgtgtcgaatattgaaactgtgcatgtgaatttgagtttgatctttgttttctaggtaaactatgttgtaatgcaaaaatatgataggttttttctgttacctggttttagactggcccaacactcttttaggttagagctttttggtctaactcagcccaaaaaacggtccgaagggccatggcttggccccggcacgcagcaggcccgccctggttgtgtcgttccctacgactatgttcgtttgatcccaaaatcatagggattgagggagattaatcccctacaagtcaaaatcattcccaatccctttcaatctccctcaatctctatgggttggcacaaaacgaacatggcctaatggtgcccggtgctcttctataccgggaagtacatgaaaaatgagatggcctacattgcacacttgaggaaatgaggatcgtattgaagagaggaagcgtggttcctccttacccccaataccttgcatgttcatacaaatttgctgaaaactgtgctatatctgtacgtcgaacatcaatttcactcgcgaaacggctattctggacgctgggtgcaaatccaagagctggagttgttgagcaaactggccaagtcacgcagaagtaacgcaggacgctcacgaaccaaaccacgtcacgcgtcccacctggcctcctcccattggcccctgcgtcccaaacgcgccctccaccctccgatcacgtggcgtggacaaacggacggcgcagaacttccccgccacataggcacgcgcgccagcccgaaccgaaccaaaccagccctgaccatttcagttcggctgctgcaagaaccgaacagagcagctgcgacgagcccaaccagtgagggggagag

SEQ ID NO: 8089 - DNA, 1500 bp, Zea mays
gagggagagacaaaagacttgccgctccaatatattagaaggagtagaactaacagaaaattacaagaaaccaagacgacttacaagactagaagcgaactcctgaacaaatttactaagcggacctactagccagccgggccatggaaataaaaaaaaactaccaatgaaatgggagtgctgcagttgaagtttcttcaggaaaataaattatcataaggtgctcgtggttattggtccattattgacctgttaatattaacagtagacataagatcctaataaagcggatcttgctcctttaactgatagcatgccaactctagccatgagatttgcacatgaaaataatagtttttcagcattcggtaaggtgccattgtgccaacgcataagaaatttggaaggcaaggcatgtggacatcttggaattgcaggattcagattctaaatgcttaacgcaaagcaggcaggagaaacaaaccaacctgtcgtgaagtatcaagaacgctgaagtcaactcttccttccactagcaatctagcatatatcaaccagcctacccaacagctgttctagttctagttgcacatctttgttctccaatctcatgatctgaatcttacactaaactatgctcccgtgcagatggttttgctgccagttattgaatcatccaatgcaactcttctttattaccatactgtctttttgtgcaaaatggtttggagagggctataaatatccctttcatccttgttctaacaaatgtcttggactgaaggtaaacttctgtcggagtgaatgatctggaattggtgaggcattagtaatcaaatgtaaattcaggaaaatttagcttgtgagtccctttgcctccgagaaccactgtgaacaaaatagggaattgctcttttctgctgtctgcccttagaaaactgatatatctattctctcacgatgttttaatgtttaagagacatgggcatctctggcaaagcgtgcgcatattatgagctagaacagatcctttgctgccgatacttgcaacatgacagtgcgacaataataagctaattattcagagctgcacctaatggtctagaatcagatgattaaacacgtcttgggagcctggatgtgagcgaagtcaaatagctgtccatgcttccaccggcaacttgcatgttaattaacggaaacggatcacatgatattagtgtgaatctgatgctaattcaatgccccttcacccgtgctgctcattttgccacccataatgcagacatgacagcagacagactcctaatcaagctcagctagtgatgccccttggctcttgccgtctgcttattcagctgtgcagttgcgtcaacctcttttccctatataaagagggcacccaaagctatgaagacaccatagcagttgcagcagcttgacttctcttccatctccagcgagaagaggttctgtagcttccgttccatcccaagcatt

SEQ ID NO: 8090 - DNA, 1500 bp, Zea mays
ccgttaattaacatgcaagttgccggtggaagcatggacagctatttgacttcgctcacatccaggctcccaagacgtgtttaatcatctgattctagaccattaggtgcagctctgaataattagcttattattgtcgcactgtcatgttgcaagtatcggcagcaaaggatctgttctagctcataatatgcgcacgctttgccagagatgcccatgtctcttaaacattaaaacatcgtgagagaatagatatatcagttttctaagggcagacagcagaaaagagcaattccctattttgttcacagtggttctcggaggcaaagggactcacaagctaaattttcctgaatttacatttgattactaatgcctcaccaattccagatcattcactccgacagaagtttaccttcagtccaagacatttgttagaacaaggatgaaagggatatttatagccctctccaaaccattttgcacaaaaagacagtatggtaataaagaagagttgcattggatgattcaataactggcagcaaaaccatctgcacgggagcatagtttagtgtaagattcagatcatgagattggagaacaaagatgtgcaactagaactagaacagctgttgggtaggctggttgatatatgctagattgctagtggaaggaagagttgacttcagcgttcttgatacttcacgacaggttggtttgtttctcctgcctgctttgcgttaagcatttagaatctgaatcctgcaattccaagatgtccacatgccttgccttccaaatttcttatgcgttggcacaatggcaccttaccgaatgctgaaaaactattattttcatgtgcaaatctcatggctagagttggcatgctatcagttaaaggagcaagatccgctttattaggatcttatgtctactgttaatattaacaggtcaataatggaccaataaccacgagcaccttatgataatttattttcctgaagaaacttcaactgcagcactcccatttcattggtagtttttttttatttccatggcccggctggctagtaggtccgcttagtaaatttgttcaggagttcgcttctagtcttgtaagtcgtcttggtttcttgtaattttctgttagttctactccttctaatatattggagcggcaagtcttttgtctctccctctcaaaaaaaaagtttttttttatttagctgtcctccatgttgaacgagacgaaagagggaaaaacgacatcaggaaaatagactaaaaaatttgacttccagttgagtatatttctgtacactctcatatatgtacatccaaattgtttcgatgatcagcagatcctctaaaacacggatgctaatcgcaggcattagagttgttgtatgatctatctacagagtgagagtgttcagaagagaaactctgctctggatcagtgtcctgaacaaagtggcaactccactctcaagatcaaca

SEQ ID NO: 8091 - DNA, 166 bp, Zea mays
ggtttgaggtacggcggtgcacggtccggcgacagcacgtctaggctaagggagggaggagcaggggacagccggtcccgcggtcaccatggcgcggtgcagggaggccgagtggaggacggcgttgcagccatggggatgacggtcgggcgaatcggcggcacgg

SEQ ID NO: 8092 - DNA, 664 bp, Zea mays
aaatagtagtaattcaacgaggaatggcccatcgggccagaaagcctaacaagcgctgcggtgggccagaatggattagcatttagcaagcagcccagacccagtacgtgtgcccggagagatagctggagctgcaaaggagtgaagagtaccactaaaataaagtaaagaggaagaggaagctcgaacgagcagaggagagctgagccgtctccacgactccacatcaatatagttaccctatatatacaattcaggattctgtgtctgagcaatataaggaggcactgttatatataagtatactcccatcttttgtcctgcgccaaactctcgtgaaggcttgtgtgcagctacaagagtagttgacactgataaatactgctacttaataacattgtcactggcctgtggatgctgatcaagatcaagtgtacatccagttctagcccaaaatatgagtggggccttgatagagggttactaataaatgggtctttgtaattacagtaaatgagttagaaggtccactaaaccaaaaaaaaaaagagtgggagcccgtaccccgctcaccctaacgttggtctgtccctgtgtacatctcagagtcaccagcttaaaaaactcttgattacccttcttgattctcgtcaccagtagctga

SEQ ID NO: 8093 - DNA, 313 bp, Zea mays
ggtgagaagcaacccggaatgctgatccaaaccgggggaccggcttctcggattcggcccattagttacgtccgttttaatctgtcgaggaggcccacaaagcccagaccaggcaggatcttcccgttcgcttccccatttcgccctccccctccattcaaatcccgctgcttccgccaccggctaccctcgcggcctcgcccgtggccacctcctttcctctttccatttccgttcctccgctcccgatccctaaaccctacctaccccaaacccgcggcggcggcggcgcgactgttgggtttccttggtc

SEQ ID NO: 8094 - DNA, 117 bp, Zea mays
ccttatttagggcttgttcgttttcctctcaatccatgtggattgggtgggattggatgagtttgaatcccaaacaagtcaaacttcttcttcattttttccaatcccatccaatcc

SEQ ID NO: 8095 - DNA, 305 bp, Zea mays
tctggattaccgttcatcagaatacttgcaggcagctattggctcttttggcagattgattttgtgggaagaggacagacgcaatgtttacaggactttgctcagggtgcgggtcacgtctctggaggaggtccctcagttcattgttttttcagaagctgatgactttattggtgactcgtggacggtgcagtgtgagatcatccactacacgacggttcacttatagcgacttacggttggttgctaaaacggccttcagcgacctacggttggtcgctaaaaacttttagcgacccataagg

SEQ ID NO: 8096 - DNA, 1134 bp, Zea mays
tgcagccctgtggcatgtggtgatgttattaactgccttgtttggcagcctgctgcctactacgctgagctctagcatttgttgtggcgcaaaacgtgtgatgcctgaattctgatgatcgcgtgtgtgtgtggaactgcgagtgcggcgtgccctagcgtatttacgttcggcctatatgcactgggacggcccctaggaagtgggggcccaggcaaggcaaggcgtggccctgttcggcggcggtgtattgcattcgttgccttgtcgtattagacccgttttgtaggcacaacggacagcgacctcgatcaaacgcccgtccacgtgtacatgtacatgtacacatgcctacctgtgccgattcacagctggtcgagtcagcggaggtggagccatggaggtcggaattgttcgcctgaatgcattgaccgtggtccacggcggaacagtcctactatatgctagtacagttttatgcctacaagtctaccgtgactgttacagatccaaacgctagcctaaccagcgaccgaatctttggagctacatgctgagaacgaagccacgcacgaaccatgccggatacagtcaaacgagccagacagagacccgaccgtcccgttccgtcggcacgccgactgccggactgatgactgcagtcggcatgtagcctaagttttaatctctgttattcccctctcaaattcaaatcaagttccagagatttttaccgtccatttaatttagcgctcattcgctgttgccactttgcaatttggccgtcagtttggatcgaggcttgttggttcattaccccactggcccactggctgacggctctggcgcggtagcctccgccctctcgccaaccttaaaagggaccggcccgggcgctttcaaattttataaccacacccccatcgcacttgccacccccgcgaccgtgatcgctcaggccgcgcccggtcgccagcctcggcgaaccacatgccaccggccgcctagcttgaccacacacgaccgagcgagtagctaccgatcgacgccgctccttctgcctctccccgtcgtcgtcgtcccatgcacctctgccacatattgtgagcgagcggcagcggtgtgtgccgaaca

SEQ ID NO: 8097 - DNA, 524 bp, Zea mays
cctgtaattctgttcgtgtgcgtgtaatttccgtgcaaatacacgcacgccgattttcgaaagcaaaaaaaaaaaaaggcgacggcaaggaatcccccgattaggaaagattctccgctccccgccttcaaatcccccaccggccaccacgacccgcctggattcgcctacgctctgtgctgccgaggtcgggattggtgctggaattcggtgcgccgagttgttccttgctcgattagacttccggttcggttcgcttcgttccaatcggggtttgctgcttccgccgccaccggtgcgctccgagctgctcaagctgggcgccggataccctctcgggctgcccgatctgattcagtccccaacaccacccccgctccgccgctgtggctgccgctcccctccccgctgactccggcgccatttcgacccgcgcggccggatccttggatggttccgatcgatccgggaccaagagacccaaggcttcgtcacctcacccgggccccggcgccggtggatcc

SEQ ID NO: 8098 - DNA, 150 bp, Zea mays
ggtgaggaacgggtattttaccaatggatgtcgacttgctgcctcaaataatccctggttataatataccatacagagttcttccgactagaatgtgttcgacccttaccaacgctgagctgactagccaaagttagtgaggaaccttcc

SEQ ID NO: 8099 - DNA, 54 bp, Zea mays
tggctgctgtcctccagccccatgctgtgacgcgccctgcaggtgttcgatgga

SEQ ID NO: 8100 - DNA, 219 bp, Zea mays
ctcactcctctccacgtggccacctgcctcttacccaacggctatttcaccatgtccccatccccagccgcagccggcctcccgcgtccccgcctgtcgctagttctctcgccttgaccgcagaaataaaacgaaaaaaaaacagcgcgccaccgccaccaaccaaacagaggaaaaggaggggaggaagaagcggaggagagagaaaccctaatcgag

SEQ ID NO: 8101 - DNA, 343 bp, Zea mays
ctgaaaaaacatgacggcttcaattacgttgcaagataaggtggaccttagattgaaggattgaaataaagaacgacgggtaaataaagatagtttctttcacaacctcctcaaacttttttttcaatataatgttgccatgcacgaaacatccattgcaagctaacccctccctataaatacaccccggtaccttcattctccgggacaggaccgcatgcatatatccctgcctgcaccacagaccacactactactgcactaggccggacatccaaactaacttgcaagctaagcgcgtgttccgtactacgaccgatagagctagagctgcagaccgcag

SEQ ID NO: 8102 - DNA, 739 bp, Zea mays
gtaacataattccagattttatttaaatcaaggaatattttgacgttctattcctatatgaaacaaaatacttagaatttaatattttgattaattcttattatacaaaaaggtccacatagactgaacaaaaagggcttcatttctattttcgaatttagaaaatcacaaatttgttttcttcttatgaacagacaaatacaataactcgaagcccgaccgttttcaccgcgaactttgcaccgcgcccgaccgttttcactcttagcccacactacgttcttaataggagtatagatttcaacactttcacttcacataacggctgtgtcctgtagctgctctcttttatggttgatggttacgacctgaacagatcgatcgtccttcctgtcgtttcgtttcctcgccggcagggcactgggtacgccgccgccgcctcaacgccaccacgctgccgccgcgccagttcgtcatcgcgagacacaagacacgtgcctcgcttccccccgggccggttggccgtgtccagccgtcgctgttctgttcctatttcttggcaactccgcccgtttcacctccggaggaccgacagcgacggcgccagtagatagatgcactactgacgccactggccacctcgagctcgagtgccaagggacgccacgagaccaaccgtgaggacaggacagcggtcgcctttgcccgcggatccgcggatttcgtcttcttgggtgcc

SEQ ID NO: 8103 - DNA, 462 bp, Zea mays
tctattttctcaacgaaattctatttttccaaaaaaattagtttatattttaaaaaaatagaaatcactttggaaaaaaatatagttctcaaacagattcccttatgccctcaacagattcccttttttcaacagttttttttgaggcagacaacatgcacccccccaccccgcacccaaccccacaaaaaaaaaggccgtgtaaaaaagggaaaaagaaaaaaccagagcaacgcagccgcaggctgggtgagcggcgcgggtcttcgtcggccggccccttcaccggtggcgagcatccaccagaccaccaggtacgcccccactcctttcgcttccctgtgcggaaccgaggcaccccaaatctaaatctacactttccgattcgcaaccgttacatgcatattatacccagtaattacaatttcacccctccaaacagtggatgcgcccctgcccccc

SEQ ID NO: 8104 - DNA, 885 bp, Zea mays
gacaggtttccaccggattgcgaagatgagcatgagtgccttcaaatgcaatgcaagcctttgctggagtacgctctagcttatttccaagaatatgggacaacttataatcttggttcttctcttcaaggcagaaggtgtatggtagaggactatatggcagcctaagtttggcctctttggcatagttggacgtccatgtgttttttgttttaaagaaaattggatgaaagttactcgaccccgtcaatttaacagtgacattgaatttgtcgaggctgttgagatgaagacatgccagattgagggtattttactaataaggagattttaggtgtgaatgacaaacgcttcagccgaatacttaaaagactggctaagaagaacaaagctaatttggtggaggtttcatccaacagtgatgaggaaagaacaccaactctggtagaagtagagtatgttgctgcatcaaagagttttttttttttgtggaaaacttcagcgtgtagttttattggtcagcaatgtttgtttggcagtagcatgcatgagtccgattctctgaccatctccatttaccggtgccctggttattatccccccatcacaagagtggccaacatgcagcccctgaaacctggcgaagtccaagggggagcgaggagacgaacgtgtggccacggtgaggtggggatccggtccttcaccccttcaacttgggattccctctctatttagccatccgtccggtgcacgatgctacaagctcctcgtcaccagtcagaaaacagtgggatcgagttgtttcactgcacgagcacatcctccggcgaccaccggcctccctctccgtcctctagcgaccgaccaacgcgccgagcgaag

SEQ ID NO: 8105 - DNA, 404 bp, Zea mays
aatttgatggacggcatgtgtcctcaatgatcgctcagtgagccataatgtcgtgaaagttctatgtgcttgtatgtttcgttttttttttataaatcatactataatgctatttctataggtggagggtgataaatatatcaatttatctttatagttaatattgttgtaaagattttgaacatgtttgaataactatcttatttaaattaaaccgtagcatgcatagtcacgtacctagtttataatttaagtgagtaactaggatagagaacaaatgttgcttgcaaatgttcgtgacttcgtgtggtccctaatgagggctggagcgaaaccgcccgctgtctcgcgtccgtcagacagaacgcacagacgcaggcgggcgacgcacggcagtgttgcca

SEQ ID NO: 8106 - DNA, 1500 bp, Zea mays
aacttgtgtcaatgttttagctcctttgtgctaaaaggatttaaaagaaataaggttgaagtactataataaactactatcaagtgatgagcaaatagacagtgtcaaatctagaagttcatttacataataatgcataagaattttgaaacagattggacatcctaagcgtcatataacacagttttttcatttttaggaagcgccaaatcagcaagcaagctttgtttttgggcacgaaaggcagcaagctaacattatagagtgattatattacattcattacatatttattcgggaacaaatagcatggttagaacatacgagttttttcatttcactttcaacaacacaaaacaatacaaacattggtcgaagagggctaggtcagttgtaagtgcttcttttttctctccaaaacacagctgaatatggatgcgtggaaaacattatattctaaggtggaccaaggacaaatttgagatcgttagtttttctcaaaaaatagagagaacaactctttcagaaccctttatcgaaagaggcatctttgtcgggctcctacttccataccaaatgcagcaccttttcccacccatggaatcgattcacttggattcacatttactacaactcttacaataactgaaaccgaggaaatgcaaaacgcatggtcgcgcggtggaggagacaaacaacagtacctcaatggtggcgagcggggccttgttgagccgtttgaggtggttacgcacctggtgccgtcgcatgtagctgccaacggcactgcctcagcgtcagtggctggcctccggtattccctgccgcctccgctccgtcgaagaagagcgctgccaccaggctagcagaacaaagcacgtccccgtcgctgccattgattcagtttcagtgccactccccatccgagcaaccgaaacgacgatggtcatacaaacgggttttcttttttccaatcgcgtcttctagaatgcttccgtcgtgtggagaagccaaaattcgtcctatcctgggacgatggctgttgaaggagcactggccgttaaaggagaatcgtgtgactgaggtgagaaaggatgacgtggacacacagaagttcagttttccgtccgtctttgatatatagaaattcttctaaacttactagctactatttacattctagatgttgtatatattatatgttttttgtacggtacacttgcattcgttcctatttcactctccctctcactggttttttcgaatattttgtacgtggttgcaaattaaattaagagcaactacctactaatctatagttattttggcagaattgaatgtagtagcctcrtagggccaacatgaccgaactcaaaatgtgcagcccacctccaatcccgtagaagatagtgctgccctgccgaatgccgcccacctccaatcccgtagaagacaaagagagagggagagaactggacggcggcggcggcggagacgacg

SEQ ID NO: 8107 - DNA, 1500 bp, Zea mays
tctaagtgtcatgagacgtgagggtctaagtgtcgtgagacgcgaggttctctggaggcttattcatgtacgctatgtcatgcaattcggtagacttagttaggagcaccctttataaatcatgttagtgtctaggctctctattaggtcttgtttgggtattgctatgccacatggattatatatgattagaaaaaagttagtagagatgttgagttgccatgaatttgaacctaccaaattccctccaatccacgtggatgcgagtaaaaccgaacgggcccttaggatgcgtttggttgcaatgataggacgagacgggatgagacgatccctcaaataaggttgtttggttcggggtcaagggttgggacaggactatcccagtgttgttcccagttattcctcaaaattagaggtacgagagagaacgacaggagacgtccctgttctggctgtctcacaaccaaatgcacataagggttcgaaagtaatgacctttctattgtgagctcgtatgtcaatttcttgtgtagatacttttagtgagaaggcaagtatgcccttcatcaggtactgattgagatgatgtagatagtgaaagatgatgtagatgtcttgcacattgagataaacgtttagtaaagattaacttgataagagatataaatattcggtttagggaggaaagaaatctgacagcgtgcacactattttttgagagaaagacgtgcacagctgagattgtttttagaattttctcaagctccagtctggaaaaacgtcaaggcttttttgaaacgtgatttattttctatatttatccggtgaaattaaactaattcttactcacttcatcctaacatattagtcattgtagctcttgtttttatatctatactcaaatagattattataaatctagacacatatacaaatatattaattattgtataatctattaaaaagataaaataaattttaatttgggacgggtagtattaaaaaaaatctgtagactcctatggagggrtagtattaaaaaaatctgcagactcctatgaagaccatgccttgatgatagatcctaagggtttgttcggttattttcaattcatatggattggagaggattgatacggattggaagagattttgacttaatagggattgaaacccctcaatccccctcaatccatatggattagggtagaatcgaacaagccctaaatgggctttggtgggctttaaagataccacgatatacaacttcgtcaagatggacaggctctgtcgccactgctacaccactacaccagtacaccctgcacgcgctgcgggcgtttccgccggctttgtgcctcctctgccctccccggccgctcgccctccgtccacgctcaagctcgccccgtcccggcgcctcgaactcgtcgtcctcgcttccgctgtcgccaccgcgaagcatgaggaggcgtcctgggatcactggcttgcaga

SEQ ID NO: 8108 - DNA, 376 bp, Zea mays
ctgccgaccctgtctatcgcggctccaagcggagcaccatcccacctcccccgtcaaacaccgctgcggtgcttgtgccgccgtcgggagcccgaatctgccccctcagacgtcgccgcctcgaaacgcgcaggccggcacggagggggcactggtggtccgacgtggttgcctagcgaacgacgatgaagaggatgaggtggtcgggtctatcaagaagaggcactgtgaagagccgccgctatcgccaatggatcaggtgccggttgcattcatcgaagatttggccctctcctccaccgtatcgctatcccatacccatcgtccctgcatatctaaatgatgcaacttcgatctatcgctgcccaacgagcga

SEQ ID NO: 8109 - DNA, 285 bp, Zea mays
ggtaaggaaaagagagagacagagaagaaaaaaaaaccgcctcctttttcagcggtcatctccatttccggacctttttaccggaaacttcttggaaacagagcggctgcaacctgaatttttgttcttcgctgaagctgaactgaacattgtttttgtgctctgctagccgaaaatcctacctttcgcgctcagactgaactagtcgctgttcattctgtatgctctgtgcaggagccctatctgattgccaagctggactctgcggagaaggcctggaaagaa

SEQ ID NO: 8110 - DNA, 229 bp, Zea mays
ggtaattacacagtgacatttggatatatttttttttttacaaatcgtgttcatgaattgtgcaaggtaaagctgtggtgtgatagatctggagataccagcatgtaagcaccaaatacgttttgatggagcgtagtttcagactactacaaaatagacgcaacgggcattccttaatcaaatcatcagtctccttggatcgtgttccattttgccagtgccagtttct

SEQ ID NO: 8111 - DNA, 255 bp, Zea mays
cctgaacatgtgaaaagtatatcatcttttcaggaatgccaatcaactgaaaaacttaatgcattctttgctgcgaaagatcttgtgaggtctcaatgatagattgtatttaattaagcaggaagataaaggcgacttgatgaactatttgctattttttcatttcccatcgtttgtgttttcaatgttttgcttcattagttggttttttggtgtttgttttcagtatggccgataaggcttttaactggggcc

SEQ ID NO: 8112 - DNA, 1500 bp, Zea mays
atcgtatgttaagagatacaaaaaagagaaaatttcgagatacaaaagtaaaaattatctctgaattttctctttttgtatctttgaatatgaatttgaaattaaaattttatacaacagtagagtggacaaagaagtacatttatatttttttaaaattattttatgacttttattagttggtttacacgaaaatttggtttgcacctgatatgttaccgatctttctttgttgacactccagtgtcattatttttaaaattattttctatcctaaaaacaactagaaactagtgcagtcgttatttttttctctatcagtctttggcttttgtagaaataagtaagacccaagtaaagttaccattctattctctaatctatcaccaatataagaaacatacaaaatatttacattgatttttttgttattcaatacattccaattaaaatcctgatttgattttctccataaacatttttagcctaaatgacacaaattcaaaattttgggacacattcttatgtttcacacaagggctatcaatattattacatgctaccatgtcacgaaaatatgtttctccttttatattattgcatatcgatattaaactatttcattcttctttgttcacagcatctaatatttttttgtactctgtccggctaacaaacttgattttttaattttattaaaagtcaaactatcttagattcgaccgatctattgaaatgtttagtattatttatggcactaaataggtataccacgaaaatatgttgcgtgatcaatctagtgtacttatttaatactctatatgtcctaaattaaaatttattttaccttttaatagatttatgcaataattaatgtatgtgttccataattgtctaaatttatcatcatctgtttaaatatggatataaaaataaagagttacaacgactaatattttagaactgaggggcagtatacaattattattctaatatataaatttgtttaaactttagattgattgagttttagaaaaaaactaaaatgtctaggttattaggatagattaagtagttatttaattctcttattaaggtcaccgttttaggcagtgcataaatgcacaactgacttatttatatttatagtttttaaaaaaagagtggagtggtactgaaagcacatatccatttatgacaagatcctaaaagacgacacacccggtaaaacaactgcggcaaaactcaccaagcccccaaactgttaacaggtgataaagcttttctctctcttggccggccagtgacatcagacatcaccaactcgtcgacggtagagagagcaagctcttcggcgatttgagaagaatcgaggagcgagcgagcgagcgagcgagagaggaggaggaggagctggggcttgagcctgcgcccgggggccccgggtcacggaatcctaccattaccaaccctagccttcgttgatcgccgtctcaggtc

SEQ ID NO: 8113 - DNA, 476 bp, Zea mays
cgtgcactagggtgcgttgaacccctagtcaccgaccgccatactccgttgcagccgccggttcctttcctcgccagaacacctcgccgccgccaacccaaaaccgccgggaaagccgagccatctcccacagccggagccgcgccgacctacacccgtgacgtcagccaccgcgctactgccatcctccgcgaccacccctgttcggcggcgcgcccgctcctcccctccatccccggcctcgccagggactcccacaccgtggcgcgcatgctcaagacccacccgccgctccagaaggccttcatcttcttcctcctggcggtcaccgcgtcgcgcaccttccgccacgaccgcttcacctacacctccatgatccagctcggggaggccggccgcgtgccggccatgctcggcctcctcgccgagatgctccgcgccgtgtcgcgcccaacgccgccaccttcaccaccgtc

SEQ ID NO: 8114 - DNA, 517 bp, Zea mays
taagggacttaatagagtagattattttggcttaaaatttggtattttcatcactttctaaatttaaatttatagggtgagagatgtaaattgattttatgtataatcaaactgttttcactctacaatttataatatactcttcagctcactctactataatagaaatgtaccaaataaatatcttctccatatatccaagtatccaacaataatatacaaatgtattttatataaactgtattcatgtctaaattataattattagaatcaaactcaattcaaggatccaaactgggtctaaacataatcgcataatcgcgttcatcgttccaaacttctagaataggtttgaacttcgattattctaagttctaaatcagctggcaaatggtcataggaaggggaaagccacacgaaggacccttcagccgccacgcgacgcgaccaagtggacgaaccgcaacaggcaagtcttcgcttcgctcctctctgcggctccctccggcgagcggcg

SEQ ID NO: 8115 - DNA, 351 bp, Zea mays
atatctattttacatattaaatttatcgtttacgatccatttttagtggagaggacgactcacttgcagagatcgcattaatgaagcttcgaaacagctctgcatccgagttgacgcagaggccataaacttcaggacactaggagtaactaactaataacggagacattgttcggaaaataataatgaaggagacccggatctcgagagacaagagccctgcttattccaccgtctgggttagccacgtactggaggtcggccgagagagagacgacgacgaccaccactagcagcacgcagcagcggcagaaggaggcggctgctaggtgaagctccccagggaagagc

SEQ ID NO: 8116 - DNA, 821 bp, Zea mays
ctgaagagggtgagttggttttggggattatgatcacataagatccattgatgctttacatgtaaattaaaccctcataaaacttttcacatagttcatagtaatctggtgcaatcacaggccagcaatcatatgcaagttaagactatttcagatcttaaatgatgcacctttgtcgaaggaaaacaaaaggtgcaggttttaggttatagttacggacggactatagcaaaacagtctatgctccccatttcttcatgtataaatcaacgtacgctgataagccacatccaacatgttttcttgcgtacagagaagtacaacatctaggcatgatccgcatgacgcaaacgtgattaggcgagagattaatcaattagaagataacgtgacgatttttccaagttcggagcacgtggcaaatagttaagcagtgtaccaatcaattaaggtctttttcaacgcgaaaaatcgttcaccgattcccgtgaaatctctgtttttatctgcgtccggagcctgtgacatgaatttcacaccgctgcttcactgctgacatgaatttcacacaatgctttactgcttttctggtaggtttgaggtaaaaaaaatgcgagacgacaacgacgaaagcgagcaggcatggccgcgagcttatctctccacgtcactgccggctgcgggtccaagaagaagaagaggtacaagcaggcggggaagagcagagcagtgaccagtgagctgcttgtccaagaatcgctcccactcccggctgtcgggagagcgcagcccagctagccgcctccgcttcttggaggtcg

SEQ ID NO: 8117 - DNA, 707 bp, Zea mays
ccttcggcttgaaggagtgaaaatacaagtatggcgccaaaagcaaatgtcgagtcagcgtgaacagtacgggagtactgttcatctatttataggcgcgggtcgcagcccatgcaagattacattaatgccctttacatttatcaataattctatagtaattcttcgaggtctaatctggcttttcatctttaagtcggtttccctttccgccgttatgccgaagctcttctacgcatagcttcgtgatcgtcttatccttcgtcgtgattgccggctcagttaagcttcgccttaaccatgctttgtatactcgcaacttgacttcgaaggtacctgttcacatatttcttttggagaacatagtcaattacgtttttgaggaccttcggaagccgaaggcccccaacagtagcccctcgcaatattaatttgctgtaaagataaatttatattgcgaaatggacgaaggctatgagccgaaggtccgaaaaaacaccttccttttgctagaatagcaacagtcattgacaagcgggaccctccagtttctgacataatgggtgtataaataggggctcgccacaatttatttggcacgctctcttgccatctgttttgcctgctcaaatagctttctgcccacaaatatttggttgcctccctagttttaagcttcggaagcgagaggcattaattccgaaggg

SEQ ID NO: 8118 - DNA, 1500 bp, Zea mays
ttcgcagtccagctgatgctgcgctgatttcttctcctttttttttccccctgcattgcattgcttcctcgtttggttgcgcttcgttcggtcagccaaatgcaaggcatgccggtacggtggctgccagctttccgctagctcaggtttgctctgctctggacacatgtgtgtagttcgtattccatgtatttctattcaggttcaggttgaggttgaggttgagagaccctgacgtgttgtgttgcttctggaccaggatgcgtggtggttgccacccctatccatctccatctgcaacgacgcggtttctgtcgccgccgccgccgccgtctggacccgctggcatggcatggcatgtgagcaagggatcgagtcgaaaggagggcggcgcagggaggagtgggatgatggctcacgcaaccaaaaatgcatggcatggcatggcatggcagattgttagatgctgcctcctaagtgcttgacccgtaatcattcggtttggttggagacgtggaaggagaggccaggcatggtttcggcttggcgtggctcgtcaactccgcattcacggggccgttgggggtggtggatagcttaaaattgtggctcagcgagaaaagaaaaaaattcggtgatcagtaaaatagaggggattcaattctctggatattcaaaattgaatagaaaggcagcccggtttcacagtgcgttggagtacatgtgacgcgaacgtttcgaagagcgcgtcaatccatccgaatccgaaagcaggaagtaccattggacgcctgctcctcctgggcccacgcacgagccacggcgggccaaccaaaccaaaccaaaccaaccgtattttatccaaaccaacatcatcttcaggtggttacaccgttttacaaaaaaggtgatttcgttcgtacgtataaaataaataaataaagctggagacaatgacgcggcaacgacacaaggtagacacagacacgcccggccggatcatcgtaggcctgccctcgacgtccgccgaactaattttaatttgataatcatatatacgcttcaatcatcataactaacccacatgatcccccccccccccctactactcctactcccaccacctacaggctacagttgccgtccacatcgcccgccgcgattggccgtgacctccgtcaagacacagcatgagaaccagccaatcacaaaaaacacgccaaactttcggaacaagaaaaaaaggcgtaaaaaattcagatgaaaaatacaatttcgtagaaaaagtaaacagccacaccggtcaactttacaaatggcagccgaaaccaaagcgcgtctttgtgcgtgtatataaacaccgaactcgcagtgacgcatcagcaataagcgcaaacgcacacaagcggaggacaaacaaacagcaagagagcggaacgccgaaaggcaaaggcaaaggcaacggcaacgcaagccagaggcagagcgcgccccgccacg

SEQ ID NO: 8119 - DNA, 583 bp, Zea mays
tctatgacattagtgtgtgttgtgctctatgccatttgtttcaaaatatggcaactatgtgcaccatattttataacattatggtacctgtgtgaaaaccatggcctatgccatttacacaatgggataaccatcgcattataacatccatttcatttacacatttcgtttcggtgcggctgggctgcttctgcttgcaattaaattctgtgtaaagatcgtgacgagagagagatgacggttgggaaaaagaagaaaacgaatgctgaatggatcttggtcgtgatccatgacgagccgagcctttttcatgaatgggcccagtttggggggtaacaataaatggttggagtacagaattctgcttggatcttggatggaacttcaaaggcatccatggaggatgagaagatggaggatttgacattgacagagagggcaataaaggggagtgtcaatgttaagcatgctcctgctgacaatggtggtgtggaagaagaggaggtgaagaatttgagcaagggagaggaaactgaagtatatcaggaattgagggaaaaggtttcaccagggtcaaagcctg

SEQ ID NO: 8120 - DNA, 1500 bp, Zea mays
atgtgactttgaaaaatatttgagacactaaaggcctttaattcaaaaacttatcgaggtgagccactacaactaactctggtattcactatgtgagcattcaaagtcatctacaaattctaaatcgtgaattaaaaatttataagtttagaacatatattacaactctaaataacttcaagtaaaaagaacttttatactacaaagttgtacattgtattgagaactataacctgatatagatcatgctaacatgtgatgttgtttggatttttaaaattttataacccgtggaactaaaatgatattctgagactctaagtagtttaaataaaaaaaacctagcaactataaagttttagatatcatcggaagatataattttgatacaattttttatttgatttcatatgagaaaattataaattttttctgatacatctatttcaaaagaaagacatatatattgtgatgtctgcctcttttagttattttttttagatatatgcatatgattagaatacccgccttggttaataactcttttcaaagttgaacattttaagaatgctcacctctgaaaatcgatttatagagacggacgttctaattaagggtggtcgtctttgttaggccgttgccgttttagaacgtctctgtatgcgtaaataatgttcctcaaaagcggatatttgcttggaggctatctcaccatttacgaagatggtctctaaatgtgtccgtttttattgatcgatcagaagctaggttttcttgtctgctaaaataaattttttagtaatggtgcaaataatcaccttgatgttgattcgtatttgcttggcatcaagaacaggttatacacgtacgtacatataggaaagaagaagaagatgatgctggtaataatcaacaaagtgcgcgcacagatatcgatcatgatcacattataccaaaaccccacctgatgaaacgcatatcggcatatcgcatatgggcttacctcataacgcaagtcacttcatgcagggcctgtctgctgggctctcaccaaaacagtttaccggccgtttctgaccccccctccccccaaacccaaaaaaaatatagttcaccgatctcgatttgtactaagaagatcgcttgcttccgggctagctttcctcacgtcattttctcgcctttatatcacgttgttgggccccatgcatgcgccacgccatcctcaggctttagtttacggaagcccttataarctttgtgtgtgtctccctccgcaaaccatttgctagccactttctctcgaacgaacaaagcaggcggcgcggctggtctggtcgccgtgtctgtctgggggtgcaccatcatcggcggttcgatcgaccggtccgtctcttcgtccagccacaagaaccagggagcttcctctctgacagggcgcctctcctcgagagtcgagaagaaccacactctctcggtctcggtgctcggtagatgcgc

SEQ ID NO: 8121 - DNA, 191 bp, Zea mays
ggtagttgccaagtttgttgggggcaaacacaagggctccaagacttgtgtttgggtacccaaagttcttgtgtctaatgccaaaggacccaaaaccgtttgggtacctaaagtcaagaactaaaattgttttgtaggtttatgcatccgggggctcaagttggatactcgacagcgggtgcacaaaccac

SEQ ID NO: 8122 - DNA, 1042 bp, Zea mays
ttaacttgcacacatagctcatttatatacctttgatcatgtctctttcatatgctatgactaatgtgtttttcaagtctatttcaaaccaagtcataggtgtattgaaagggaattggagtcttcggcgaagacaaaggcttccactacgtaactcatccttcgccgtcgctccaagcaactctccgttctagggggagaaaacatgaacaccaagcaaaaggactccatctttggtataatctttactcatttgttttgaccaaagagggagaatgtaacttcaagggctctaatgattccgtttttggcgattcatgccaaagggggagagagtaagagcccaaagcaaaaggaccgcaccaccaccaaaattcaaaaacttaagtgttgaatattttcaattggtatccttttgtgttcaaaagggggagaaagtagtatttcaaaaatgatatatcaaaaccctcttgaattctaagaggaggatctcacttagggggagttttgtttagtcaaaggaaaagcatttgaaacagggggagaaaatttcaaatcttgaaaatgcttctcaaaatcttattcatttgcctttgactatttgcaaaagaactttgaaaaggatttacaaaagaatttgcaaaaacaaaacatgtggtgcaagcgtggtccaaaatgttataagtaagaaacaatccatgcatatcttgtaagtatttatattggctcaattccaagcaacctttacacttaaattatgcacttctatatttgctttggtttgtgttggcatcaatcaccaaaaagggggagattgaaagggaattaggcttacacctagtccctatttaattttggtggttgaattgcccaacacaaataattggactaactagtttgcccaagtgtatagattatacaggtgtaaaaggttcacactcagccaataaaaagatcaagttttggattcaacaaaggagcaaaggggcaaccgaaggcacccttggtctggcgcaccggactgtccggtgtgccaccggac

SEQ ID NO: 8123 - DNA, 796 bp, Zea mays
tcctcaaaagaggattatgttatttggaaccgaacctcggaacacaaatcgcctgtgtctttgtgctaattttgtattgcgatttgattcttcctctcccctctctctaagttctcttgcttgcaatcgttttgagtttagctccaaaagttatccgttatccattgattgagcaactcatggcgcaggaaggactctctttcacattccgatttcattattactcgttcttaacgttgaccccggataaagtttaagttcaaagtttataattcccatcgcacaagaccgtgaatttgagagctttctactatatggctcaagtcagaagccaaacagttaactgtatttggaatgagcgagttatgttcatatcacggttgaacccttttgatgtacggcgagaagctgggaaatcaactctgagtaaacatgggcacacttggggattttatcgtgttgcggcccacccgctcgaaggatgcacatgtgagtggcggccggccctcttgcaagcgccaagcttctttactcgggagccttttatgtcaaagttggcaaccttccccgagtggccgagttcctcactcagctggggacaccacccggccaccctcacctctcaatatacataccaccatccaccaccttcatcaacccctgggcctggcactcatagctcgttcgtagcaagctagagagagagagagagagaagagtgggaagtcgtctcacgccatcagggagaggggagcgaggatcacatctctcgtagcgcgcgcgaagctatataata

SEQ ID NO: 8124 - DNA, 204 bp, Zea mays
ttagggtagaaatttaaagttctggacagcctaatccttatttatatactactccgtagtccgtacaataatacccacggtggccgactggtttcagacgttcgattaattttgaacggcctaccatctccattggcatccacatccgtgacagactgacagcccttgacactggtcctggtcccagccctccctcgcactcct

SEQ ID NO: 8125 - DNA, 735 bp, Zea mays
acgtatcattatcaacgatgctcgagccagttattttatagagtacgaagagagggagtcgaggactcgaggtttcgacgaactatatggattgtgagcaggtgcttgcgtgctcatgattagcaagggtggaaatccaaaggatctgtcaatcaattcactatcatttcaggatttgctaagtactatttatgtcactcacaatctcacatgtaactcgtgagcttacatgctattgagacatggagtagcaaaacctgaattcctatttaacttaaccatcattcaagtatatgttgatctgagtgagtgtccttacggaggcgcctattaggcagaaaatttcggaggcacggtcacgctaggttgctaagacgatgcgccaattgtttattaaagtagctgcatctacgcaattccacacttggctgatttttatttcttcttgttctagtaaatctaaaggagatcacttgtgagctgtggctgtaccttgttgccttgttgggatttgggaatgaatgagagttatttggcatcttccagatgaactttaattttcttttttttcccagaagggaggcctatgcatgcattagacctcatccagcattttgttcatagtggttagccaggaagctgattttcaaggaggaggatgagaagaagcttggccctactacatatgcaggcaagagaaagatcaggaaatttaaagaatcagcttggaaatgc

SEQ ID NO: 8126 - DNA, 1500 bp, Zea mays
gagaatattgtattacattagaattttaaatgacataacataacatttaaaagaaataagttttattgagataaaattagtttcatatagatgaaaacatgacaactcgttttaatgatctttcaaggtcttcgaaaacacgtctattaacatattttagcttgcgttgtttactggtcgcttcgttccacgcgtccagctgccctttgctctttacaaatgtagcaagttacgtattttcgtggtattgggcagcgcagccgcagttactggcaggatggacccaggctcgtcaaacggtaaaatataattaaatatagataaaaactaaacaaagttatatatttatagtatgagtattatttttgttcatattcttcaagatttttctgggtctgtcactagttgctggggccaatatttgatatctatggggaaaatacaaagatgctgagacacaaatgttcatgttttataatttttaaaaatatgtttaatacttttgctagtttaattgtatggaaaagatggagtgcacaccggttttccccttgccgtgtcctgaatccgctccgctcgccgtagcatttcggccctctgcctgccaggctgccacaccgccccaagcagatccgggggccctgcccggtccagcggtcctgccactttcgtctgcctcttgctccttcgcagctccgccccgctcctcgccgctgtggcctggtccctttatataacgcctcccccttcctgtccgcgcccctcctccgctgccctcctcgcctccctcgattcagggttcagcgaattcggacagaacccggcgtgtccgtgtcgaccgacccgtccccctgcaagtctgcgacgagtctcctgccgctcttcccggtacgtgctcgcgtccgcgctctgcttttgctgctgcttccgaggtctgcgtgcgtgattcccgctgcctgcttcgcgcccggtggccgtgtcgtcgcctgcgggctgcggcttgcgagcgcgggaatctggtgcctccgggtcggcatggccccccgcgttaggccgccttgctcgattgcggcgtgggatttcgccccgcccgcctagcggtagcggcggggtgggtggaggcctggagccgtgggggtggttggctgccgccttctctggcccatttctcagagaaccccgcccgcacccggtagcttcctgcttcccgtagcattttccctcccatttcacgacaacttgctgcgtgcgccgctctgggtgggacctctgtgccttcctagttccttccttctatatgccgtgccgtgcgtccgtgggattggaacataagggcgaggcaggcagggcagtctttctgccgctattgctctttattatggcgagtggattttatggtagcccgcggcgttgcgattgcttctttcagcgtaagaataagatagattccgttctcaattggcgcttctttgggatggctctgtctgtaggccgggcgaa

SEQ ID NO: 8127 - DNA, 90 bp, Zea mays
ggtaaccgaagcgtgctagagggccttcagcacagtctgcacgtttattgggacaagggacttagtccaagagcacgtggcctacaggat

SEQ ID NO: 8128 - DNA, 1490 bp, Zea mays
ttttcttcgtttccatgacatctgcataaagtcgtgctcgttcttcaatgcaatctcacaaaaggtaattgatgtgattatgttgaatcatctacaacaggatatagctaatatactctatgcaattctatgatgcattttctgccaacatactttgatatgttagtacgtctacttgttcatctgcagcgatagattagagcccttggcctaatgtactcacatcatatgttcccttttaaacatctcataagtgttttttgaaaaaaaaatgttaggaacatatttagattacaagggtgcatggctgaaggatggacaatgaaggtggtaattaagttttgcatatattatctgaatatcaatttgatcagggttccagaatcttgtcatgagggaagactatgaggcaaataaaagatcaatgagaaatttaatcaaaacaacaagagatatgaatttcctagctttgatatgttaacaaaatatgatgagcaatttatgccaacacaacatgttggggacttgtcctcaactgctatgagttaagaacaaggcaacataaagaatgttaaacgttaatgcccttcgtccatcgaagcattatttcccttgggatataatgatcttcgaacgagggtcatgagggacataccttcatcatcacggcacatgataataaaaaagagaatcatatgaaatgtgaaagataacatgaacatttatgtctcattatcagctcatttctattttattatcatggaaaaatagaaatgatatcaatttacaaatgtaccttcggcttgaaagaaggcaaaagtacaagcgtgacgcaaaagcaaatgccaagtcagcgtgaacagtacgggagcactgtttatctatttataggcacgggacgcagcccatgtaaaattacactcatgccctttacatttgctaatgattctatagtaatccatcgaggtctaaatagccttttcccttttaagtcggttcccctttctgctatcatgccgaagctcccctgcgcacagcttcggctctgcgccaaccttcgtattctttgtacttctccacattgtggttctgatccgcgtctgaaggtacctgtttatgtattatactccagaaatattgttaaatcatgtttttgaggaccttcggaagacgaaggcccccaacagtagcccctcgcaaggttaatttgttagaataatgaattcagattgcgatatggacgaaggccctaagccgaaggtccaaaaaaacaccttcccttcgctagaatagcaacagtcaatgacagacggggccctccaacttggagcgcgctgggcgtataaaaaagaactcaccccgagcacatttggtatgcctgctttgctttgcttgatttcttagctcttgctttccaacgagttgcttagtttcttaaattttctaagcttcggatttaaggacatattttcgtcagttccgaagataag

SEQ ID NO: 8129 - DNA, 745 bp, Zea mays
tgtaggccaaccgacctcaaccatccaaagcagtttcggtgtctccgcactgcagtaggtgcagactgcagactttcatcactcgatcgccaggtgatgagctcataaggaaaaagcaaaagcatcaagcaagcaagtgttaaccacgaacgatgtataaacgcaggcatgtcagtttggtgagctgctagcgcgattgccacacccaccttgtcagaattcggcttaccagaagtggccagaaacaaactaataataatatagtcgaagccaaaacgcccacgaatcacatcacatccttcaaaatctaagctggtatgcttcgacgacagtctgccgagccgtgatcgaagtcgaacagcagaccaacgtgttagagtatatccttcttgccttctaaatcatatactcttatatattctccttaaagattcaacacaatacatctcaattctcattacatgcattttctctttccttcacagcataatggtgccacttcccacctctccgtcctcaagcagcgcgtccagctcgagcccgagacagctgcacagcagcagcagcggcgagtggcacgccgtggtgcggcggaacgtcaagtcctcgctgctgctgctcctggtgctctccaccgtcttcgtcttctccgtcctgcactcgtcgcacggcttcggcgcaacgacgcctgaccagcaagcgctgacgcagacgcagacgcagacgcagacgcagagcacggacc

SEQ ID NO: 8130 - DNA, 132 bp, Zea mays
ctgcagataccactgctgctgcgcctgcacagccctcagcaggtgggagagagagagacagagagagagagggaggcggcagcggcagcgtcagccagcaaaggcggcggcttgcggcaagagctgttgctg

SEQ ID NO: 8131 - DNA, 1500 bp, Zea mays
cactagtctttcttttttaaggctaaaaccattgtccgaaatcacttagggcttatttagatgcatagggaatcgagggacatataatccattactagttaaaatagaatagcaagagactatacgcccctcaatcctttcgaatcacatgcatccaaacaagctattaaagtgttatttaagttctacacattttttttgtatgaaaatacctaatttcatcattcaaagtgaaatttcatggtaaagccaaacccaaatccaaagtgaaaggggtggcacggaatttccccatgccgtttctaaaatactaacaaaacctcgaatctcattctatttgactatttctccacctccagaaattgtagagctttgaagtcctcacgtgcaaaaaaatacatccaaataacaaagtagtgtttgatttttctgactaaagtttagtccatatcatattgaatatcaaatgtttggatatcaactaggagtattaaatatagtgtaatttcaaaactaattatataaatgaagactaaacgataagacacatttattaaacataactaatccataattagcaaatttgtaccgagcaactcatatcatgggctaataatggaataattattttttaatatgtttgtcttacaatttaatacttatatgtataattagttctcaggtaaaagggtgtatctgatgaggacatccctarcaacgcctaacacctagtttcaaggtgaaatttgaaaattagttcttttcaggggacatattggttcagatttcagagattattgcaaaaagaagaagattaacttgaggttttttagtgtgtcgagcattaaagtaagtagccgtggagatcttcacaaggcatggatgaaagtctaatattagattggaggacacttgaagcattaatgtgttcctcctaagggagtttacattcattctattgtgggtgttcaattaattatcaatttgtaatacatgtatgtagaaggctggaacatttttataataaaaaatctgtatatttagctttatagtcagattatatttaattttctaactaccatacaaacatatgtcgcaataggtactaaagtttagtccctgtatttaaacacctccaaagacacccttgcataaaccaaatttacagatacgtccatcctctctcgaagccgccgcctcctgccgtcctgccactgcgagtggccagtgcccactgcccagtggccgttgctggttgctgctccccttccactcccacagttccactactttcaccgcgcccgcgccaccgtttgcccccttcctccgccaccaccacagtgccacaccactcctaaccctaatccgcgcgagccaaatcttagccgcaagatccattcgccgcatgcctctcccttcccggcggcagcgccggctaagctgagccggacaggtaactcccttcgacgccccggcgccgttgctgtcacagccggcgcc

SEQ ID NO: 8132 - DNA, 95 bp, Zea mays
tctgaaaaacaacaaataagcaagggtgagtacaaacgtactcagcagcccaccttcacccgtggaatgaggaaatcagatataatgcatggaat

SEQ ID NO: 8133 - DNA, 222 bp, Zea mays
ggtatggtatggcaattaatgttttgttttgaaaaaagggtgcgtttgagaaaaatggtttttaaaaggtccggcggttgagccgtgagctatggtggacgggaagtccagtagctgtttttgaaaaggaaaaaacagtgggaaactgctgagataccttggatggtttagtccaggggattttgttctatattgaaaaacttcctgctcctttgggagagg

SEQ ID NO: 8134 - DNA, 614 bp, Zea mays
cattcttagtagtatcttcgtcaaggcctggatcgtacagattaaaggacatggatggcaacgaaattccaaggtcttggaatgcggatgagcttcggcgatactatgtataacatgatgtaattttttatgttttttcttttctttttcatggcacccttttcctttccgaagggggagaaaggtttttaatggggccatcatgtgtaatttccttttttagtcttataagagcaaaatcccccaaaaaatgtaaatgtaacagctgagaacgcaccatcgagtgcaggaactgaaaaagaaaaaagagaagaagctccaaagacgttcctaagggaatgcagagcttataccgcctaagtaaaaggcgaagaaactccaaagacgttcctaagggaatgcagagtttataccgtctaagtaaaagacgaagaagctccaaagacgttcctaagggaatgcagagcttataccgcctaagtaaaaggcgaagaaactccaaagacgttcctaagggaatgcagagtttataccgtctaagtaaaagacgaggaagctccaaagtcgttcctaagggaatgcagagctgatgtgtggttgattccaaggaaata

SEQ ID NO: 8135 - DNA, 878 bp, Zea mays
cggccgcggcctcccccacgcacctcgcccgtctgccgtgcccttgaaaaggtcagcctccatccgtccgtccgtcggtcaatcgtccgccgcaggagggagggccggagggccagccccggccagcatatgcgtatgcatgcatgcacgcacatcgatcgccagaagaaaacaatacgaagaaaaccacacaaacccatcactctcgccctcctgtccctctctcgacatgcctgtctatctctctctctctcatctctctgccctcacatacttctttattgtcctctcttggaagccaactcaagttaccccatctctctccctcctttcgtttctcctcaccgtaaccgtgttccgtgtgtattctctcgtctctcctggtgcttgcttggtgctaagaaaagataactccctttccgcagccccatatctcacatcctgcttcccctccacccggcctacctccttttttgtcccccacaaaagcaagaacaagcttgctggattgcttgctactagctagctaccctccaagcagatcgagcgaacctgacccttcaaaagatcgttgtacgtccttcttctgccctagccttcttcaatctccttggtgcctgccaagttgccaacacctgcatgcacccaacaagctgtgtgcttcctgtgcgccaccgccacacgggtcttggctagctagccttattagcttgcttggtgccgccggccagttgattggaaaggagcaagagaattattgagcagttggcatcaaccgcgtccctgcagaaactatagaggcagcagcgaccggcgagctagagcgagggatcggcaacggccgccctagctgccagccgcgctcggtacgtacagcc

SEQ ID NO: 8136 - DNA, 176 bp, Zea mays
cgtcgccaaccacctcgccgcgcacaacaccacacaagctaagcgtgtctaccacactgtagccggaggccggagcaacttgtagatgtagcccaggacgatcctgcaggtagctagcagtgcaaagccctcctagctagcttagctactaccagctccgatcctgtgctgctgcc

SEQ ID NO: 8137 - DNA, 420 bp, Zea mays
gggggcagcgatcggagcgggccgccggccgcgccactggcaccattgtttcctcagtaggaggaccccgcggcacccgcgcacgatgggggtaagtggaggcaccggcggcagcagcgggtgttgcatccatcggcgccggcggcgagaacggggaaagataaatatcctcttggcttggcttccgctttgcgagcgcggctgcttggtgcgttgacgttgctacgcaatcccacccgtccgatcagcatcctagggcttccgcttcacaagcgattggtcctggccggctgcgtttaccacagattggagttggacgtggaccacgatgagacgaccgtccccgccgtccgacccattcacccccactgtgccgcgccccgccccgccccgccccgcccacgccgccgtggcaacgcc

SEQ ID NO: 8138 - DNA, 81 bp, Zea mays
gctggattgctgcagggagtaggaagaggaggaggaggaggagcctcagcaccagcggcatcaccagcggatgccatccaa

SEQ ID NO: 8139 - DNA, 181 bp, Zea mays
taagggggataggtttgtaacgccccgaatttttgcagttgaattttttcttttctttactcgccaaaattcgggcgttacctttcccttttctttttcccttcgataaaccttgaccttttccaaagttctagcgggattcggtttggatttcccgtgtaagaaaaaccctaaatgcttt

SEQ ID NO: 8140 - DNA, 471 bp, Zea mays
tatgataccttaatcccaaactggcttgatcaatggtagtcttaactacatagctcctctgattcatcttctcaactttctcaattagaattttycagctcatatttatctcatgtgttgtaatttaacattattaataaagaatttacagtaggggtttctactcctgatctttcaaaaaaaaaagctcttttccgtccaatggctaaaatccaacgacaacagctgttgaggccggcagaatgacgcattaacaagagtaaggcacacatcaatgcacactaggatccccattaccatactcaatgcacactaggctgcccattatcttatcatactcaccatcgtcttgcgttttctttgtcgtgttttgcatatttgcttcgcatctgatgaccaggctagatcctcggccgcgacatagctaggcattaccaagcctatagctagcttaaacactgcctcgcccat

SEQ ID NO: 8141 - DNA, 1297 bp, Zea mays
aactactcacaagcttgcacctgtcgagatagttttgtaatcgcctacatcctgttcaaacgtgttcttttttttgttcccgttgtgtaatctaccctaaaagtgcttccttttctcttgaaaaacagctatagttgcctgttgagcagtaaaataaaatacgaagaacacagcaagcctaggtttatgactccgttgtgcaagtttgtgacatttgaataagtcgagcgattaaagtttttttttaaaaaaaattaatggtgttatgtctttacaatatttaagtggaatttctttagaaaaaatacaaaaaataagcgcaaaatctagggtccaaaccctactaaccgtctctctcccaagcttaacttcaaaccacttaaatacatttttgtttgtgtattaaaaaatagataccgttaatattatgaatatagaaatcgtagcaagacatggataaccaaatagtatgtcatatatttgtaaatggaggtactaggaagttgctacgacgagtctagtaaaaaaatgtataaaactgaaaagaatacactcgtcatcgtgtgacctgctccactgttattcccgttacaccaaagcaatcatggctggtcccgtgcacatccttgttgcaaccgagcggttttgtgtgtgtcgtggcctctcatgggccctccgtgtcgccaaaaaggcaccgcaccgtggtggtccactggtcgcgtcgcgcgccgtcgtcgctgctgcttctggttcgttgcgtcttctcgccggtcgccgtggacggctggcgcagagcgcaaccgattggctggacggtcggcatattttattcgatgcaaacttagcgtgcaggtgcaggtgcaggtgcagcacggcggccggtactactagacaggtagtagcaccccggacccggacccctttcggttgctgctacctttcttggccgtttttatggaccagctgatccagatctttctcttttttgctagtactatattataaagttttttttcttgttttgtttcgggcaatgtatgcatgcaaagatgatttttgctctatatgaatcattgaagtagccacaataattacagagtttgtatctcatataggaccaattatgaattgaagtaaagcaatccacatttgtacacaatgcaaactaattaaacattgggggacggaggcacgctgcacccactataaataaaagacgccgaccaccgccagccagccagccagagcctccactccagcagtcagtcggccggcgatacatatatatactagagtc

SEQ ID NO: 8142 - DNA, 522 bp, Zea mays
ctatagatttaaaccaactaaatcccgtcaatccacatggataagcatcaaaacgaataagtccttaggccttgttcggttattataattctatataaattaaagtggtttaaaataaattaaaataaattttaatttgctatgaatttaaaccgacttaatatcattcaatttatatggattaaatatccaattcatatggattaaatgaacgagagctgaaaaactgtcaagtattactcaccgagggcccaaaagtttatcccgctagtcggacgctggtttagctataggggcctttccgtttgtagttgcgctagaaaggtgaacctagcccaaagcaacggcaaagcccgtcagccggtgtgtagacccaatacggcccggccgatttgtcgctgacgtcacctcatcttcaccaccggagtccggagtaatgcgcaggccacagggtcgggttcgctttttcttggcttcttctctcgtccatccacagggggaaggagcaggagggagggagcc

SEQ ID NO: 8143 - DNA, 257 bp, Zea mays
ccagtatgtggtactaatataatagctcatttttctctcatatggcttcttattagcatgattatcgggtgtccacactctagtagagcgtgtggtatgacaggccaggtaaccttttacgtgtgcgtggctatgaaaaactagctagtttagtgcatcagtgcatagcactggcatgtttaatttgctgatgaaacttgtactgaatctatgtcatgttactccgtgtagttactagggatcctctgatcgaaagg

SEQ ID NO: 8144 - DNA, 191 bp, Zea mays
ggtccggttcgacccctccctccgcgcgcgcgccaactaggcgctcttttgtaaggggctgggcgcggcagccgttaataggaggataagggcccgcttcacgggacgtggcgctcgcgctgctcgatgcggcgctggaggcgcctgacgaggatgaagaggatctcggggaggtcagggaagaagaccag

SEQ ID NO: 8145 - DNA, 812 bp, Zea mays
ggtattttttttaaactgattctcgtgtggagtcgaaagatcgggagtcgtttttgtgaagaaaggtgggatctaaaaaaacctgctccaccctctcttaaaacagctcctcaaccaaccaaatatggaccttctattaaagtttgatcgaaattacccgcaattgccattggacaaaaacataacgagccaatttatggattaaacatttgagaccattttatgcactactatgatggaaatattttatatgttattgtttcatatttttttccgtatatgcatcctatttattggtttgtaacaaagttgaactgcaaagggtaaaatagacaatcgccacagaccacctactctcagaagacaagaatcagtttacttgccaaccggttttaaaaatgattctgattttctagaagaatcagcaggatcgactcctcgccaggatcaggatctagagctaaagaagcaggagctggagctttgccaaacgagcccttagcccagtaatcctcgtttatgcggcattccgtttgttacaacggatctacgggcgctcctctccccgagcgctgctctccctgggcgatccagctctccccgacgagcgctcctcctcgacgtccgctcctccagggacgagcttgctctcttgatgctttctgctttacaattcagtctctgcaggtgggtgccgatggtaacttcttcttttgccgtttcaggtgctagcataccttctgatatcgtcatcagcaactgctcgagcaagtgatttgactgagaactgggggagcgattccttcccgaac

SEQ ID NO: 8146 - DNA, 1284 bp, Zea mays
gctgaacaaaaacatgaaagaggtaattttctagatagttcttttgctataaaacaaatattcaatttgaccattagataatctgtagtttgggcattcgtcataaaaccaagaatgatccaaaaattgagacaactttcgtttgaaaaattctaacaaattgaaacaattaacccctgccaaactcaccattctgtatctgctctatcatagagatgaatgataacataccaaaatagcagaacccatcacccacagccaaagtttcagttgcaatcgtgcttaaggtataatcaaatctcttcaaaatgtaagcagctacatatcccttattcccccacacaatgcatacagcctcgagtagcacctggatcatccggaaggtgcgggcgaggaaggactccacctcgtcgatgcggggcagggggcaatgctaggcgaggtccccgagatagagcagtgcggcgaggagagtcgcattcttggcggcaatgttgagcacggtctgccaccataggccgagggtgaggacgacctcgcctgttgattcacgcgagtgggacaggggaggaaggagactcctcggccggggcatcgacattgcgtcgggtgagggtggaggacggtggggacatcgcgggaggacaggggtgagggtacgagcatggactcacggggttcgttgctccacctagggcatgagggggatgtgcccgctgtcgccgccgagctccggtgccacaccgtcggggatcacggggttcgtagctccacctagggctctgtggtggagcacagcaatagaagcaagcgaggcgaggctgtctgccgaggggaggccaccggcgatagaggcgtaccggcggaggggagtggaggctcgccggcggggatgaggccgccgcgcgactgcctgtggggaggagagccgctgcgcacgcgctcgaggaggagctttttggaaccgtgatatcccgaacattcgggcttctaaaaattggtatcccgaacagagcaattggaattgtagtattataatccattgaaattcggaattttagtatccgagtcagttttagcccagtaatccttgttgttacggcagtctgtttcttacgacggatccacgggcgcaaaatctctccagagcgcgagagttctccacgaccgtcgctggcggcgaggtgggcacggctgacgctgccacggtcggcgctgggcgacggcgcgctgtcggacatcgtggggcagacgaggcaggccaggatggagctgcagtaggtg

SEQ ID NO: 8147 - DNA, 846 bp, Zea mays
cttaaatttaattaataaataacaatgtatagtatggtactacaaatactttattgatttttaaaactaaaattgatgtaaaaaatcaaatatgttagttaaatagtaaaaaggaagctggacaaagaaggtaaaataaaggaaataataattaagagagatatatttaaatacgaatagaaaataggaataataaaatttggaaggggaatggtcggagagagaaagcttcctccctcttccctggtctggtcgcttctcctgtagctgtaatttttgagagtccctctcaaactttgcttgcttgcgctctccatatatcctgtggatcggagaggatgctctgatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaaggtaattccttttttgcttcccttcccaatgcaaggaaagtatggtggactcgttggtcttcctccctatgatcacgcaatttgggtgctagaaatgcgcgatggttgatcttcacgtgggtcctgtttggttccagttgcagattttgctgggggcaacggagcgagaacaagttactgcagaaggaaagggcaaaggtgggggaggcgccggagatgaggg

SEQ ID NO: 8148 - DNA, 51 bp, Zea mays
ggtaaaaacttcttgatttggaaagctaagatggaattgtggcttactgca

SEQ ID NO: 8149 - DNA, 925 bp, Zea mays
ctctctctctctctctcagcggtgtgtgtgtgtgtgtgcatgcgtccatgcatgacgactggctcatgcttgcactatgtgtgtatgtgcgtgtttttagaaccaacgccggtgtgtgtggtttcactccgaccatccggagattgattttttcccccctgggagtgggggatttgcagaggttttcgcggctgtctccgacgatcgcctcagcgattttctgtttatgtggtgtttttttaaacggctccagcatccgaatctcgtgctccttgtttttccactgcttctgcttgtattcgctagaaaattcgtcgcacacacccgtgcgtcgcgtgcctttttcttgtagaagtcttcttttacttatttgtttgaccggttctggacgtgcatcgcgcacagctgttatttctccttaaaagtcgtcgtggaaaaatcgaatccgtgcgttcgtttgttcccttgctttgcgttaggactgggtcccaaccttggaggggacctctggggccagactgttatccctaattgttccgatggcacagtttttagtgatctaattctagttcatcagagcattttgcactagttttggtatagctgctggattaaattgttcgaacggttatttaaaaagttgttgcacgaagagaatcagagcctcgcattacatacattatataagttaacacaagacgcatatgatggctttaacttctcatatcgacgtttgtgcgcatggccttattttccgtgcacagatattgcattctgtaaggttagaggaatgtcttgctctattcccctaaaaaagagcctaccttgtttgtggataacccgatgttaaggctaatatcactttttttctatttaggcctccgttttattactattaaatatgatgttgtgtttcctcactcag

SEQ ID NO: 8150 - DNA, 112 bp, Zea mays
ggttggttggcctgagtttttttcagaagaaatgggaatttgaataacattggggcttgcttttaccatttttttgttcgtttctaaacatattatttgtgtgcaggcatca

SEQ ID NO: 8151 - DNA, 389 bp, Zea mays
gctaccacatggcatttacaagatcaaattcagcatcaagatattctgactactcggcctggtcagggacaacttgtcatcagaccttgaaacttaaagggagaatacaggagcagtctctgaataccttactggacagtggtagtacacacacatttgtccctggaaccaatggtatagtgtggtcgcatgttctgcttggtggtaagccgactggatcctcaaatacctccacgaactgatccagaactgcttggacttttggatcgaccgattgtccaacgggtgtagcctgtgattccactgacaagagcaaaagttcggtgacagcgccggctggtaatgtcacctgcacaccttgcaagtatgctggcgatccattatatgga

SEQ ID NO: 8152 - DNA, 97 bp, Zea mays
ggtaaggaaccgaaggatcttattgatgcatgcaaaggaccgccctgtttctcaaagctcatttatcctgcatttttatatgtaattattatagaac

SEQ ID NO: 8153 - DNA, 310 bp, Zea mays
caatcccctctgatatcctcttacttctaaacaagcccttagggctgatttgatgaatagggatcacgagggatctatgctacaagagaattcctctccatagacccctcttaatccctattcaccaaatcagtccttattgttttctgttgccccgaatgccacctacgttcaaaatgaattggcctatcttggtgtttcttgtactgagtatgtagaccatgaaagggagggtgatggagatgggagtaacagaaacaacagtatctccaattataattatagttccttaagcatacttgacaaatgc

SEQ ID NO: 8154 - DNA, 1330 bp, Zea mays
gtatactagctatttctacggtagagcatacagtgcatggagaaaagcgaactgtagccacgtccgggaagagcaagatagtgaggatccgaggagaaggaggcgagctagtttactcagttcagtttaatttcagaacgaagttgtagagtattatgggagaacccaagatttgtagtcgtagtaagaccgctgccgacacctaggcagtggcattcaccggcttgaactggaagtcgcgcgcggctagctctctagctttactatacaccgcatgccgcatgcagctagcaggagagcaagtagtggatggacaccagcccagccccgcccgcgccgtacggccaaatgacaccatacggccgactgcggcctgatgagccctgtcacaataatggcgatgctcgatctccggccgcgagatggagagggcaccacctggtccccggccggccgggcccgcccgctggggaggacacaccgttgatgcgcgagggcgaaggcgaaggccggcgacggcgacggccgtatatggatctgctgttttgtttcggctccaagtcatgacacataagctgtgtagcgaaacgccttgtcgttgctacccaccgggaggtatatggtgggggccggccggccggccggcgcgccatcgctcgcatctagatcttatattcgctgtgatcccgtgttctttgttttgtcagtctgtcctgccgccactatgtgcagtataacggtgagggcgcgcggcaataaactttccactactcctactttgtagtgaagattgcaataaaaacagtctgctttatctgaaagtagtatcgtcatacaaatgaaagcccaataacagtggttggagtttccaatcactttatatattggactttacttcgtcataacagtggttgaaattagttcgcatatatatgtgaagtatctcattctcgtgagaaagatatgcaagtttcctgaagtttctgtctccggggtccgggcctcaagcggcaagcagcaacttgacctgatgattcttcttccgttccttattaccacatacctaccaaaaggaaacgtgcgcgagccccgtccactggctgtactgagatctctctagtgtaacctgacctgatcacggacggaacacaacgcagcaaaagtttggagctgtacctaaactccatcgattagtactatgattatatattgccgttgcaaattaagttccctctatcctctagctctctctctctctcttctctcacacacacacacagtcacagacacccctatcacttagactgtgctagtaggtagcggccgcgta

SEQ ID NO: 8155 - DNA, 218 bp, Zea mays
ccatggaagttgtgtatttttgaaaatgctgtattaaacactattttttaccatcaaatcaaacacacatcctgtctagatcctttctatctatttgtggttttatttatcttctagtttattaatgtatgtataccctccctacaagccgcaactgacccaagaacttccaaacttcaaatggtatagttgcataatctgaaattactagttctgtg

SEQ ID NO: 8156 - DNA, 1500 bp, Zea mays
attttggatcgacttgagaagttccctagcactcagatggatattggtagcgcctaaaacaaatgactaagtgttagaaacttacctttactttaatttgcttttctaaacacctgtgctcatgctcataagaggartgttagttcttattaatgtgttgaatatttaatcaccaaaacaaccgaaaatgtcccaaagatacatttccttttcagtaattattctgaataatatgaacgatgaatagttatttgtgtaataatatgacattttattatgtatatgtggaaagtgcaaaataattttctttccggctttccgacttgagtttatcgttttcgattgttttcgaataatctacatatccgatcccgtatttttaatcgttagtttccgtttcttgttttcgttccattaaaaatatgaaaacaaaattgatttagatatttttgatcgttttttcgaccgatctggcgagaacgcgcaggaaagagtggagtaggcacacttgtactgcagtgtgtgggccggagattcgtacctaaccaacatgtgggctgcggcggtccggctccgggcccggtccccagtgcgagtcctgacctgaaccacccgtttctcccccaccaacttcgcgctcacctgggagctggccctccgcaactgaactaaacttttttcatgccaagtctaacctgcgtgttgccaatctaattgccagcagtacttggttcctttttttcttttccatataataataatattgacgttagtgaaaaaaaacttatctgatcaccagtaatctgatcaccagtactactacactgactaaaacaacatgtagtcgtctgatccggagatatcttattaggtaatgttttggtttgaataagggcagcggcaaacgtaaagataaccgttccacttccacagggagttaatgggaacggaatcgactattttcgtttttgtttggttccatggcggagtaattcgcaggcagtttttttttcttatcgcggcttccatgaggagagcacgaattattaacactggtcatctcacccactatttaaaacttaattctacaaacaatgttaaacaatgtcatctacagtttcacattttctattttacgtgattcatcgaagatagtctaaataaataaactgatgtggtagacttggtggtaccgagacttgcctacttggatccagctccagcctccaaaagagagagaaggctatatataagaagagcacccatccagccggccagcccaacctaagtagccgctggtagtagtggtagagctgagagctccagctaacaaccttgtgtccgctggcttggctgcttctctcttctccctcctcctccattgcttccactgcatgtgcgtcgtccttcatcataccccgatcaagaaaaaaaggctagctagctaaccaagtccaggtgatatatcgatctccagcgagctagctagcaaggctgcgc

SEQ ID NO: 8157 - DNA, 193 bp, Zea mays
agtattactatagtcatgaaccaacctttaaaatacctatgtgggtgcagtaatctggcaatattattatgaccgatgtgctgtgtggtgttgaatttagttttcttgttgcattctccccaagcgaactcattattatttttgataaagtgaacttactaatattttttttgataaagtgaacttattattc

SEQ ID NO: 8158 - DNA, 896 bp, Zea mays
tgtaaataagaaagtcttatgtagttcatcgtaggccaaaacttctcctgttatcgtaggctcttcactgatctcgtgatagtggttagagtctagatagagtattggccgtgttcgatcttttgggatgttttaccgcggggtggcggttgtttcaatctttcctatttcttaatgaaatagagggcttcgccccttcataaaaaaagtaccaacatgtacctgtatccgtctacccaacgggtagaggttatttcctattaacatacctacgggtaaaaaaaatcgtcacgtatctgccttatatcgggtaaaatcctgtcaggtagtcagttttcggctacctattgccatctctggcagtgtgtcatcttagcactgaaagaaatttatttctgctattagcaaatttcatagtttcagcagcatgctatgagcagctcacattttttaattttttattaccttggcacttggcagtacttctgtctaatgcaataactgtaccaaattttctctacgtaaatggatactccacacgttcaccgaccatgatggacaaggctttttggtttgggccttccaatcggtccaagagcacgggagcccatctgaccgcggctctagtggcccgtcgtcctcctcttcgccggtttccacacgttcgccggccgccgccctccccgctccctctcccgtccgcttggttgtttacgcctgcacccaggctagggcaggacatccaacgcgccaccttgtacggctgctgcctgggcctggtttgagtctttgacgaaaccgcagaagcatccggcgcccgcgctagcctcctcctcccccaagcgttgtttcgccgccgttcgatagctgagggcagaggcgggcaagtataggag

SEQ ID NO: 8159 - DNA, 1500 bp, Zea mays
agtactcctaaaaccaatgtatgtgcagcaatttaattttataggtatagttcaaggcaagtgtaagcaataatatgacacaaaggattagtatactgaatatgagggtgcaaggtacacacatatataatataggcaaggatatgtactgttaagtttatagaaacaagaccatatcctcgtgtatcaccaaccactaagcaatctaccttggtgcaaaccagctattgggccagcacagtacttgtgggacaaatgtccaatacacactatatgcctctgggtgccgggaagaaggtcgtgctgctgctaggccagcgttaggagcacatgggccacatctgaatggagcctgcccatgggttgtacaaggatgaccaggaagccatccacaagggtgtaggtgcagccgtgcagcccatggacacactcttggtgttgtaccctgagccagcggacgatgtgctgccgccctggccaccactagctccgttccaaattgggggttgggcagcttgctgggtgtaacccccaggagggaagccctggggtggagttttggtgccactgggaggttgaccgccagcaaggagttgttggtagtggtggcatcataggcagagggggcgtagagggatgatgtgtcattatgagttcttcaagaaggtcagcccatgcctcaggaaaggtggggaaggggcatgcacattgtaggtgcagaccaatggagaatgttctgttgagacactgaaagatactgaggatctgtacgtgttcgccaaggtcatatcagccatgctcttgaacctgcaaaatattgccctgaacgaaattcctaagctcaatgttgaggtagaggcagcaagtctaccggttgttatgaactgatgctcgagggtgagccaaaaatagtgcatggtggtgtggggtccatcatcttgttgatgaggttggtggagatggtgccatatatctaggagatgatgacataacccgtagctgcccaatctggcaatgctggatcagcctcatcgcccaggacacatcacgtcgcgtgtagttgttcgagttgatgatgaggatgatactgtcgccgagtggcactgctcgagtttggtggtggtagcgtcatgttcaccagctgtcactcgctcacgctgcaaagctgcgcaatctgtaattgactatgaggattagtagaatgattatgacgatggtacatgcatatgtaggcaatgttgtctaggactaggtttatagaaactggaactttacaagatatccttcctatcagcaatcactaagcaatctaccggtctgccctagtgcgtatgggcttattggccggtgcagcacaggactcgtgggccaaagggccgataaacaatacaacatagccctactccctgcctaacaaaaactcataatcatctagtctgaactgtgatggatatcccatgcgtaattttgttatactgaattcctttaagtttgcaggac

SEQ ID NO: 8160 - DNA, 1500 bp, Zea mays
atctcttattagaggcatgtttgcaagcacaccagttttttaataaccactttatatccctagtttataggtaccggtttacgaaaatagttgggtggaggtgtttaaaacccagtttctaaaaagccagtttctagttttttttataactactagcatactctttctctatttcaaaaaacggtgacaatagatgtagattctatgagtaattaaacacaccaaagctaggtttatctatgggagagtagctttttggtttttaagaaattagaaattttgtttctataaactgggacataaacccatatatttcaaactactatagtttctataaatcgagcaatgactactatgcaaacagacattaggtgcaagcctgcaagcaagtctcttgatccgttaaatttagacccaaccttatatcatattttgcacttaaaaccttccaccatattctcttgtatctttataaaaaacctaataaatcacggttgcatttacggttgaatctaaatctaaccgaccataaggcatgtatgtttgtacctagtgtatatttgtatagtagttgtcctataaatcagtttctcaaaaactgggtgctttcaaacacgctctaggttgcacgacataaggccctgtttaggacaactctagccccaaaattttggtagagttggaggagcaaatcattaggtgctacataaaattgtggagctagagctgtaagactttagaagacatttaaacatgtcattttgtttattatttaaattaaaaatatttttaaaactatttaaattggtattataaactacatctccaaactagagctttaacctagagccatcccagacacacactaaggggtatttggaatcaaagtatttttggagttttaagacaaaaccatgatatttaagaataccatttttttcaagaggtgtttggttacactgtaaaaaaactytgttttaaatatcgtagttttatggatactatgatatgttttgagtatttgaaacttcactctaatctaaagtttttgtctatgattaattttgcatatgtatactaaatatcattgttcagatactttgtctttaaacacacattgctaaaagtgttgtaaaaaatacggttatgtaatgacattttaaaaaacatagtgttcaaaaacatgcaactcgtgagccgacagatccgcatcgctccaagctaccgctcccgcccagctcgcaccacggcgatggaaccaaccgtggaagggacggccaagggcggacgctgccctggctggcgttgacagttagatgcgaccgcgggagcgtccgtccaaccgccaccgcgtctgcctcagctccgcgcctccgcctagcctcctctaatctccagcccagtagtggcagactagaatcgtgggcgcgacgcctcggctgattcgtccgccccgatcccaccaccaccgtactccgcgggcgacgtcggccgctagcg

SEQ ID NO: 8161 - DNA, 180 bp, Zea mays
acatcaaaacccatccggccaccatatgtaacccaaaagttccaagcttcatcggaactgctaaatgtcataccaatttgtggaattcaaaaaggaattgcagcaactatgcggttgtaaataatgcattcagaacacgaccaactggatgttctcatcatttaaagtagaacttcaacc

SEQ ID NO: 8162 - DNA, 500 bp, Zea mays
cccatacctatatccataggtgcctattgttggtaaatgcgaggactgcaactaaataaatttgcgttcgatatggatagcattttttttccctacaaacggtacggtgtggtcagaccaggccggcatgggctttatgaccaatggaccgggccgtggccggccaaaaccggcggtttgcacatctatagaccgcgacgcgctcgtgaacagatccgtccacccatagacacgcgtcgcgtcggcttgtccgcgagagagggggccccgcctccgccgcggaaactggaaacccccgacccgtccgatgcccctggcttttaagcgccgctttcgcatctttcccccactggcttcctctgccgctcgcagtctcgctccacaaccacaactatccatccactaccggctccctccctcctcctgaaaaccccgaccgcgggcgaaccaaaccctagcgagcgaggcgatcagcgtccggcgaccggcgacagagcgca

SEQ ID NO: 8163 - DNA, 1500 bp, Zea mays
atcaagcccaagtaatgaactatattatagccacctacaaataagagttattggccacaagaagtttcataacccatatttcagtctatcaattaatgtatggcacgatctatctgtacaacggtggcgatctcatagggtgcgggcgccggaaacagagctggagcgccggagggagcagtagcaagagagcgtgggaggaagcaggagggcgggagatcggtagatgacgagtctcaagtgctagacaaatatagctagcgacggagaggagatgacgagctagatacgatrgcgagttcgaaggcgagactgttgcaagctaatatcagaatgttttccatttctttaccgagctcatgctgtttagccaatctattggtgatgctttaacagaagccagaaggccgtcccgaatggccaaaagttccttttcgggctagcccgctcattcatgggatggacggtcccttgcaatctgggctgacggatcggcttgcctttgtggaatttatccacctgcggctgcagagtttttttttcttccgctagagtcagtttggaaacttaaattcggcgtagaattcctgttgattaaagtgaaaataaactaattttatattcaatcctcgggaatctcagaggggatttaactttccaaagtaaccctagatacgtgaagctgccgcgtggttttgaaatgggatcgtgtcgacacgggcggtttttgcgcccgggcgctattccaacaagctacaagcgtggagcatattagtccgagcctcacgcggcggtgtgtccctcgatccggcagggcctagcgcagcccccgtggggtctatcgaggaggcaacgacgacggaaggcttctgggagcaggatgcgggctggacgcccacctagggttttggagcagagcgaggtcgaggaggaagagacgtgaagctgttgcgtggttttgaaatggggccacatcgacacgggcagtttttgcggcgacgagcatgattccgacaagcaggcgcagagcgtggttgtctaggcatcacacgggaatgaggattttatgcgggtgtgcgggatgggtgaggcgacacacgaaacagacgatcgatgactgttgcaattggtgcattaaagtagtagagaagagatagagaaaagattattgtgatattgtattttttttacaacgcacgataaaaaaaatatgagcaaaaacagttcgttgtgctagttggggccattcgcgcgtggttgagaggaagcacgtagcacgatatcaagctttggacccacataggacgcactcaaggctcaattatgcccatcgaaggcccaactagaacccaattacaagtataactccattcccctccgtcctcccgcatcaactcgaaccgaagggacgaccgagcggagtctagactcgagagcaacctcgacctcccggatctctctcccacccacgcctcgtcggcgccgtcgtctgctgcagcg

SEQ ID NO: 8164 - DNA, 570 bp, Zea mays
gttttaatttttaagtataagagaccgtatgaaaaactaaatcttctacatcataaatataagagttaagggataatatataaagaattgtgtagaaacggactcttcaaaaaaaacacatcttaatttttgttcacttaacccctatagaccttttaagggctggttagtgaccatgaaattggataacaatagaattcctttctcacgaatactttccaattctccgatcactaaattagcttaaaaaatctataattaatggggttgtagtaactgctgtgcagtatgtgactggacaaaccgcggatcctcttcggatcttccttcccatggcaaaattcaggttccggccgactcctatacataggcagccagccttttcacccttttcccttccccctccccaaccccccacacagactagcaagccgcgcgcggaggcgaggcgttcgcacacctcgccgcgcgtccttggcctctccccgcgccaccaccgttccgttgcgcccgctaacgatcacgcgtttccggtgggagagagagtaggtagggagaggacgggacagg

SEQ ID NO: 8165 - DNA, 826 bp, Zea mays
taaatagagataatttatccttttaaagtccttgtgtttggtaatttaagaaccaaaagagagtaagagactaacaatttgtctatagaaaccaaacactctttactttgctagccacattatcgatacattcctaccctaatattatctcagttcataaatatatgacagcgttattttttttcgaaaattttaatcattcgtcttattcaaaatatttatttaaaatgtaaaatttcaagtcaaacacaaactaacttaagtgataaaacaaatcaaaaaaataaataaataacaactcattatatttaataatacaaatggttaaagttttttgttttaaattcagcggtgtcatatatttatgaatgaagataatattttcttttttgtcctgtgccacttacaacaaaaaaaaataatccacaaaaatcgcattcgcatataaaatggcaaaaccaatgtrttctcgtctcagtaacattttggtgctaaatcaaatggaatgcttgcattttcttccacttgtattttttaccacggaaaacagcaagtaacacgtctggtcgtccgaaatcacgcggcatcgccatctccagttcagcagttcttcaccgctccacgagacaacacaacccatctctgcgacctgcgacaactacacgaaaccacttgatttctgaaaggcaggccacatatataccggttcctcacagagcgtcgtcgyccggtcgccgtccgtcccaccaccggatcccgcccacccgccagatccaggtgtccagatccccgaagggcgaaggcctgaacccctgcgcatatcccc

SEQ ID NO: 8166 - DNA, 476 bp, Zea mays
agatatggaggactgactattacaagattttgtgctcaatttcacacaagtgcagttatgcacaaaaggaaacggaggaaattccaacaagcagccttatgtttgacggttgtccttccgtccgactaggggtggtaatgaatcgtgatccaaatgctttttcacaaaatgatagagttttaaataatttgcagttcaaaaatgaatagaaatagagcacgattctaatccgatttgatacttaaattttatagttaaattttatagtgtaaaaattagaatttattgtcaccctacgttcaatataagtttaagtctgtagggggcatactaccacaggtacgcagaccactactggactctcatttcctaactcggcccagcccattcgccggtgcccgcaggccgcagcacacacacaacttggcgactcgcctccgcccgcgaaccgcagcagcgtctccaactctccatcg

SEQ ID NO: 8167 - DNA, 229 bp, Zea mays
agtactagcaatttgtttttcgacatttaatcctaaagatatctcagtgtacatgacaattcatatgtgacaaatgatcttcggtcttaaatgtaaaagaccctcatctgctatatcaaatttggtttgtgatccactcactcctgctttgatacattgcctatatgatattcatttcagaactaaatttgatggaagtatatgatgtattaatgtgaaatggtttaaa

SEQ ID NO: 8168 - DNA, 360 bp, Zea mays
catccggagccgccggatcgcgccgaagagcctcctcttcccaccgagcctcgccaccgccaccttcttcttctttttctttagccccgccggcaccggcggcgacggcgacgctccacccgccgctctgctggccaccagtctccgcggcacccggaaggacatcatcggccgacgcggggtgacgcgggccgccgccggagcgagctgctgctctccccccatcagatcgatatgactgctcgatctcctctcccggccgcttggctgtgcctgggcaaggcaaggagccaaggagggctagctagctatgtgagagctaatagacaatggcatgtgaatatgtgatgctaatagaca

SEQ ID NO: 8169 - DNA, 839 bp, Zea mays
tattagaaaagaacttcattaaaggcctatttggaagcacccagtttttaagaaactggtttataaaaaccgaggtggttcgaaacatactagtttatgtcccaatttatagaaactggattctcagtttcttaaaaaccaataagctagcatcacctagctaaagacggtttatgaaaactgaggtggttccaaacaccattgaccacttttttttataaaccagtttctataaactgaagatagaagctagattcttaaaaactagtaggttggttgcaatacaaaggtatccgttgggactcgaagccgttttagtataccaggtgttcaaactcgatgagagtattttatgcaattgatgattcatatatatgtgcacaatagcacatgcctccaattagttgtatgcacgaggacgcacaggaacacatgagaaaaatgtatatattatcttcatgattacgaaactagctagttagttgtgtgttacaaaaggtcaaattaaactgtggtactagtagtatgatgcatgcaaagcatccacctcagtgaaacaaaaaaacaatgaaagcacttgtatattactacctgctttcttttcacgaggaagttagcattgcatttttttgtaatatatatatcctacagtactacacgaaggaataatatgtagtcacaagttcagtcaacccacacggttgaaccaacgctttcatagcacgttttcattggctatgaacattgcaattaaataccacgaaaccatcactaacatctaggacacaattaaaatcattgtgtgtgtgtgtgtatatattataggtggtgtgacgtcg

SEQ ID NO: 8170 - DNA, 330 bp, Zea mays
ggtaataacttttccactattcagtcattcttcaaagtaggcagttgctttttaggtaaatttgtataattgtatggaaacatcacctcactgccttaaccgcttgcttctgggttacattcttattgctcacaaaatgggcagctgtgctcatattggtgtcttcacttaattaataccaatgttgttgatgcttttatgaaaaaaaggaagccgtttcccttggcaaatcagaggacacgccagagtctgcagctcggaaattgacagagatcgcttattctcgtggcagcgctgacaatatcacgtgtatcgtggttcaatttcacc

SEQ ID NO: 8171 - DNA, 678 bp, Zea mays
tgcttgtctatatatatgtttgttgttctgtatcacaacttctttagctaatcgatatgatatgaggtctatgagttgccactttgcttatgcttgcttcaactcttctcaggggctcacatggatcatcccagagcgcaagcaaactttgagatcgcgccgaaagcatgccatccctggaatccttcagttgggagtaacatttagttccactgtgtggtttttgctctctaaatatattgcttgtcatacatatgtttgcgatctcatagatttggattttgagcattaccagtttattatttttgttaatgcaagccttgaagcgtattaaactctatgaactggtatgatttggaagataggaattgtaacttctgtgttgcaaataatctatgaggtgtgagctgctagaggtaaaactttgctgaaatagttatgatctgaaatagtcatgtatcttgtgatattaacaattcctcatagtatttgactatttgtattgtagcaactgctccttttgcttcgtgtagtactaaatttactgttgcttgtttaaaagaaaaaatttaggttccatttgcaatagtggatatgttttcactgtctgatgaatgctgttgagatatttggtttttcttttgtcaaactccaattaatatattttccttgtattgt

SEQ ID NO: 8172 - DNA, 688 bp, Zea mays
tgcttgtctatatatatgtttgttgttctgtatcacaacttctttagctaatcgatatgatatgaggtctatgagttgccactttgcttatgcttgcttcaactcttctcaggggctcacatggatcatcccagagcgcaagcaaactttgagatcgcgccgaaagcatgccatccctggaatccttcagttgggagtaacatttagttccactgtgtggtttttgctctctaaatatattgcttgtcatacatatgtttgcgatctcatagatttggattttgagcattaccagtttattatttttgttaatgcaagccttgaagcgtattaaactctatgaactggtatgatttggaagataggaattgtaacttctgtgttgcaaataatctatgaggtgtgagctgctagaggtaaaactttgctgaaatagttatgatctgaaatagtcatgtatcttgtgatattaacaattcctcatagtatttgactatttgtattgtagcaactgctccttttgcttcgtgtagtactaaatttactgttgcttgtttaaaagaaaaaatttaggttccatttgcaatagtggatatgttttcactgtctgatgaatgctgttgagatatttggtttttcttttgtcaaactccaattaatatattttccttgtattgtatgaattgcg

SEQ ID NO: 8173 - DNA, 784 bp, Zea mays
cgccttctcggtaggtctgcgtatattctgtctgattggttcggtgtgtaagtgtggtctggctcatgcgagcctggtccgctggaaacggaccgctccttacgtatctgtgcatgtaatcaggagagatgttttaggcttaagctgtagccccgggtgcagccttggcgtcgtgtaagcatgcaatcaaacgagagccgccgcaaggtcaacgcatacacaaaggtcgtgcagacgtccaatcacgtggattgagtttgcatggttacaatggctcaaaaagtcaaactacttatacactacgggcacgtttggttcacgccctcgcaggcatttgcctgtcaggcatatgatcgtagcctcccgcgatcgaaatggaacgctctgtctgggccaggcaggtctggtgcagcgccaacggtcctacgagcgcgggagtgtacgtcacccattggtgtggacgtgtggtgtggccgccgcccgccgataggaacacacgaatacgcgaccacacgttcacctcggccatgatccaccaacacagcagctccctccctgaaatctcattcccatgagccatgaattttcacacggccagcttctgcgcttccgcggcgataggaggcctgccaacagcccccaaaatatcggcttcgttggctactggtcgctttgcctgccgcagtgagaaatctctggagacctggaccttcactgcttcacatctcctgctactagctgccttcttgctgctactcccacccgctgcaccctcacagacacc

SEQ ID NO: 8174 - DNA, 355 bp, Zea mays
tcgtgttttgatgacgggagcacagcgcgccggcggcgaggagtcaccgcggccaaaaattgcggttccatctattctacctggcgaagcccaagcagtgcaaacagcccacaaaagcccaagcagcgcaaagaggcccatacaaatctaggttttcttctgtcgcagagcaagaggatataaataatcacctgacgcctgcctcttcctacatagggttccgactactgccgccgacggcgtcgatgcatctacatatgagtactctcgccgcctcttttttttaacttggatcacctatttttgatttgaacattcaagcttcgtcgtgtatcaagattgtttcttttatttt

SEQ ID NO: 8175 - DNA, 980 bp, Zea mays
ttactctgtttattttactaagaacggaagactaatttcattattaattttctactgttggataatatcttttctgctgattgatatcatgtccaagttcttcaagctgatggtggtaggtgatttgctttgctactttctcattgttgaagttgtctccatgttgtattcactaaagaacccctatattatttattttggaacaaaccttttttgttatgtcctaaaatgagatcgagcaagagcatttttcctgtgggttgagtaaatctagatttttgctttgcatgatgagacaatccagagaatgtataccaattatgatgtgtgccttttatatttatctacattacccaatatagcatattattctttgctatcttagtctattattagatggcaacgggtacaaacccgctgggttttaccgtcccaaacccgtacccgtgaaaaatatctatgcccattaaaaaacccgtacccatgacgggtttgagattttgcccaaacccgtacccatcgggttaacgggtacccatgggttacctgcgggtttcatctccaatatacttgttcttctcataatcaataagtatcgtaatgattaatgatatcatgatccaaaatctatgtaatgaacaacgagttcatgatttggtataaaaattattagtagagagaatgaaatataaataataagttgtataattaagtgaccttgcactaagttatccatccaccacatatataacgctagtaaaaactataatatcaagcaagcaacactctcactgactactgatacattcaccaattgataaaaaatatgaagtaaataaggaataacaagtttgttgttcgtttataaaataaaatgacaatatgcactaggtttggtcgggtttaaaaaacccacgggttcacgggttcagatactataggaacaaacccgtacccataaacccgctgggtacagattt

SEQ ID NO: 8176 - DNA, 1171 bp, Zea mays
gttttgaagactaatatattgtgtctaagtgcttgaaactggagaaatcgagtcagagaaaagttggctgtgtacagccaaaaggctgttcggtctggagcaccggactgtccggtggtgcaccggacagtgtccggtggtgcaccggacagtgtccggtgcgccaggttgcctcgagcgaagtggccgctctcgggaatttgccgacggcgtacggctaaaattcaccggactgtccgatgtgcaccggactgtccggtgagccaacggtcggccgcggaatctgtgcgcgacacgtggtcgggccaacggtcggaagggggcaccggactgtccggtgtgcaccggactgtccggtgcgccaacggctcccagatctgcagcggtcggctgcgccgtttaaggaaagaaatcgggcaccggacagtgtccggtgtgcaccggactgtccggtgcgcccgaagacagaaggcaagatcagccttccagaattgctctcaacggctcctagctgccttagggctataaaagggacccctaggcgcatggaggagaacatcaagcattcctacaacattccaaagcaccaagacatcgattccacgcatttggttcattgtgatagcatctagagctcttgttgagttgtggactcattgagttgtgttgcgagctcttgttgcgacttgtgtgcgtgctgttgctctgattttgagtcttgtgtgcgttgctagtttctcccttactccgtatttctttgtgaatcttaagtgtaagggcgagagaggctccaagttgtggagattcctcgcaaacgggatatttaaaggcaaagcaaaacaccgtggtattcaagttggtctttggaccacttgagaggggttgattgcaaccctcgtccattgggatgccacaacgtggagtaggcaagcgttggtcttggccgaaccacgggataaaccactgtgtcatctctgtgtttgatctcttgtggtattgtgttttactgagactcctttctagccacttggcaatcattgtgctaacacttaacaagtttttgtggctataagtttaagtttttacaggatcacctattcaccccccctctaggtgctctcaattggtatcggagccgttctcttcaagaagggactaatcgcccgaagag

SEQ ID NO: 8177 - DNA, 1484 bp, Zea mays
gcgataattgtgattgtatttattagtgattaagcgcattgtgagagattctatagagtgtgagattgtgtttcatttgacgatatgtgttgcttggttttcttgatcatgctttattcctctccttctaaaattctcattgacttataaagctagcaagagacacctaagtatgtggtgatccttgtggggtctaagtgaccctcgggattaaagagaagcactgaaccggtctaagtgatcgtttgagagagggagtagattcatcggaaacgaacctcgggaaacaaatagtctgtgtctttgtgttaatcttgcattgtgatttgattcttcctcttccctttctctaagttctcttgcttgtaatctttttgagttagccctaaagttatctgcactgattgagcaactctaagcaagaaaaaccctctcacactctgattttctttatactcgttctaatgctaacccgaggtgaagtttgtgttaaaagtttataattttcaggtttcgtctattcaccccctctaggtgactttcagtaactgtaacattggtgggtaattttcacttaaattcactaggaggtatggaatatgtttttatgaagcaattttttatgagcttcaccgtcttgatgaatccaaattggtgaagctaaaatgtgcaattattttttataaaataaaactgtttttaagtaaatcttaagcttgtgaagttgtattagataggtctataaccaacgtttatggcttgtttgggagcacgaataccaaagagaattggaggggctaaaatctctttggtatttaaaattgaatagcaagaagattttttccactccgatatctttatttccaaacaaacccttgggtactctattattgaccccaatccacatgtgttgaggtggattggactgtaaattagtttaagttacacccccaattcaccttaatacatgtagattgtgatcaatatatgttgagatgaatttttcaagagattttcatttttctaagaaaaattagtttattttctcttagtaaaatataaatcccttgcctagcttttaggtccggcaaacgtccaacccacaaaagtcgacggaggcgagggaggggcaagatgggaattagaaagatcgggcactaaattccccggtcctgggtgatcagggagctgtcagacacgtgtgcaggacaaaagccggtagcatccacgcgcgggccccacactacgcgacaacccacagctcaccctgccgtttgcgtccagccccctactaaaatatttgagtccccgagagggccctcccgcctctatttattcgaccagctcagctcacctacgtacaccacacacgtcgtcgcgtacgcacgatcgatcttcttctgacactcgccgttgccagatacatggagggaaggaggcgtcggtcgccgtgccacggaagccgccggcggcggcttggggag

SEQ ID NO: 8178 - DNA, 363 bp, Zea mays
ctgcagcacatgtgcgtaacgtaaccgagcagagtagtaaactagtaactgacgaccattgataaaaaaaatcctgtgggctatacgcagagaagttttgataaaccattgctgatcagcccataaagcccgacactagcttttctgcacaggttgtgggctcgcttcaaaccatagcaccacgcgctttcgactcggcccatacagcccacagacacttccttcctccacgcatgggcacggcagcggcgccgcaaagccgaacgaaccagagacagagaagcagagaacccctcctcgacctcggcctctcctcttcctcctccgctcccaaaatcctagggttttgctcgccgcggcgcg

SEQ ID NO: 8179 - DNA, 521 bp, Zea mays
tcgtcttttttaaaaaaatccataactatcattaatttttatcgtgataccgatatacttttaagtatgattttgaatattttatttttccgtaaattttttaaataagacaagttgattaaccttggtacaaaagagtcaaaccaatttataaattgggactgagagtatatctcttcggtaagtggcgcagaaatactgcatttatatgtcggtaaggtaaaattctacatttttccatttagatgtttattttttattgcaaaaatgtgtttttaattgactgagaaaaacacaatttaatatatatagatatctaattaaggcctcttttcaatgtaagaattttataaaaaaattacaagaataagttttttaaggaaaagccagaatgcaatctatattttgaagggcctaaaaagttaattttcgggctggcgcaagcgcggcccagcaactgctgcagccgtttccccacagctgttgcttccttctcctacactgccccgctccgctctgag

SEQ ID NO: 8180 - DNA, 1364 bp, Zea mays
cattcataaaagtgaactggtggcttaagatttcgatatgtatgatcgcgatgagaacatcccaattctttcgtcatcttcatctcagcctagtggtgagacataaattgttttcgttatattgtagctaatggcttacttgctgtgagagagatagagaggtgctatttgtatgaataagtacttaaattatgaaatctgcactaatatctgtaatttattcttggcacaatatatatttaggcgctaattctatggaatatttcttttcaattttggccggtacagagagcgttgtcctcacgctgctgaattgcttatgaagaaggcaaaaagaaatatcgccctgtttagatcattgtaattgaattccattctaataataataatttagacacataccaattaggtcatgtttggctcctaggaatcgagaggaattcgaaagtaatctaataataaaatagaaagcactttctagatattggtttcaattcatgtgatccaaacaagcctttaagctaattcgattttatataaaatatatttgtacagtgttattagtaaaataccggatatatttatgtgctacacatttttattatagaggagtgaatccaagaacgtcttataagttatagagtgaaacaaattctattaatatataaaatcatttttcatcctccacccatgaattggaaagatgaaaagttaaattcaagctaaatatgttattttattaagtaaattataattttttcaaaataaatggatccgaacgctccatagagaaaagtatggacaatgttgacatgcaatgcaaccaacttttcatccatctattggcaacttattagcatgctgaaaattagcaaccattagctagctattttttagtgccagaaggtctaaataggccctgatatatatggtcttaaagtgagttggagatgtgtatgaactattagcacctattagcaacttcaaaccttgctaatatagctaatagctagtagctttttagataataattactttgttttttaggttggctagtattagttttagctgcaaacttttagcgttaatatgaacaagcatgggtgttatatttttcataaaagaaatataggcgttctgaagtcgtggtgcgctactgcgctcctacctcggtacctccagtatccgcaagctgaatgtcttattggacccacaagtcagtgtgatcatgctgcccttgccttcccctgccgcaaggcttccagccatttcgaaatttgaaatccctgacgttcccggcgcttatatatgcacgcactcctcgccagcacgcaggacgctgtccctccccttcccaccgctgc

SEQ ID NO: 8181 - DNA, 1414 bp, Zea mays
atctgtacccaatgctgccttggctgctgtgatttatgatggaagtaggcctggccacactcgttctttttttttactgctattgatgcatttctgtctagattggactgcagagagaaagttggggcagatttccggcttcaatttatgtccttattagtagtatattgcacacgtactggaatctgcttgtttgcttaatggctataccacgaacgggttttgtcactgatgtgctgaaaagaatgcggatgcttttgtttcttttaatatgggtcgtgccatcttttccccgacactggcgcaatgtggttttgtcaccgatgtcttagtagtaattctcacagcgcccattcagtaatgcagaacaaaatcagatatgcaaaccgaccagctagcgacacatgattctaaatcgaaacacaatccgagtttcatagaccacaacttcaaatgggcgctgtgaacattttcaacgtgttagcaagaaacgcagcgctattctttggacataaagaacgtggttcactgtatgtacatcatgagttgggccaagtagcaatagtacctgccacacacgtggtcttttatattaattgttgccaggctgagcagagcagctgtttccaacttgcattgtattgctattagcaagcctaatccaagggtatccagctccaacccaaattaaagactccttgcctttggagtagatgacggacggctagccatgcaaaatgcagtgaatggatggcctgatcctggtacagacaagcaagcattgtgaaatgaaccaaaccaaaagatgaactactcagtgtacgtagtcatccatgatccacgccacacgaccccagcacgcggcgtgcatgcaattgcaagcccccccaaagctgcaaaaatatcacaccattggctgactttgtgctgcattggggtccgtttgtctgcatgttcatcgtacgtgcctgcaggcacgcatggacaaccgctaactgtcaagctagaaccgaaaggaccgtttgacctcaaactcttgcgatgtaaatcactccattgggcagtgcatgcatgcgatcgagacctaatcctctcatagtttaagtcggccctgctcccctctcctccgtctttcttgcaactgggattatatataagcaccattcctgtacagacaatcagacatgcacaactactagtactcctctccctttctctcccaccccaccccacccccctagctagctccggcaagcctgaaggctggctgaagcagccgccataggagctagcacaagccaagcacaaggctaaggtagtataggtagctgtggatcgacggaaataaatgggcaacatgctgccatcatgcctggtggtgcaacaaggcacagcagcaggtgctctgccggcc

SEQ ID NO: 8182 - DNA, 725 bp, Zea mays
atagcatcatttcttttgttttggatttgaacttgcatcgtcattgactgccacaactcactaacaatgagccatgctgtacccctcaactgcattcagtcttttattttgtaagctaggcacacatcacgcacatgattatccgaggaaacggcgtcggagccagagcagaagccgcagcccagtcacaggaaagggatggagagcacaatcgcatgggagagagtgagagacgaccgcgtgggaggaaaagaacgaacggagggaaaaaaaaatatagcctttttggctgacaacaaatgcacctatctttattagagatgaattattggtgatccgcatatttttgttagggttgattgatccgaagaaacagtattggggaccacctgccattgttttgtgaatgaattagtggtgagctgctatgctctctctcactccttatcccttctctatccgccagagggaaatacccattgatctcatctcatgccctgttgccgcgcctgctcctccttccccatccgcgcccaccgccgcccctccggcagccccgccacgagcccacccgcaagcttcccgcacggccaccgctgcctggtatcaatcaaaccagtcgtccgtcctcctttccttcaaatcaagtccatttccactccctgtctaccctctccctcgtctctggtgggcggtggcctcgcctccctttccccgtcgccctg

SEQ ID NO: 8183 - DNA, 861 bp, Zea mays
tgctattcttagttgaagttagactatcaaaagtattgtgcttcatttctgctaccaaagataacaagcacacaacactatgatgtccattgtgtccgttgcacaaggagaacttgttaagttgtcgaataaggcgttacttagtttagtttcttggaacttctgcgtgtatgtatatatgtttttcttgatcaatagaactttatatctatgaccatattatgactggaatatttttttttgagaaccaagtcacaatttattacatccataaaatttcaattaagtacgaaaaatgtttgtgctcttgtgatattgtaatattagaacactattttttttatctatacacccagtcaccacccacattgagaccagttaatagcttactgattatgtgtcagcaacaatgagcctatgtaatttgtagttaatggattcatgtgccacagactcgtagttgactgactgggtgttcggaagacaacccttgtgttgactgataatatctgatttattttataagaggtctcttgtgaagacaaatctactgcggcacataatatctgatttgtttggaagacaacccttgtgaagacaaatctactgtgttctggtgttttaaattccacatgatgtctcttctgtaattcccattgcatgaatactcattgttcattgtcttgtatatcagattgttgaggttcttacagaatccttgacactcaaggagacctggactccaacaaaggttgctcggcttatgcaacaaaggtgtctgacattcttcataacagtagcgctcctgtgaagaacgcatctgcattccgaacgaagtttgaagcttctttggcagatgtt

SEQ ID NO: 8184 - DNA, 1063 bp, Zea mays
attgccgcccccaaccgagcgcgcgcgcgggcgtaggcgtacgttagggtcggtcgttcacgagcatggcaaggtcactcatcaagctgtatgtgtacatacatatgtgtcgttatttgattttgatcgtgttggagaactcgagattgtataatatgccatgctagctagtgcaaggtttgttttgacgttcttgatgggagcagctggcagcgggtgatcttttcgcgattctttctcatcagttgctagcaataataattgcttacagatggcaacttttgtccagcttccttccattcgaattgaagcgatcgcctggcaaagtttgcgcaacaaacagctttgcaaatatgtcttcactgagcacaccgatctcgattatcgaccgtgtatgaataaacaacgatttcttctagctgtccaagatttccaaggttgatcaccatgtatgcaaccttttttctagtagtatttggaggcaccagtctggctctggcctggtttgcgttttgcagcattttttaagaggaatttgcgtttctacagctgtacctggctagttgatcttttgtctaggcgatgtcgaaacggaagcagcgtgacaggcccagtgagcccagcagccgctccagtcgctattgggccttggtgacgagcagcaaccatccgattggcgattggtggggtgggaatgtgagcaacgcgtgagctggctctcggttaggcaaatcgctgtaacggtccagcaaaaccagcggtggcaatggcaatgccatcagtagcgcacgcaagttgtcccctgatcggtacatggccgcatgcaaagttgcagttgcaaggctcatgtgaccatctcaaccgaatttgtccacatacggcaaaaatctcagtgacacccttactttccatataatggtatcctaggcgtacttgcattgcaacccaaatatcatccgcaatccccatcttaccctgtcccttactattaaaccaagccatggactgagctaaaccaaaacaccgagaaaagaagatagacggatcctcccggtgaacgaac

SEQ ID NO: 8185 - DNA, 160 bp, Zea mays
attgccgcccccaaccgagcgcgcgcgcgggcgtaggcgtacgttagggtcggtcgttcacgagcatggcaaggtcactcatcaagctgtatgtgtacatacatatgtgtcgttatttgattttgatcgtgttggagaactcgagattgtataatatgcc

SEQ ID NO: 8186 - DNA, 1500 bp, Zea mays
catactcataccgatgagtgaacctattagtccaaagcctccaaacataccatggctaattgtttgccatgcaggggtagaatagactaaaggacaagctacacaagaagatttaagagtagagtcttacttgcataagttaataagtcgacaaaataagccttggttactgtaaaggatatatgccaaatatatccacatataactccatgaagacgaccatgatatgtgggtccatgagctcggacaagtgcactaggactcagcccacatagtcagaggaagatttcaccagcaagaaagttatagaaagataaagatggcaaagatcctaaagaattaggagataagatcgatatccatatagacgtggcaaagtcctagcggacgaggaagaaacgtgtaaaaggataagatacatattatacacggttcgggactaactcggtcacgactcgtgttatrttaccaacttaatattgatcttgtatccgatccaaatgcatacctcgtaaacatttcccctccttagactataaaaggaggatcagaaagcctaaaatgatagatcgtttcatagacaccgtcagcgcattgcgagccataatctgtgtaagtcttctatacatttaccttcagttattggtcaaatcattaccaaataatccttgacaagaaaaactacgatgataaacatacatagttttctactagtcttctatggagcaattagagctttttagttaaataataaatctaaaaataatgcagttaagatagagcccatcattatcaaattataagatattttaggactaaacgtttagttcgtgtcagatcaaacgtatgaatatcaattagaattatgaaatatagacttaattaaatttaataaatttgtctcgtcttttagtcttcatctataaaattaattttataattagactatatttaatatccgtaattattatttaaacatcggccctgtttgggatagatctagtttcaaaaaattcggtgaagttagtggagcagatcattaggtgctccaaaaaatcgtatagctagaacggtaagtctttagaagacatttagataagttatttcgtttattatttagattaaaaatatttttaaaattatttaaattaatattataaattatagcatcatactagagctgtaatctagagccattccaaacacctctggatatcgcagagattaaactttagcaaggtcacacggtggagtatcgcatttcagtcctcaaaatagaaaccaggggtcaatcaaggtggcagcaataatcacacaggacattgacaaatgacatgagcacaagcacactgtgtcacgttcggtgtgtgaggccacgactcccgtccccttcgagattccgcacgaaacgagtccacttcgtatcgccgcccggtggtccgccgccgctcgccggagtagcagcagcagccgtagcaaggagtaggcaagagacaccgg

SEQ ID NO: 8187 - DNA, 117 bp, Zea mays
aaatttacaggaaaagtcatggacttttccgggttattttcctataagtacagccattcctttcacttacaggccccaacattagcacaaagaacacaatagaccactgatttcaca

SEQ ID NO: 8188 - DNA, 132 bp, Zea mays
aaatttacaggaaaagtcatggacttttccgggttattttcctataagtacagccattcctttcacttacaggccccaacattagcacaaagaacacaatagaccactgatttcacaatgaaaagggagaca

SEQ ID NO: 8189 - DNA, 89 bp, Zea mays
tgtggtctgtgtgtgtgatgtgcatttcttgcagctatcttataaatttctttgcctcaggaacttgatcttatattgcaaacttcaag

SEQ ID NO: 8190 - DNA, 370 bp, Zea mays
caacggttttactcggtaaccctttctacaacatgtgttaattaaaggtgaggtcaatttccatcgtccatgtgatgtcgttgaccgaaagggagagagccatgcatgcacgcacgtagtacaaactacacagagtactaatataagcggctggctagcaagacatgagtgagtgagtgaaaacctagtcaggtagttggctcagctcaggcggcaaactttaggagtaggttgatatatagcaaagctctcactcacattcacctctcgcaactatatataatataacgaaccaaaccgggcacgcacgtatatagcatagcatagcatagctgcagggtgcaggctgcagagagcgagctgcagcgcc

SEQ ID NO: 8191 - DNA, 89 bp, Zea mays
atgattggcctattggtgtcttgtaggctgtaattaaaatctgggcctgctagagccaggagttttcgttgcaaatctgtgtctccgct

SEQ ID NO: 8192 - DNA, 879 bp, Zea mays
gcacgttatatacttttcttcagacacatccgattatctgtttttttatggggctggaggggtcgaagcccctacaggaatttattaaaagacaaaaaaactcagaggttacagagttatctgaaatttcaatcgcgataatccatatcctaataagtacccccattttcagttatgcaataatcttttttccccttgacgttgttgtacacgtgactttggagtatctgttgaagaaaatgctaattgtgtgctcacctattggcgttggttgtacgcagtttgcccacaggaaatgcatacagagatggtgcaacaagaagggaaatgtgtggtgtggcctgtctgatctatctagcatgtttagtggtactcgcatcagctaaaccttaaacttgttttcttcttaatgcctccgtgatcggtttaagttctttcgctgcggagatggcagcggcggcggggccgtacaaagagatgctggaagtggtgaacgcgtgcgcggcccggatccggtgacgcctccgtccagcttccaagcgtcgcctcctcaacggtcagtgcccactcgcttgctgctttctcttagtagctgtagtcgttttttaacgggaaatacaacaggggaagccaccagcccaccactatataggattttattaattgaaaaatagtgttaatgcacgaccacgaagaaaaagtaaattcatgaacagatctacctaacttatgatttctgttggattttaactctagtatacctctttgaaattaaaaggctgtgatgtggttgttgatgaacaaacctagttgttgccagatatcctgtttctctgcactgggttgcggcctgtggtactggtcgactatggtggcaca

SEQ ID NO: 8193 - DNA, 49 bp, Zea mays
cctccttggatagggttagagactgagttcacccgcacgcgcgcgagcc

SEQ ID NO: 8194 - DNA, 654 bp, Zea mays
cgactctgaggatccttctgcgactatcaatcactctgctagcgactctgtctttctgccggagcaggactctgtgctctctccttcctgcctcgttgaggatatgatgctagcctttgctgttcaggcttcagtggtagtgtcgtagcacagtaaagtcactccatccttcaccgcatttcgacagacagtctccatctccacacgttcagtgtccgttgttccactgcacacatcgagggagaagaggaagagagagatgctggagcctggctgctggtttgatctccttggattctcaaaagggacccggtcgctttttgccctcccagtccggcttttagcgtaaaggtgagaagtccagcccctgttactgttagtggcttagtgccaatccgccaaacaactccagtgcagggagcaagtttgcttccctgtctgtctgtctgtctctctttctttctactgtagtatcttttaacttgctctgatgatcctggagatgagaatctgtgagctacacattattgttcttgtccacatgcaaatcaatggcagtaacttgttggcaagaccaagagactgaatctgctggtagcagacaccgggcacgcatgcagcgcctgtagcctgtttcttgcgccgctctatgca

SEQ ID NO: 8195 - DNA, 218 bp, Zea mays
gactttggtaaaccagtgcgcaacctcgggagcataaagtgggacgaccacgaggtggttaaggttattctaagatcacttattttccttaaccctactcaagttcaattaattcgtggtaatcctagatatactaaaatgacccccgagggaagttatcgggaattttgtaagttttgagtgcatgattgaaggctcgaggaagatcaacgagcttg

SEQ ID NO: 8196 - DNA, 1380 bp, Zea mays
tttctttttcttagacgcacatatatttccctttatttttttatattttttttacacaactaggctagacgccccacgttaattgcctttttaacttattattattatttgcaatctctatctgtacatattaatacatgcaaaattaggttaaaactcatatttgcttaatttacgtttacatcagtaattggttattgactttattggcctagctgaatatatgcatggattctcttttaggaaatttttttgtggttatatggttatttgtgtaatttgataatagttggtgcatatgtatcttctcgcttttttatttttttttagtgtagcatgcaagacgttgtgtctcgcttacttctaatttcatggagcagagtataaactgttcgtttcaaacgtggctaaaacataaatggatttgtttggatatgagaccaatttgagtccatatcaatttcaccataaatacccgaatttcacccatgcacatttgctacctctttcacatgcggcttgcttaatcgaaggtattaaacccgcacgacatatattttgataaggtcaaaatccgtgtcaacagcaggccgtcatggtcggcgtccagcgcaacgaagcggtcatcaaccgaggagttgaaggcgcgctcgtcctccacgaagctccacaccatgctcccgtcaaggatctccacgctcatctttgggttcctctcgttattcgtgttccggttttacacctcggtggcgacatatttacctaatatagaatttcttttgattttttaagtgataaaaatatcaaaattctacttttcaatgctattacatagtccaaatctcaagtttatttcaatactaatacaaattccaaatctcaagtatattacaactatatattatgattggttttagaaactattacaattagagtaccaaatttgtaatcaaaacaaaactaaaacgcattacagtttgaaatacggaaattacattatatgtaaacatagcaatgtcatatatattatatacatatacgcaccatatataccatagtcttatgcgaagggaacaaaatataccatagttcctctctgaaaatagatggttactatagatgtgtccaacatccaagcaaataccaagttagcgaaccatactagatgctgccgcaagttcttgctccaaactgtagcacccagacatcactggaattattaaatgttcctcattataaattggattgatacgttcatgtgggtgctgagcttctgcgcataacaaaggttccatttctccacccttttcaatcaaaagatgtgttttattccgtagcctctttgttcttagacattgcmatctcatatctacttctttc

SEQ ID NO: 8197 - DNA, 69 bp, Zea mays
caggtcaattatttccgttgggataagaaggaagaataatcctctaatttgtacagattctgccgtctc

SEQ ID NO: 8198 - DNA, 276 bp, Zea mays
ccactatagaatgaacagtaatagggtaggagatgtgtagagtgaagcgacagtcttatagcccgctattacacttctctaaagtcgaaagacaacctccttccacgtgagcgctttcttccttcagccttctcgttatcctgaacgcggcaatctccgaaggtcccatccaaaacctcgccgccggattcgcacctcactctcgcccgcgcactacgaattgactgacgcctacgccctaccgctgcaagcagcaccatagcgggagccgctacc

SEQ ID NO: 8199 - DNA, 655 bp, Zea mays
tataagacctttttaaatataaagaatggaggaagaatagaacacatgtatcagtgataccatgctagtgctcgagttcccctcatggatcattaaaatagaactcgtcctaaaagagtaatacaaccttctaatataatacagcattctatcattgggtgcttgaagttggacagtcacttgccactgccattattcaaacacagccaaaatagaggattagctttttttaacaagatgtataaaagggtcaaaatatgtgacttaactagtctccatagtccaactacacagtccaactgaaattttaaaagaaaactctctggaaaatgcactgaaattaatattgttggtgagccgccgggccgagggcccactcatctctgagatgagatgttagattgtgtcattgtgagcaagcaagtgcttgtccttttcagcgcctgtgaccgctagtctcctggaaaccgcgtgacataacccacccttctacaagtctatataagcgagcgagcccgcgaaacaccaccaggcagatcgtgttccagtgcagcaagcagagcagagcagagcagcgtcgtgcgtccgagaagaagacgactcacgagagcagaacgagcaccgatcgatggcagtgatggccggggcggcgtcc

SEQ ID NO: 8200 - DNA, 1500 bp, Zea mays
cgatgaaagaatgaacagaattaccactacggttgtgtttggtttgagcccatccttggtttaagttcatttaaattgaaatgatgtatgataagtttattccttaaatttgataggaggattctatttcttatattagtattaataattaactataagaaacgagatgttaatgggtcaattcatctcattacacaaatcggataaaattagtgagtagtaaaaagatgatagactagtccattttttaaaccaaacacctcatgctttttcttcgcttgggtcctactttcagaaagaagttccgttgtcattgaaaaataaagtatttgtacaattttgaaggtatttagtttttaggcactaatatgtagtctatttattaaattttatttgtctttaaatatcaaatacagaaactgaaactatattttaattttccatattttgtaatttaaaaactaaaattgaataaaacgaaaaaataaaattagttaatataaaatcaaacaccctcttattcttttatgttagttgagaatgatcaatgtcttcctaatgtttaaggtttataagctagaatgagaaagaagccgagaagtatcccacggtttccatctaagcgctagttcaggaacccgtcttcccaatagatttatatttctgtaaaaaaaatatttattttctttaaaaattaaaaaatttcttagtaaatggaattatcaaactaatcctaatgttgttaaaaatgctggtatgaaaatatcaccattactattatttcagcctggttgcatagaagtcataatttttcggatagatatcacaagctgcgatggttggctgcatgcgagtgtacaactatctgtgtgatgtcgctgccatatttgctgaaatccccatcatacactttcgatctaaatcgatatgaaactttatatatttttaaacacaacaattaattgttttttagttataaacacttctctccacaacaccactctattcacttagctttaattcgtatcgatttatactgtttcaataatattctttgtctctatagatacaacagtataaataatcgactttaatctaaagcaactagcaagacattgacatacagtgtttttttttactgcaacacacggcatatgatatgagcgaaggtaatcagtttttagtgtttctgcagcgtgggcccaatgaatcccaagtccaaacatcagtcagattttgacatttccgcagcgtttcaccgagagccacaagcccgcaagcaacaaatccgcgctccctgattcgccatcctcttcaccaagttaggcgacgactggcgcccatcgtcgattccccgttctccgtttccgtctcgcgtgtttggtgctttcgatctccccaaggcggcaggcggcagcgccgtacgcgttgcgggaagattttggttggtggattgttggtggcggctccactccgtcccagtgcactggtccaatccaa

SEQ ID NO: 8201 - DNA, 1500 bp, Zea mays
tggggcttggatttctcagggcggcggccggtcggctgctgccaacctctctgcgtggaggatcgtctgcgtatcgacgacgacggccggagaggaaaggtggtggaggcggtggaaacggacggcacacagtggccgacgacagagagacgcgcgatccatatcctgtgcaactgatatataatactccacgtacaataattgtactgtaaagactaaagacatagagcactttgagagattatggtttcagctagctgtcaactcgctcgcgtcgtcgtcccgttcgatcaaaatgtcaacgcgcgcgcgcgctactccttgcactttaaaagagagcaccttggatatatcatatatgcggcctgttgaccctgcagcagccagcaggagctagcggaccgtctagacaaaataattattggtgtcatctttattattaagttatagtctcatcaactcatttaagcactgacaaacatacatacattttaatggagatagctaaaatttgttggtgtcacagggcaccacaaaaatgggctggatccgcccctgccctgcaaaggcgtggtatcttttctcgagctgcattgcgtgtggtaacttgcaagatgcaaagtgagagtggccatacatgatggaaagttggatacagacagtgtagattgaacaacgaacagaggtgaaaaatggtcctatagctagtgatgaaaaagaggttcgggtaaaaatggttcgggtagggagtacgtacgatcaggtacccaccatgagattcaccacgccaatgaataccccaccccacctacctaccggcttgacccttgcaagttgcaactgctgcacgtagtacactgtgcacgtacggtaagaaacatggagactgcagacaggtggtgccgggtccacgtgcatgcatgcccagcaagcccacgggcgcccggccccaccctgccgtgccccgctccctcgtcgtttgacgtcttatattttttttttaatcaaaatctcacgtttacacactttacaaaaaaaataaaaaattcaactgtttataggaccgaagtcgttcgagtcctgttgggtgacgtctcccagatcctagtcatgaatgagctcacaacaatttctccaaagcttacaactaaatcagatttttcagtgttatgtttatactataggggccagaggccagaccacataccggcattggcacgggagactacttggtatgtggaactcgtgtcgtgctgccccacccagagcaggcctggctcatttctccacctataataccaccccgccgtcccgctcgccgtcgccaaccaccacacttcatatcgaccccgctccagtgctccaccatctcactttcgatcgcgagttccaacttccaagctagctagtcgtcgttgccgtcgtcgtcccgaccgccagctagcgctcgtggtacgtacgtgcgcgtatacgcgcgtgcgcgctcaatacaacacacac

SEQ ID NO: 8202 - DNA, 338 bp, Zea mays
tgtaagcaaataaataaataaaatcgataagaatagtaaggcatatgtcccaaaagtcatacatgtgaatagaatattgactttcgcaatttagttttttttaatgtttttgcttcttgagcccaattgttcttatatattcccttgctctccttggagttttgacatgaagcatagaatacagactacagagtgagttttttcatagttcttacccttcttacagcgttgtctcctcaggagcaagagagaactcctaaatggaaagtttcctttctgcagtcctgggtgagctgatatctcgatccataaatttgatcatcaacaagttgtcaaag

SEQ ID NO: 8203 - DNA, 178 bp, Zea mays
attttgccattatacatgtgtcatgtaggaacatagttttgttcattttttttctcggtataggatgccacaagttacagcacaggccaagtgtaaaaacatgtaaggtgtcacaggttacagttacagcatcattaaactgcactgctacattttcatatgtgaaatacaagtgctt

SEQ ID NO: 8204 - DNA, 973 bp, Zea mays
ccttggcgcataaatctatacaattaagcaggatataaaaaatgaaacttctgaattgttgtagggaaatgtagagtagtaactcaacaacttttgaactatcttgaaaagtaaagaatcatttacctatacagtccatgtgtgatcaattgatgctgatcttcataataagttcttataacacctctgcagagggcaccgtcaccggttctcgttatagtgattgacgtccgaaaatgtgtcaacacaaagcctaagtatgccgtgcgtggggtgggggccggcttatgggccgtagttggaaatggccttgggagagctagtggacgcaatgaaccgatcgaacgcgaagaatttctttcatcgcggaaaacagctaagggctcgttcgattagctctcaatccatatggattgagtgagattggatgggtttgaatcccaaacaagtcaaaattcttctcaaatttttccaatcctatccaatccacgtgtattgggaataaccgaacaagccctaaaaatttctcattgccatttccactcaccctgaaggcctgaagtatgccgtgcgtggagaaatttgtaatttttctactctgggtgggggacggcttatggggcgcaattggaaacggccttgggagagctagcggacgcaaggagccgaccgaacttgtccagtatgaacggatgggccaaaaagaactcccaacaccagtaggccagccaacaaagcccaatactttcgtcattaatatctgtccgcccttctcaaatgaacggctcagatccacagcaaacarcgaaaccctagttccaactcggccgcctctactataagtagctccactctctgtcctccgcggaaaccttgcccctgctcctcacgccgccgccgccgccgccgtcgccgccaccacatccgtagcgcccagccgccggagaagaggagggagccagcaccagccacc

SEQ ID NO: 8205 - DNA, 235 bp, Zea mays
actctgttgatccccctgccggctggtgaacccggccacgggagccgtgcaccacgtgcccgaagaggacccgccgtacggctacagcgacaggctgtgcccgtttgggcaggttgccagcacaagggagttcaaggtgctccggaaggtttcctactcgctcaacggcaaccctcgtgtcctctacgagatctgcaccgttgccggcaccggcaggagcaatgcgcagtggagg

SEQ ID NO: 8206 - DNA, 366 bp, Zea mays
catccagcctaaagatggcacctttttgaagctctctatggaagaaggtgctggacaccgctcaattggtctcaacctggagaaagagaagtttttggacctgacttagtgactgaagccgaaaggaaggtcaaattaatcaggaagaatctagaagttgttcaggccaggctgaagagctatcatgatagaagaaggaaacctctccagttcgaggtgggaagttttgtatacctcaaggtatcacccaccaagggagtgcagaggtttgggatcaaaggcaagctagcccctcgtaccattggaccttatgagatcatagaagcatgtggacccgtggcatataagctgaagttaccttcaaag

SEQ ID NO: 8207 - DNA, 501 bp, Zea mays
ggttattaacatcagcaatcaacaaaaattagtaataaaaaataaatgatctgaaaatattaacagttgagaataattgtctattttatagagatagacatcattcaaacatttggagaccactatgctgattatgaacaccaacaatattgcaaatgatcttttttgcaagaactaaaatgttataaactaaatgaaatgaactacctaaaggacaatagcaaacctaagaaattaacacaaaagatacttagttgtccttggatgtttactgattttctgtattcagcaaagctaatgtttactcyttccattccaaaaataccatggagaaccagagttgaaaaggagaaggtccagaagcagggatcatgatcgagaaagatacagtaggtctatctcattcagtccccagaaaaaaaatcagccacatgggatcagcctcctattaaagcaaaccaatctaactttcctaccaatttcctgtcaactgttggctag

SEQ ID NO: 8208 - DNA, 559 bp, Zea mays
accaacatggccaggcgcagttcaagcactgcgatttcgtttcaggtcagccgatggcgacggagatgtggtcaactaaaacgatccgacagtaactacagtgagttaatgtttaccaaaacccaattcatcacaactgtcacgcttccggatcgacgacacccgtggcaatccgaaggccagccacgctccagttgccgcagtttccacgagaacactagaccaggccaggtgtccccaaagcgcgaccgtttgcatgccaaaaattaaaattaaaaataaaataaaaccaccagcagccgcttccttcctcctccacataaataagcacacctgacacctctccgtctctccacctccacccgtggccgtggtaatcaaatcgaacgcacatgcggtgcgcctccctttcccgacctccccctgtctcggcctccacctaatcccgggcaccccaatccgaggagactgccgtgcgctttaagtgagcgcatcacacgaaaagcagcaggtagccagccgagaccgggagagaagcagcagcagggccgccaacgcc

SEQ ID NO: 8209 - DNA, 90 bp, Zea mays
actacatgtgaactcaagtaagctaattaagagtgctgcatgtgaactgctgccggctcatctgcgagcagagcttgctggcccttggca

SEQ ID NO: 8210 - DNA, 1108 bp, Zea mays
gcatcaacagtggttggcaatctatttctggcttgacttcattgaagttcaatctattttgctacacgaatttagcatatttatatcgttaatataatattattgttattgtgatattttgctacatgtattttggtatttgtcgttccatatctatgttttatattttttttattttcgtggcaacgtacgggcacagaagtatagacacatgcaatcatacaacaggtcactttgccagactgcatagacgtcctgtctcagcataggtgggaatggaaaagacaaggtgaattaggagcctggccatggcgaacatttgcgccgctgaaccggatggttgcgcgtgcaggactttaggctagccgcagtgatgggcgggtgttccaatttcgtatgcagtagctaaatactgcagtgacacactttaactggtactacataaccacagagagcatcagaaacgctagtataagatcagcataaggtaggtgattaggaaaagaaagagaatttgaaagaaataatataatatatggaagttgatatagggttgagatatagagtaaatatgaccgcatgagattatgatataggataaagaattttgctgacaagaacaaaatattctttttagatagaaatttagagtagtgagtgcgggtagccttagggagatgggatagaagtctactggaggtatgtttttttttccaataaaaggggacttattactggaccaactcgctagcgtactggcttctccggcattcggctaaacagttattgggctgatatcacatgggcggcccatgtagctaagcttcattttttttttcctttggccctcaacgtctctctcttcgtttccgtcgacggacaggcacctccgcgccccggcactagccgttaagccgacggtgcccaacggctccattcccgccgcgctctactctattaaagcccatctccccgctctctggtgactatactccactccagtccccgcgctgcatccttccgcttcctctcgctccctctgctctctcgcggtcgcagtctcgcagatcccgatcgcgcaaggagccagcgtagagggtgatcgacg

SEQ ID NO: 8211 - DNA, 75 bp, Zea mays
tcgttaccccaattattgattgcattctatcaaatactaaagattgttttctcagatttgttcggtgaggacatc

SEQ ID NO: 8212 - DNA, 799 bp, Zea mays
ggtacatcgggctaataacttgggttaatgttaaaacctggctttctactagtaaataataatctgaccaactaaaagcaactgcttgacttatcccccacataaagctagtccactacagccaaacaggatacttgctgagtatgttgatgtgtactcacccttgctctacacaccaaacccccccatccccaggttgtcaacattgcaaccactgctcaggagaagatgaagccgtggaaggagacttccaggagttccaagactacgacgagttctaggcgtgggttagcggcaacccccagtcggctgcctgtgaaggccgcgtttatctacgtttcttttccgcactttgatttattgtaaagactatgtggatgtctcagacatatgatgtaatcgactattatttccctttttaatactatttgagcactgtgtgatgatgtccatgttatgtaactgctgtgtacgtgaattgctgatcctggcacgtacatggttcgcattcggtttgccttctaaaaccgggtgtgacatatgtggtatcaaagccgtgctgactgtaggaccgctaacctagaatagaatggtcgttctaaggactatagacctttgtccctgccttgactttgatatcccttcaaaagttggtcataccgaccaaacctatgttctactatatattataccttgctgaaaattatgttttattctaatccttcatttatttatggttcattatttgctggtcatattaattctgttctcactcttttgcttgcggtgtcttttgtag

SEQ ID NO: 8213 - DNA, 696 bp, Zea mays
catgttgatttggacgttttttgccaaaacgaatctcacaaaaatagactaagaagaaaaatgtttgagtgacasaaaccaattttaaggtgaaacgaggcatcccactgakcgatgcactgggaagtgggaactaagttaggaacacttgttccagaagaaaagaaatatacctccatgtcctgaaacagatgggaaacgaacaagatcgagtggttggccattgctcagtgtgtcagacggtgaaacgggcaggaaaatgaagttgaaaacgaaaccacaggagaccagaggcgagcgcgcacgcggcccgcaactgtgtccactggataaacggccaggcacagaggagaggaaccagtcaggaagggaggcgtgccccacaagccgctgcccgagtcccccacgcacacgtatttccgcgcaagaatatccgccacgtggacggcccacgctcgccgaccaccttaaccaatcaccactcaacagttgagtttaaccccgcctcctctcctctcccctcccctcccttcttcatctcttctcctcacaaggcttcctcccaccacctccagtcctccaccggaccaccacctccagtcctccaccggaccaccacctccaccactcctctctcagaacacgcgcaaaccgctcgaaccctagctggtggcgggaggcggaggtggctccggg

SEQ ID NO: 8214 - DNA, 660 bp, Zea mays
tttagaaataaaagtgactaaactttagtcaccctaactaaacggggccttatctacacccctagtcctgagccataggtcttcttttagccacgccactccccgtgccattgaaaattcgaaatcttttagcctcggataagtcggaaggggcatcgagtgcgggagctctgtgagagtcgtcgtcagataactccaggaggcggatcattgcaatcttggcctattccaccatggacgcacagtttggaaagtgacaagcatggatgccggtctggggttggaggtacgccttgctccgccgctttcagcaaatgcctgtcctggcccgtccctgtctgctcaattcatctccctgctcccagtttgcatccggtgtcatgtcccatgccctacatgatctggcactgcagtgttagatgtcgtctgcacaccactcatcgattatgtttacttcgtgtgttgatcgttcttgtgcgaatgccaggttggagccgttgcagtcttttggctaaatagtagtaagacagtttggagtttggactacagtttcagaacctactttgtcgttggccctctggcagagtggcagaagactatcttgttatctataatagtatgagatgttcctaaagtttagaagccaaacggtcctgcttc

SEQ ID NO: 8215 - DNA, 1382 bp, Zea mays
atacttagattaatcatagttgtagacctctctaggtataccatgtattggtatattagatacatttaatgagtgctcgacctctcaaacacaatttacatcgtccgccaacagtggcgtagaaaggggagctagcagggcgagccctcccccccaaacaaaagataaactttttttgtagttttatatttgtggctaaaattaaaaaaattataatacgctaaaatttattatgtatttagggcatatatgtgctaattgttatgacttgtatactaattagttaatcgtacatcactatggtttttatatatcatataggtagaccttccttaaattaaatatttattcaaacacgattatattttttattttaaattattagtatataaatgtatttacaatatctctcctttgtataatacaatatacacgatctacagtggttaagatgcgtgttttgttattttgagatcctattttttttattattttgggacgcccgcgggaggagacaacgcacgaaaatattaacgcattaaaagtgttagtgattagtgaagtgaagtgagttgcggcactagaagttgtgtgcccggaggattggaggcttaaactggagtagaaaagctgttgcaagcttttgcctaatcaacagctgctgctctcgtctcgaccctgacgaagacgacgtaggcgcatyttactagtgcgttagcagcgattcagcggttacgcagtttgtttggctttgctagcttggggtaggcaggtagtttggtcgcttcgagtttggcggaaacgtcctttccattttgcacaatgtttttagaatatatagatagatagagtaaaagtcgcttgctgaacttgtatttatctttctgtatttttggtatatacattcaaacttaccaatagcgctattccaataattaatgtcatgattccctttggtcacaggggataaagcgagatactcaaaagatcaaattaaaagagaatcaaaagtattcaacccaaaactcaatcctagcgttatatttggtcatccatccatacatatgcttcaaaatacatgcaaaatggcatcccttatacgtgcacgccggccatcggagttgacgaactgaaacctgcgacgccgaaaataatggaccgacgcgcaggtccgagtccgacggcgtctcccaacgcaacaccgtgcttgattccacgctcttgcgacctgcccctggcccgtctgcctctgcccttgcccttgccctgcccccatatatgcatgccattgccacccccaaagtgtaagcacaagcacaaccaaaagcaaagaagagacgaagtcgatcgatcgatctcagcaaccaagcaggtaggtaggc

SEQ ID NO: 8216 - DNA, 1500 bp, Zea mays
gaaagtttggtgcagaaaatacaccggtaatggtcaaaatctaaaatacgatcgataaacatatcaaacttcacaatacagcaaagttgacaaaagatcacaaagaccacaagttcacaatataccaagttaccaaggatcacaaatttatagtataaaaagttcacaaagatcacaaattcacaatataacaagttcataaaaatcacaagttcacagactcaaagttcacacttcacaatatcccctcgatctagctaacatggcatgcttattcattaaatattttttcctcacataaagagttttttcacagcctcacaggaaaaccctaaaatctagtgtgtaaaaaaggcagactgtcggctttctatcattatatattactaatatataacatgtgcatagaaaagagtgcattcgttcgagagaccaaatcgttaatcccaactactttccaacaccatatatcccaaaaaatcttaacgcgtccaaaaaatacaaaaataagtaatccttatttagagacatacagacgatgcgaaaaatcatatctagagacatacaggtgatgcgaaaaatcacatgctgaaaaattccaaaaaaatccaagacactattccggaaaattctgagacacaaatccggtaatttctaacaaaaaccggtaaccgaaggaaacgtcaataaaacaccacaccaattctgataccgattccgatagaaaattccgaaaaccgattccgtttccgaaaaataccgttaccggtgaatccgatcgaaaattttcgaaatcggtttccggaattccgaaaaattccaaaaccgttttcatccctagtgcaaaggaacatcctaatctttaacatagtcacatccacatgaataataacgaaattggatgaaatgaaatcacaacaaaaaccaaccccagggcctgaaaaatatttctctctgtctcatctcttttccctgctttgcccaattcctagttgattatctctctttattattatagttaataaaaacatccagcttttaaactatatttcttttggattcctcccccaaatgcctttaaccaggcctttgtaaatcccctccacgctgcttctgcattccttcgttcctctattatttctccaaccctttcccctctctttctctctctcatctaccctctctctaaaagactggatacagaacgaggaaaacaaacacccgaaaagaaaggaagaagaggagaagaacaccaaacaagcagaactttttttttgagaactccataggctgtggaattgtctccaggaatcccctctgggtttgacgagattcatacagagaaatacttcttgattttccccctttcttttgctcaagaatttacctgtacaggcgaaaccgcttctttgttcccttttttttctgtgtttgttttattgggattttcctctggtccgttcttcttcacctgtgaggtggtgagaagcagagagaatc

SEQ ID NO: 8217 - DNA, 114 bp, Zea mays
cctagagatcggcaacaacaggggaccgaagcaatctgttcgaggcaagagagagagagagagagaagagactccggcgggcgggtggatggagcatgcacactcaccgcaaat

SEQ ID NO: 8218 - DNA, 1500 bp, Zea mays
cccgttttcggaattggtgacgtgcggcaacgaaattgcgcgaaaccaccccaaacatgagttttggacctaaagtagtcgatttggcatgttcgttgcgcaaaacgaagaaatggttccggtggcgaaaactcgtgctttgtatgcaccccgacacccgttttcggaatgggtgacgtgcggcaacgaaattgcgcgaaaccaccccaatcatgagttttggacctaaagtattggattgggcatgttcgttgtgaaaaacgaagaaatggttccggtggcaaaaactcgtgcttgtatgcaccccgacacccgttttcggaattggtgacgtgcggcaacgaaattgctcgaaaccaccccaaacatgagtttttacctaaagtagaggattaagcatgtttgttgcgaaaaacgaagaaatgcaaaaacttgtgctttgtatgcacccccgacacttgttttcggaatgggtgacgtgtggcaacgaaattgcgcgaaaccacccaaaacattagttttggacctaaagtagtggattgggcatgtttgttgcgaaaaacgaagaaatggttccggtggcaaaaactcgtgcttttatgcacccccgacacccgttttcggaatggttgacgtgcggcaacgaaattgcgcgaaaccaccccaaacatgagttttggacctaaagtagtggattgggcatgttcgttgcgaaaaacaaagaaatggaggttgcaaaaactcgtgcttttatgcaccctgacactcgttttcagaatgggtgacgtgcggcaacgaaattatgcgaaaccacccaaaacatgagttttggagctaaagtagtttagtgggcatgtttccttgcgaaaaacgacaaaattgttctggtggcaaaaactcgtgctttgaatgcaccccgacacccgttttcggaatgggtgacgtgcggcaacgaaattgcgcgaaaccaccccaaacatgagttttggacctaaagtagtggattgggcatgttcgttgcgaaaaacgaagaaatggttccggtggcaaaaactcgtgcttttatgcacccccgacacccgttttcggaatgggtgacgtgcggcaacgaaattgcgcgaaaccaccccaaacatgagttttggacctaaagtagtggattggggcatgttcgttgcgaaaaacgaagaaatggttgcggtggtaaaaactcgtgcttctatgcaccccgacgcccgttttcggaatgggtgacgtgtggcaccgaaattgcgcgaaaccaccccaaacattagttttggacctaaagtagtggattgggcatgttcgttgcgaaaacgaagaaatggttctggtggcaaaaactcgtggttttatgcaccccgagacccgtttacagaatgggtgacgtgcggcaatgaaattgcgtgaaaccaccccaaacatgagttttggacctaacgtagtggattgtccattttcgttgcgcaaaacgaagaa

SEQ ID NO: 8219 - DNA, 416 bp, Zea mays
caaaagtttaaattttttttagattatatagtggtatagatagtcaaacagtagcggcaatgacatcacggtaaatgcgcgttggcatccaaatgcagctggacacaggtcacacagcctaacggatatatcatatatgtgaatcctaactgtacactgtctgaagtggacgaacggctctggcttcggcgtgttacgtgtatagtaggccccttttgaacgaacggcgcgggccggggccaccaccagcatctgcggcagggagaatcgcgttggttcgacgcaaacgctacccggcgcccccttgcccttggggccggctattttaccgcacccgttctcccctctctaccgcagatcagatcacactcgtagagagaaggaaaaatatccccaaaccctagctcccgatctcg

SEQ ID NO: 8220 - DNA, 739 bp, Zea mays
agttatgttactagcgtataagattttcggccggagagggtaagaccaccctcgcagtattatattaatagacggccgtggcaatggtcctgagcgagaaaccccccgaaccctgtcctcctatcactaatgggccgattcaagctactcactctgcaaaggcccacctaggcccgagggtggcgcacagccgagttgtagcctgagagcggatgaggaatagcaaggagaattttttgtgtagagccagggtttgaacccgtgacctggtgaaagggaccctgctgccttcaccagtggggtattacaccatctgcgaatgcaactatcaacactttgttcttttttgcttacagtgattacatcttattatttaatgaatttggccaatgcacaaaaattcttttaatatcttctttccatgattgctgtgatctgtgtgacactttaaacagcattaaatattgaccgtccctgcttctttgcaaaaaagaaaaaaattgaaaaggaagagatggtcattgatctcctagtaaatatgtttgacctctagttcagcattcctcatactttgcagtttgtggaagtcgctcatatatatttgttcggactttgtgataatagtatagagttcataccaagaaattcatttaaaacatcaagcggcagtggctgtgcctcaaagtcatttctgaccattttcatcattgtttcgatcactatattctctttctcagat

SEQ ID NO: 8221 - DNA, 404 bp, Zea mays
cgtgagtcgcctgccccatcgtttcttcaccgatttcgtgcctcgaattctgtaccggtggtgcccagaagccaggacgtgtttgcactgaaaaagttcccagtgccttccgtttaatttcgtttggctctgaagcctgaatctccggcgagattcagttacggtttccttgccggcgaccattggcttcagcgttacgaaacgggagaaggcttcagcgttacgaaacgggagaagcaagcgctgctagtgcctgggcgagctacgacgcaagacagcgggtgaacaacaaatgcacgcaacgctaacggactgaaccactggctgccgtctttcaggaggaatggagcgtgcagctcctgcccatccagttcctcttcctgtcggcgtcgccggtgatcgtc

SEQ ID NO: 8222 - DNA, 275 bp, Zea mays
ggtgatgtcatgtccccctaacggcagattgttgctgtgcatggttgttaagcttctgatggaactgaatcaaagtgatagtgtttctttcaagtagagtatgctagctcttaaatcttagatagtayacttacatctgatcagtaatcttgatttttcttttgcagttctcgcccctccaacccttcatgatgcttagataatatacagtgctgggttttagcactgttttgagtttttaaattgagctaaggcttcagtgttartcttgaaag

SEQ ID NO: 8223 - DNA, 139 bp, Zea mays
aggagtgaacgaagttaatttttgttagtggttgagtaagtcatgttatttgttttcgagaaaaactgcatgtttctgaaccatatttttgttcttggtgttccaagttgtttgcaaacctgacatttttcagtatgtc

SEQ ID NO: 8224 - DNA, 1500 bp, Zea mays
ccgaatcatgcgattgatattgaagatactgacgtggacactgtctttgtccctgttttgaaccaactttaatatatttaatatataggaaatgcacgcacgatcggggcagacaaacttttgttaaaaaacctagtatggttttatggtcaaataacacttttatccttagtggtctcacgtctctttataaaggaacatgtactctatcttaagatagaagaaaacagaaagagtttagaggtccaaccctgcatcttatgtctcatatgtgttcctctgtgtgtggtttgctgggaagaaaaatagacttctacaacttctcgcgtctctaatgttaacagaagggaagagaacggatctgccgatatgtagtaacgtaattatttaacacgttatcatcacgtcctacctcaaaattgaataaaaaggggttccggtctcttcaatccgctccgattttataactctcaaactaatcctcatgacttttcttcgtgcccgtccatggattgtcaactcgtttgaaccacaagggtgatctgaatgtctgaatagcttatttagataattgtattttattttttttagaaattaacagctgggctgctggactcctgacgatgtccgtatatgagtccgtatatgagtccgtgacacggagaaatagacgctatgagtatggctatggtagctgttgtatggggtaggtgctcgacactcctgacatgtactggtatcaagtgaatagatcattctaaagcccaaaagacttcatactagtaaaataatctacgtcatatagtcaactgatgagcataatagggagcatcaaagtttataatgtccaactgagaggacgtgcaaaatagcctttttacgttttttagacaagatcatcaaaatatgattgatgattacatgaaaagatattagtatttatggataggccttgatagaattatgtgtttttaggtggtcggtaagggatacaagtcttggccaatgactatagaaaattatccctttagaaagcttcctacaatataagaacattatatgcaactagcataaatgtattcaacatatatgtattcaccataaatgtattcaacatatatgtacacattgaaaactatttctaactggatcaggagacaatttaaacgattttgttgattaagagaagacagtttatccagttttgaactttgagaaatggactccggcaaaagttcaagtaggcaaggaaaacaaaggcccccctcccccctcaaccaaatgtattaaccacccacaatccgggccatacctgaggcaacggcccctgaggcaacggcccaacctgtcaagtgtcaaactcccattaaccattactacgcgctaaaaaatgacgattatgagctcgcacaaactgaaaaaatgcaggtcgtctccttctccggttgagctacgctgccccccctccaaaccctaacccgttgtgtgatccgttctrct

SEQ ID NO: 8225 - DNA, 425 bp, Zea mays
tggtgtgggtttaaacccctacttctgtaccgcctttttaatattttacgctgagttgatttagaagaaatgtagtgactttttaataaaaatgatatagagtagagaaatagctctctgcttgaattttaacaccaaatcgagttgaccggcggaagaaagagttggcctccaccgtcaagtcaccaaccacccagagactcaccagtcaccaccccaggccagccgccacgtttagccgggctaaacaaacacgggcgcataatcggaactcgctgcactgcttggaatccaacgagccaatcattcaaatcctccccggaaccgcgttgagcagggcacggtcgattggatctagggtgagggtccgtcgccgaagaaactcgcaggcggtcacgaggaggcggcgggggagggcgggggag

SEQ ID NO: 8226 - DNA, 1291 bp, Zea mays
gtttcagacgattgaaatccctcagttccctcctgaacacattgtgccttttggagtatctcaccaagaactcaatcgtcctcacctatggggactttaagactaagtcctcagctcctcctgacatgatatgcccttcaaagtgtttcaccaggaactcaatcgccctcccctaagggacattacatccacatgttagatggtgtactaagtacccttcaacgagtgtagcgtttgataccctttcggatgatcgagtctgtttcatgaccgtgtaaggcatagacttgtgtccatttctacttgacgatcatggctacaatgttgcaacatcgcacccttgatctatgaagtagttgacggcgaggtacccaaaagagttcgataaaattattgattgatctgcattgacacatagttagccccccaacatcctgagtgtaacaaaatagaatcggggtgtttggaggaaaaaaaggttaatgtaaagaaaacttaaacacaaaaataacttagttgttcaatgttctatgaattggacatgttcatgccatcttttttttctcgaacgaccggggagagctgcatgtcatttcatttaaaaaaagacaacgagtaaggtcaaaatgacccaacccaagtacagacagctaggttttacacaaaagaacaacaaaaaccgacgaccagggccaccagcacctaggaggctggggataacaacctattcaggagctcaagcaaccttgcagctcctgcagcacaccaaaggatgccctcgcttcctatcctaaggagaagaagctggacattaggctgcacgccttcaaacacacacaagttcctaaatttccaaatttcccaggctatcagaataaaaagagtgttccacccctttcgaatgttcttgggaaccatcttgacagagcgcgtccaccatgagaagaaacccaactctgcccccattgggcgtaatggcctccagatgcaaggattgcaaaatcaaggcccagatttgtctagagaagatacagccaattagaatgtgctgaagggtctcaccggcttggtcacacaagggacaggaatctgggtgagaaaggcctcgtttggcaagccgatccatagtccaacatcggttgttcctggcaagccaaagaaagaacttgcagcggagaggagcccaactcttccaaattaatctccaaggtctgaacttgacagacccctcaaagaaagcagagtaggctgattagctagtgtagcaatcggattgagtaaacttccacac

SEQ ID NO: 8227 - DNA, 406 bp, Zea mays
atccagcgacaaataaaaagaaaacggagggagtatgagatttgaatcattcatgtgttctttaccgatgtactttattaagaatgttgaagcttgattgacgtccgtccgcaacgtaccagtatcaccctagtacccgaaaaattcagcctcacgccagccaactcagcgatccgtgccttgcaccacgtcagcgatccgcggcatctacccagctctcattctcacccgtccgtctggtgcccatcgaacggcgcagagcagcagactggctccgcaccccaccacacgccgtttaaataactcatttgccttcatctgaatccactcgtctcatctcttccatacgaccataccctacctccaaattcccaattctcaacctctcctccgagttcgagtgacc

SEQ ID NO: 8228 - DNA, 823 bp, Zea mays
caaatgaatccattcacctttttactcggaactcagcagatgtaatactttccaagaaatgagccttcattccctgccactttcatagtttctttcgctgttccacactgacatctatgatttttggagcaaactctgatctgttttgactagtttacacgtttgtgtgtggaatctgaagagctgttctgaaatgttactttccttttttaaccattagggccttggttcaggcttcatttgcataaatgggatccataaatgattcggttattttttcacttgatcatcccagtgtcggtaaataaaaaaggttccgaaagttttctatgaaatcagatttcacaatcctacactgttaacgaaccatcctaaaatataaaaatgaaccatcctaaaatataaaaacgaagtttagcgacaagaactggacttctgggctggattggattagtaagaggcctattggtctatacacgctttgttgtctttcactgtgtttaaggtggatagagcccataaacgaccacgcgcccacggtgaactgcttgtctagggttcagggataaaagacccgctcctgtcccgcaggcaactgagcgccggcccgcccgcccgcccaccagccgccgccgcaccgccaccgcgcgacctcccttyttcgccgcaaaccgctctgggcgcttgaaggtacggccacctctcaccgcactctccatccccaccgcactctccatccccaccgctaccactgtttggttggttggtgtggtacacatccagaactgaaattccccccttcgccaccactgtgtatccgcag

SEQ ID NO: 8229 - DNA, 884 bp, Zea mays
gtgtgagaaaacctccatgggcttttacatccatttttcacaaaattcggacaaggcaatgggaagaatccaatagaaaactaatataaaagatttatctaattataaggcaatggaatggcaaaacaaatagcaatgtatgggttttgttgggggccttcatcttccgaaggtcctcaaaaacgtgactaaccatatgtttttagtatgacatagatcgttataggggggcttcggcttcgggatgaaggttttctctcgtgatagggtgaagatgtagcccgaaggtaataataatggacgacgaagctatagccgaagagcttcggcttgatgtgacgacgaagaccaagtatgatgatgatcgaaaagggacaaacactattcaatccttagtgattcgtgttatgcttttagatgaatgtcaagggcataaatgtacttttgctcgggatgtgtctcgtgcctataaatagatgaacaatagcaccgtactgttcatgctgattggtaatcatcttctcgtgtcttcaccttcgagcaagtcgaatgtatcaatgtaatattaatacttctaatattcatatatgtatattttatgagatgtaaatatatatatatatgaattaatgagatgcagttattgtctttatcctttcgcattcctagtgacatattaaatgatgaaggtatgtccttcttgaccttcgtctgatgagaattatacccgtgtggagataatgcttcggaaggcgaaggtccgcgataattaacaattgtgttgccttgttcttgattcacaacagttgagaacaagtgaccaacattggcgcccacctccggtgaactcaaacgaccaccttcggcaagcatccaccttcacc

SEQ ID NO: 8230 - DNA, 687 bp, Zea mays
gccaggtactgatgttgttctgtttccagattggtttcacttatgggtgacaatgggatctaatttttacactataaagtttaaatataggattgaatcagattaggatcgtactatattttattaatttttgaattaaaattaatttagaattgtatcaaattatgaagaaccatttgaatcgtgatctattaccactcactcacttgatgaggttgtggccttgtgggtattggttacggcaaccatatctgtatgcttagatccttatggaggaggatgcagaaatgtcatctctgttcactagtgcgtgcggtagtgtctatagttatttagatgctatttattcagaaaagagctagaaaagaatgctgtcttctagtctagtctctagtaaaaaaagagtaaaggaaaaaaagaagattaattaattttaaaaagtagaaacaaggtaagtaaagggaggaaacagaagtcatggcccatgaaggctccactgggccacctctcctcgctggtccacttcatatacgctgcatcgcaacaggcacaaacgccccgaaacaaacgacaccaaaggttcccggtgccgtccaccgaccaccggtgacacggcgcccatagcaagagttcaggaggagcgcggagccgttgctggtggtagcggtgtccgtgaggcgcggcgag

SEQ ID NO: 8231 - DNA, 266 bp, Zea mays
aaattcatgtgattgaaaatgtattttgaagcaacacataaccctctggtcagtcactcagtccatccaacaatcgaagcgcattccaaatcaaataaatgaaaaagaatcaaaatgcccacctacgagacggccaacccaccaaagtagcaaacaattgaagcccattccaaaccgtcctcccccgagtccccccctcaccagtcctgaaaagcgggccccctttctcttcctcttccttccaggaatccaggcgtcctctgtcc

SEQ ID NO: 8232 - DNA, 613 bp, Zea mays
gttcttaagaccggatcaggttcacgcagaccgagagcacagatacaccaccgtccagcctcttgccatggagggtacacgctactctcgccaccgctccacgcccatctcgtgttgtcttattccggccttagtctgcccgaggcaaggcttacccatgacgaggcatgtgaccagttaaagggtcctcgatcaacaagcctacatcgacaaggtccttaatcgactcagacggagacactacaccgagactctcttctcgtgcaagtcacccgcccggtctcagcttaatcatttcaaacccaaagtttggtacctggcagaggtacatcttttccgatgttgaacctatcaaggcctttgatagatccaacatcaagttttattttcgaaaaacatcccacccacctttgccacatcatattttgtaaaaacaaaaccttttgtttttctaaagcaaagctaagcatcaaaaagcttttgtaaaacaggtgatcaaggaaggtaatcaaattcatggaaggtaatgcaggaatggttttatcaagcaactcctatcacctaatgcagcaatcaagtgagaaagattttgaaatagcaagggaggtggcaa

SEQ ID NO: 8233 - DNA, 1193 bp, Zea mays
ctgcaggaataaagaacttggttattgttggtaagcattgatatacatttgatgatatggaagtgattgtcatttcgctaccatgataattgaattctgtatgatatccttgttacttaataatcttattccttttccttgtgtcttccttttcaatacttcatttgtgattttaattttcttggccacatgatggaagcacccattcatatataggtgtgtcaatgggaataaacgtacaaattcttcattttttctacagtatagcaacctgtgcaccccaaaagggaaacttatttgaaacagagatgttatcatatcttttcttcttgagagaggttgtcagcagacaacacgtgagccaacatgttgaggaggatcagcagccggatagagttccgatgaagatggacaggatgcggagatgggccaagatgatgccgaagctggaattgtcagactgggctgtcgtgttcgcaggcccaatacacgatacccgtcgtctcgctggacgcgctgagtcagccgtcatgttaatggcagcttaaatactgcgaaccggagttagagagaactaagaaattaccaacagctattcctgttctttccactcattttctttgtagttagccagtagacagttacagaggtcaagcatcacatcgtacatcatgctacttaaacatgtatttgttgattttcaggagttcagacaccaaattgcattcggcagactgtgttcgatgctatagcactggactatgagaaagttacggttctaattgatgcaacagctgctgcaagaccagaaatccatttgtgtgagtacttccatagatctcctatacttttcacatcaaaacaatatttccattctttacagtttgagatgcgtatgattagactgatgttagacatattcgtttacattaaagagggaaagcttgtattctagattttttgatttcataaatttatttttaaaagcagtagattattcataatgcttattttttatggtatacatattccgtccaatgtgatcggacagatatttaagttatggtattgggaggtgatgagccaaatactagacatattctgtaccacagtgatttgcaaggttctatttcgaactgccgcatcttttgaaatgctgttttattttttccagtttgttttgcaactgttag

SEQ ID NO: 8234 - DNA, 993 bp, Zea mays
atgggaaagcggaccctagcggctaccgccgtcaacgttcggaggaaggcgccgctgcgtgcggggccccctccctcaccctgagacagcggcatgtgctcccccgcggccacgctttccagctccacctttttcatcaatcgaactaacagcctgcaaccaaacagtactgcctctcggcggctagctagaaatgacgacgacgacgacgacgaccacgaggcattggctggaatcccagttcccaccgtcccgtccatggttccgtcgtccatccagccagcaacacctcatgtgcgaacccggttcagcggaatcgccatctccaaattctcgatccgccgcgtgcgctgcctgcggatatctccctgtccgtgtcccgctcccgccttgcttgctgctccaccaccgcactgtaggtgctgcctgcctgcctcctcctgaattattcttattcgttcgctattaattattagccaccgctatatccttcccttcctcgtcttcctcctcggagtcggagaggtccgtccatctcgatccgcggcaagtctgaacggacgactccgaagcttacttgccagagagccgccgtttaggtggcggcgatccttccgtggttccttctcggttctgcctgcctgctgctgcttcttcttcttctggcggggccgaatcgagagcgtgtccgccggaatctctcagtcatcaggtcagtgaaacgaggctccaaaaaaaaatcccctctttcttcttcactctccccctattccatccttcctgaggattttcttctctgcttcattttccgcctcttcgacgagtcctgttcttgttcgttcttgctcctcagtgaatgcgctgcttcccatttcttcccgaatcgctttcccctcaatgctgatccgattactctcactcacaggcaggctgcagcctacggcggtcgattctactgggattctacactactcgctcaagagtcgagactgc

SEQ ID NO: 8235 - DNA, 131 bp, Zea mays
tgggggggggggggggtcgccgcctgaaccatttggattccctcacctggaattcgaaaaacggcgactactcccctagagcagatccatctagactctagagtacatccgagggggaagcgagcagatcg

SEQ ID NO: 8236 - DNA, 305 bp, Zea mays
cattacgtttcctccaagttcaaacttccagcaggatttccgagttgagtctgaagatcttcgcttttccggtttccatcagaagttagagagaacccctattctgatttgccagattccatctgtgctgcagttcttgcgcagttcaagagactgccccaactttatccaaaaagtttcctccgtatgtaaacatgtatcctattcaacatacgtgaaactgtaaccttacatttttatatttcaaactaacctaacctgtctgcaggtctcatttgtggtcaatctggaagcggtgtgtcaag

SEQ ID NO: 8237 - DNA, 1500 bp, Zea mays
tataatagcccagctagctagaggtcacccatcaagctgcccattccctcgtgacagcagctgcctgcctgctccgaggcgccacccagctcttcctcgccccagcagccgcttcccgagatccttttcactttcaccaccagggtacatagaccgcatctgcggtgctctgcgctcctcggactcgatttgttggttcatccatccagctgccgccggacgtcgatcagctacctatctgtaagctccctcccttcccttccttcgctgcccttgccctctctctctcttctccttcctcccccaaccgaattccttttcggtgtttggattcacaacaatggaatcccattctttctagttcagagctccagctccagggcctaaataaaagggagtttctttttcgtgtttggatcatataaactaactaataacaacgggaaaaaaaagggaaggggagggatctctttcgttcgtgcttttgccgcagctgccacctgaaatctggcctctgccgaacgtctccaggcctgctgtttgttagccttgctgcagttgcagagctttctgggccgcagtccttccttcccgctgctccatctgatctctcccttcccccgcctgaaaaatgcctcttctgctgtgatccatgttccttggatggttgttgctcaactcgtacggatggaataggattaggaatacagatgtgaatatgcccccctcgcctgctgcctgccttcccctgcgtggacgactcactgaaaactgaatattcaattcgattgcagtggctagcttggctgttctctctgcaggcagttgccatcgtgtctgatcatactaatattctgtccagatcccaaggaggcaaaggttggtctaacttctccttgactactaattgattattcggatattccagtgagtgagtgagtagagagagagagagagagagagcgcttttgtatttcgtgagaaagagtacttagcagccccatgcatgaatcgaattgttcaccagtttcctgatgacttccttccttgcttccttcctgtggtgagggagggagagagctggagaggaataagaacaagaataacaaacaaggcacaagcaggctgaaccgacggctgttcgcctgcctgccgtggatatgctctcaattgggcgccttctatctagttctgcagggcaaaagaacaattgactattgcatatcattgtcctcccaccatgattccaaagattagacgatatcgacatgcagcatactgaacgcatcaagcatcctgatccaactcgtgtctatcctgctgccatcttttttttcctttcaccgtcatctgtacagtgtgcctgtaagactaactaaactaacagactgggtgaatttttttttccacgcatgacagtgaaaccacaggaccgagcgtggaaactcccggaccggacattccattttccattccgaagggggggtgagaaggcgggga

SEQ ID NO: 8238 - DNA, 176 bp, Zea mays
agggaggggaattccaccttggcacttcctcgaccaacgcaaatctgcctcgggagacgggacgagcaatgcgtcgtcgtccatcgatcatgaggcgtctccgacggagctaaaagagatcgatcagtgagcggtggtggattgaagaatcgarggcgaggaggaagagagggagg

SEQ ID NO: 8239 - DNA, 92 bp, Zea mays
tgtatgtagcaaagtgtgtttctttcactgaggctgaaattccatcacgtttttgagttgtctgtttcttggtaagtcatttgtggttactc

SEQ ID NO: 8240 - DNA, 776 bp, Zea mays
tgggggctgaataaggagtctgctttggtggtggccggctgatattatatatactagtggaagggtctggagagggaagacgacgacgccgacgacgactaatatttaagaataagggaagaagaagcagaagcgggcccagacatttgatattggatattcaaaaattcaaaagattaaagaaattagtactctaaccctattttgtgtaatacattattggtaaattactatagatcacaaaaattttgggtattcaatgaatacccatgaatacctagtgggcccgcctctggcttagtgtagaatgtgattagacagaagtcttgatggttggattatggtccgcctgccatttatgtaacctgattgtatatgtatgtattgatacagtggtttactgtatgtgtcattatattatatatactattcaatatggtttatatgtgactattaccgtataattaggtgttacttactgcccaataaagcgcccgaaggggcgccccatgttctagtgatgagttcaaacttggagctttgctctgcctgtcttgacgggcgcgccaagttagaccacgtggtcagcagccaagtccaatttttcttgatccttatcattaggtaaagttcagatgaggttatatgatttattgattgattgacgtcaccattagcaatataaaacgtgcgcccactcgcccgaaaaccacactgtcagtcagtcggtggcagagacgagcaccttctccagtttttttctcagttctcactcc

SEQ ID NO: 8241 - DNA, 173 bp, Zea mays
ggtatatatgcatgcgtgcttttatttgatccagttgtaaactatatgcatatgtcagttgtaaatgaaattccttgaggacctactgacgagcaaataaatcaacaaacaaacaagcaggagccagcggcggcgagtcgtacgtgccggtgcggagggtggtgtaccggtcc

SEQ ID NO: 8242 - DNA, 1027 bp, Zea mays
tgcagatgcctacacaagatcaaattagatcctgaggtgctttcccatcatgcgtagtagccaaggcaccttgtttcgaatggttcaccggtgacactagacttctgcatcataagattttttatgtgtagaatatttaaaggtagatagaacctcatgggggaaactaataaactatattatcacaaaagaaccaacaatggaaaaaaaccattgccctgccaatgatcacaagacaacaaatcgtattaccaaaaaacaaattccaatcccattacttatgaatccaaaagcatatattttcatgggaagcctagtttgcaaaacagcatgacccttgataaggaactaatgaacaatcctctgttattgcctttctacacacatgactctcgtccaccccattgaatcccattttaatcatgaaatcagtactcatagaatccaatcccaacctactaaataaatagaataaaagaaggaaatccagaagagtaaaggaatctcaattaaccacatcatcagtcatctcattagtcagtgttcggctaggcgccgactaggcggcgattaggcgcgcctaggcgctagtctacagcctgccgcgtagcctagggccctgtgcgtcttctaggcggccgcggcgcctaggcggcgagtgggcggcgcgcagcgcctaagcgggcgcgcaggcgggcgcgcagggtagttttagcgcgcgcagcgcgcgtgagttttagcgcgcagtagttttagcgcgcgctagccgtctccctcccacacggtgacagaaattgctcccccgccggcgccgctcatcccctcctgctgctcccccgccggctccctgctcccccgccggtgagttctcctcccccgtcggctgctcccctccctgctcatccccctcccctgctttcctcccctgctttcctgctttcctcccctgctttcctcccctgctgaaactgctttcctcccctgtgcagtgtacaagtgaaagaaatcaaaggattaaggtttaagg

SEQ ID NO: 8243 - DNA, 68 bp, Zea mays
agcgctcggctgaggcgcgcgcgcgcgacgtcgcgcaaggtctgtttcgaaggcggtatagggcagcg

SEQ ID NO: 8244 - DNA, 727 bp, Zea mays
ccctccctcgcgacagggacgttgtacgaacggcgccccgccccgccacgacaccgcccacccatccaaccagcccaactcgcgcgctcccgtagccacacgcccgcctcaaatgatatgtcgcgtcgccgtcgccgtcgtcgtggagcgccgagcccacgctccacccgtcgaactgcaacggcccgtccgtcctcgaccgcaggatgcggccctagcgaccccgatcacgcccggcgtggtgccgagctggccgcgggtgaggggaccggtggccgtcgcgcggccatggaaacagatggaggggcgggacgagacgaccgtgagtcgctcacaaggacaaggccggattgcattatccgctcgctgtgcctgccctgcttcttccgccattctttccgtctctgctctactttcttggtcgcctgtccggaggctcctccccgcggcccctgagcaaactgtaccatagccgcgtgattgattggttcacgggagggacagggagcggcgtcaagctggttttggtagtaaaaaatcacttcaattgtcccctcattcccatactaaagcaggctgcccaaaatttctcaatattgtcctcagaatttgttgctgtgcttttgccagaagcggtgcttgcttcggcagatggttgttctcccgcacctgtcctaccgccgttgatcgcgagagtctcgtacgtagtcttcgggggcaagcatcc

SEQ ID NO: 8245 - DNA, 182 bp, Zea mays
tgtaagaactatatggacgtctcagacgtatgatgtaatcgactatttcccttcttaatactattttgagcactgtgtgatgatgtccatgttatgtagctgctgtgtacgtgaataactgatcctgacacgtacatggttcgcattcggtttgccttctaaaaccgggtgtgacagcagta

SEQ ID NO: 8246 - DNA, 743 bp, Zea mays
tacaagtactgccttcacagagaatttggacggacatgtgacaccgacgcatgtgggtcagttggtggaaagttccaaaaggttatcattcgattcgagtgccatctcatccgtgtatatggaaattccaagcctgccgcttgctctccttgtcacgttgttcagcaagcagcgcggtcctctgtttgtcacgtcgtcgctgggctggcgcttccttggctcgcttcgctgaagaaaagagagagcagggcagcagcaccgcgaggacgacatgcatccacgacgagtgaagactgaagagcccgtccatccacgctccacgggccgcacagcgacagatagaaaccggctgtgaccaactggccagcaccacgcaacagctagactagactggtagaagagctagactgctagagcctagagccgccgcgtcccgcgtgcgtcgtgcggcgctctcccgatcccgagtgcatgctacctcacctgcgtgtgcgccgcgtttcaactcgagaaagaagacacaccgtcgcggcgcacgcggcctctggtttctgatttcctggttaccctttccctccctgcatttgcctttcagatcaggcggcagcaccttcctctcctccccttcccttccgtctcatcttcgttcccttccggggtcatcccttccgtcctcctcctaccaagtcccaaggccgcgagacagacagacagacagacagaaagagagagcagagcagaca

SEQ ID NO: 8247 - DNA, 1237 bp, Zea mays
ggtaagatcttgctggttaaattattaacgccttgttctccaatggcatttgttgatggatgtgactcaccaggagcatcgaagttgtttaacatctctcctttaggagtggagctcctgtcctgaaatcacaacaagtatttgagataatgccccgttagatgctccttcttcttttttctttgattagttaatgtgctcattacttatatagttttataaatagctaaacacacttgtagatccttgcacacaaagggagcattactgtgtttttcctgcaccaaactgattttgtactcgcctggattctcattcttattgtttcaaggtgatccacctcaggaagttctttagctgttgctaagacacatttaagaatatctgaggatttttgttatagaaagttactaaaggccccatcgtgctgggactatcgttttagttttctagacctattcagggaaattgataccagttaacttgtcctaaaggaatcttcagatttagatttatgaaaatccgattttaccttttagaggcagtttggttaaacacatacggctttttcctgcaccaaactgattttgtaccgctagattctcattcttattgtttaagggtgatccaccttaggaagttctttagatgtccctaagacacatttaagaatatctgaggctttttggtatagaaagttactaaaagtcccatcgtgttgtgactatcgtttcagttttctaaacccgtcacattgatgtttggatgcttaagaaattaagaaacaggaacaaagggcagcatgcatgcatagatgatagatcatgcacccatgacctagggggtcaagtattaagctgctattagctggcgcgttgatttgccaccgaaattctctcgcgtgactgtactactgacatgggtgcattctattatgtcctagacgatagatcatgcattctgttgtgtcatttaatcatacaacagtattagagtagattatttttgtttgtgaaagttctgaggatgccaggacctcaaccgtaaataatgctatgctcggcttatgacacaatttgcaggttgtgcgtgagtttcatcctaattttgcagcgaaatggaggaggtacatgtatattttccctcttgatgaggatgctgacttgattttaggggaagcacaagtcctcaaaaacactagagaattctgaacacaacataaagcctcaaagctttg

SEQ ID NO: 8248 - DNA, 746 bp, Zea mays
ttttaaataaatattttgaataaaacaagtgattaaagttttagaaaaaaggataagatcgtcatatatttgtaaacggagtatactgagacgcagtcgagttcaattatttttcaagtaagttgaagacgaccctccaacacatgcaccggagtccaggatgaataatgtgcaccttctattgatgatttttttaggggtaccttctattgacgagatgtatcttttgagcattttcttcgatcattgtcaccccaaggatattcgctgctccccttcctccatctccacgtctcgctccctgcctgctacacattacctcttgccatttatacatgttttgtaacttcaaaagttttaaacttgtatatgatttatctcccattattacactgcaaaggcatacttgccagacatataatcttacaaaacgcaaacgcagcttggctgtacgaaacaatcaaaggctacattaccaccggccgtctcttaattaggttgcgctggatataaaatctagtggatgctatagattaatatgagcaatcaatcatatgatcataccatagcctgtatctagacagatgacaaaaaactatacaattagagtgaaagcatagtttgatcgatgatactgaatgataggtatacttatagaacgtggggtttgtgtgttgacctcgatcattgcacaccgctgaaccagatcaggccacagcgcatagctagaaggtggccgagagagt

SEQ ID NO: 8249 - DNA, 51 bp, Zea mays
ttgaagctctgtgattttgctgtgggcacattctgtttattgtcttatgat

SEQ ID NO: 8250 - DNA, 507 bp, Zea mays
gtactcatgtgttacgcgacaacaggcgcacgtccaaggagtagccgccgagcgcatgcaggacgaaagctgttcgtcaggtgtttcacagaggacacgtccgtcgaaccgttcccgactcctgagtcctgactgagcccagctgaacggtgtggcttctgctttgtgctttcccgagaccccaattcgactactacgttcagtcgcccagtgtggcgtacggccaagtgttctcttcaagcggtggtctgcaagggtgttacaattcgtggcccagctttggtgggctgcatcgatttgctacggaagttcaggcccatcaagtgaaaaagcctagttcgcgttactcgacacacctaggaccgtgtccgactcgagcccaaaccgcgtcacccactcaccccctcccccaatcgtctcgctcgcaagtcgcatcgcacgtacggtctcaggcgcatcggcctcgccgctgcacaacgccggagacgatacgacggcggctacggg

SEQ ID NO: 8251 - DNA, 374 bp, Zea mays
ttcgtcgcggggatgaggatggggagctattccccggtgggaaattccccgttgccatccctagccgctttactccccggccggaacacggatttgctgcgcgcctgctcgatcgttcggctgcagcgcgggcacaggcactgccagtgcccactgctgctgcatgcgaatttgaacaagaccgagcagacttagcagaaaccgacgtccccggcagtagaccgaagcttccgcccgccttccgagctccgtgtcgcaccaccacgccctttaaacccgccccggtgtcagtcatgcagcgagcgtgaggacggagtgccactgctacggtgctacctactggagacagatagcagtgtgagtgatcgatcgcc

SEQ ID NO: 8252 - DNA, 208 bp, Zea mays
atctcgttttgtttcgaccctttgtcggattggaatttcaacctgtgagcataatccaagtgaatatgaatataacatcctaaatattatgaacgaatccaagtgaaaatcttccaggttgcacatagcatagcaattagcaggtaaaatacttcaccgcacggctacttattagtctccttgccgtagaaatacacagttatataag

SEQ ID NO: 8253 - DNA, 783 bp, Zea mays
ataataaggcatcaagatcatctttgtgttgtaacagagaggaaaaataacagagatgatatggtttagttctatctgagttgagcagtgtgcttagtgctactggtttctgcctggagagctgatcaaaggatatatgtagcgtgttgttatctgatctgaaagggagtgcttgacccccaacgttgttctactcgattttgctagcgtttcagtaggatttttctagaattgcaaacgttatgctttcgtcagattctgaagcgtctgcatcctttcctttttcatctatgtactgtggctcttgtgtgtgactggaaattcgttaccagtttgctatgctggaacatggaaaagaaaaaaaagagataattataattgtttcattcaggtagcattttttatcttagggttggaaaagaaacatttttgaagtctcacgatcgttttcgttttccacgtgactgaaggacgcccgtctccacgtagcctggaaggttcacgaggttcattgagccgttgagcgtgtaactgccgtgaaggttcccgaagcatctggaacacgtgggcacgccgcacgccactgggcgtgtgcgctgaccctgacggcaccaaaaggagaaagaggaagcgagcccccaggaaagcggtcagaattggagtgcaagcgacgcgtcgagccccatcccgttcccgcgcctcgccgagagatctgcgccgtcgtcggcaccaatccgtacacccgtcagtccgtccgtcgtcggcgccggcgaacgagtagag

SEQ ID NO: 8254 - DNA, 1500 bp, Zea mays
ttgtttactttgtttcgtagttaatttttaaattaaaaccaagtatcccatgcaacctgattataaattagaattactattatttattctattatattcgagacattgttccattataaatggtctggtttataaatgctatctattttcccaaaaaaatctttttgggtgactacgctatagcttgatcctgctttgattagtagattcacttgctaagtttgttctatgttcactctcattacgttatggtgagatgttgacataatgacatgtgaccacaattaaggcagcacatattgtttcagttactaaagtaccaactgatacatagggatcttaaatagggaaaaacaattacatatggtttcttaggcatatcatcaggttataaacttttccctaaaaaatgtttgtgtacattactttgcaattgctaacctgttgtgcaattgattttgcaatcgtaaccatcgtgctgcccaaatatacctccaatcaacaggatcgggctacgcaaaatgctcctacattctcacatacacatagaggtgacaatgagctctaaattttacactataattttaagaatctgatcggattaggatcgggctcttttctattcatttttaaactagatttttatttagggacctaagaaattgtgaagaaacatttggatcacgatccattaccacccctatatacactcccattgtatgcatacctgtccatgccttatttacattacttgtttacgcacagcagttagtgttgggggccttcggcttccgaaggtcctcaaaaatatgatttaacaatgtttctagagcatgatacatgaacaggtaccttcagacttaggtcaaaactacagtgtgaagaagcacaaagaatacgaaggatggcgcagagccgaagctacgcgcaggggagcttcggcgtgataacagaaaagcgaaccgacttaaaggggaaaaggctatttggacccctatggattgttatagagttattagcaaatgtaaagggcatgagtgtaattttacatgggctgcgtcccgtgcctataaatagatgaacagtgttcctgtacttttcacgctgacttggcatttgcttttgtgtcacgcttgtacccttaccttctttcaagtcgaaggtacatttgtaacttgatatcatttctatttttctatgataataagataggaatgagttgataataatatataattattcatgtgtcttttacatttcatatgattctcttttcattatcatatactgcactgatgaaggtatgtccttcacaaccttcgtccgaagatcattatgtcctaagggaaataatgcctcgaaggacgagggtcattaacgtttaacattttttgtgttgccttgttcttgactcatagcatttgagaacaagtccccaacattggcgcccacctccggtgaatcctttttgaccaccttcggcaagcattgaccttcgtc

SEQ ID NO: 8255 - DNA, 240 bp, Zea mays
cgtccgtcccgcccttccggcgaacctgcattgcagcacgcactatttaaatttgtttccttctccttctctccttttttccttttggattggaagtgatcaatgccagctgcttccgcgccgcaaggccgcagtgttgacattctcatctgaccgcgatctctggctttgttcatccgacgatgcatgtccatggatggcgatgttcattattaggagtgttttgtcagtaaaaaaaac

SEQ ID NO: 8256 - DNA, 1022 bp, Zea mays
aggcaaaatctacttgtcctccacctctttaattgaaattcaatatatagttctacaataaacaagtaaaatgttgaatacatactagctacttgccaccacacattgtttcaaccatgatttgttagggctcgagactcaagagccacaaggtcgaagactcacagcgcagctattgccgtcgatcgtagaatcacggtccgctttttaagctgtgtgggctatagggttgtcgacttagctcgtctagctcgcgagctgctcacgagctagctcgagccagctcgttacaaaatacaaacgagccaagtcgaggagttatcgagcttcaagttttttgtccggccctagacacaacctaggggagacatggcacctaaaataaatatgcagttaaaatgactaaaatctgatttaatatttataaccaataaaaatgttttaactaaaaaacttaaataaaaacagtgttatattttttaaaaaaacgatggcctatgtggctatgtttctctagagagcttagattttaggaaacgcgcgaagtccgtcgacccatctaaatttgtaatttctttccgtacgattttcaataaagctcaaggtgtttaaattttttaaaaaataaagcaatctataatttagaacggatgaaggagtatatacgaaataacaaaagtgctatatttatccagcgatccggtgttgctgcgagcccggtctccgcggccggtagttcggatcggaatttaccgcgcgctctcctcccatccaccattgcccctctccccctacccctgcacgcgcgcgtcccaaacaaaccacaattgggtgagagacggagacggccatggcggagtcgcagacgtgatcgccgagcttgcaccttgcagtgggttggtttcgcttgaaagagagcggataggatagctgggtaagaggaggaggaggaggaggaggctcagttcagttcgtgggccggtcgatccaatccggcattacttatcgatcgatcgatcatc

SEQ ID NO: 8257 - DNA, 165 bp, Zea mays
atcagaaacttaaacgtggggattctgagaacattaaggcttcaaatggtatgtttctgaaccatagtgacgttgacagctccaagccaccagtggttgaactacttggagagttcgtgcttgcaagtagctcaagagaaagatctaccaagaaattgtatcaga

SEQ ID NO: 8258 - DNA, 1500 bp, Zea mays
ctttcttattcaatttaaataagaaagaaattttagtccctctaatcctctccggtattttagctcctaaactagtccttagagtctaagaccacctaatcaatttattctaaagcaaaccagaataagggaagaggggattttccttttctttgttcacttattttaaaacaaaattcaaaagattttggattttatttaaatttagaaccaagtacaagtaaataaaatacaccatcatgaatgcatagacatgcttctaaccttaagttaattttgatttaataaaacgtcattccgctcatctcatgctcatataaattcataattaaactagtctcaatgatacttcaaatagaactagtcttatacaaatagggtgtataaaagtacattcatatagataaatgttatgtgttaatgctggtgtgtggcaacaacacacaaattattcaataaagtgtcagtgcataatgattacattaatataaataatatatattactatccactttaatatatcacaaaatctttagtaaaagccaatacattgttgaggtgccacttaaaggcggatgtcgtggcttgggtcatctcgacaccacccatctcatgcagcgtgtcacggaggtggcccatggtgtccgctaggttctccagagagtcacgtaccgattcatcgtcgctgaccacaatcccttcatgttgccgccacaccgggatgttgccaccggaccatgtgacccatctatgaaaaagcggcacacaccagttcccgttggctccgcggcggcgcaagccctcgtacaacgccaaactctgctcgtacaacgacgatgtgcaagggttatccagcagagttggatttttgggttgcacatatacataatcaaaaaacgtatgtggttagctgtcatatattatttttgttgtcttattcaattacatgcatgagagtttatccgtggtacacactctggttgttagacacaggaaagaccgaaagaggaacaaatttatgggggtttgttttctaatgactaatttttagtctctttattttatttcattttagtttatagattacaaatatagaaattagaataaagttttagtttccatattttataatttataaattaaaatagaataaaatagtggaactaaaagtttaacaccctcttacacggtttatgtatgcgcgcacgatggtgacggtaaaaaactgattcacgacgacggtaaaaacttcagtggagaagaggagagaagagattacggttcaaacctcaaaaatatttacatgttgcgtcagataaataacccgccccgtcgccgccgccaccgcaacggtcggatactgaagtactgaacggttcgagtttggaacacttcattccgccccgtccccaatctctccatctccggctctccaccttccacaaatccccaaatcgccacatcaaatcgaatccacccaccacggaccacgcattcgcc

SEQ ID NO: 8259 - DNA, 230 bp, Zea mays
ggcccggggttagatgttgatcaatatattatcaacatatagattcagcttaaggatgaacagtggaatgatttgtgtcccactcccagtcacacaatgcatggcagctgctgatgctttggcatgtgtgaagtttcagatagattgttcaagtcaccggagcacggcatggacttcagccctcaaagaaagagcaggcgaacgcgatcccgtcagcttcgtcgaacacg

SEQ ID NO: 8260 - DNA, 1500 bp, Zea mays
aggatgggatagtttttgccctgtcttttgctcagacagggacagagagcagaaaaaggacaccgtttcgtttcgcaaacccacccacacccatccacacacccacacagcccacaggggaagacgatacaacgcgtggctacgtcagagctgtgccatgcatgggcagactttccggcagcagttggtaggtactaggtactaggatagattaggcggagatcgatatgcacgaatctcattccaattccaacgccaggcaaaaagttgttgctgctataggattaggcggcacacgaactagtagagtttagactctaatctacctcgtgttctctagcgttttggaccagcactccatcatcgtcctcgtcgtagcttgcaaagccgtcgtgacgttgacacttggccatgcatggcatatggcacggtccggctaaaacagcggcgacgcccagttccgttacgcgccccggctgggtttagctaggccataccatatcgatcccttgcttgcttttttttacttgccctttccacacaagttgcaaattaagcgtcacctgcggacctccgtttttttttacttgccccagacgagcactgagcagacaaatccacggctcttctctgccatcgaacgaaagttacgaaaccgctctgtaactaactaactactacgaaaactagcgcaagccgccagcagcagtaaccggatcggatgaaacacctttggactaactactatggactcgctaaactattcgtaggtgtgacgctgcacagttatagggtgtttagtttgatgaatcatttcatctaattaaattgatgtggtgtattataggtttattcttcaaatttggtggggtgactacattactcatattagtactaagaactaactattagaaataaggtgatgataaatcaacttattatattttttatagaccaaacaaaaaatagtgagaaacaagaagatgatagactagctcattactcaaatcaaacacatcattactcaccgagtcacccggttgctgttttccctttcagccttgggggagctgttggggactttacgagcggtgacgccgtgcgccccagctaccagtcaccatgcagcgttgtccagtccagtggtgaggtgtggtgttctctcccggtgtttgtcccctgtttgcggcggggtcacatcacccgcggttttggttttgccgcgcgctcaaagtcgttgccagaaccacaagccgcgctcctccaagtcagggccggccatccgtgcgggcgctcaccggttgggtgcgctgcgcccgcgatgccatcgccgtctccccagccgcgagcgcgcgcgcgcttataaaacgcttgcctgcccacctgcgcttctccccaactaagcctatctctctctctcttctctcccagaccttccctccggccagcctcaatctcccgcgtgagctcctcgaacgcacctctctcgatccgactgac

SEQ ID NO: 8261 - DNA, 668 bp, Zea mays
ggtgcttggccctcgtgtgggcttccctttgcgtaggggcaccaacgaggattagtcggtaccttgcgtggttccggatacctcggtaaaaatactggcgtcatccacgggagtttgcattctctaccttgctctttaccttccacatttatattaagtatttaagtttcaatcttgtcttctagttagattatttaggattgaaacttagacattgtggtagagatagcaacacttagacaaaacctagtttgcacattctagattgtttatttgcataggttttgctctagggatttatttgtggccaagtttagagaaagttttagaagtcctaattcaccccctcttaggtgtcactgtttccttgaattggtatcagagcctggtttggctcatttgaaacgttttagcttcaccgctaaaagagccgacgctttttagagaaaggggatggatacccataggccaccatacttcgatggcactaacttaccatattatagtgctagaatggcttgttacctagaggtcgttgatctaggtgtttggagagtcactcgtgataggatgaaaccacccaagaatcccgaaaacccaccacgagtgaggaaaaagaaatacatttaaatgctagagccaaaaattgcttgtatgaatctcttagc

SEQ ID NO: 8262 - DNA, 963 bp, Zea mays
atatatatcaaatattatacgaatctattagcattctaaaacgaatattattttggaacgcagggagtactattttattacggagcagttatttatatcaaactcattgaactgcttattcttttatggaggctttttttagagaaggtactttcaacgacgatgacacgtaaaggatgatgtcactcgagaaccggtgatcctctacgctggctggcttctacggtggtacccttgaaactaaaatattttgactgcacgcatgcacaaactattggccatgtgagcatcacaaacgtgccatagggatacgcggcacagcggatccttctctgcatggaattccttctggcatgcacactgactcacctgtcagctgctcagatcgcttcaccgttatctctttcactgtactaaactagcaatagtttaaacatatgattttatttatatttacgagcatgagttggtgtctgtttagatcgaataggcaagttactagtcgaactaatattttttgtggaagttttgctgactacagtttgtagagacgactaattcggtccatccgtttagacgccctaaaaaaaatttaaccattcatttcaaatttaaccattcggcggcttcctcgcctgcttcacgtttttggtgcggctctgctatgtgtagcctgcattcctcgcctacttcatgtttggtgcggttctgtatactagactgtagtgtaggcaggctgcaggagacggagccatgtggtgtgtggacccgtgcacttcacgtgaaggcaaaataaataatagttggcatcttttgccacgggctccacttgtattgtatcatcagcctatcctagggcacacgtttgggctataaatacacgacacttgcatcatcgatcagcctatcctacgacacaagcaaagcaaagcagctcaaaaaactttagccagctatcaagac

SEQ ID NO: 8263 - DNA, 263 bp, Zea mays
  unsure (1)..(263): unsure at all n locations
ggccagcccagctggggatctctctcttctctcctctcctcacagggcgccagggcagacgccaattgttgccagggctagaggaccagacggcagactaggagtaggctgtcctgtttccgttgtccgcccgcccaaccaccacaccctccccccggattataaacacagcgcctctcctcacnctgcctcctcctctccgtctgcgttcctgtcgtggcccacatctagccgtcgtcgtcgtcaagaaaggaggcgccaca

SEQ ID NO: 8264 - DNA, 654 bp, Zea mays
ccacaaagcttcttttcttctactgaaaataggatatgaaaaataccataagcatcaaggcatcaatgtacagatatactagtgatgggaagcacaaagtacaccgagcaccaaattatccaagcatggaaaaggtctctcactctcaatcgttttttactatttacttttccagaatgttataaaacacgcgacatccagtttttacccacccacacgggccagccactggcctgtggccaccgcactcgttccaactagttgggccaaaaatccggtaactccgcgtcgtcccttccctcccggcttccagggtccaggcctcccgcctccctgcacagcacagcacagcacagcaccccgcatctctccccttcctcaccaaccccgccgcctccgacgttcacctcggcggccgccaccggcgaggccgcacctcgccggtcacccacccccgctactcgatattatatcctactccgaggatccgcgtagccgcctccggctgcccacccgcggaactctagatctccgataccccgcgctccctcccgccgacggccacccgaccggaatgggccgctgtcttcagtaaggtctaaggacccaagggaaccctcctccgccttcgctcgtgcgcgaagcgcggccgcg

SEQ ID NO: 8265 - DNA, 841 bp, Zea mays
gtccggtggcactgtgacccatctgagtatattgtataatttagcaaaaaaatatgtagttctaaggactcaaacacacaacctaatgtataagagactaaaacacatacatctagccaatgcagctgtaattttattgtgttatatattaaattcttatacttaatatatgtaaactattattttttaaaataaaaaatgtaaccgtatcgtgcccgtaccaacactacggtcgagatggtggcctaggcacgacactatagccgtgtcgtgccaggcactggcactatactagccaggccgggtcgtgcctagaccgtgctttttcgtgtcgtgcctaggctggcccatcatgttagtgccaaatgaccctctatagtaacaccgtgacatgttcatgatacagtcaaaaatccttatcttataataaataatccaagcaacaattaatgaatacaatatttttacagaaacgtaatattattgttcgggggtctaagcgtgtagcatgtggagaaaactggcctgtccttgcaacacaacaaaagctggtgatataaagaactcgagcatgcagttggtgggcggtgcacatctctttaacccattgactgacctcgtccccaacccaaccctggtgaagctgtgcgtaggatcaatcaatctcaatctcaccttgggtagagaccgcgcgcagccccagccccagcctcatggccgacggggtgttctataaatagagttgcttgtcccctaccttcggacgcacaacacaagagctactactacagctcctcatctcaagtgtgtagacgagacagagagacactgagagagcgcc

SEQ ID NO: 8266 - DNA, 279 bp, Zea mays
tagtttaaatagctaatagctaaattattagctagagtgtttagatatctttagctaatattagccactaactattatctctaatacattcaaacacccttaatttttagtcaataactattaactagtggatagtggggtcatagtggatagtggggtcgcgctcgtcccggaccggacctgcactccatccatctccagggaccagaactagggtttgcgaaatcgtgacgcgagcacttgaagattcgcgaaagacagcgcgaccgacccacggcg

SEQ ID NO: 8267 - DNA, 369 bp, Zea mays
ggcttccatcgacgcctctaagctcgacaatgaggagatgactttaatcatcaaaagctttcgccaaatcctcaagcaaaggaggggaaggactacttgcttcgctccaagaaagtttgctacaagtgtggtaagcccggtcatttcattgctaaatgtccattatcaagtgaaagtgacaagggcgacgacaagaatgggagaaggaaggagaagaagaggtactacaagaagaagggcggcgatgcccatgtttgccgggagtgggactccgacgagagctccaccgactcctcctccgacgaggacgccgcaaacatcgtcgtcaacaagggtcttctcttcccctacgtaggccacaagtgcctc

SEQ ID NO: 8268 - DNA, 1318 bp, Zea mays
ttgagatagataatattttaattattaatctagaactaagatataatagtatgtatctagatgcatagaaaaaaaaatataggctaaagcaaggtctcgacctccattccaaaataaaattcgttgatttatacaataattaatctatttattatatatatatctagatttattatcattctttgaatataggtataaaatttcaagagttaaaatgactaatattttagcaaagaggaagtatattcttttttctttttgacagttttcttctcctagcattttcatatacgacaataaatccgttgcttttgcggatgaaagtttctgtctgaccgtttgtagttgtagcatttgttttcacatgcgaagaccaatccgttgcttttgcggatgaaagacaccattttacgcatttatacatggctcaagaactaactatgttctgctccagcaatttcttgcataaatttcttatctttttttcccgtgctgtcgtggtcctgtactgtatactcctgtgcttggtggtttggctcctcgggatgttcttcctgtcccctccggaccaagagtccaaaacccaaacccaagcacccaaatccgacccccccaaatgccttctctgtgatggtctgattctgatggatgctccccacctgctctagcggtctagccccagctcgcgccgcctcgcttcctccgttcgcgacgccggcatttcgtggccggcggcgccgccttatcctctgccattcttgtgggcaagataagcagcgggttgtttttctttaccgttgtttctgaaggtttcgcggccacttccagccggatcccggctcttcggacgccgccgctccctcggcctggtggagctggtggagcggaggggaggggcgatccatacggaggtggcggttccatttcttgttttcctggtgagtaatcctaggttgcttgcttgtatagatggttcttggtacttctgtcctgacggactgcggccgcgagcagggagtccgaatctttctccctttccgcgcaaatttacagcaccgatgctcgttgccaaagcgtggggtgcggtttattgttttccctgaaattttgtggttcaatgaatggctgaaccagtattaaatcatcaggcaggtctacatatgctatatgcttatctttaatgttgatgagttgaagctttgtgcttggtctgatgctctaaccaggttttgtttatgtagattgcctgagtaattgtggacatgaagagacttctgtggtgctgttgaagaattagtgccagtctcgatttctcctg

SEQ ID NO: 8269 - DNA, 441 bp, Zea mays
aaattgatgtcaaacaaacattaacaatatcgtataaattgtttctaaagagtcattatagaatttttaatgatatgttaatatgtcgaccatcatatattaatctaatcttaggtctctcttgtattgtatgtttttgcagtcatgacatatagaaatactgtgataatttgatgttatatagcaaaaaaaaaatgtacatttccaagcttaatatctttcaatgttacttatccaatcccacggtgtacgataggcaaagcaatatctagctgcgtccgatcgatcagtcacacggtgtacaaaggtcccttggtcaagtgtaaagaaagaacaccgataaaacgccgtcgaactactccggacgggaagcacctccaatcccctcgcccccacggaccctcgccgccggggaagcgccgctcgctcaggaggacagcc

SEQ ID NO: 8270 - DNA, 418 bp, Zea mays
cggactgcaggcagaactgtgcaccaaaaaagtgtgtacgtctatactatggtcttatatagtagtagagattcgtggggctggtgtgggtaatttattgtagtagagaaatctcagaaacgtgcggaactgcgaacgccctgcgtcctacttcgtctatgctttcacaactcgctgaaaattcaacgattccctcctcgccgtcaatcctcccacaaatccaacgcctgcagttgacgccaactcatcgatccgcgccgcacccatctccaccaatatccttccattgcgctcctctacaaaagctcccctcccccaatccaccccattccacaacaccaagaagcaagaaaactagaaaaggctcctcccgaccgcaacgcccctcatctccctcgaccccgacatccccgacccg

SEQ ID NO: 8271 - DNA, 819 bp, Zea mays
actgaacagtgcctgtccggtgcggcaccggactgtccggtgccactagaggacaaagcctccaacggtcagaagttctcaaaccctaacggttgggtgacgtggctggcacaccggacaggtgtccggtggcgcaccggactgtccggtgcgcccatcgacagcagccatccccaacggctatgtggtggttaagggctataaatacccccaaccaccaccactccatgcatccaagtttccagcacttcacattcaatacaagagctagtgcattcattcctagacacaattcaaaagaatcaaagcctctccatgtcccaaattcactccaaacacctagtgactagagagagtgttttgttcgtgttgtttgcgctcttgtttcttggatcgctttcttccttcctcattcttgtttcgaagtgacttgtaatcaaagcaagagacaccaagtgtgtggtggtccttgcggggtctaagtgacccgtttgattaaggagaaagctcactcggtctaggtgactgtttgagagagggaaagggttgaaagagacctgtctttgtgaccacctcaacggagactaggttctttagaaccgaacctcggtaaaacaaatcaccgtgtccatccgctctatttcttggttgatttgttttcccctctcttttggactcggattcatttctaacgctaaccctggcttgtagcgtgtgcttaagtttataattttcagattccgcctatccacccccctctaggcgactttcaattggtattagagcccggtacttaattagagtctaacactcgaagtg

SEQ ID NO: 8272 - DNA, 722 bp, Zea mays
tctaagtagttagcttcacatataagctcgctttttcaacaaacaacaactataccaaacagggtctatgtcttagtttatagaaactagattcgagtttcttaaaaatcaagaatctactctcccgatctcccctagctaaaaccaactcttgtttgtttaattacatcatgcccttattgatttcatagaatttacatatattgtcaccacttttttaaatagaggaagggtatgctaataattgtgtataaaaaaactagaaactagtttcttagaaattaagttccaaacacattcacccaactcttttgattaaccagtttctagaaactcgaaatagaaactggtttttaaaaaaccagtgtggtttcaaacataccaatacaaaaaaatatttattgatggtaaataaatttgagccgaggaataaaaacccacattcatggaccgcgaggtcagtgccgtgccaaatagggccgcaaactatcggactcattggaaggcccgcgactgcggctgcgcctgcgcccgaccaaacgtaggagacccatctcctctcttttctttccaagaaaagtcttctcttctctgtctcagcgccgacgcttcccaactccttccaatcgattcttcgtctcgtcctcgtgtaatccccagcttgccctcctcgctcttccctcccaaaaccctacgcctccctgaccaagctccggggacga

SEQ ID NO: 8273 - DNA, 826 bp, Zea mays
tgtccagcctgggcaccaggacctctgggggcaccaaaactgccctggcggcgctgaccaggaggggtgacgcgctctccaggggccacacgttcgccggtccagggattgaagccctagagaacgcgtttgtaggtgctggtgctgctggaggtgccgccggaggagttttggaagggctgctggccacccttcttggtgttaggacgccgaccgccctgcagctactgctgttggtgaccgccaagagaggaggcagtagccaggagggcggtggtggcgcgcactttttcctcgttttgcaggcgcaattctttgaggaggagctggtgccgggcggcagcgagggtgaggggctgcgtcccggcgatgttgtcggtgacgttggagtagacctcgttgagccctcgcagcaggttgaggacaaggttgggttcagagacgggctgcccagtcgcgcagttcgtcggccttctccttcatgcgaacgtagtaggcgtcaacggacagatccccttgagtcatcgattggaactcgtgattcaagaggatggcgctaggagctttgttcgcctggaacaccgtgccgatggccgcccaaagggcgctcaccgtctgcttgtcgtcggtcatggcgaggttgaggacggcgtcggagacggtgctgtacatccatccgcggacgcagaagtcagtctgcagccaggtctcgtcggagtttgaggtggaggcggtggcgagctgatgtagcagcccgaattttccacaggtggcctggaacaccgtcgaccacttggtgaagttagagggcttcaactcaagggtc

SEQ ID NO: 8274 - DNA, 368 bp, Zea mays
gttaaatttaaaagaagtataaagaattcttttaaaagagacgaccatggaaacaaaagagtagagagtagagaagagaggagatatgtggtgtttgattttctgacctgggtaattttttatgctgtcaagcagttggaacttgaaaaccttgaatatgaatatgacaaatggtgaaatgggagtagcccgctagcccacgtaagcacggtttcagttcaaaaccattctccactgttgctcctgtcctgttcctccgcttcctctgtctctgtctcgtcgtctcccccatctggccatctccggctagggtttgccctcccaccacgtccgaggtctagctcgtctccgccactgccggaccaagg

SEQ ID NO: 8275 - DNA, 550 bp, Zea mays
tcggcccaagattctgaatgtactgtatttaggtcacttcattcaaatgtttctcttccttaaaaaaatggttatttcagcagtattcggtgtatataactatatatactgaggataagtgtgtcactttagaggatagatattctgactcactgtagagtagaaaaatgttctgattgactgacacaacacacatgtaaaacaaaggattgaatttatattcgtccagtattgaattacaaaatgcgagctgattgtgatatatcaagcacagtattgaattacaatcaaatacccggctttttccagaatgaggatctatctacattttttttctaagtcacacttacataattgacctcacggtgtaggatcagcagatgactccaggaatccacggtatggtatgtgcacacatttggtggcatgtgccggaacgccaaactatactgttccgaatagcagtaccatggagtaattacagactgaaaacaacatggatgcactaaaataatcttcttgtataactcaagcatcatgatggttgttg

SEQ ID NO: 8276 - DNA, 1441 bp, Zea mays
ggatggatggaataataaaaacaaataaaatggagtttatggtcactttgccgagtgtgacactcggcaaagaaagcacacctggaaagtgggaaccggtaatgtttctttgttgagtgcagtcgtctggcactcggcaaagaagctccctttgccaagtgctggacagcgcgttcggcaatgggactcgcaaatggattcactggtgctccctttgtcgagtgtcagataggcagacactccgcaaatgagctccctttgttgagtgttagtttgcggctctcggcacagaggctgctgtaggggcccattgaagctttttttatcgagtgctaggccagcaggcacttggcaaaggctctgtatttgatgagtataattgagtacactcggcaaagtcgccgtcaccgttaccatcacttgtcgtcgtcacgacgacttttcagtgagtatccggtataatgcattcgataaagagatatttgtcgatgtacagttcatcgagtcctctttgtcaagtgtgttttcgaggttttgccgagtgcttacggcactcggccaagcattctatttcggtagtgatagctcaccatttgagatggcttataaatacattgtttaatacctgatcggattatgttcttcgagatggattaattaatgggcgctgtgctgttgtggaaatagaatatgctggtgtatgtaatccaccaagatttaaacgcatgtaatattgcaggtcgattaattatatggggattatccttatactcgtagacaaaggaatcaaacacattgctgggttcccaaatcagcgcccgatccgtggcaatctcttcgttgtcggcctaagctaacaacgaaatcaaaataatttcggcatggtatatatatatgtattgaactgttggtgcatgccgccagcagtgcacatgctgagcgcagattcgccgctacatttttgcgtcactgtcgggcactatacgttgtcgttttccagcacgtcgatccatctgtcacgctgggctagtgtcccggccgtgccaccgtttgaccctacaaagtttgcctccacgaagaatcgttggaacatgcatgcatgagcgtgttgtttggagtttgcatgcgaatcatttggtccgtcaccgtcgtttgatcgatgtttttgttataaaacaatgtgattgcttgggtgggattggaaaccggccaaacgaacgaaaggggtcagaacgtggagccacatccatggcgtgtccatccatccattatatatatatgatcgccagcaggcagcaggctcattcttctccgtcctggacaccacacacacacagcttccctctcttccattcttccattagccatccagtcaacaagtcgtgcgcagcgcagtggcaagagctagctaggagattgatccggcctagttctgttcagc

SEQ ID NO: 8277 - DNA, 118 bp, Zea mays
agtatccttattcactttctcaattcttgatgcccaattgcccactaggcaccattagttttctgtactgttttcctagaaatggcagataacattctttctttgctgtgaagaagta

SEQ ID NO: 8278 - DNA, 407 bp, Zea mays
cattcactgcgtgccctgcacagatgtgaccattttgaaaaatatactgataattcctgggcgtccccccccaatgggtgtgggcaagggacgtcttggtacgctgagtgttttagccggctgcttctgagtagtaatgtgatgtgacggcgagtgtaatcatatcctttgcgctgttgactggagtcccaatgggtgtagagttgcatgaaacggcgtcagccgcctgacgtgtcttcagacgagtggaagtgcttattgaatgctttgcgactgttcagtgaccgaggttggaggtgagcggttgccttctccctttataaataacgtcgttgcctttctggttttttcacatctcctcgctgtcctttactgcttccttctcttctctcccgtctgcttccgcc

SEQ ID NO: 8279 - DNA, 798 bp, Zea mays
ctgcagttttgatagcaagctattatagctacagaaaatgtgacccccgaggcagttaggaatcaaacatgaaagatgacctagcttgatgtctgaaatttcaaggacacagaatggtttttttccagtgcttttggttccttccctacgagcaaggtttcatttcatgtgtcagtgtcagactttgttgccattatcaaaacaatattttttagttcaggtactcagtgaaaaatgtctagtgtattgcttttgcccctctagaaagagcgctatgcttgttcgcttggctttaatctttaccgatttctactgcttttacagtgtttttgtctttatgaattacagctgcagcagtccaaacagccggctttagttcagcatgcttgtttctctatctctaccgcagccactaagataattttcaaatttggtgatatttatggtgtaagagtttctttacccctctttctcttggcaatataaaaaatacgcagctctcctccgtgttcaagaaaaatgatctacatacatctctgttcaagaaaatgatctacaacagttcagatcctgtatgtaggcctttacaaagtggaaggactggcctaccagtttattccttgttctcaggactcacgggcgacaataaaatgctcgcttccatggtggatccaagtcgccatctgcctcatccagtgcaagagggagatcaaactggccacagcagtctcagaagctagtcaaaactagtgggaggctgtgtgcacagaactagaaaagaaaaggcttggagatcga

SEQ ID NO: 8280 - DNA, 192 bp, Zea mays
cctgcatcagcgggacccatgggttttgatctgcagcgtccaatgacaaattaacggttcagattagctatgacccacaagacaagtctgccttcgtcgtcctcaaccctcgtagtcatagagcatcagaggcgccgctcctttcggatctgggcgaggtgagctgcggcgccggacgtcgcggggaagagg

SEQ ID NO: 8281 - DNA, 49 bp, Zea mays
ttaagtttacaagaattgtcttatattttggttagtatattagacactt

SEQ ID NO: 8282 - DNA, 969 bp, Zea mays
tgggtcagatgtggccgataaagatgaaggcaagaacaatgtcattggcgatcctcgcacgccaagtcagttacaaggagtggttacttgaaaggctctgaacaagagaatgactaataagactcaaggccctagagggcaaacacgaccggatacccgattacgatcacatgtcttgtgtacgcaggacggtccgggacctaaggccgatcagtctaagaatgaccaaaagcaacaacgacctcagacctttagaccatgacatctagaagaaggtatatgcaagcaaaatacatctaaagcatctgactgactcgttagtgctagcccttcttttgaacaacttctttctaagtatatgaataagaaggtcgtttcacacaattgatcgacaaaacgatcaatatcatccacaacgaggaagcaatccatgcaagggcaaaagccgaataaatcggcccaggaagtggtgcaaccaatgtcgcctactcatccgctctaggaatgtcgtgttactttccaccagtctactcatcgatgatgttttatcctgctaacatgtgaaaaagtatgacgatgaatccgtattacacaggggcggacgcagagggaggcaaagtgggtcatagccacctcaatttttatgatattttatatatcatgacgtgcagtctctttgcaaccccggccacattaattaatggactccaccgacgagcgacgagtgatggtaccggccgccgggccgggccaacccaagtggaaaaggccgacgactcccggacgtctcatcctcaccggacgccaccaacccccgccatctccagaccagacgtacgagccgcctatttaaagccctcagtctgccactctcatggcaacgcaagcagaagctacaatcctaaaaccatctgcttcagccttcagctagccccaagtttagtcggccgatcgatcactgaagtagta

SEQ ID NO: 8283 - DNA, 467 bp, Zea mays
ttggcaggagctgaaggctacccaatctctctctgcaggtttcggtggagagatcgggtggtggtcactatcttcgcctcatttcgagtagatggagcgtctcatggccaaatcgggcatgtatggcggattctgctactgtctgaagcagcgttgcctgcagatctgaaagtcacttggtctccttgcccagttgaccttactgaatgacattgctttccgcggtttgactgtcattacatccttttcggtgtctgatcaaaaatttttagcacgagatgacgtgcttctagttgttgttgatatcttgtcctgagttgagtaaacctgaagctggaaaggagcggatcacattcgtgctcttgctcttgttgacttctaggtctatcttagatacctagaggctggaaggggtcagatccagttcctgtggtcctagtaacaaggtcctcttgggggaaggcgcc

SEQ ID NO: 8284 - DNA, 124 bp, Zea mays
aaccagaggactcttggcggcatcgagacggcttcacgtggtccggcgaccaacgccaggaagtccgctgtggcggcgcgaccggctccgcctctgaggagggcgctcagcaccattgaagagg

SEQ ID NO: 8285 - DNA, 676 bp, Zea mays
tttggtgctccacccctattgatttagattctagatatttacccgccaatttgattttaaaagttgaatcaaccacactctcaataaaggaagagatggaaacgatgcgtttcttcccaacacaaaaccgctagtttttcatcctcttgttttgctgatagactcggtttctaagtaagaaatagttttcttctttatttttctcattgatttgtcttacacgtcaacgtcatcaaaatgctgatactcttagttcttcacggctcagttaaaagaagtgaatacttgggttgacactgaagcatcagtatagccggcatttatattttgccgtgccctcagtttgaccctctggttgccaagaaaacccccgcccagtcagccagtccacgcgaatcgctgcggcctcgctcgttgcaaaccttccagcctgtcttgcctccgctcgaggctacaggacacttcaccctctgccgccccgcctcgtcgccatcctccacccgctatatatagccgccctcctcgagtcttcctcctccatcggccatcgccgtctccagcagagaagaagaagcggcacagctcaactgctcaaggacagcgcagcacgcaagcgggaccgcaccgaagcagcacacagcacacaagatcacacatcctactgctgcgccgcaca

SEQ ID NO: 8286 - DNA, 988 bp, Zea mays
ttaactgcatttatgatctaggaactcagaattatatcatataatttgttaattgtctcttacacttagaaaaccgaaccaccatctcatggttgtacatgtcctgatagcgtgggttttctagtagttttatctgcattactcacttgtatgtccttaggtcattttaactccaacaaggtccctcaaaatagtttctccataattaaaaccctacatcatttaaaatgttcaatacattaaaaataaattagactccaacggttaattcttaaatcatgtattttagaaataaataatattattaggaaagaaaaagttgagggtgatgcagaaaagaagaatatgatagtaagctatgatgtagtatatttggatcacttcatgatttgttctattttttataaaaatctataaaataaaacactgttgaatctatttttataaattgaaccttatatttgaagatagtgtactgatttaagacattgttgcagatgctcttagatctttttttagggagagtagtatgttaatatgagacgatgtgtgtcctattattatttttgttgcaaggaaaattaagtctagtggtattatatttttaaagtgaactgtaacctcttgattggctaaaatctagattttattgatgttatcaatattgtagatcgtacatatacacgtggacattgatatttgtgttattcagattttggtggaacaatgcaactttgttgtttcattagcgaaatttccaaggcatgcttagtacttctatgtttcagttgtcgcattctagctcataacatgcatgattctccgacctatcatttttccctcgcaaaatgaactagagtattcaatatttcagagtcctgtaactccgttgcaaagagctacagaaatgcctcctccggtgttcaaccagatattgatgaatcaacaataggaggattctgatggcccgcctcaaaagaaaattccc

SEQ ID NO: 8287 - DNA, 1500 bp, Zea mays
gtgggattgggcccagacagcgtttcctttttctttcttcttttctttttatttttattttcttttctctattcccaaactcaatttgaattcaatttctttttaaattcaacccttgtgccaaatttatcctctaattatactgtgaaattaagaagtaccaactttggaaatatctaaattttctttatattatttactctctttttctaaattctaaaatctcttgtatattctaaattccacttgagactttaatgttttcttttcatatgatttattatgtggtcacaagatgcacacaaaaatgaaaaccagaatgatacatattttagtggcttttatgttattaattatttgtttttacctagggtgttcacatgtgatgatgcataaaggtcaaattcacatatagatgaagtaaaattatgtccccttttatattatctcttaccaaatacaaattgggtattacagatattgaaagtaaggactcacttagtatgtttttctgcaaaataataaagtttgattcttgctaaaagcctctccttgattcccaaaggccagcatatctttgagagtttttctttagtcgggtaagacttgtgaaagtaccttcgtactcagggttctttgaacccatgtaggtgaagagcctacgaaattttgctatttctgcataaaggttgttccaaagcatgaagaagaaacttaggtatgaactcgtggaaggtgtttacttgcactcgaacacctatattgtaataattactttcttcctatattgttacttaaacatatgaatgtgaattaagttattataatcttttctgctatttctcctattccgatatgtatgttatgtctgtcagataggttactcgctcttgggatgttgaaggaggaagaagatttagatcctgttaagttatttagtgcacatgcatagctatctgtgatctttgagacaaggacatgttcgtatggacccgataacttggcagagaccaatcgtgcaaattctctattttacatgatctactatggacaaatccatcaactacttgcattctcgagactcatattctatctcgtgtccatcaactactaaggtcccgtttggtttctttaaagggactaaagtttagttaggagactaaaatttagtctctaccatgtttggttttagagactaaaactattcaaaaacattaaataaatcataagagtactaaaacaatttagttcatattttagtttcaccgtttgataatttagtaattaaatgagacaaatgctcgaactaaaccgtgcgaagtttaagtgaccatactggtgatttagtaattaaataagactaaaatactcgaattaaacggtgcaaagtttaagtgaccatactggtggacaccgtctcaccgctactgctaggatcatagtcgtctccctgtcctcccacctctgcccacggtccacgggacgacatccagtccagcc

SEQ ID NO: 8288 - DNA, 1500 bp, Zea mays
cattctccagagttcgaagaagacgtagaagaaatgtccgcctgccttacactccggtcaagtctttcttgcgttgcgttgcgttgcgtcgactctccagttctttgagggcatctggtttatcctattctatcctatcctatcatatcatatactccgaatttcccgaccgatcggcacagccatacaggtgtctggacaagcggttgagccttggtagttcacgtgataggcggccggtcgtgcaagcggggacggggagatcacaggtttgtgccgcagcccgcaggcatgaccgcatgactcactcaccacgagcacgagatcttttcctcgcgagtttccgtgccgctgaccagctgtgcgcctgcctcataattgatagacacaggtcatctcatcaaccctgtaggcctctcccttcttctgctctccctcccttctcaaggcttcctcctgcagtccagctcaccaggaccaggaggatggaggaacaaagaagttgcatcgaacacagctgagttcctccctcttccctgaaatgcgcccggcagctagaaaggagcagctagcgggcgggctgcccgtacgtcgttgaggtgagggattagttcgttggttcctcttcctccggattttttttttctgctcgatgccacaatctccgaaacagctttccgattcagcgaactccaacgcgcgtttcgatatacggcggtggatcggaggcgtctcttctccggccggtgatgcattgctttgctcggcctactgcttgctgctcatggtggtagcactagcagctagcgccaggcactcacgcccagcgttttctttacggcacaacttgcggccgatttccaaacacacacacacgcaaacgtcttttctgggcgaaaagtatgccggttggccgtacattacgccaagttgcgctacggttccgatgctgattactggtcctggtcccccaccaccgcgaacgtctacaggataagaccagtcgcctctcgctccgttccgctcacttgtgttgtccttgtccgtcgtgcgtgctttgtgctgcgcgcgcgtgcagcactgcggagacggccgggagcagggggcgcgggagggatagtggcggcctctgctgctgctggtcgaggcttcgattccgggcgggggctggtggtctcgagaatcccggagggaagggagcgagcgcaaaggtgagagctgggagaaggaacatttctctcttgaaactcgtttgtatgcggtatgcggtatgcctaggaagaaggaacaaaaaaaaaaaggaattccaaaaccctctttttcttcgtggtatcttctggttctgccgtgaattcttcgtgtgcggcgaagctctttcttcttcgctgttttttttttgtgtgtgtgtgtgtctgttgttgtgttcctgatgtcgtggtgaattcgtcatgcctgcagatagatacctaagcgggccgcttccgctgcacagccacaggc

SEQ ID NO: 8289 - DNA, 1500 bp, Zea mays
tgtgttcatgatgcgttttttaaggcgagtaatttctaaaagaggtacatatatctgtcaattcatcacatttcatcttgaagttatttatctatgtatgaacaagatcaatgcttaacaaatgaagtctgaaacaaaaataccatccatttccagcttttagtgtgactatgttcgacatgaacaaaactgaatggaactacctgacattattacttaccaccgcatggacaattttgatatgccctacaaagccaggggaggggggcatctcgaagatactccctctgttcttttttatttgtcacattttagttcaaaattgaactagcggatgataaatattcgagggcggaggtagtgcatactaccggctgttcggctgaattttcaaaatcaaaagctaggaatgaaaataggttatagaaacatacctactttaattactacgttattatcacaagggaaataccaaatgccagaggccgggtaattaaagaggtctgtccttctattatacaagaacggaactaaacagaatcccaggatagattaaccaagcaaataatggtatccttccaaattcaacaatttcagatattgatggccagttaagaattacagatattaatctactagcgtttttgacatccactttgtgcataaatcactccaagaagctcccgattcaggtgttattatcaagtaacaagacacgaagagcatagaactaggcatgatttataacaaaccacctctcttagtccatgtaatcattacttgtcaacacacatcataaggattggaacaaatataagggccaaaatttccatatatgtgtgatgaaacaacacagcaaggtaattacgtcgtcgctcgttcacctcaactcacctcattttttcccaaccccctctcggcaggggaaggaatcaaagtagccggaccagaaacacatcatcgggaaacaaaatcgcgaagagaaaacaacatgatcaaaactttatcgcgaaagcgacgtgacgactcgcctccgcctcagtcgaggaagccggtgcggcgcaggacggcattgcggacgcggcggaggtcgcggcccttgagcgtcctcccggcgccctccagcaccgagctgtgcgcggcggcgcggcgcgcgacgatctcgtgcggggggaccaaggcctccccggcgtcctccgcgctgccgccagctcccgccccggcgtgggcccacctccccctccgcgcgggatccgacggtatccgcaccggcgccgacctcgccatcgcggacgctgcgacggtctccgggacggggcgcgcggcggatcgggcgggggctccgaccccgaccccgaccccgaccccggccgcggcgcgcttcttcttcttgccctcatcctccgggagcgcggcaaggaggccgagacctaccgcggaaggggaggcgggccagagcacgtcgagctcgaggaagtcaccgtcggcgcccgcagcggc

SEQ ID NO: 8290 - DNA, 330 bp, Zea mays
attgaatacctctcttgctagccttaagaatgagaatgaaaaattgattgctaaggctaaggaactagatgtttgcaatgcttattaaatgttgatgctattcatgatcacctagctttaattaaacaacaaaatgatcacatagctcaacttagtgccaaaattaatgagcatgacttataaaatgagaaatttaaatttgctagaagcaagctctatagtgggagacgccctggtattaaggatggcattggcttccaacagggagacaatgtcaagcttaatgccccgcctaaaagattgtctaattttgttaagggcaaggctccc

SEQ ID NO: 8291 - DNA, 310 bp, Zea mays
cacggcggcctgcgtgccggaccatgtctaggccgtgctaaggcgtgctgggccatgggctgtatatcgggcccggcccggtttggacatgtatactcaaaaggacggggaagacgaggccgcaactccgcgggagcaacagccagccaaccacctctcgttggaacctgcgactgcgagttccacctccgcccgcccgctcgcccacgctcacgcccggaataggcagttgcagcagccagccagccccgcgcgccccgccatcgtgggaggaggcccatgccgcgggggcagcagggggaagggtaga

SEQ ID NO: 8292 - DNA, 1364 bp, Zea mays
tagacatttacagatgtagccccatcacatgccagtggtggagggtcaaattgatgaacttgtcaacttgtataaacttagttaaaaataagttaagtatataagtaaaaaaaagtttattgtagagtaaaattgttaatctgaatgtttatgccactttgatttgattttaagcgtaggggaatcttctgattttgcggggagtaaaccactaaaggttcattgtttgatttttcattatatgtggcacagaaatatcttccctttgataaaacaactaagggagttctatttttttgacatcagataaaaatactttttcacctttcctgtttgtgttacatcctatgtttatcagaccatgctgttctagttactaacttactattgctaatcattttttttctcctagctgaatgcattatcgtcaccatccatttgaataataggatactgatgcagggctcaaaagttatggctaacctgctttccttttgttttgggtgaccgaaacaaagtttggtgaacacttcacatgccatgtgactcagattagtgtcatagcattctttggcagcactagaactctagaagcacctttaaccttttttttaagaaaaacttgtctagttgtgttttcggtggctacagccagacagtttggcaaattgcccccattgcggtggtggtgccgtggtgggctgttaaaaaaaaggacatttaaaaactcttttagggctagcgtggcaactccattttctattgagaaatgaactaattttccttgtgaaaatggaaattatcttcggtaagccatgggattgagttggattcttagagaggattttagttccaaactagccctcaatcctatggattctaggagaggattcgagtttccaaactagctccggtaatccaagggatctagtcagattttcggagaggatttgggtttcgaaactagccctcaatcccatggattctgggagatgattggagttaaaaatctagctcttacatgatttattacctgcatttgttctttacatgctacagtctagagtatatggtttttgtagggcatggtccagagtagttgctggaggtgtttcccatgcacgttccatgttcaattatacacaatcttatcttgcacaatccattcccacatcagcatgggcattccgcattatctccttgcgcaaactgcattctctatcgcagacagtgaagcaagagaagtttcttatttcgagaatatcataatatctgcatttagcatgagcataacattagcaatcgctctttcttttcgatggatctcctatggaaaaagaagagcagccaagtaaaccgtggga

SEQ ID NO: 8293 - DNA, 1500 bp, Zea mays
ttgtgtctaattgtagcaacaatatattaattaactgtctatgtccgtgattatgtgtataaaaatatgtgatttgtggtgcttttgtatgtatcattaattgtatattattattaataacaactgtaaataggtcaactttctgttggttgctaaatgtatagtataacaacccataatggatcgctaaatgtataatacaacaacccacagttggttgttaaatatacaatatcaacaatagacggccggtcgataaaaagatgtcggtcgctaaagtcaagtgacatatttatagatcactaaaggtctttagcgaccaaccgttacgattttatcgaccaaccgtcatttactgtcgtgcctagttaaaaagatgcctattgccgcctggcgcttactatcgccccttcgctagaatctgtgaatcctctagagtgttgcgcttccgaccttggccactactgctcactcgctgcggtggggcagggtggggcggcgacggtgaatcaaagcttgaacaggtgtgcgggctggtggtgcaaggagcatgggccgaatagatgtgaatagtcctcagaattggtctcaaaaaacttttgaattatattatgctagctcgaagcgtaaaaatagtgattcaggctggatctaaaccatgtcgtgctttcgtgggccatgtcggcctatatatttgaccacataaaatcaaaattttacaaccacataaagtacataacttaataattaaagaaattaaacaatatgggctttattgagccgtgtcgatccaaacctggcccatcggcgcgggccataccgggcttgacggacaacaatttgaggtttggcctagacccaccggaccgtgttagcccgactcatattatatcgtgtcggaccgtggtttgaatttctattttttggcccatgcacggtgacccgaaaattctgacccatattcctagcactggttgtcaaacatcaatcagttatcatctgtctcgacactgtaaatggtgctctattattttttttaaaaaaaacaagacactgttggactttatttttccaagtcttgcatttattttaatataaggtacttgttagggcactgttggtgagtcacagattcttgtatcccgtcttcattactcgtaaatacgggcaaacaaggtatacggatcaggaggacgaatgccgtttgaagtttgaacacgcatcgcgcttcgtcaaatgaaaaccctggcggcttcaacgcggctggtgtggcggcgccgtgtccggatctgtgtctgtgtcatccctgagctggcgcgtacgggtattctctcttacggtcttacctctcatgccactgctatataaacatggtaccagacgcatcacgcatgcctcggtcggtcgaacaatcttcaataacccagtcggcaggcgtgacccgatgctctcgcgtcgtcggatcgtcgccaccgtctcctccgcgtcgcctacaccgac

SEQ ID NO: 8294 - DNA, 868 bp, Zea mays
gtggacttgtggctttgtgaacttttgtgatgaatttgttatattgtgtacttgtgatctttgtgatcaatttgtcatattgtgaacttgtgatctttgtgatcaatttgttatattgtgaacgtgtgatctttgtgatcaacctgttatattgtgaacttgtgatatttgtgatcaacttgttatattgttaattgtgaacttgtggtctttgtgatagttgtaaactttgttgtattgtgaacttattatattgagatattttcatattgatagggttatcgattgtatttaaggttccgaccggtaccgatgtatttttagtaccgaacttttgattccgatgtttccgaaataccaatatcgtttcagtttccgaattttccgtttctgatttcgtttccgataaaaaatataaaaacggtaacaattttagtgttttccgatcgttttaacccctatctattcatatatgtacccatatataatttttttacctattagtatatcatagataaaaaatcattatatatctttttttatattgggtaaaaccggttgagcatttatgtttgagtaaaaaatattatatatctattttttatattgggtaaaaccggttgagcatttatgtttgggatcaagtacaccaagcacttggtagacggtgcacaccgtgacgaccacggctacattcattcagcccacagccctacacggcccaggccatccggaacgacgagtccgcgagaccgccacctagcaagccgaggaggcggcgccaattctaggcgtcttcctccgtcacacccggccccgcaaaccctagctcgccccggccctgcctccggctccgcccatcgctgcc

SEQ ID NO: 8295 - DNA, 134 bp, Zea mays
gtgacacaccatatatagcagtagcagtacaggcagctgcatacgagtcttaccacacttgtcagcaaagcgccggaatccaaaccacgcaccgccgcctcggctagctaacacgtacactagcagtgatcccc

SEQ ID NO: 8296 - DNA, 1500 bp, Zea mays
gaatcttgctctcttcctcagtctctccccccaatctccaatgaaggtgtgcgagacaatgatctgaaagctagtgcaccgacgtttacgctaaatgtttttttttctcgtttcggtttatttctataaaccgttcctaaatcaatactacctctctttttatttcgatcctgcgctgactgtttttttttcaaaatcaaataacagaagaatctttatcctttctccatttccggcaagcggcaggtgttggtaggcagcccaattcggtgcgtgttcggattttgctctgctcctatctttcctaggttgctttgcttttatcccacttccaaaagattttatgtggaacaagcgctaatttcaaaatttagcatggacatctttttcttgttttcacatgatctctacgaacttcccgtgtcagatttcataatttttcgtggatgccaacaagttttggctgaaatgattctcgtggccctgaaaatatagtgatattcttttccgcggctactggagtggctgtatcgtcgagtcaactgaatggctcttcccgttatcttagaaaaacctgctcaaaggtgtcaagcgtatgacttgagcaggcctcaattatgtacttgtgtcaagaaggtttgtacgggccagtatcatcactgaccgattcatgaacaatcatgcattaataagttattatgtgatatgtatctcgttttcccacaaaaaattttttgtttgcataacgcaacagcctatctaggggttgatagctaggaaagtcaacttgttcagccgagatgtcaacgtatcttcttctggagaacagaacatacctgtgcaatgcacaaactcttgatctcaagtaatcatggtggtcttgtttgtagttgacatcgtttttcttcttcattcatcagaactaactcttaacacccaaggcaaagttaattattgaaataaaatagaagtcatctatcagacaccagtataatagttaggtcacttggttgttttactttgtttatttaccttcagttattagtgtatcatgatctttgtggtctgccaacaaaatttagatcttttgatgaaaaaaatcctggtcaaaattcttcctaattttcctttttctagagcagaatctgatatgtgtttctactgctccttgcagtgttgtagtctgaagaattcgctggcggtggtgcagcttggcttcctctgcttctttttgacgatcaactgtcagggaacgtaacgtaactacatggtcacaattttgatgctggagcaaggcactcatggaccggacagacacatctggatttgttaccggtggatcagacggtacttcactgctgctgatattctttcacttcgtctactcgactgtgcacctataagagatcagtagacctctgatctcactgtccagaactacactctcctcatcgttgttcgtccaccgccttcgctgaacttttcaagtactttgtctag

SEQ ID NO: 8297 - DNA, 1389 bp, Zea mays
atgagcttctgtggcggtgggtcagttggggtgggatgggcaggacctgatcgcgataatgttcataaaagaataatgggaaatttggatccataccattaaaagatcaccactttggatccataccattactatctcacttacatgtgggtccacatgagtcaatgacatgtggggttcatggtatatatctaaagtttggatcttttaatgatatagatccaattgttccaagaataattttaagaataagatggtaaaatcatgtgcaggattgtgatgtggggcccacttattcagcgtgattattgttcttctattgccacttgtgtgcactctactgtacttatttagattgttatctgattcaatagttgacccaagccaaattagttttttgttttgccacatttgacagaggaaacacatacaataagggatttcattttcctaaggccccgtttgtttcttcacattttgaggaattggaatctagctaatggagtatattattttttttagaatgtgatattacacaatttttcaaattttatatataaatctatccccaattcataaggtgagagatgaaaattgattctgctacatttctaatgtacaatttataacacattcttatacttccttctttatagcataaatgtagtatcgggataataaacaaatatattacatatataaatatattaacttaattagttttgtctaaattatacttattataatgaaattcaattccaacaaaataaacggggctaaggaaattagttcatttttcttttaataaaataggaattctttggaaaaattgatttcctaaactagccctaatatggtactcgctgctaatgcgaccacagggataacttcccagtgtgtgttctattcttagtttctctgatcggctccaaattgccttgttcccatggtttatttggactcgaggtctctcactgatgatggatgtaggcagtgttcaacaatatcaggcaggtgttttttttcctttttttcataacatgattcatctgacttatgtttctgtaggttgttcatctgacttatgatgacctatgatttatctgacttattgctttgcttgaaagaaattttaaaaatcatccgaaattcgcctcatgaaactgactcggctgaagtaccatgcacaggaagctttctcgtaccatcactgcaatcgtcgaccccacatggcagcgaaacggaaacggacgcgacacgctgcaacgttcgggagtaccagcgacgaacccaatcccaatccctatcttccgagatttgtctgcgcccctgcggcgcgcatggcgccacgactgaccgtggccttgggcggcgctcgggcatgagtac

SEQ ID NO: 8298 - DNA, 1298 bp, Zea mays
cgttacaccaggttctatttttatgttataattgcagaggagagataacctaaagtagtaattaattcaactttaatctaagttataaattgatcatagatcatattctagtagtccataatgataagcagtttaactagattaaccaacatcagttaaataatgatctaattataaaagaatgagacatgttataataactgttgttattacatagtaaatatttatacaggactaacgcaatttgaacggatcaaatcggagttaaaacgggagagttacgaatttcctaaggttttatgtatttgatataagattaattagaaaataaagtttaaagtggctttcatgttaaaacagagacattaggtgatacacaataatattacaaaattatagaaaytggaatggactaaaaagtagttaaaatgcattttctaggaattaattaagttcccataattattttcacacaaaaatgtattttctaaatgaattcttttgattttctgttccctggactgagcacaccatttacagaaaacacaggggcctctacaaacatttcctaagacacagagcccctggcgtggacagcgggttaatactaacaaaatagaggggctcttttaaaagacggccagggcgaaggggtatcggcaactgtgggccgttggatctaaagcttacggcgcatattatcccggactcataaatgaaccggtatgcgcccgtgaccgtcggatcggtgatcgacggatgcagtctaaaatgtcgcagattaaatcctacgcgtttgactcgcatcggacgacccttctcacccgagccaactggcatgcgcaggactaatcccgaccgcatgtatcagatcgtagggtcagggggccatcttcttcatcccaacggcaggccatggggcgcgcccaaccagacacggcggcgccatgccacgcaccaccccctgcccggattccgagcctaaaaccccacaccgagacgatctatgcgctgcggaggaaaaatagaattgacaggtaagcttcttaccaaatgggatggcgtaatcactccggtcaccgctcagagtcgctctgccactatgtagatttcccggcaaacaatcccagggtcccccggcatcaatccacccggaacgaccacatgatttgcactggagatgtcggcggaatcctgtagctggtcaccgaggccaaacgcgggcgcacacccgaattacctagggccgctggattcccaccacgacgacgggctcccaccaacgcactgcacgaaac

SEQ ID NO: 8299 - DNA, 109 bp, Zea mays
agtagtgtgctccgttcgtctggattcagctcatccaacgcaggcgcgcgtttcgatcggcgtcgtcatttgctttgctcttcatttcatcacgttatgtaacgtgcca

SEQ ID NO: 8300 - DNA, 1500 bp, Zea mays
gatcgaattctctactaatcttacgaataaagctttagtaaatcagccaaccacctcattctttgaataaacaaaatcaatctcaagcattcttataaaaactctttctcgaacaaattgataaccaaattctatatgctttattatggcatggaacaaacgaattagatgacaaatatattttgcatatcatgcgcgcgctagtgatgttttacttttactcatcggtcacaggtttcaacttttctctctctgaagttgagaaagcctccttgaaatcgaaaggggaatactgactggccaaattgcttatggagttgttaaagaatacaaaaataggtgccgaaagggtttgctctaatgatttgatgaagtcgtcgttgccaccgatggttaccatgcagtactactactatcatagtgtcatggtttttttattttcaattgctgtactgatgcagacgtgacgcatgcgtttactatccttgcagccaccgactccaaaatgaagagagctagcgctcaattcattggtccacgtcaccatcaactaacgttccgaactgtctcgcatgcatcgtgccgagaaaaagagcaccgatgacgatggatgcgatcgagttcccaccatttgagagcaatatgcgttttacactttacaacaaggtacaagtgaaacaataaaccatgctaaataaaagcgctaagggctgatttggtggcccagaatcacgggaggattggaggggattgagagagaaattagttcatttcctcctcaatcatctacaattctctcgtgattcacttatcaccaaatcaatcctaaaacttacgtctctcctgctgcgctctcgcaccacactgcaggaacgtacgcccggccgaggctgcaactgaaatggaagtatgaaacccttcggcttttgtttcctgattgaccaactgtgacaaatcccctagcattttgcaagaacaactacatagacgttgagataacatatatatcctccaaacgagacagcccatctgacaacacttgcagccgttcgaacgtaccattaccaaaatatttaagcgttacacaagagatagcgtaccctccaatgattagcggctttgccgtttattattgtcattggcgcattgctttggtgtaccctcacatggacacgccatgaaaagatgacaatagcgcaaacagacatccgaacaaagcttggtgcgcctgctctcggccgggctagctagtaccaatcatggaataataagctagtatatatataccgccccatttataaaaatgtaaataaaatgtctgtggcgattatgcacaccgtccataatactctagtcgtcggcaagctgaggccgcccattaagccttgagcgtgtataaaaggggcatagactcccagcatcagcgaagcagcaacatatcaagctcagagcctcagagcgccagccaagtcttgcggtcgcgaagagcaacgcaacaag

SEQ ID NO: 8301 - DNA, 301 bp, Zea mays
gaccgtggagatcgatccaaagcaagctaagcaagcacacaggagtacgttcttctggcaagctaggtgtccttggtgtgtaaaaggaataggagagagagagagagagagtgagagagagcaaaaaaggtatgaagtgggtggagaaacaaggagagaaagagagagagaagggtgcaagtgcaaggattccacccatccatcacactccatatcagtagcagcaagctgcagcctgcaggtctagcaaaggtagctacgtaccctcttgtttgcaaggttccatggctatagcaaagcc

SEQ ID NO: 8302 - DNA, 138 bp, Zea mays
ctgcagagtgtcccttgtaaaatttggcgcatcttctgtttataagcatatttaatcggtgatgacatggatacgtattttatgtttttcccctccatgttcaacaaaatcccagagtgagcgatttatgtacaggtg

SEQ ID NO: 8303 - DNA, 133 bp, Zea mays
aaggatcaacctggggtttgctgatgaacgcaagactgccatcatcagctccagcctggacgacaaataggaaagcgcgctcgtccagtttctgcaagataaccgagacgtattcgcatggcaacctgcggat

SEQ ID NO: 8304 - DNA, 879 bp, Zea mays
aactccttttttttcctattcttgctcccaaacaagactggatagaccgggccgtagaatgtttcaatttttctgcccaagaaaagagagagaaaataacgcaaaaaggaaaaaaaagaatccggtgtaatcggggatttgaacccgacgtgaatcgaacacgcaaccttctgatctggagtcagacgcgctaccattgcgccacggatccgcacgatgtttaattatattattgtgtttctatatacaatatcggtaatataaggccataaaggctgcaccacggcccagttgcgaatggaagtggcgggaccataaagacagcatatgccatactttcatgttgacgctgacgcctcagcctgcagtgcaaacaaaacgtttgagcaagctcttcctagtttgagtttggtttgtgctgcaccgcagactgcagtcgaaagaaaatccatctcgcatgtcgaacaagtttttttttttttgaaagagagacaagtacatgtacatcttcgtcaacgactattcagtttgttttggactaggagcgtaaatagatcttttttgaacaataatatgcccatgacctgaggtcctgagctgtgccctgttaacgaagaaacaaaaaggccactgctatttcagaatccagaaaaaaggaggaaatgtcatggctatagctgcgatcaactgatcaatcaatcaattaaaccggtccgacgtggcgcaagttagcccacacacctaacagatagagattcttacgtgagggtcccacaagtcatccggagttcccaactcggtaaggtacgaaagcccaacgggccccaaacagtccagaaggggctctcacaccggatccgctctggctccaacaacgtg

SEQ ID NO: 8305 - DNA, 1500 bp, Zea mays
taacagtatttctggagtataatgtgtaagcaggtaccttcggactcaagtcggtatcgcggcaggagaagaccagaataatacgaaggtcgatacagcgccgaagatgtgagcaggaaagcttcggcgtggtagcagaaaatgaaaccgacttaaagatgaaaaggctattcagacctcgatagattactatagaattattatcaaatgtaaagggcataaatgtaattttgtataggatgtgtcctgtgcctataaataggtgaacagtacccccgtactgttcacgctgatttggcattcacttttgcgtcacgcttgtactttcatctccttcaaattgaaggtacatttgtaattcgatgttatttctgcttttacataataataatatttaattgtctatgttatcttttacattccttataattcatccttcatcattatataatgtatttatgaaggtatgcccttcataactttcgtccgaaaatcattatatcctgagaggaataatgcttcgaaggacgaaggactttaccgattaacattttctatgttgccttgttcctgactcatagcattcaagaacaagtctccaacagagcctctggttgacgatcaatggccacacaacccccattttgccgaaaatagccatgaatgaccattttgaataataccgaaggctaacacgtacgagtttttaaccaagaaatggtttccaccagaaatccaagaatgtaatctatggcaaggaaacatatgtggggtgaggtttatgagcctctagtcgatgataaatggccacacaacccccatttttatgaaaatagccatgagcgaccttgaaaatagccatgagcgaccattttcaataatactagaggctaacacctacggattttagaccaagaaatggtctccaccagaaatccaagaatgtgatctatggcaaggaaacatatgtggggtgaggtgtatgagcgtctggtcgatgatcaatggccacacaacccccatttttgtcgaaaatagccatgaacgaccattttcaataataccgaaggctaacacctacgattttttacccaagaaatgttttccacccagaatcccaagaatgtaatatatgcaagggaaacatatgtggggtgaaatttatgagcctctagtcgatgataaatggccacacaaccgccatttttgtcgaaaatagccatgagcgaccattttcaataatattagaggctaagacctacggatttttgaccaagaaatggtctccaccagaaatccaagaatgtgatctatggcaaggaaacatatgtggggtgaggtgtatgagcctctggtcgatgatcaatggccacacaacccccatttttgtcgaaaatagccatgaatgaccatttacaataataccgaaggccaccacattcgttctcgccgtggacgcgcgcgtgaggtgagtgagaccaccacgccagacaagaatta

SEQ ID NO: 8306 - DNA, 656 bp, Zea mays
tggcggcggccgatcagacgctcatggaacgggcgttccagaagcttctggaagcggagccggatctcgcggcggtagaggcgggtggaacggggagggaagagagtggggtggattaataggtggaagcaggaaggagtaggagacgcgaagcatcagcggcatgtgatgtgagaggctgtgcaaagtgcaagcctgagggaagaaaagccggcgaggtgctgtcaccgcgcaggtgagttgcccagccacgtcacctctgctcgctgccccacataaccccacctacaccaacttcacggcgcccacacctcgccatttttaaccgacacgtgggaccgacagggagtccgcaccgaggcacacgcgtcgccggtcgctcgcacacccccctctggatctctcttgctgcagtgcaccaacttcactggtccatagggtcactggcatgtggttcccactctgcagactctgtccacaccggctcacgagggtgccacctcccttctcgtttcttcctgtcctggtgtcctgcccacctctcctctgatcctctccgccatttccctgcgcttctggaactgttgttctaaacccccaaaccctaacggcctaacctctgcgctgccggcgtcgccaccgccggagctgcggcc

SEQ ID NO: 8307 - DNA, 949 bp, Zea mays
gtttggcacataacaactcaaagattgtgtgttggcacttaatcaccaaaacattatagaaatggcccaaaggcacatttccctttcaagaggcggttggggctggtctagtcaggtgtagtggagaacgcctctcacatggtcagccacaccgaccatggcatgccttggaagctcatcgacgcggtgcgtgagacagggctcgtcttcttccgcgcacccatggaggacaagctccggttcacctgcgacccggcagggatgccgtctcggaatggtacttttaaccttgtgctattacaaaggctggaggtttctgtaggttctaatggaagattacaaggtcgtattgaagtatcaagagcttttggtgatcaccagtttaagaaggtttgttgatgcgtaccattgtttgcttaatcatagatgttatctattgcccatcactgtttgatttgaaatattcttgtttccttacatttacatgcaattttcttcataaagcggacattcagatcgaaagcattaagtaatattgaaacttggttatttgcctatgactattctgaatctgattggcagagttcatgtgcattaagtaatctgattggcatgccaggcacgatgtagtgaatgagcactttttaattgttgttccttgttgtgaagtaactatgagtgtttgtcccatgagttcaattccaatattctttcttaaggtaattgcttacaatttttaattacattttggtattcttatcagccatcctgattgcaagctggttgttagccatgatgattatagcttaacttccaagctgccaagggagagaacttctgttgtaacggtactaagaaacccaattgatcgtgtattagcacatatgagttcttagttgaagttgtagctagattccttgtgcacccaaacttaacttctgtgaagtta

SEQ ID NO: 8308 - DNA, 1209 bp, Zea mays
agaaacatcagaaaccggtatagattaaagccaagcaaacagacttagagattcatacaataattaatgtatttattttacatatatctagatttattctcattcatttaaatatagatataaaaatcaagagctaaacgactaatattttgaaacggagagagtattatttattattagagcctagatagccgattgtctaacaaatcgaaccatgaattaaaatcttaagtattttgtcatctaatttaatcaaaacaaatattaagttcaatgcagacactagtacaaccgttgacgaaggttgccatgaaaatcaaaatatatccaactgcggctaactcctcgccgtttaatcagatgttagaatcatacctccctctcttcgtcctaaaataaagtttattttaactctttagttaattcatatacaatacttggtatatgtgttctatatatgtgtttatatttatcatcatctagttaaatataaacataaaaattaagagctaaaatgaatactattttgggataaagagagtatgcttttatgggtactctctatattttttaattgatataaataatgtttttattaaaaaataccttcaaaaagcttatttaaatagttattaaaatatagttatcttctatttcgatattctcgctagtcaaatatagaaaaataaatggctctatagagtacaactaagatatagaaaaactattggagattggaaagatatataaagtagtttttatgtaaattgaaagactcttggagatgctctctattgtatctaactctatctacaaataaatagtatgaaaatcaaggctataatatatataagtaaatattaatgaatttaacaacaaaaggtttcaaaattatattttaatttagtttacactcaacaggacactggaatttttctttctaccagccataataactgcacagaccccacaggccagtgggtcactaaccgttcgaaaaacatggcgcgcgcgcaatggccgggcagccatcggtttcgtctccacctcatgtttccacgagagttcctcccatcctctcaagtttaccagcacgacgcttataaaacttcttcccaatctccctttgcaactcaccccacaaagcaagaaacaatccttgcacccctcccctgcgtcaccccaccatatccggccagcccaacgaaa

SEQ ID NO: 8309 - DNA, 1500 bp, Zea mays
aggtcaagtgctcgagaacaagttatccaaccaatcactattgcaagtgatcatctcttggattaaatagttggagatctgaaaagtgtcatgcaaaaaagactaaggctaaaatcatttagtgaatactactcatttgtatcatccattgagtacaaatcacgatttacacaaccaaccaccgttattattttagatggaagattgaagtacacttcatatcttagctttcatgagtagtatgcatctattagggatttcatatacaagattagatgcctgggtatacaacactatatcacatatagtgtaatgacaaatgagtttgtcatactcattgcccttctctttttaatgtgcttgtatatttgctttcaagcaaaatatatgaatacaaagtgttagtctacaacataatgtagacacatactcataagtccacaagtcttatgattttctttgctattcattttgggcttgcacatcaagccacaaaagcacattagttcttttcataagaaccataagagaaagagagcatctcatttcctccaaaacgaagaggtgaattcccatgtcatgcaaagatgaaatgaacatatccaatgaacattaaggataattaagcccattaggcgagttcatcaaactctattaaataattatccttcaaatggcttaaccattttcgtttgctattgtaatatgccacaaaatataacatatctttatatgttggagaattctaggtatcacataaagtgtaccaaaagatttttgaaaattggtggacacaacgtagataatctccatgtaatgaaacaatggagtagatctcccagtagtgggcaaaacttttgctgcctgaaagcatggtctctgggctgatatattcaaggaacataccgcagccaatgcttaggactccactaccctgtgcttgaccaaaatttcaaaaataaaatggaaatcaccataaaggtgaataaccaacatcacatctccaacatatctacttgggagaacacataggtaatcatcatgaccatatgatgtagacctcttactgatgggcaaataacattttgctgtctaaaagcttggtctcagggcaaataaattccaagaacttattgcagccaaagcctagatctccatcatgtgttgaaatatcccaagttcaagatatgtgtcatattttgcaagaattcatcatttaattaagtagaacttaattaaaagaattcttttagcagtcagcatgactgcagcgtccagcctggctccatagcccgcgacgcctgcttggtccgtgatctttttgggttagcacgtataggtaatcatctcgaaagatgtagacctcatagtgataggcatttcaaatgcggcctaaagcacggtctctgggctactaaattctataaagaatttagcgcagccagtgcttaggactccatcaccctatgctttcacccaaaaaatgcaacctcatgttgc

SEQ ID NO: 8310 - DNA, 1092 bp, Zea mays
ggtgggtggggagctgctctgttccctccctcagatttcttcttcctcctcgcccaccacgataataattcctcctcggcgtcgtcgtcgtggtcggggaggtttataaataaaaaaatattaatccggacggcatcagtctcgtgtccactactatcagaccgaacgcacacgcaccactgaagctgctatcaataaccccctaactttagaaattagaattggacctgctgctttccttccactttttggataatcgtttattataaaccacttatgcaagaataagaaccgtttactcccaagtttgaaaattttgctttcacaaactgccttgctagaattcaaatgcttaaattttagttttagaagggttcatcattctcacgaaatgacaatgcatttgccattcatcttattatcttattattgtgacggcaactagttaaattttcacttttaactactggataggaaggtatcttaaggcttatttaagagcaagaatattggatggattgccggggcaaaatttatcttgctatttaaaatttaatagaagatgattttagaccctcaaatcattggtttcaaaatttaatagtaagatgattttagtttcttcaattttcttcggtatcgttgctctcaaaaagctcaagtgcttttgagaactgaggcatgtattctaatgactaattttaagtccctatattttattcgctaaattattaaatataaaaattaaaactctattttaattttcgtatttgataatttaggaactaaaatagaataaaatgaagagtctaaaattactcaggaaattagaccaatgcaaaagttttttttcaggaaaaggcatcatttttttggagaattgaaaacggtgggacagcacttttccgagagaaaatacggggccagcccatctttaaacgggcctcggttggctttggcctaacccattttcatgaagcccagtaagggaagggagagccgattcatttgcatttttctgagcagatgcagatcgatcccgagttccgctgactgcagaggagagagatctagagcgagggagggagggaa

SEQ ID NO: 8311 - DNA, 201 bp, Zea mays
ggtgagctcagcggctcagcccatgtaggcagtcagcctctcaggttgggagttgggactcaggagtttcaccagattaagcatatgctgctgattcgccggtgatcccctccctccttcgccgtcgccgtcgccgtcgcaccagcttggccgccatctctggatcgccgctggactcgcttccctgacccagaagctacg

SEQ ID NO: 8312 - DNA, 161 bp, Zea mays
tggctcggcccggttttctaaccgtgtttggtaggccgagcccaaaacgggctgggcggcccgtttgaccatctctagcctgcagtcaccccctttccccctccatctcggtgtcagacgcatacgcacccaggagatacagcgagcgagcgaccaaagcc

SEQ ID NO: 8313 - DNA, 119 bp, Zea mays
agtaaaaaagcccaatgttttatattttagagtctttggtagcaaatgttttattcttgttaaaagaggtagaaaatctaaatttgctcctaaggctgtagaaggctttttacttggtt

SEQ ID NO: 8314 - DNA, 343 bp, Zea mays
taagacagggagatccgttctcacctcttctttttaatcttgttgcagatggcttggcttgtatattcagaaagctcaagaaagaggtcttgtccgaggtttaattcctcatattatccataatggatgttgttgtcttcagtatgctgatgatattatttttcttaattcaagattgtttggaaagtgctagaaaccttaaattcattctttgtctttttgagcacatgtctggtttgaaaattaattttcacaaaagtgaaatttattgtttggggggtaggctaaggaaattgaagaattttatgctgatatttttacttgtcctattggtaatcttccg

SEQ ID NO: 8315 - DNA, 253 bp, Zea mays
agagtttgtccgtgatggtttcttcaacaaggtgttctgcttatgttgctcaaaacattttactgttatgtttacttattctgatggctgggttggggaaacaaaatatagaaagcatattcttcaggcacttttatagatatagtatcttgcatagtttaagagtaaaaaggttcgacttcaaatgtaacgtgtttgtggggttctttcaaaccactggagatgatttactatcccctaagatgagatttaa

SEQ ID NO: 8316 - DNA, 1500 bp, Zea mays
ccccttacatccgacatgtaaggggaggggggcggtagcgtcgagcgctgcagatagccttacacgatgggcagtctattgcttaactttaatgacttytattgcttctatactattttttatatataaatccgaacagttaacagttagttttaatttaagcgaacagccgactcggcactctcytttcgagcggagcagacgagtttattgctattataacactcgtttcagtagcattcactgttataatattcttaaatccatcttctctctaaggtcccgtttgtttcctttcatttcgaggaattggaatcttactaatggaatagactatttttttagaatatgacattccaccactttccaaagttatcatataagtttacctcaaattcatggggtgagagatgaaaattgattttatagatttacatgttattttccgatgtacaacttatagcacattcttctacttgtgtctctataacataaatgtagtatataactatgtctctcatatgatttaggatattatacaaatatattacatatataaatatataaacttaattagttttgtctaaattataattattaaaatggaattcaattccaacgaaacaaacgggccctaagggatttccatttttctaaagaaaaataggaatttttagaaaaatgaggttcataaactagtccttaatgaaagaatttcccgtgaagaattgagaatcggactcattgccatctctacttgaacttgagtggtcagtgatcgaggcacctgttgtagcggaagcattattggccagagtgggtacacggaacaaagcttgtttatgaaacaaagatgcgcaaatcatcggtggcaccggccctggattaatccaaagaaagagtaaagcaatcagcggcaaaggataattaaaataaagagcatcatgcagtaagacagcacaacaaaaagggagttattaataagtggacgctcyactgcagcgaacagtaatatacattagagtagaaaaggaaatacatgccttctgcagtcgcagactcaacgcttttgatatgtattagaaagaaaacgatatatatcctaaaactaaacatgcgcctgtggtaacctatcgttccgagcccatttaaaatccagggatcggagcaaaaaaagggtacgtgtgcagtgcaggcaccagctgggcgattatgcatctgcattcagcacggcctgacagtggccggcgcaccctgctgtagtggaagacagggggaggaggggggaacaagaaagacgcgcgcgccaatcagcggggcacaagaggcatcatatgcagtaagaacagcataacataacataaaggggttaacaagtggaatgatgctccgtccattatagctaggcgcaagcagcaggaggtgtgtttgagttgttcagtttcttcgccggccggccggccgggagagacacactgcttgctaattatgactgcgatg

SEQ ID NO: 8317 - DNA, 1334 bp, Zea mays
caaagtcataatgactctagtagttttatttttatattgtaaaattttataaaatatcttatgtaatcggtcaaagttgataatagttggcttatgacaaattaaaacgactaaatcatgtgaacggagagaatatgtattattgattttaaaaaataacattagataaatgcacgagcaacattcctcgtacttaaatgagacataacggtggtctgtatgttccaaatctagacctgcaatgcactattttcataaacttagagatgtatgatatattatttaaccagttcaagaacataaaactacaattttaaagtttatgaatctaatcgacatctcttaacaaattcagagatcactggtatgaacatactcatatgactccaaataaataaacattattaggatattattgaatggcaagttttataaaactaatagtttttataggtgttatgtgtttcctctgtaataaagtatttagacaatggagcgaagctcaaggcaacgtgtgcgacgacgtactgcacgtctgtacatacggcgagagatccatcctgcttgcacatgccaaatgggatgcgtgatccgatctcaaccacatccatgccgtacgtgagtcaatacaaatataatcacatcaatcatgcgaaccagcaacttctaaacaaattgcttttgcttttatttttgcttttgcttttgtatttgtaggcgaacctaagtttagttttttttggctaatgactacgccgacggtgtcaattcagttgacagttattgctgctcctacgacggagcaccgcccaaacatataataatagagttaattattataggtgcgtggtgcgtcacgcacgcacgacgccgaccgggcgttcggcaagttgctacacaaaagctgaggtgctcgtcgggcacgaggccacttgctccctgctgggccgcgaggggccggccacagcgatctcactcggcaccggtcggcgtcgcgctccagaccagtccacacaagtccgatcgaaacgcctcgtcagttttttcctcgtaaaaaaaggtcgttttttttcgttggacaggcaaacgttagtattttcttcttcttttgagtaaggcaaacgctcggcacggtagtactgctacacttgggcttctgaagtactgtcagcccatgggtcgtcctattccacgaggcccagcccagtttaccaacgttgcgcgcaagatataatagtctcggcccgtgtcgattccatcgattaaaaccctaacccgagcatcttccacgccgccgttgtctcgccgcttccagccgttgctcgctgaagaag

SEQ ID NO: 8318 - DNA, 883 bp, Zea mays
tgcggcatagtgtgacttttaactctagtcagcacagattaactaataaatataaaagaaaaaaatattttttagatggaaactggttttattataggagagatttcccacgacccgaacaaccggacggatgatgattgatgcacggaaatcggaaagcaagagtgggttggtgggtgggtccgtccccagcgagccgcggcaggcaccaattggccaccaacaacacgtccccrgtggccggtttggtctccgtaggaagcaacccgccgcggccgggcagggcccagcactctgccaggtcggtcagagtcagccgcgcgcgctgttcttcccacaatccacacccaccaacccctctccccacactcgtcaaccacggccacgctcgctgggcaccatggccaccgggcaaacgggaacgggaggctgaaggcctcttcaccaaacgcacggatcaggtcatcagaccagtggccagcctaccgctgcgcactggcacggcgcacctatgcccgggtccggcaagcctaaccacaccaaccaacccacagggccacacccacaccgaccgtgtccgtccgctgacgcgccgggcccggaccccgtcgctcgcacgaccgactgcttcttcaccttcacgttggccatatttgagtagcgtcacattggccgtcgcgttggcctacttggcagtggatgccaagctctcacatggctcatcttcgccttcgccttgccgccgcgcgttatataagccgccccggcaggcaaggtcggtcaatccagcaatacccgagtacccgacgcgctagctagttctattgccgcaccccagatctccaggagggactcgttcgttcagctaactacactgcacgca

SEQ ID NO: 8319 - DNA, 421 bp, Zea mays
acagtattagggtaggggacgggtagagtcaagcgttgcggacagtctaatggactctccatgaaaagaaggtattcggcggcccagcccatccgtcagtgcagtcaagtagtcaccggttcacgcaaaccctagtaccaggccgccagtcccgacctccccggctccagcccccgcgcacgaccagctctgacgaccccgctcctgcctcccacctcctccggtggcctcgcgcctgactccctcctccggcacccaggccagccgcgccccgcctctcgcacaggacggaaatgatgccttctcctttttgttagctgattctgatcaaactggttagttcgatagagaatatcagtaatatcttgctgcccaaactgcagcttcaactgattccgcgtcaggagcacttagagcaacc

SEQ ID NO: 8320 - DNA, 871 bp, Zea mays
cgtgtacacgcccttgttcgtttcttgacttctcaaattaagtgaaataattctcaccatataagtaaagctaaygatccttggaattgcaatatgatactattggtattgtccacaattacacatcatatagtttattaattaaatgggccaagcccataaaagatccaacatgattttgctaaataaatgtttaatattagagaaaagtaatttactagccatttggtaaaatttgtccgatttgattctctttyaatggtagagttatgctaaataaatccttaataataggtaaaagtaattttgcagtcatttggtaaaattcgtcggagtcagtgggaggtggcatagctctgcaccaagcacctcgtaccaaaagttgtgttttgtcaaatttgccagacagtcgcagctttttgcataggcaagctttcagaaaaccagatttcaaaaaaccgaagcaaaaaaaaaaaactagaaaggccaaaagctaaatgacgtcgagcccgcgagctcccgtaacgcctatacaatctgggcctcggcccgcctacgtaactcgacccgcttgcccgcctgccgccctgccacaaactgtcgaccggaggccggagcaaatgcgactagccgaagcggccgcggcggaacacctcggcgatcggcgtgcgtaccttccacgcgggagtgcgggaccgttgctgcgacgctgcgtcagatcgacgcgcggcgcgtccgccccccaccctctcgccgcctatataactcgcgcccgaatcggcggctccctcctttgccctctccgcgcaccttccaccacgctctggaagctgtttcccctttctcgagagtttagaaagctggtgcagag

SEQ ID NO: 8321 - DNA, 302 bp, Zea mays
cactagacgcgcagcctcgctccgtcgccgcaattcgacgattccaccgcttcgtccgtcggcatagcaatcatactcttttctcttcccctccctcccctcctcaccagtcacctcgacgagatctcccccacctcttccacttccaccccgcccgtcgtctctcgcgaagcacccctatcgtacgttttccgtagctcgacggggacggcgagccgctcctgctgctgccgccgccggaggaggaggaacaggattagcgggaggaggagcagggcaccggtcgcttggggctgtgccac

SEQ ID NO: 8322 - DNA, 676 bp, Zea mays
acaagtggatgaatacctctatggccgtatcactcaagttccggttgctccaaagaaaattggtcagcttcctagcatgaagcaacgcgtggctagctgaagatcacaggtaaactaagacaccaatatagtaccacttgctrttatttcgatttgcctgttcagtatgtacaactctgtcatgagtcgtgagtttattagtgtggatgtgatggcagattggcatgtctacataataattgctggccgcacctgtctacagtatgcatgtattcctaaattgtaaaataagtgaaaaaacgcatatgtgcgcgtgtatcatggtgtgtactcctaaattgtaaaataagtgaaagaaaaaacaagtggatcattgaatgttgaaggatgtttttgtaaccagatgttctttagactctgttttttgtttagagaaatataatcccttatgtagttacttgtgcatccatatcatgtacacattggctcttacgggcttgccctttttctttgtacattcccattctatctatgctgtgctaaaccttaaattcattactccacatagattaatattgaaggtgctgttcaataaattatgagcttattaattatggactaggtatatagaatagaaaaggcgacacagacagcgacgagacagtttgggagccgc

SEQ ID NO: 8323 - DNA, 1281 bp, Zea mays
ggtggtgactctagcttggtatgatagctaatccttaaaagagactacacgagaagtagaagtgttactaaatagtcgaagtcttggatagtgtataatatttctatctatcttggtggtaagaactaggcctcattggatgyytatcagtgggatttgttgctcgtatccctcctcttgtgcaagagtgagtgaataatttgtcttgtgaccactttgtggtagattgaagtggtattyttgagtccaaaagggagtccaactagacttggaccgcatctatcaatgccttgggaggtgactcaaaaacttggtcatgtatgagtaggactcatgcaagttgaatcatttcagcgtctgatttggaatagagattaaaatctattaaaatttacaatgaacttgacacaatctatcgaccttcgcgtctttttgttgaaagcccctatctagcaatgccacctctcagtgtttgatgaccattaatcctactatgggttacccgaaggagggtttaaagcgtttcsgcgtaagccaaactcgatggtaaacacagagacaacaatctgtcytagtttaagacgctaagtattgtaattttgtatccctgtctgatgtgttgcctctcattagaaaactcaattgtattcttccatatagagtcttctagtgtaattatatattttttattttatgatttctattagatttactataggttttaaagatttagataaaataaatataaagaaaaatagaaacttttgagaaaaactgccatagggtgacatgtccagtttaaatttaagagacgatgaagaagctgttttggattttatagttgaggaataaaaaaactaacattaaatttttagagggataaaatggattttcccgtgttttatatatatatatatatatatatatatatatatatatatatatatatatatatatatatatatatatatatgcaaaagcaagagaagtcagcaaaaaaatgggcccaggcgcgcagtggaattggcccatactccatccaacggctagtccaccgaccgacaaagcgactagtgaccgttgctgccgctgcctctcttccgctcccctcctgcagtggagtcctcctcctttcccacttgccctgccttccctcgatcgaggcccttccttgttcgtcgaggagagatcgaaatcgagatcgggatcgggagatccaaggaggcgacgcggaggaaggattcttgaggtaaccatctccagtaatccatctcatccacc

SEQ ID NO: 8324 - DNA, 684 bp, Zea mays
ctggcacagcacaaagaggagggaaaacaaaaaccatgaacctacttggtccgatcagaaatgaaacagccactaatacgatgattagttttactttgagtaaatcatcgtatttatgaaatggcagtggtcttagttttactttaattttatactatggcgatacggatgtcctcacacatgtccatgtcctcctcccgctgtacgggtggtgccgtgccgattcacgtgtcgggtgaacttcctccttggccggccggccggccgtcgtcaactcctcaccagtctgtgtgtctgtggtgtgatgagtgtgtttgatccccgtgccatgcaagaatagagacggagacagacaggttgtccgacgctgtccctccctgtcccgctccgctcccggcggccgctgccggacgcggaaacgtcaaattgctccgctcctcgccaccgccccgccgctttgctttaccacctcctgtgcattcatcaaagctccgaacgaatgcgcgtttctctttccctatgcatttgattaatcttcaacacataccagtccagcactccagctataaagcctgcctcgcctcgtcttccccacactccactccactccactgcctgctggctgctgctgcttccttccagatctaggggatcaagcagccagccttccccgcgccgccagca

SEQ ID NO: 8325 - DNA, 193 bp, Zea mays
gtgccgtgcgcactcgatacaggaattgaaccgacgcgcagtctcagtgatgaacttgtgtttttttttagcctggtaggtttcaccttttttaggtgtgtgtagtgattagctcaacggtgttctggacaagcatcaagatgtgtgtacctgattggtgtatacaaattgtccctgtaatttatctgtacat

SEQ ID NO: 8326 - DNA, 217 bp, Zea mays
aaaacaaatctgatgactcctagggcatgcaactaccattttcaggcgtatatttgtacgtacccagcagtatacgtatacacgcatattgattgagttcgctgatgaagaagtatgcgcgcgcgcgtgcgtctctgtctatatatatatatatggcgtatacttatgggcggatatgatatgcccacgtctcagatagggccttcttgctagatcg

SEQ ID NO: 8327 - DNA, 366 bp, Zea mays
tacatgcatgcaacattgaatggcaataataccagtattagaatcgtaatgcytgcatcggaattcatgctgtgcaccactagctaaactggtcattaagcaagcagtgtcacggttaactgatgagcatgagcacatgctgtatcactgacgtaaggacgcgtgcacaacggaagcagcaaggatgcttcctgctttttctcggcctttcctcgtgccgcgcagctatgcttgaccgggtcgcacgccctcgctgctggctgcaggctcgcacgcgcgtggcgccatgtgcgcgcccacgccgcggacatcggcaacggtgacggcgagccacgcccacgcccacgccacggcgcagctccacgc

SEQ ID NO: 8328 - DNA, 63 bp, Zea mays
ggttgaaggagggacggcgcgtcsagggacgacgagaggcggcggagggagctgaccagggag

SEQ ID NO: 8329 - DNA, 106 bp, Zea mays
cagcccctcttcccttttcggctcttgttgccttgcccccgggccttccgtgccctggatctgaggaacgcgagggtctggttcccttgcgctctttgcttggcag

SEQ ID NO: 8330 - DNA, 881 bp, Zea mays
tttagcaggagcaaccaatcactcccttttttatcggtccactacgttgttcgctgcatttaaggtcatgcatcgacatgaggcatttgaggacttactaatatgctgtcacctaagggggtgtttggtttgtaggggctaattttagtccctacattttattccattttagtccaaaattactaaatatagtttctatatttacatattatagactaaaatggaataaaatgaaggaactaaacattagtccctagaaaccaaacatctactaaatcggcatcgacatatattataactaacaaatcacattattatttttaaggaaattgaaaaaaaaaagacagatcaaactcttgttctacggtgagatagccttgagtctagagtctttatctaggagaagagtaaacattttttttgttttccgaaaaggaaaaaaagaaagaataaaacaaaccctcatgctacgtcgtactgtcgtagcgtgcatttgtactctgcatctaggcgagaacgaaacagactcttttgtttgcgaagaaaaatgaaaaaaaagaaacaataattagaatctaatgctattgtaaattcgtactcgtagtcctgtacaggtcgtaggcgaagaaattcttatacatcaagcactgacgtcggaggctccttccttggcgccaccggcaccgaggcggctggaggaactggacgccagcaacggggccgatcgcggcgtgtcctggccgtggccgctgcgtggcgtgggcacggacctcggcgagccgaagctgatctggcgcgcgaaggccacgacggccttcgcccacctcttgatctggcccttgagcctcccggcatccacgttcttcaaaggcccacgcccg

SEQ ID NO: 8331 - DNA, 718 bp, Zea mays
cgatgcaaggaaaaatgaagtacaatcggtggagtaaattttttttgaagggattaaatattttttaacctaaacaaacaaatctctgtatcatggagggtcgcaatttgtattccgtggcatcgcacgggcacgtttctagtgataaccaaagaatataggaaagaggaaagacgggtatctgcgtaaggaaagaaccatgcgaaagcacgaaaaccagacgcaacaaaggaccagggggcaagaggcaacacagaagcagacacggatcagtaccgcaggcacaacgaaacgggaacgaatcgccgtgcctcccctatcgctggtatccgttgtccagcactccagcccccgtccgtttcccacgaattccgcgtcccacccggccacactttctctacgagcgccccccatctcacccacccaaaattaaaatcctcccggaaatcagagacgcgaatccctcgccccaggccccgaaacctccgagttctctcgccaattcgatccgcctcaccgccgccgcccgtccgccggtcggccttgactgctccgttgcacgtggcggttcgcagcgcggaatctaccttgtgttgagagatccggggaaacccttgttcccggtcgttccggctcgaatcttctgcggactggcaatgtaagcgttctccatcggagggcgacgatctacggggcggttgttggcggggtcgcggga

SEQ ID NO: 8332 - DNA, 791 bp, Zea mays
cgaattagactttttccaaggaaaaaatataaaggctaatttgtaaccctaagtttattttccttaaaaatagaatagaaatcatttaaaaaaaatgagtttctaaactagccaaaaaagggaaatactcgtccattgtttgctcagggttagggtgctgttgcatgcctcgtttggttctgtcgccatccatgcatcgccacacaccgaggccatctccagtagaccgtgtaaacggccgtgcaagatactattttgcactgctgtttgtataatgaagtttgaaatagtgagtaagataagaagtgaaatagagagtctgtcagagatagtctgacatggagccccacaacccttcctcaccttataacgggagtatttgttttataggactaatttttagtctctattttatttgattttagtttttaaattattaaaaacgaaaactaaaactttattttagtttatgtatttattaatttaggaaataaaattaaataaaaagataaaactaataatttctagaaatcaaacacgactagagtgggtgggagactgggaaagacgagacagcgagacaccactgagacgagagtcagccggcaggtgagacatcgcaggggaaccagctctcaagacggccgacggccggcttgcctacctgctcccatccttcccgagggaccgagaaagataagaaaggcggtggtcaacttgtgtcctgaggtgcccgtagaagcccaaggacaagaaacaaggagaagagtagatctacatctactccaccg

SEQ ID NO: 8333 - DNA, 139 bp, Zea mays
acttcgacgagcgctcggacttaggccagtcgtcgaggcccggggacgttgtggagctcgggcgcctcccctgtctcggaggtcatcggccaggcggccttcaccggtggtggctcaggtggcgtcaacgtcgacgcca

SEQ ID NO: 8334 - DNA, 471 bp, Zea mays
ttagacatagaatcccctaaacaaaggggcatatataataataagaaacattaagatgaatagaaatctaatcttattttcttattagtgtttaataatatcctttttttgagtaggttatttcagagtattgttttttacttattgaatattgcatttttgcaattcattgatattgcaatttgaatattgcaataatttatattgaaaagatgatagccaatttattggctaattcgaattagtatgtagaattcgtataattataactgttgaagccttaaattcaagtctcttggctcttttcacgctttctcacaaacagattacgaaatatattgcattatttgttaaagtttggataaaccattgcttcgtctggtgtctacaatacatctaatttatatagtactaatttcatttttaccagatcgaaaatttttatgttgaaaaggaaaatttagagatcca

SEQ ID NO: 8335 - DNA, 218 bp, Zea mays
ataagaaatacttagaatgagtcaaaattcttagaatttcaaatataaaataaataactaaagaatcacaattttgatttagtaaaacccatctactgccaatacaacaaataccttcttttctcttttgttgcgtaattgttctattctaattaattgaatcggttcaattcttgtcctcatattgaaatgaatcgagattgataaggagttagtta

SEQ ID NO: 8336 - DNA, 97 bp, Zea mays
ataaataagaatacaataacagtaagaatattttcaacacaaaagttctctcaaacaagagaaagaaacatacctttttcatatatagatttagaat

SEQ ID NO: 8337 - DNA, 54 bp, Zea mays
cgtgttgaactctctggtcatctcgtctgaaaaaacagacaggtgtttgcagct

SEQ ID NO: 8338 - DNA, 1500 bp, Zea mays
gtatgcgttatttgaggcaggtctgtcatgccacattagtgtgtgtaattagcgttgttgaaatgtgacctcgcagtcggagtattcgacctcgacatatccggaaagctcccttcacagggaacatgtatgctgtgcgaagtctaggatcctgtccaaaggacactgaaatgagaataaactggcacgtgtcaattgacaattggtttggttttgtgcgatccatttctatacgtcataaatgtatccgcaggatctgaggctagagatgaccaaggaccttgtgagccgagagtaccactagtattctggttatttgtttgtacagtgtgtgctcaatcgtcctctgtttttgttgctacagcaatgctctccggccagctagctgttcacatcgaaaatgacttggttcaattgcgatcgtcgccgtgcattatctctgcagaagaatctgagatcctaagctagccgcacacacttcacttacccccagtaggtcacgctcacgtcgtcgccgtccccgtccctgctgcttgcatggagcttttggcagcagatcgaggcggctgagtatgaaaagcccaccttccaatcgtcacggctgacaccatcaccgccgtcggggccacgaaggaagcttccacgacttgaggacccatgtcgtacgctgtcatcagtaattgttatcttagtattcctacgccaatgatggcgattgtgtcatgcatcaacaattcaacatctagcacagctccggtcgtgacactggccatattcaacatgatcgtggcataataataataacgcgtctcgtgcggtccgcggtcggattcggtcgtgtcatttactgctcatctgattaaattcagtaggccattttgcgccaatcacatcctgagagcgacacgctgatcgctgattgcttggttcatatgtacgtctgtccctcttttgtcagccgtttgcagttgtcgtcagacacacagaggtccaattacctttagttaaggccccctttggaatggaggataggaaaaatataggaataggaaaaatataggaattgagatggtggatattttgaatcctataggaattgaaaacaaaggaactgtgagataagaatgcctttggtagcaccataggaaaaataaaggaatcactttgctgtgtttttgaatttgaaacaaggtagtcgttgcatagtggcagcaagccaaccgttgtcttgctagacgttagctaagtacgaacttgctgctacatgtctttataaaccactcgcttatgtgttgcaacacaaataagcagatgcgccacttcattaggtgagtcacacaacttttcatatgtgcttacatattttcttgtatatatataacagtttgtgataccaatccatttctcgtgcttaactcactccaggcaatagcaattgacaaaagaagctagcagcatactcaaagtgtcatactcgtgtcatttttyatcatcacttgc

SEQ ID NO: 8339 - DNA, 264 bp, Zea mays
ataaagagctggacgtgtaatcatttactctgtgcaagtttaccagtgatgcgatctgtatagatgtgtgtcttgtccagctatacgtataccggagatgaaaggagacggaggcagtgaagaaatatcctttttttttcttctcatttttcacgaggatgccgtgcactgctcccagaatgctgtgtccaatttacaaacgcacaggtggcacatgaactagcagagtagctctctcttgaaaggaaactgtatttggggtcg

SEQ ID NO: 8340 - DNA, 105 bp, Zea mays
ggtatccctcccatccgggtgcaccatggatctcggcagttttatagcaatctccccttctcccgtgcttttccaaatcttgatcccggctcatctgattgctag

SEQ ID NO: 8341 - DNA, 566 bp, Zea mays
ggtgagtgcctgagcatctagttcacattgtggttgaattgtactatacatcgaagcatctggatgttcacatgagaatgatgttagtagatttgtcatcagacaaatttctatacattacagttttgttcaaagtttctgttatatttttagaaatactaatggtcaatgattgtcgtgctctaaatgttcaagtgaatgaagaacggaggtagtagctggggtatttgacattcatgtttcttcagtttgtacaacggattgaaaaagacctgagtatgtgtatcacatttcgaggaagtttttaggtagctgcatttttatgtagaggccaaacacctgatttagttggcaactgtttttgtgaagtgtcttggtcttgtcagtactcactgcacattttttcgaatttagcattgctagttttaccccattatacctattttggctttggtgtcactgtttcggccactgatttgttttttctctaaacaggcagatttgcttgttctcccctgcaaaagctcaagtgtattggcgcaacagtagtggatcagctagatatt

SEQ ID NO: 8342 - DNA, 160 bp, Zea mays
gctaatatccgctcgttcttccttgcgtttgcaatttgtttttcttgttttcaggacctatacatacaatacaaaatacaaatagagaacgtagaataaggcacaagacaacattatcgacttgtcgtagtgtttttggctgtgttgttagcctttgtca

SEQ ID NO: 8343 - DNA, 892 bp, Zea mays
tccgaaacgtcgacagtaatggactatgtgatgtatttgtgaacaattgtgaactgtggactctagtggtattttggtgaaccatgatgtacttgtaaagaattgtgatattttgtgttaaatgtgtaattttagaattactgtttctgtcatattattgtgattatattgttgttgaaattgctgttttttttcatttcttttatattttttctctgaaattttttattttctgcggccaaatgggggccgccgagaataactctagaaaaatttcagccgtctttattttcgctggccaccaaaaattaacgtttatttttttatatttttttgtggccaaaagccgctgaaaatagctttttacgacggcaaagggtctattttcgatagcttatggctgccgaaaatgactgctgtagcagaagattttgatttttcctgttgtgctaattgtgtagatttatttatattctaggaacttggttcggttaataaaatatatagacactattgattttggtgaaacggaaaaaataaaaacaattgcatgtgatatatacggttggaaatgttcaatctctggctcgaacccgtattgtgcaccttgatatttcatcatcttcttcttttccgctccaagtcttaccgtggattccacgcactccttatctttgactcgtcttcgtcgtccaaatatgacatgactttggggggtgcttcacaatgtgatgtactgacgctgacgtcgacttgtgcaagaaatttgattatttaaatgaattaaactgatgttgacaggactgtgccggccacatattaaaattgtttgacacaacaacaacgatgtgtctcctacctgttagttatcctcggtgtcgttacccccacc

SEQ ID NO: 8344 - DNA, 242 bp, Zea mays
gcataagggatgagtattgtactttgtttcctatttccatgtcatttgatattcctttgtttatatttcctctcaagaaccttcgtcctcgatttattacttcgaataagtaacaatatgaggacgaaggttcaaattcttaacttgcattgccttatttttgatgccatgtagcaatcgaaaataagtaatcaacgttggcgcccacctccggtgattccacgaccacaacaagctacatc

SEQ ID NO: 8345 - DNA, 698 bp, Zea mays
ttagagaggaaatcacatcgagatagacctgaacaactagcatatgtaagaaaaccagcagcagttgtcgaccgagtagaagaaaaataaccattacggcatgttatccatcgggttgcttcttcagttgaaaaatgttgtatttactacctgacataaaccacagtaattctgaaagcagaagtgagagttctatccattatatgtgcatctacatatttactgctttcatctgttaaatgtgtagatgcatgaatccaatactcgcgcaaagcatgagcaatttactagttttcgaaaaaaaaaagtgggcagctgccaccgtggatgtctgtctcgattacctggccaccccacacccccagatccgacgtgtcgtcctcccgttggcgggagaaacgtcatagggaccgacacatctgccgggcctacaggtttcctcccctgggcgcccacaggtcagtgacacgcgcgcggccatggagaaaggattgagaccacgtcgccttcgacccttctccgtcctcccggaacgcccgtcccgtccgtcctccccccatccacatccatcccgtgtgcttctactgctcctcgatttgatcaccgattaggggaggcggtttaccagtgagcacgcgcgagagataggataggaggaaagggaagctagcggcttcgctctcgcggggagatggcgc

SEQ ID NO: 8346 - DNA, 858 bp, Zea mays
gctcatgagatcagcagcagttcggagagaatgcagcctgctccgagtggcgccggtgagagtagccggcactagaatccccgatcgagagacaggctctcctcgtggcttcggcgtgaacgcgtggtggttgtgcttccgaggcccccgggccgtgagctcgcgtgacggcgtagctggtggaggcgaggcgcggcgcggcgcgagcgcgacgagggggaagcggttagctggatgcctggatcgtccggttcacagttcacttttggcggaggggttgccgtcactgacatgtgggatggatgatttaaggtcgtaacggcccacatggcaggttgtctttggaggacaagtggggagcacgttggagcgggggcctgttggcttctggaatttgcctgttggcttctggaatctacctgatcatagcattgcagctaactttcccccctttacttacggacagacacacagtgatgaaaggcatacaataacgtgcattggtagttaatgaaaatgaaagtcaaagattgaacagtgaaagaggtctaattgtttactctgacagtgacactccagatctacctattgaccaggtatggtacagcaatgtgcacagctggctcctggctgccccgaatccatgggcgaacacaatcggcctgatggttctgattatttctaaacaaactgtttgcaagggggcgcgcatcatgatccaaagtcagacgatgcagcatttcggttgtggttgtgcaagctcactttgtagagtgtagcggtagcggctttctttctcctcttggcaggccgctcacgcttctgctcttctgatgtgagcttcgaatccaaccagcg

SEQ ID NO: 8347 - DNA, 1356 bp, Zea mays
agtgagcttgcacaaccacaaccgaaatgctgcatcgtctgactttggatcatgatgcgcgcccccttgcaaacagtttgtttagaaataatcagaaccatcaggccgattgtgttcgcccatggattcggggcagccaggagccagctgtgcacattgctgtaccatacctggtcaataggtagatctggagtgtcactgtcagagtaaacaattagacctctttcactgttcaatctttgactttcattttcattaactaccaatgcacgttattgtatgcctttcatcactgtgtgtctgtccgtaagtaaaggggggaaagttagctgcaatgctatgatcaggtagattccagaagccaacaggcaaattccagaagccaacaggcccccgctccaacgtgctccccacttgtcctccaaagacaacctgccatgtgggccgttacgaccttaaatcatccatcccacatgtcagtgacggcaacccctccgccaaaagtgaactgtgaaccggacgatccaggcatccagctaaccgcttccccctcgtcgcgctcgcgccgcgccgcgcctcgcctccaccagctacgccgtcacgcgagctcacggcccgggggcctcggaagcacaaccaccacgcgttcacgccgaagccacgaggagagcctgtctctcgatcggggattctagtgccggctactctcaccggcgccactcggagcaggctgcattctctccgaactgctgctgatctcatgagcgcggtgagccgggagatgggagatctggtggaggctgcggctgtgtcgtgctggcaagcccagtcggcccggctcgcctaggtatcccgggcaggggtggcgggccctggagcccgcgcgtgtgttcttcttgtgccgcgaccgctttggccgcactaccgggcaggtggcggtgggcgccctatggcgcgccaacattggagcgcgcggcccgtgcgttcctgctggcctccgcagcgctcgtgctctcctgcgcgctctacctctacgtgctgcgctacgtcggccggggaggtcgcgccttcgccgccgcgggcttcgtcggggacgccgtcctgggcctcggcggcgagccgtgcgacgtgttcgacggcgcctgggtgcccgacgacaccggcctccgcccgctctacaatagctccgggtgcccgttcgctgagcgcgggtttgactgcctcgccaacgggcggaacgacactgggtacctcaagtggcggtggaagccgcgccggtgcggcgtgccgcggtttgcggcccgcaccgcgctggagcggctgcgcgggaagcgggtggtgttcgtgggggattcc

SEQ ID NO: 8348 - DNA, 714 bp, Zea mays
ggtccagtgaaatcctacggctggattcgaaaataatggctagtttggaaaccctatttttctaagagattttcattttctcaaaaaaaattagtttatttttcttaggaaaatagaaatctattggaaaaattgtgtttccaaactagacttaagagatgacggcaaccatgacgatgacagagtgggctcattggaaaatcggccttacggtgggcatagaagcccagttggcgggcccggccagacacggcagtaacggcactcactcgttccatccgtggcttgcgttggcgttgcattttgccggctccacagcagcacatcacagggtgattcgttttctctctcctgtccgtttgctaattttgcttgcttggttgcatgctgtgctgagatttctcctgcccaacgaaccgcgcgtatgcagcatgacctcctcctccctcgtcccatctgctactttagctgctcgtcacacacagcagcttcctctcgcaagcacgctcgatcagccgcatggatcccggccgcctccatctcctttcttcttcacttgacctcttctccccttccacccacttccattcttgcctacttgcagctagctttcttggctgatcgatcttgatccgccgctgatgcgatcaaataataatctgctctagttccttaccttgatcgaaacatcatcaacgacgcataccatggggg

SEQ ID NO: 8349 - DNA, 110 bp, Zea mays
ctgtgccgtgcacaacgcacggcacgctggtttggtttgcatcgcccccgccaagaaagacgctgccgtgagcgggctgagcgggcgggaagcagcagcaggcgggcgac

SEQ ID NO: 8350 - DNA, 461 bp, Zea mays
tggcaggtacgcaacggattctctagttatggtacttcatagttcgtgggttggggaatggggatcggcttggttagggattggcgtggctgcgcggtggggatgtgggatttgttttttttttcctacgcggatttgcttgtcatgtgcctggaaactgattgtttcgtgctgcttgatgctgcttttgtggctttgctctaattgtccgccacccaacacactagttgcttgggtttttccagaccggcctagggctccgtagtccagatgtgatctgtattgtagatttctgctgaattgatgtagtcatgccagattccatccatattgtaatagtgctttatatggaccttaattattagtctttggtatttgaatgttgcagagcctagaacatctttgcattttggagagtctccactcggagctattgtacagtctccatccctttcaacgag

SEQ ID NO: 8351 - DNA, 163 bp, Zea mays
ggtacgtagcgcgtgcgggcggtgtgccggtgtgtgtgtcgactgtcgactagctacttcctgtttcactcttgctcttgtcgttgcccgcccctcctcggtagagatggatgaaccgcgcgaatggacgatacggccgggcgcctgatgcggtgtgtggtgc

SEQ ID NO: 8352 - DNA, 1500 bp, Zea mays
aagccacttctacaggcgcaggatgagcgacggattggttggggtgcagtgctagtgcagcgagcgaacgaccacggatccccccttggaacagaaaactgaaagaaagccctcccacgtgcgtggtgagctgaatgagtgcctgaaagctgctggaatggaagtgcgccagagcctgccgttcgtgatgattggtgactgatgagcgagcgacgactgacgattaggggtggtaatggatggacagttcttcgtaaaattgtagggtcctaaataatttgtagttaaaaaataatagaaataaggttcgattttatttgattcttaaattttatagtataaaatttagagctcattgacgagagtggcagggccaagctggcttgagatggatcgacgcgatgctgttggcccgagcccggacgggtgttggttctttctgtgctccttccaccctcacttttcatctactataatcagcgtcgcgttagcccaggaccacgggtcgcaggccgaatgcgcgcagcgggcacagtggctgcaatgggcgcatgataattgatggcattgtcaaccatctttcatgaaaggtacagcgcgatgcaagtagcatagtaggtctaaagtatgagcactgatgatatgaaatatgaagtctgaacactgtagacatgatgatagagatcttttcgcgtaaactaaggctatctgcactcgcggactgcaaactggatgcatcgccatttacagtaaaatattcctgcagcggtggactgtatgaccaactgcaccgggcccaaggcgagctcgaacctcagatatagcgtcttgcagtggataccctattcctccacgtggacaaccacctcttcctcgcgcgcgatgccggacttggacggaggagcaggcggccacgtggtttggttgaaaatcaaatcaagaatttcattatatccctttcttctaccttcaattttatatcatatttcataaggataaacaatagggataggctctggaacagaagtaataaagtacataaaaatcggcaatctaaatattcctacctaatatatcaggacggtcttattaataattctaatgagttatcttgggaattttttgaatcgaatcaaaaaaatctatattatgctcactcaaggaaagtagatgtagataggggcttataccctcagaaaaaaaatacaccagcttcttaaattaaaacgtaaaaaaagatttttttgttatgtcgggaaataattttccagaataaccaatgtccgttaggcacctaatccttatgtcataatagatccgaacacttgcctcggattgacttcaatatataattgctccagtgaataactaaaaaaaaaaaatagaaggacggtagatagtaaagaaaaggactaatcataatatctatctttaaaagattcaataaaaagacagttggcgggtctctttgtatgtcttgtccggaaagaggaggactta

SEQ ID NO: 8353 - DNA, 501 bp, Zea mays
tgcagggaaagtcacacagttcgtttttgaagcttagaacttctggtattattacctaggtctgtgttacaatgcatggttagttatctagtcatataataaagaaaagagcgaaaatagaggatgtggtgtatgggcaacaaatcatgatgctcagaggtggagctagagggaatgtgaggggatgcacttgccttgtgggtgcatagaattttatcgtatgggtgagtatatgttttttcgtggctgcacccgcacccccacatgatgcatagatccacccctaatgttgtcctagcatgcccaaaaacaatagcagatcaagagattctgatgagatcacacattttcgtctatattataagatatttttggttaccgcttttagcaaggctagtatctcatgtactgcaccagttgcaacttactaacttacatcaactaccgtagtaggcgggcagtagcactgaataatgatcttatcacaacttttttttttgc

SEQ ID NO: 8354 - DNA, 1231 bp, Zea mays
ggtttaaaaacaagaaaaaagaacagaactcatttacctgtatcttcttcgttgcctcacggactcagctgtgttctctgtcttcctcttgctctccatcttcctggtgactgaattccattctcgagcaagtatccaagggaagagtgttgggttcgtgacactgcgaggcgatgataaatcggcggcggcttccgaacgaaacgcgcactggcagcgtccgtatgatcaacgaagaaccggtggcgacggctgccagacgaatagacgatgaagtaccggcggctgagtagaaaaccatgtgtcactggctttagataccaattgttagaatcataggtggaaaaaagagacatatagtttaacgtgaaaaaaactcttctatacggagaagaaaaaaaaccagaaaaacagatttattatgtggtgtagtatacaaggtacaaggaagtctatttatataggcacaggagatagcgatatagtcacgtaatcttatccaacaataatcacttcatttatatgggtttttagctgaagtaaatgatttaatctaaatacataaatgaattcagtagagctaatagttagctgactaaaaataatagtgatattagatagctaataaataactagctaactatatattagttaatttgcaaagagtaactaatagctgaattattatatatctaggctataaaaacgtcttgtcgtcttgtttataaaatgtatactagtagagtttctattaaacgtacacgtggaaacagaaaattgaagcaactaagcagaacattagaatatggtgaatgagctaatattattcgatcgatccaaccacccacaaatgacgaactattgaaaaactaaggcagcaaatagtgataattattagtaataagcctccgtaaacaacataaaaaatcaaacacgccaggcgcgctcctcacaggaaatcgaaatagcaccaaccaaaattgctggtggtattatctgatgcatgaattagaccacgaggttgcattggatcgggcgaatttctggccacacacatcgaccaatgggcaaggcgctagttagcctagcctagccagatagcgccccactcccctagtataaattgagcacgagtggggtgttgaggtgaagcagagcatagagctagcaatacatcgctagctcacttgatatacatattgcatctatcggcataaaaactgaatttacc

SEQ ID NO: 8355 - DNA, 1394 bp, Zea mays
cgattctgataattttttttttcgaaaccggtttccggaattccgaaaaattccgaaaccgttttcatccttaattgcgccacagaaagagataaaagcattaccaataggctcattcatcgaaaatcagagagacataaaaagaaaaaagaattatgatcaaatcaatagaaggaaggatctcttacctgatttgaatttcatcttccttcaaataggatatgctctaagtctccccatactttcctataatgactgcaacgattttctccattttgtgaattcctattttatttgagtacctctttttgaacttcggaaggacaaaaaaagtactgtgaaacggataattttaactcattgcgctctaccattactttcccacttcggattccataaaatataaaatattttttcttcacacctgtatatagcttcttctagtgattgttcaaactaaccgacttttaccaccatccatgttttttaaaattttacaattataacattggatcgtactgcacgtatttgatccttttttattggtataaaaacaatatcatctcagaaatactttgactacaaatctatagtgcacgtcgaaatttacatattatgtaattaatcgtgtcgatcaaaatatatatcgcttacctttttattcaaaatatgattattatttctggatgaaactttttaaatacaattattatttcttagactgggatgcacgtatatttatccaattccaatccttccatccgaaagcaatttttgggagcatccagagccctagctggcaacatcaaaatcccacacaggcctcgcgacccagtcgctccctcctctccatctcctcaagcttttcagtttccactcacatatttacaccgctacgggccaagcccaagcgagaagttcttgtaaaatactccgtactacttactgaaaagaataaaaacttcggtcttaaaagtttttactactagcaaagactcctcgactcgagcgaggtcgaggaaaagtttcgccatccggtttggttgtgttggattttccttctattaaaccacaccatctgtgctcctgactccgctgctctggtctttcccaccaccgcgaacacctggcaatggcggcccccgccccgtcggccacctcccagatgtcctcaagcggcctcctttcttactgagctcacccaccacccgccacgcccccgactcccacgaactcctccgcctacccacccctaccctacttctctcgcccgccggacgcatctcggggctctgctccccggttctcggggccggtggatgcgaccgcgtccccgcccccgaaatcagctgcccggcgtcctcatagcgttcccgggatctaggccctgagca

SEQ ID NO: 8356 - DNA, 779 bp, Zea mays
aacgttcgtttacatttgtattactgttctgggctctgggtggtctagctgcaatgtcataattatggtcgtgttaggttttgttccacccttggcactgaagtgattttttttgtaattcctcggcactgaagtgaagttttgtctgaatattgcctcgtaacataattgcccggtccctgttctagttgtggcgcagtctggtttgttttgacatttgttttcaaggttcatccttatttgcattgcatttgtttatggcttgacgttaacatttggaacaagtatttgtcaccgctcatgtcgatggtgtaaaacatgatagttatgttgtcttccctgggctgtgtaaaataagggatttgcaatatgacattatttgcagagtgaagtttgaaataagagatagggaagctgacgaagatagccttacaagtcttattggtatctaatactcggtggactggatctacgtcgcctcgccgcctactcctcgtagatctagttgccggtggactggatctatgtcgccgcctactcgcctctccttggtccgccccccttggctgccttctcgtctcttctataaggtcctctggctctgtcctacgtccctctatagatatagtcctccaccgaccactgtgccggtgtgtttgtgcccgtttggccatctacacgtgtaagttttgaggattttggctctgtttttttatgttctttgctctagatctttgcatcttctctgactctggatttactcgtgttgcacgtttgtc

SEQ ID NO: 8357 - DNA, 1070 bp, Zea mays
tgacgaaggtgatgcttgccgaaggtattcaaagctcaagaaatggaagtgagttcaccggaggtgggcgccaatgttggggacttgttctcaaatgctatgaatcaagaacaaggcaacataaaatgttaaatatcaaagcccttcgtccttcggatcattatttcccttcgaatataatgaatctaggacgaaggtcatgaaggacataccttcacgatcatgataaaagatggagaatattcatacaaagtacagaaagtaacatgatttttgtaaacattattattaatctatttccatttatattacttgtgtaaacaatagtaaattacaaatgtaccttcggcttgaaggaatgagaatacaggcgtaacacaaaagtgaatgccaagtcagcgtgtccagtacgggaatactgttcacctatttataggcacgggtcgcagcccgtgtaaaattacattaatgccctttacatttatcaataactatatagtaattcttcagggtctaatttggcttttcatctttaagtcggttccccttttcggctatcatgccgaagcttatctgcgcatagcttcgtgatgatcttttccttcgtcacaatcgccttctgtcccactcaagcttcgtcttgaccatactcttatatactcgtaatccgattctgaagatacctgttcacatatttctacttggaaaacattgtcaaatcatatttttgaggaccttcggaagccgaaggcccccaacagtagccccttgcaatattaatttgctggaatgataaattcatattgcgatatggacgaaggctttaagtcgaaggtccgaaaaaaacaccttcccttttgctagaataagcaacagtctttgacaagcgggaccctccagttttcaacgcactcggtgcataaataagagctcaccacgagtttatttggcacgctttcttgccatcgactcttgctcacccgacttttagcctgtgcgcaacaacacttgcttggctttttaagcttttaagcttcggcttcgagagcactttctcagcgtttgcgaag

SEQ ID NO: 8358 - DNA, 1067 bp, Zea mays
tcgcaaacgctgagaaagtgctctcgaagccgaagcttaaaagcttaaaaagccaagcaagtgttgttgcgcacaggctaaaagtcgggtgagcaagagtcgatggcaagaaagcgtgccaaataaactcgtggtgagctcttatttatgcaccgagtgcgttgaaaactggagggtcccgcttgtcaaagactgttgcttattctagcaaaagggaaggtgtttttttcggaccttcgacttaaagccttcgtccatatcgcaatatgaatttatcattccagcaaattaatattgcaaggggctactgttgggggccttcggcttccgaaggtcctcaaaaatatgatttgacaatgttttccaagtagaaatatgtgaacaggtatcttcagaatcggattacgagtatataagagtatggtcaagacgaagcttgagtgggacagaaggcgattgtgacgaaggaaaagatcatcacgaagctatgcgcagataagcttcggcatgatagccgaaaaggggaaccgacttaaagatgaaaagccaaattagaccctgaagaattactatatagttattgataaatgtaaagggcattaatgtaattttacacgggctgcgacccgtgcctataaataggtgaacagtattcccgtactggacacgctgacttggcattcacttttgtgttacgcctgtattctcattccttcaagccgaaggtacatttgtaatttactattgtttacacaagtaatataaatggaaatagattaataataatgtttacaaaaatcatgttactttctgtactttgtatgaatattctccatcttttatcatgatcgtgaaggtatgtccttcatgaccttcgtcctagattcattatattcgaagggaaataatgatccgaaggacgaagggctttgatatttaacattttatgttgccttgttcttgattcatagcatttgagaacaagtccccaacattggcgcccacctccggtgaactcacttccatttcttgagctttgaataccttcggcaagcatcaccttcgtc

SEQ ID NO: 8359 - DNA, 564 bp, Zea mays
gtagtttttttatttagaatcaagactctagaatccagattccttgaatcccctaaattgtgtttgtttattgttagaaatgaacttcatctaccaaacatgattcgaacaggcctttctttaccatgtttcgtgcaactatgcattgctaacatatcagctagcatggtttgcactgctagaatatcagtttattaccattttcgtgcaatcgtgactgaggtggatggggttattgaacaacgtatttgaatatttgatgttttagctgcatggaagtattcattccaatccttctattgaattgcaaagaattggtaaactttgagatctgtatagttcagttttagttatgcctcttcattggagcctgaattggacttcagttgtttgcatagttatagttacaaatatagaatagccttgcttatccatcaattttgaattgttacagtactgaatgagtcctcagagtgcatagtgttgttctctttttatgtgcatgatagttggtcctcttgtaattcagttgctcttgcgggtagttcccccccaactgtcacc

SEQ ID NO: 8360 - DNA, 1500 bp, Zea mays
aggtgaatcaaatctgtgaagggaacgtggccgtcagatctacgggttgggagttagatcaattatatcttttgctaaatggtttagctctaaaacatctagcggaaaatgttgacaatgtttaatggacaacataaataagaggagggttggctccaactacctatctttctagcatctatctggtggtttaattttcacgccttctctcttgtaggtctcaccctcacttgtgtaacttgagattaagaaagtgcagcacttaccacagtggtttatggtgaagtgaaatccattttcgtgctccattgagttcttgatttttttttgrtttggatttttccttcccgatttgaatttgagttcttggaacttttgggttggatagaaacgtgcaggaacctccaggtggtttgggcagattcaacaagagcacgaaaatccaacctcttgactgattttgagaaaacagagttcgcttatatcatttttgccttttagagcttttgttcaggctgctagcagccgtcaacacatcactgccatgcactgagcacggacaattcaccgttttgagtcttttttggtgtttggggtgtctgttttgtgatccgtttttgattttttatatactttagggactttttcaaagaatccaaccactagttggttgtgatgttttttgtttgagctctttcttcgttaccattagagcagagctcacttttcggatttcaaaaggcttcacttgtgtacttagttttggctggctcaagtgctccgttggcttgagagtatctcatttgtttctttttgaaacaagaaggcaagagttctgccttatatattgataaggaaagaaatgccctaaagaaagagtcaatataaagacgatgtcaagcacaacagatactctctaagcatcccgtagcaactaaaaataagactcacaactagcaactcagctaagttatgaggataagagagtagctaattgcctagccccggctgcaatctaggctgccgcctcgcacttaatcagagttatgatctgttgactggtcgaaaacctgcgatcaaaagtcctcgcattcctttcctgccatattatccaattaacaaggatcaacaatgatctgagcccatttctgctaaggtttggtgttttagagaattggatgaagatttgataaacaagccaaaattgattcgtatggaaattttttattgacttctattcattcatatatggacacctgtttcggtcctgcccaaaccatgcggggaacacatattttccacagttcgcatcctggcagaaaaagacgaaaactaatggcctcaaaactggttgatcgattgaggcaggcaacacacgaacacagccgtacgggtacggtaggtgagggagagattttcagtcatcttcagagataccggctgaggcatgcggagcatgcacatggcctattttaagtgtatttgtacagccctgaatgc

SEQ ID NO: 8361 - DNA, 1279 bp, Zea mays
tgtaaatatgtttaggaccgtcagtatagagcttatctgtactagtgttaagaacatggtcaccgacgacgaaatgtattattatacccttgaagtagtactagtgcaaatgcttgggcctaggctttagagctgatgcacaatgtgcatgaaggcacatgcgacactgtattaattaggagctcgccgacacacaccaaggctcactagataaagtggttaattaggaggtccgattactattggccgacacttctgctagaagatttatgtctacgagaargtcgtcgccgagtgtgagtgcgagcacgacctaaacgtcgagaccctctctgaccccacggtcgtgcgagtaacgataatctttgccaaagtaggtatggaaaagcgcgttaaggtgctagtagtgtacgggtgtacaatatctgaagatcgttttacggcattattctcacaactccatgttcttcatctatatatcatgatatatttttattcttgacgtaaaaaatgttatacaaaaataaataaataactctacacccctgctacacatcgcagaaagcacgtccaatatctcaccaagcatctaggacgtgtcccttgatccgcgcgcatgaggccacgcgagacacacaagtactattggcttttaggggatgcatgctgtggttctcgtcgccaactcgaacacgcaacgtggacaaaaagtctctgaatataagataacgcttgcgtcgtctggaggcgccacgcagcatctagacgcgtcccatgcacgcttcagcagttgcatgcccctcccccaggccaggtggacacaatacacgaacacatcgcatccaaactcacacacactgaagcagaagatgacgacgaactataaaaaacaagcaggaccacgccaccagaagcccaaatacacaagaacacatcgcctatccagtatccaccgacctagctcatcgcgaccaaagaaaaggacacagcaactcagcaagacccccatcttccatagctctagctactagctactagtttcaggcctgcggctcgtgaacacctcatctttttagccacttttgccaccaccgacgacgaccgatcgatcagctagcagctaggccatcccgcgcgcgtcacgaggaacccacggccggcgtcgccattgttgtcgctgtaacttgcaagctttccctagcatcggcccttttccccttccttttccctcgctcgtcctcgtgctagctgtgtataaaagcgcgtcgctagcgcgctc

SEQ ID NO: 8362 - DNA, 598 bp, Zea mays
cgactaagggaccacggttccttaatgaactttgtccggaaactagctagttttatacctcagttcctccctaaactatatggaaactagttctgttatcgctgctgaccatgttttatctcgatcaacatctgcacattaacaatacacacaaccgtgtacgagcacgatttgacattaatcaaaactatatatctgtatgtatgcattatatccaaatacatgtaaatcacaataacaaattctcataatgttcaaatgtcaaataactcaacagtttaatgtaggtgcgaggtttgatgccttccattccatgtgattgaaaaaatatattataaggaaagaagcaaatcgccgacgactcacgacatacggcctgatatacccctgatttgctgatcactgtttaactataaattatttcatctattaacaaattaagggttgtgtgatctgtttgatgtataagtagtggtagaacactcagacatgcacgctgcagggtcgagtcgggtagcagcagctctacgaatgctgcagcgagctagcttgtctcgacttctctactcccccgatcacgcgtgtaatttttaagacc

SEQ ID NO: 8363 - DNA, 1500 bp, Zea mays
atcmatttctcatgaaatatctctctttatgtttcaacatgtgtgtttgacttagagataagaaattgagtttgatttacaaaaacaaaccaagtggtggcaaagaatgatccatatatgtcaaatttgaatcaaaacaattttgagttcttatttgaagtgattttgcacttgttctacttgctttatgttaggttggcataaatcaccaaaaagggggagattgaaagggaaatgtgcccttgggccatttctaagtattttggtgatttagtgtccaacacaagtgcctaagtgttaaatggtggacaaagtacaaatcaagtataaaggtatgtttctccgacttagtacattgttttagagactaatgtattgtgtctaagttctggaaacaggaaaaatcaagttgaaattaaagatggctttgttcagccaaagtcagctctgtctgggtgcaccggacagtgtccggtgcgccaggctgactcaggcgaacttgatgctctcgggaagtgattaacggcgtacgactaaaattcaccggactgtccggtgtgcaccggactgtccggtgagccaacggtcggccgggccaacggtcggccgcgcgatccgcgcgggacacgtggccgagccaacggtcagaagggggcaccggactgtccggtgtgcatcggactgtccggtgtgcaccggacagtgtccggtgcgccaacggctccaaagcgccaacggtcggcttcgccaaataaggaaggagatccgcaccggactgtccggtgcgccaggcgacagaaggcaagaattgccttcctggaatgcactcaacggctcctagctgccttggggctataaaagggacccctaggcgcatggaggagtataccaagcattctctaagcattcataagcaccaagacttcgattccgcgcatttgattccttgcgatagcaattagagctccgtttgagttgtgaactcgctgagttgtgttgtgagctcttgttgcgacttgtgtgcgtgttggtactctgatttcgtgtcttgtgtgcgttgctcatccctcccttactccgtgcttctttgtgaacatcaaagtgtaagggcgagaggctccaagttgtggagattcctcgcaaacgggatatagtaaagcaaagcaaaacaccgtggtattcaagtgggtctttggaccgcttgagaggggttgattgcaaccctcgtccgttgggacgccacaacgtggagtaggcaagtgttgaacttggccgaaccacgggataaaccactgtgtctatctgtgattgatcttcttgtggttatcgtgtcttgcaaagactcttatctagccacttggctttattgtgctaactcctaaccaagttttgtggcattaaagtttaagttttacaggatcacctattcacccccctctaggtgctctcaattggtatcagagccgttctcttcaagaaagggactaatcgcccgaagag

SEQ ID NO: 8364 - DNA, 1500 bp, Zea mays
agcggatccgtgccgcccctcccttccccctttgttaacttggatgcgtgtctcggcgcgattcgtgctgtcggaccggcggttcggctcgccggaggcgggaatgagggttgttcagctgggtagacgcgtttcagctcgtatcgtggcgggattcggtgggggaggacgcggttctaagctgtgatttggcctcgaaattatttgggatttcggtgtcgactgtcgagaggtgcctccttccgagcatcctaatcctgaataaaaggtataatcatccatcacgcgtggtatgggcagatgcatgcaaatcttctattgcgcgtgaatttatacgtggtcaattcaatacagtcgtggctggggggaaccgagggccgaggcataccatgtgtgctgttttgtgcagttgtgctccggcgacctggaattagtgttgtggctgttatttcccgcaggctctgctatgctgctaaagtttatattggatcttgtgtgatgccaccatagtttctcgaaacagctaataaatggactgctgcgcgtcatttctaggttcacaaaccttctttgagctacaccatttctaggtgtatacttatttgatgggtatggtggcataggcacaactagggctggatatcgagccagctcagctaggtcgagctcgagcgggctcgttaggataatgagctggctcaacttagcttattaagaaaccgagccagagaaccagctcgaactggctcgtttagctcgcgagccaataataataatatgcacacacatatataacaatataatggattgctagttaatttcagaccaattaaacattagaaaagagtaataatactcacaatttcatataccacattaagtcaacaccaaattaacacagttcgtcacttattagttcatccaatacaagtacatgctttgttctgttgacaaatgctagctcattcgagctaacgagctagatcgagctcgactcgagctaacgagctggctcgttaacaaatcaagctgagatgctagctcagctcgtgacaaaattgaaatgagtcgaaccgagccgagctgsccacgaaccgagcgagctgacgagccacaagtattttgtccagccctaagcacaacacagcatgttgctgagtgatccatacgttttcttttgcgatgattgctgtactgtgttggcacaagagaaacgcaagagggggataggttctcccccgttcacaatgactggctgtactgatgtatttgataaattatttgatgagcttcaaataytgtacaaggcatgtttgcagagttttgtctctgggttgctgcttctctgttattttgaattaagcagcatgtctctgttctcaccagagagaaatttcagagaataacccgagttttcttttcccttgttaggcaggctcatctttgcacagagtcattggaggaagtttgatgtttcagcagtactgtgacctttattag

SEQ ID NO: 8365 - DNA, 293 bp, Zea mays
gatcacgactcgatctgtttctgatagacggtgattttgcaaaatcgacccggaggacggagacggagtagaaccgcgcagcgaagcagcagcggcaccaaaagccctcgcgttggtcgcggctgccgcccgccgcccaccgccggtcgccactgccggtcgagtcccatcgagccgagtcggtaaaccctccccgaatcacttgtgtcacctctttggtccacatcaggacccgatctgagactcacggtagctccgcagcgctctccgatccgggtggctgcggcgccggc

SEQ ID NO: 8366 - DNA, 437 bp, Zea mays
acactgatgctcctggaactgcagtgacggttcggccgtgtcaaattctcgggtgtagggtgtacctctggccaagtgactgatattctgaaaaacatacggacttctagtataggagaagaggaatcctaatcctagtaattatatcttagtagatatgtgcttagtctcttgttaattttttgtcttgagaggactatatatactgataaagtgataatttattcagagaataaagaatgggctccatgctttgtctatgtattctcttcttgagggcaatttacgcctcttgagaagggtggcttcgttgttgggctcttgaaggccccacgcagtccaacggagcccactaagcctaattctgtttcttcgcgatcgattagctgattagctccatggcggcttcgaaaaaatcaaaataaaaaactagcgcc

SEQ ID NO: 8367 - DNA, 189 bp, Zea mays
gggatcatttgtgcatataatttatgggtctgatggtaaaatagagaaatccataattgagagtgacaaaatagcaaatagcccattggcgacgatggacgacggttgatggatgatcgaaccgctagtcaccgtatccgttcggcttgaaatttccgatttctgccagatccaatcgcggctaccatc

SEQ ID NO: 8368 - DNA, 502 bp, Zea mays
ggttgatctttgggtgttacaggatcacgggagctggtcctggtcgatgaaccaccggatcaaattggacgtgatgtttttctccctgctgccggtgctggacccggaaggagatgtgctagtgctttctaaaagaggggaaacaggcatcctgtggcaacatctgcatcacatttctggtgtcaatggcagtttgctggccctgtatcaatggagcgcttatctgaagcttagcaggcataggctcaaagaaagtctagtccaccatgacttcttctcgatggaaggtaatgagggtggtgtggatgaaaaaccattgttcgatggcttgtcaactgtggcattgcttcgtgatgataattctgagccacattgagaaacaaaggtattactcaagctgtttcatctcatcaggatggagtcactcctgcctagtaataacagcactgcagattagtaataacctgaaactatacctcgagtctgatttttcccttttcac

SEQ ID NO: 8369 - DNA, 656 bp, Zea mays
agttcagttacgccgccagccccatgtgagatgaatgaattctgcattgagatccagcactctattagtctgagatccagccgctcccagacgggcagtaggcaccgtcattgcactaatctacagcgttgggcacttgggctcggaccggagttattatattgcaaaagtagagagtactcccgtctcttttaaaataaacgcacgtcttgtattttaagaaattaaactacattttttataaactaatattaatatttgtagtttaaaataggttcagtaaaatatattatgtgatttatttatagtgcttatttgggatcatcgatactattttttatatatttcattaaatttggaaattgtggatttttcgaagtgtaggaatttggaactgaggtatactaataaacaagggttgcgcgatcaatcatcagaacctccattggcgtggaaggtgaggaacgcgcttccgtgcgtgcaggagggtccccctatttgttgggggacgggaaggttggcagttctctgtaccgcgcgctcgcgcccgaaatttcacaacaccaaacccgcaggggggagaagcgcaaagccacgaggagtgcgaggcgagggccgacaccggggacaagcacggcgcggcggcggaggcagca

SEQ ID NO: 8370 - DNA, 255 bp, Zea mays
ggtgagtgtttgatccttcatattcttagtgccatgtattctccagtctgtgattctccactcaatcattactcaaagaaatggcaaattcaaggcccttggggttctaattaactgatttttatggagtttgtttttgttgcttacatcggacctaagttgttgcattttgctccaaattgaaagctcgtccttttgggactttaagagaataagaggcaaaaggaacataaggatagaggagagaaataaaca

SEQ ID NO: 8371 - DNA, 272 bp, Zea mays
atctgtctatcagcctcctaaaccatcatcgttgttctcaatggttgagtacatgcttctattataaaggtgttaaactttaggatttatcattttgttatggttagacgctgaatctgccattcaccttttcctgcaggttcaacgctgaatctgtccttcaatgccttcacaggctctacccctgaagaagttgcagagttagaagctattgccgcattttttgttgaagggaacatttttttgggtcatatccagattgaatacgaaac

SEQ ID NO: 8372 - DNA, 1398 bp, Zea mays
tggtatacttcagcgaatcatgcagccttagctggtgatacatcagatttccattcaatgcgtatctccacgaatctctacacaaaggcatcgtttcttatcgttgaagaagttgtcatgtccctttcagtgtgttgtgtctcgcgtcgtcctcggtcaaagttggtagcctgaaaccagaacttgtatccaatagcaggctgcaggcctagctctttagtatatactacccttaggcctagtttgaatactttgagattagagtgttttgaagggattggagaggttgtaaatcttcgatagatcaaatactctctcaatacatctcaatccacttcaatcccacttattactagagtacctaaactaggcctcagttatcaaatatttgtcacccactaattcaattttgaagtaaaacgcgacaaattaaaaaacagagggagtataatcaattgaatcgaaacagtccaacatagctgctgtcctttcctttttctcctgtcactgtaactaataagaacagagaaagtgaaggcccacgcccacaaactgcgcagctagatcgaccaaacaagagcattttgttctttttttccgcggtaactttgataaagtccggttaagccaacatagcatttgaagtcaactgtaggttgggccgttggggtagacatgtatctagcctctcatttgtatcttctggaagtgggccaacacgatgtgcttgcaagattagtcgtttctctgagctgttgccagacgttcaaatgacaagttggagagactaccaggtgcaagattagcaatttgtttggagagactaccaggtgcaagattacaagttggagagactaccaggttcaaatgacaagttggagagactacaagttgccagacgttcaaatgacaagatttggttgcgttggaaattggaatgaggatgttataaccttcagagcttgtttgggagcaattaatggacttttatttagtcccctcaacctcaatccacttccgtatccattgacaaatgaaccaagggtcagctgctgaggagcacattcagttacagtttgatgagcatccttcaattcaatctagatctctgaccttatctgctacgttcagacttggtagagagaaaaggtcaactgttcaacgttcagcgccgtctatttttctttgagaacacttaatattaataatgtaacagaattgacgttggccggcccgtagagatatataagtaccccgactctcttctgatgtccacctccaccaatccaaccaaccattggccattgcagagaagagattactttaagaatgggctactcgaagcgcattgcactggtacttgtagcggctgttgtagcgctccacgtccatgtcccg

SEQ ID NO: 8373 - DNA, 1011 bp, Zea mays
cacaccagcactagacgaccgatattgatcgggcttggttggtactgacatagactccaacacgactgtcaatatcaactagcatggtcccagtataattggtacggaccatgctgactggtcagtaggtccaccaactgatcgatcgaatcgtctgtcgttttagcctcgatggtcggtattgaccacgcaccaagtgggcgataatggccagcgttggacccagtttaaagtttatatattggagtgttgcagtagataaaaactaacgataattgttagtgtgatcaataacatgatctaaagttgatacggggtttaataaggacgcacttcatccgaaatatgaggttcgacaataggcactacaccctaagaatgtgaggctacgaagtgagtacataggacacgtagaatttttggaccaaatatgcacacgtttagcagcaagtgttggagcgtgacatgaagagggtgtttggttccacttaactatatttaaataataattacgcatattaaatataatttaattataaaactaattacacatatgaagactaaaaaataaacaaaattattaaatctagttaagtatatatttaatactaaaattgatactccctccgtctcaaattaaaattcgttttattcttttattagattcatataataattaatgtatgtgctctctctatatatcatctatatgaatatagacataaaaatctagagttaaaataaatactatttcaaaaccgacgaagtatttaaatatttgatgtaattacacactcatctttagcctgaaaacaccctatattttagccaaaaataacrggtgaatccctgaggtatcgccataagcccataacggcataaccctagtccctaccccatataaaacgcggcagcgatgaggctttccttccaattccacccatcgccgccgaaatcccgttgcgtctctcgcgcgttaccaagctctcaagttttctcgcgccgacggca

SEQ ID NO: 8374 - DNA, 572 bp, Zea mays
tgcagcttcttcaaccacagtacttcctctctcccaagccattcacagtgtgaacatcaagtcgctggtgtcgtacactctcgacactcaagttcacaactacggcaaatggagtcaactgttcaccatcgttctcagtcgcttcacactggtaaagggaatgtgatggcgacgatgatggtagatatttaaggcaaggcggataaaataaaacagggaggacaattgaggagtacttgtggggagagttagatcactatgccccacttcaaatggagactcccaatgatgctcaagctgtccaaaaatgggcagaggacaggagagtgacccagttcctcaaaggattgaactatgaatttgagagtagaagggctgttttttgtcaccaggatagtctccctaccttggaggatgctatttcagccatggtccaagaagaaattaggttgcggtgatcggtagtaacactcctgttagatcagcctacaccatagctgacaatagggaatcttacaattgtggagacaaacggcatttgagttataattgtcgtagaccaaggaactata

SEQ ID NO: 8375 - DNA, 842 bp, Zea mays
cccacacccctttgtaattatatttattgttttgtttcttttctttttcgtttttgtttatttaagatccaagtgggttttggtgtgttttcccatgctggtttggttttggtttgtgatctcgatttcattttttttaatatgagggggttgcgattttactttatctttttttttatatgataaggcttcgaggggtttggatttgaatcggatcaccaaacacagatttcagatcttttagagtgatgtttcagatctcttcagccaacgtacggcgtagacggactatcaagggagcggtggcactacctcacttgttcaccccaatcagccctagcttgccgatgtccattaatggccggccaggcctccttcccagttccctgcggttttccggctgcgtttggcttgtccgcttgcgtgagtggtgaaccacggtgacatgttcaccgcaggcgagcacaggcactcggctgggctaatatataataggacttgattcgagccgtgtattattataactgcaaacctagggcgcatccaacgctccacgccgcccgcccgcccgtccccattttatttccccctttcgtccgtgggcacctacagcaacggcagtcggcagcatcgtctgttgccggagcgcagctttgctctccgcgccgcatgcgtccaccccaccgttccccggtcgctgttaccgaaccggcgcgcccccgccgctgccgctttaaccccaaccaccgcgctggcccagccgatcgccgtcggggttcatagttagttagtctgttggttggtttggttgccggccgggtttctgatctacggtgacgacg

SEQ ID NO: 8376 - DNA, 1191 bp, Zea mays
tgtaaagctcactttaacatcctgtgaactacaaacacaaaccctagcaaccatattaggctatgttgatcattaaacaccagaatcaattagtcaaatagacggaggtccattttccttacagtgtttgtggtcgtgtgcgttgttagcgagcgcacacaaacagtgggtgcaacatgttggtgaaaaatgaactcaaacgagtaaattgtagttatccactcaattggatatacaaatttgtccgtgaatagtagtattctatctgctgtaggtgaacggtaaaccgatataaaaactaatttcctattttcatgtcggtattttgcatttcccgtctgtctgttgtgcaccggtcatgaaaattttggtttccagacgctctggacaatcaggtcgtatacgaaacatgcaagttgcttattttcactcttctatgtcgatgccggacaaagagaaaaacagattaggtgacctgttacattaaatgcctgaagcaaaagtgatagaactggccacttcatctgaagcattcaagcgtgtatatatagcaccattagatgctgacatttagctgtgtgtctccagcaatgccaaatttcagggcctgatgtgcatttgctgtagcctgagcaggtgcggtgcctacctgcagtcctccgtcctgggcggccacgcacaagtgcagcactcccaagtcccaagttcccaaccacagcccacctgcagtcctttgtttctacttctggcagaaagaaggtgttggtcagagcttacatatcgccgcacaaaaaaagcatgtgttgtgttgggagtgagatcaccatggcggcgtgcagccagttttatattgtactacccgtgtgttaggtacaacagccacaggtgtcttcttcggctgccagcgtgcgccccacaaacacatgaggaggagggccgtcggggcgcgtccatccggtccggacacccgagtacccgacctgcttgctcatcgcgcgcacccgccaaagcaaccaaccgccccatcgtccccgtcctgttccggcaggcagccgctcccgctcccgctcccccaccccactccccctcgcgcggcgcgttctcagatcccccgcccggttggcaccggcaccccggtccgaaatgcgaggagccttgtagcgcctcggagcacggacggaatcgcgccgc

SEQ ID NO: 8377 - DNA, 96 bp, Zea mays
cctaatgatttttatcaaaatcattaagttaaggtagatacacatcttgtcatatgatcaaatggtttcgccaaaaatcaataatcagacaacaaa

SEQ ID NO: 8378 - DNA, 625 bp, Zea mays
tgtgaatgatgcaagtgtgaactaattaatgagctctactcaactattttcccccttctcatgcatgattgtgtaaacatcagggagattagtcagtgaaatatttggcatgcaccttacttgagcgctgtggctaataaattgtggttggctggaatgcaaattgctccatggtgttgttaatttggtctaagctggagatgaagtgactgactccatgggcatgtggttcacctccctgctggtggtggacgacaaatatcaggctggcattcacgtagaatgtgcggcaaagactgatgactgatgagtgatgactggtgaggaaccagacaaatgatgagttgaatctttcaaagtttgacagttcagtctccaatttttttttctcaaatcattggtactgtgtacaagcttgaagcttcctggaaacagcccctcctccacgggtttgttcaaccatgtgagcttccacaccagtacaggtcatcagtgtcttggactttctctgccactcccagaccttggtatcctttttaagggcgctcattctgtcattcaccacacctgtctcgttcctcactaccacaggtccaaagcaagcaagaagaaacgaaggacgata

SEQ ID NO: 8379 - DNA, 1249 bp, Zea mays
cagactctcggcaaaggaggctttactgagtatcaagctctcggcgaagcaaggcgccggtaaagggccgtcagtagtcgtctatagttgacgaccgttaactttgccgagtgttacctagcaaacactcggcaaacctatattttgccgagtgtcttttatggacactcgacaaagtatatatgtttttctttttctctaaactttttgtgatgtgttcatacagtatatagatctatatgtttaattttgacaaaattataaaagtatttgctataactatcaaatttacttcttttaattgaatttcttagaacaattcagatttaaactgcaagtcactcgaaaaaatagaaaatggtgaatgaaaaataatattcatgttatttaacacaagttacggcgtatttcagaaacatgccaaaaatttcgaacaccattctcacaaaacatgactgagaacttgcgacacaattgttttaaaattgtataaaatatagacaaaatcagaaaattatgaaacttgtcgacatgtcatgatatcatatgtagagagtctggtaaaaaatttgagattgtttcgtgaaaattgttatgcactatatgtagaaaactagccgatctatattgaaattttatgatttcgtatgaaccaaatccttagctttatttcttgctctctaacaaaaagtcgttgcagtgtagtggttagtattccctcctctcacccgggtggttaacttattttttggtctgtctgcgcttctcaacatagccatgaacacgccttgcctttccttactcttccagagcctagcaaggcccatgagccaaaaaaaaaagctcagttggtcagattaggcggttggtggctgcttcgcttctagacacttccacaacggccgaggctgcggcattcacccgctaggcgatcgtccggtccggcgcatctaaaccctggcgtgttgtgctgtgttatttaacgcctcatcgcctctacctcgcccgtccgcaaacccctctctcgatcgacacacgcagccgcgacctgacccgaccctcccgaggccgccagccttatcctctccgcctcccgccgtcccccgcgacccatccgcaagcgcgaggtgagtccgcagcccgtgctcccgcgctccttcctcgcctccccctctaattagaggctcctccgcgctctcggcaggggtttagctgccgtggtctgaggattgggtgagtgtggaactgg

SEQ ID NO: 8380 - DNA, 882 bp, Zea mays
ggtaactcgctgctttgcaatgacaacggttgttaaacgacacatgagtccatgacagaagcagaaagcagctatggaagttagggagtgttcatcgactgttcatgtttgaaccaagcatgagggatgaaagtggtaatccgaactgttaggacaaatttaatattttaaaatagatatgtataaatgttgatgttgatcttttcctatattatcaagcacattagtacaaatatgaataaaatattacataaattgttttatgtattatttggtccatacaacacaaatagttgaaaaaattatcgaatttgtttccgaatccataccgaagtttatatctattatttaagaaaatataagatgaatttaaggtttatcttttatgaatctttacaagctggatgttaaaaacatgaatacaaatttgtattgtagattctatattctatttattcgcaatcaaagaaaaacgactaaaaaactgattatcgaataaataccgtttcagaccgttttcatccctgatgacacaggtaaaatttgattgctctgcttcagtgcttcgttgagaagcttttgctcgtttctgtccgcgacgcggaagtccagccgtttctgccgcaagacacaggcgacgaaaccgatgtgcggaaggagagcccccggtatccaggaaaaccagcgcccgcggccgcttgtttgcagtcctccctcccgtatatatcaacccgcccaccacacctccaccccaaacaggcaaacacacaacacaaccaaccacctcactcgatctctcatcactcgcaagtccagcgatcaccaaccagagctcggctccaagcctccaactccaacccaaggagacagatacgttcgcag

SEQ ID NO: 8381 - DNA, 243 bp, Zea mays
agccccagtattcaaatggttctccgtattagaatttggtgggttaatcatctcttgcttctatggattaagtcaccactatgatctttcgtctgttgggtgtgacaatgatctcctaacccatctatatctgagactactcagagcactatatattctcacatttgaggatgccgatcaatatctgagacagtacacacattcatgtttacatgttttaaatccacatgataaaaatatatt

SEQ ID NO: 8382 - DNA, 874 bp, Zea mays
cggagtcagtcccttcaatgttttcttctccttcggcagttgttgggcctgcttcagcagcaggcatttcttctgtaagtagaccggaacgctgcattgcttcggagatgggcacagtgtctgaaccttcggcttcgtctccctcacgtacaactttggcagtagatcgtattctcgccatttgattctaagtttgggaagtcaaaaaacttttttccttttttcttttctccgaagctcttctttctgacgaagcggacgttgagaagcaccttcgttcggctctgagacttaagcttcggctatggtgaaaaattttggcagcgaaacagtgcaaatagcaatgaatgctgtggtaacttcacacccacctgtttgtttatatagtgctgcaggtaggaaggcgaagcggtggaactgttacaccaggcgcgcagtaactcatacccgctgtgcagtggaccgcaaagaccaaacagtaactctacaaagtgggcttggcacgcgctcggaagtcggatcgtttctccgcaacgagctcagggaaggtgttttttggaccttcggcttcccgaagctgaagaggttttttttcacgggccaagctcgttacgaagaacgatctagcaccgcgaaaggggctactgttggggtcgtgcttcggtacgccgaaggtctcacacgaagaagcagcttcggccaaagtcgtttctaagagatggccgaaggtcccttttcatggagcttcggcgttttaaaccgacatagaggcagaatgacctttttatacatgtatgtccgagtcaatgttgtaaacttccgcaaggggcataattgtaatttgtcacaggctgcgacctgtgtctataaatag

SEQ ID NO: 8383 - DNA, 392 bp, Zea mays
ttattaaaaaaatataagtgaacggctagacaatctaaatatattttggcgtgctgatttttactctaattagcttgcaaaaacaaaaaacagtttcaaaagtctaacaaaagaaacctaagtaggtttaagagtcaacgataccattttttcactaaacatgggtcaactacgtgtgtctttttattgaatgtgaacgaaaaggccacaaattcaaaggcagggtgaacctggcagcagggcccacacgacatccaaatcgaagaacacgtcgctgacacaccacctctccctcgccgcattctccactctctggtcttcgccgtggtcggtgccttccaaatccaaaaaaccccaagccctagctgtagccgtcccccaaggtcgccgag

SEQ ID NO: 8384 - DNA, 150 bp, Zea mays
ttgagatcagcaagaatgcaatttacgctgattgccgacattgagctgatctttcctcgggcattcgggctcttagccgtcatggtgaatggccacgatgattgatgagtacaaaaacggtggcaaactcgatttgacatcgcagcagac

SEQ ID NO: 8385 - DNA, 1500 bp, Zea mays
agctaagctagggtagtggaggaggcgttaatgtcttgccgaccatggcgcgtacgcttcctcagctcacttgtttccggaacgggtagtgctgcaccagtgaccagtgtggtgcgtggagtacataatagtactggagtggagcagctgatgcctgatggccaccggatgggattcacgcgaaacatttgcatttgtacgcgcgagattgcagactccagcggccctctaggctctagcaaagaaagaaagaaagaaaggaacggacgttaaggacatgattgctttctgtctgtcaggcagctttgcaattgcaacctagcgagaatttagacctcagactaagaatatctaagtctagaaaaaaaaattcgcctaaacgaagaaggtttttagttctttgagaaaaaaaacttaagaactagtttagaaattcaaatctccatagagaggctaattttctcaacttcccaccatcctgaagatgatctaaatttccaaactaaacataagagaccgtgagtataatgtgacgggaaacaacaacagtgttccactatcaaggcccatcctaatcccgatcccctttcaatacgcacaaccgtcacacggaccatacgcagttattatgcacgcggaagtagggaatgccaaaaggcttccttgcgaagcaaacgagaggcaggaagacgtcgtttacagttggtttctcgtacagaatgtgacagagctgccgcctaagtataagtaaccggatcatcgtcagtagtttgtgcttaattatgctgccagcggattgcatcatcttatgttggcttggttttctaggttctgagaccttaaacattgtggtagaaagagggaaagtgtgagattgtgaccatgattgaggacgggtgccccatgatgaccatgagaaactgggaatgttggcccaacacgacacgccacgacacgaatcggtggtgcgtccataactggcgcatgtgatgtgtcacgctggtaatcgacgtagccaacccccaccttaattcgtccgtcataagcagacaaaggcgttcgttccttccctcgaccacgattaaggaataatgtgcatccactgcccgtcacgtccttgtcgcgcgcgccatcacattcacagctcaggtctcaggcccccccacgactattacctctgcctgaggcggcggcggcggcggtggagtggatgtggagcacataagtcagcaggcagcggcgtacataccccattcatgatggcaatggcacagagagaggtgagtccagcgttcctcctctttacaacgtctcccgcgtttggttccctggctggtacggtacccgtcgtcgtgcgaacccaagacacccgcagggtgctcgaccaaatgcgacactaggttaggtgcttctactccacggcgatcacccagctcagctgctacccaactgtcgcaggccgacgcgccgagcgagggcgccgccgccgtctccggcgtc

SEQ ID NO: 8386 - DNA, 1500 bp, Zea mays
tgaatgtgatggcgcgcgcgacaaggacgtgacgggcagtggatgcacattattccttaatcgtggtcgagggaaggaacgaacgcctttgtctgcttatgacggacgaattaaggtgggggttggctacgtcgattaccagcgtgacacatcacatgcgccagttatggacgcaccaccgattcgtgtcgtggcgtgtcgtgttgggccaacattcccagtttctcatggtcatcatggggcacccgtcctcaatcatggtcacaatctcacactttccctctttctaccacaatgtttaaggtctcagaacctagaaaaccaagccaacataagatgatgcaatccgctggcagcataattaagcacaaactactgacgatgatccggttacttatacttaggcggcagctctgtcacattctgtacgagaaaccaactgtaaacgacgtcttcctgcctctcgtttgcttcgcaaggaagccttttggcattccctacttccgcgtgcataataactgcgtatggtccgtgtgacggttgtgcgtattgaaaggggatcgggattaggatgggccttgatagtggaacactgttgttgtttcccgtcacattatactcacggtctcttatgtttagtttggaaatttagatcatcttcaggatggtgggaagttgagaaaattagcctctctatggagatttgaatttctaaactagttcttaagttttttttctcaaagaactaaaaaccttcttcgtttaggcgaatttttttttctagacttagatattcttagtctgaggtctaaattctcgctaggttgcaattgcaaagctgcctgacagacagaaagcaatcatgtccttaacgtccgttcctttctttctttctttctttgctagagcctagagggccgctggagtctgcaatctcgcgcgtacaaatgcaaatgtttcgcgtgaatcccatccggtggccatcaggcatcagctgctccactccagtactattatgtactccacgcaccacactggtcactggtgcagcactacccgttccggaaacaagtgagctgaggaagcgtacgcgccatggtcggcaagacattaacgcctcctccactaccctagcttagctaggactgcccgccatcaatgcggtccacatgcctcgcctttaaattgaatcccctactaccaccctctccttcgcccccgccgcatcacgcagaatttgcttactgcctgctctgctcgccattgctgactccctccctccctccctccctcgccaccgaaaagctagcccgcccggccgttgcttgcaagcctcgctccgcattattgccacctgccgccggcagccagcgcgcgcggcgcaacacgcaagcagaacaacggtgtctgttcggttgttgttgttgttggagagagcgcgcgatccaatccaaggaaccagggaggaggagcgtgcagtgcagtggcagtgcaggagcg

SEQ ID NO: 8387 - DNA, 1500 bp, Zea mays; identical to SEQ ID NO: 8385

SEQ ID NO: 8388 - DNA, 1500 bp, Zea mays
ccaaaagaacatggacattggaggttcagatagcgattgccgcaactaaaaattccccatcgcacaacacataggggagcagcagggtagaggcgagtagggatagcgctggccaaatcctcggcgatggaaaagagcagggagccaggagggaggctaggctaagcgcgaccggggaaggagagcaaggggtgcgcgattcggcgaggtcgcggcctgggcgagctcgagcaggcagggagtttgagggcgagctcctgcagaggggagtacgccgagcggggaaagccgccatgggcgagctcaccatgggaaggaggtgagggcgcagccttggaagaccagggatggggctgtcgagcagggaagggcgaggggatggggtgttggcctcagcaggaagggggacgacagggctaagggcgagctcggcgagcaccaagggtgaggtggcggcggcaccytccacggctgagggagggggcggccatgggagaagtgacgacggctgcacgcgtggaatagggttcgtttgtttgtttagtaggcctttagatgcgctttggtgagtaaataagaaacataaaactcacatacccctatagcgacctaccatcagtcacacacttacctctatagcgaccgaccataagtcgttaaatttctagacttttagcgacccacagaccgtcgctataaacgcatttaacgaccaaccgtcggtacataacttttagcgaccaaccgtcggtcccaaataagagtcgctaaagatcaaccgtcgtgtagtggatgtttaagaagttttggtctagtcaacatctgtcgtggctcgaattttgactgtggtggtgtttgagttgccgtgtctttgtattgcaatggggtgtctttgtataatgggtttcggcctaacaactgtattataaatatatctctcaaccttggttacggttagagtttcactctccaacataacacttagtaaactgattacttctttaatattgttgtcaatcaatcaaccaaaacccacaaaaaggatagatgcattttcaaacttcctccacgatggttctactagagaagtattacttctaaaaggggcacatgcagctgcagctgtggctgtgagccactcagggaaacactaggatggctgcaacgaagcactagccgaacatttagacgtgggtcgttggagcttggaagttcaacgatcgcccggcgtgatcattatggtgccgcatcttcccaagaattggagtactgaccgccacacgccgtatcgggtggacgtttggagttccagctcctcgattggtatgcaaacgatgggtttttaatgtacgaaagacgaatcgtttatattgaaacgatcactgctttcatcctctacataaagccgttctcccactctctgaagtccctgcaatatccgatccaattcgtcctgcaagcctgaacactgtgcagttgcgctccaacaaccgagcggta

SEQ ID NO: 8389 - DNA, 1500 bp, Zea mays
aattggtaggagctgcgttccgtatgctgacgatatgtttccgttgcaacgcacgggcacccacctataaagatttaactatatttaatatttataataataaccatccaaatattcgacgtcayatgaactaaaatttattctttgcaatcaaacacttctaataacacgtagggttcctcctggaaagatataaatttatcgtgccgcaatctacgacagcagaggaaagaattccttaaagatatgtacatctcttttctctgtgtgtagagatggcaatgggtacccgcgatccgatacccaatgggtatttactccattagggtatgtatgtgggttaaatattctacccatgggtctgttattgggcaaaaatcttcacccaatgggtaaacaggtattagaacgtttcgccttcacccatacccgttaacctatgggtataaaatacccaatataaacttagcccaagcatgaacttgaactttagtcatccatattttttactatttaacaaccttttagaccataatgtcatagaaggcttaacgacaatttaatgaccatttgtaatgatgctagaaaattttgtaatggtatttatatggatatacttgatatttgtatagtataaaattttgatagatatttaattttgtgggtacgagtgacccgatgggtgacccatacccacatgagtatgggtatgggggtaaattcatacccaccggtgtatatgggtgacccggtggggttgtttttgtgtcgtgggtatgggtatggggtagtaatacccggtgggtatttactcattgccatctctagcgcagacgatcaacgtatgtcggttcaactggccattcagtggggtttttcttcaaatcttagaaagtttgggtgaacattcctccaacttcaccattgctgagcaggggcagacccggttgtgttgagttttctggttttagtggatattttgatcatatttaatgtagttatcaaggttctatttagacccccgctcagttgttgggcctctacttaaatgttgggctgggtcggcctctcttggtgagtatattaaaatatggaaaagtttggttttaaaagaccttaaatatttatacaggagtgttatttcatgttttggtctcacactgtttgaatggtcaaaagagtatcgaacggaaaccgaaccatgtgacttttttcgtggaaaattgcagcataccaactgggccatgctggcctggtttcgcagggacatggtgggagtcgaagcggaaccgagtgtgcagcccaatagcatcctgggcgtacggcccatgagaagaacacggcattgattcccggagaaaaccctagactgcggcgggcgccttcccataaaagcacagctcttgtgtccccgccgccgccacctgctgcagcttctcaaccggataggtagcaccggagcaggtagaacgctgcacaatccccttcgccgccgccaag

SEQ ID NO: 8390 - DNA, 1500 bp, Zea mays
agcagcagaaataactaaaacgttatctaatagtaagtttataggtgggatatatctttttttctgtgaggggctataaatatcctagtttgcatccggtctgtaccattttttttccgtcgcatggcggtgcgctttggtcgtttaaatagaacttgttttgacacgggaggagtatcttttatcgatggtacctataatacaacatctgagatcttctgttatttcaactttccactgaacctccttatcaaacaaacagacagacagaccgaaatctactgaacgaaccttataaaaacagtcgctaaagaacaagcagctgaaccatcgatagattatcatagccacaaaatatctagtactgatagtaataaaaaaatatattaaccgtcagcctatttaaatagatccccatggctactatcgatgttcatgattagagtctactgatgaatcaaattccatatgcttctggttattacgagaattcagcgtggtgtcttcgttgagaaatctaattaatcgttgaatatatatatttataataaatttatatagatatactccagtagaccagtagcgaaattcgatgttttccgtacgagatgtatgactcatgtatgtaactgccagggacgtctgcatctgaatctgataggccagggcaggtgtctctgttgcatcagcaaacgtggaagtggaaagggaccgctccgcgcacagatacgacgaaggcagcgcggaaaccatgtcctcgagcccgctggtttgaagtccctccgcccgtctctcccatagttcttgacgctgattcgtgtcccagaggccagagcatgtggtaaaaaaaaaacctgcagctcactgttcactcgtgtcgaaacatatatatgttggtgagagagagaaaaacaacaacaagtcccacggctggcttgtcgggtgagctgcaaattttgccacatgacgcgatttcctgttaggatcaggatcaggatcactgactgacacacaagtgcagagtaccaggctacgcggccactagaccagaccagagcacgcccacgtcttaaccaagctactaggtgcgtgatggaggtgtggtggacacggccggccgcattcggagcaagtggttagcacaccgacgacaggtgacaactgacagggcacacagcacaagcattttccggttattaaaggccgaggcagacgctgcccgctggcgctctgcacccggttttcaggagcttccccccactgttttccacgcgccggcggcggagccccaaaaccacgtgccgcgtggccggccgggccggctggctataagagaccaccggccgcacgacactgtctccccaagacgtacaagcacacggccaccgaaccaagcaagcagcatcggaccagcgggcgcatcgatcgagccagtactcctcgaccggcccggccatagaagcataataacactacagggggtgtggagcggagaggtag

SEQ ID NO: 8391 - DNA, 1494 bp, Zea mays
tcgattgatggcattagggcaatcaatcaaacatgacgaattgatttgacacggtatagctgaaagacatcgcgagtgaagacgacggttttgactcgcggccagatctacggatggaactgcaacgatggtggcaaaatccatggtacacttcgcttctctatggatgtgggcatgtggcttgttcgaaggttacgtgaactgtattcgatcagcgatgcatgatcccggtggctcacaaattggtgtgcacacgaacgacgtggaagagagctcccacggctggcatgagatatgtggtcatgtactcgtgtgcgccagggaaggacataaatttttgagaaaatatcttcaatgccatccaaaacaatagcaatccctctaataccatcgaaaaatatgtctccaatgctatttattttaattttaagtcccttaaatgtcattaccgtctatccataaacagtcaaagaactgttagtcagtgttgaaaaacactaatatactcctgtatcttgtacattaacaccttccatacaatttcatcaacttaattttgagaactccagaacatcaataaaagtatgtaaccgtaatatgaaaaaaaattataaaatattgttgtcatattactcttacatacttatattaatgttccagaatttcaaagctaaattgttgaaagtgcatggaaggggttgatatacaaaacataggggtatattagtttttccaacaccaactaacaactctttaactaattatggacgacaatgacatctaagggactaaaaattagaactaatggcattaaagagaacacgtattttctgatggtattgaagggattgttagagttttagatgacattgaagggattttctctttttttagaagtcaatcttttttaaaatttaattagttatataaagaataatattaatatttgtatctacaattaagttaccataggagtatattttacaataatataataatacttattacacagcataaatattactctctgtctgagtatataaagcgcaaccgcatctggttcaaagaccaagaaatatatttaaatctctctataccactgcatcgatatacatatgcatagagagagtatgctttatattgtgggacaagaataaaaaatggttacacattgtattctgggatggagagagtagtacttttgtcaatatatttagtcaaatctaaaaaaatggctccttgacaagtaatatgcgcacttattatatgcacttattttgggacataagaagtaaggtgcacttttgcagttaggagatgtttgaatgcattaaagctaataattagctgctaaaattagttgagacatcctagctacttttagtaaattagctactcgttacctaaatatttgtttgctagctaaatttattagcattttttagccaactaaccattaaccgtagtgcattcaatgctactgctttgtttaac

SEQ ID NO: 8392 - DNA, 958 bp, Zea mays
taaaatggctaagaatataatgaaacaacttaaatttaattggaaaactaaaggacaattaacaacaccgagtaaaatgcaatgtctaaaaatccttcaatgcatgaatgacttagatacaattgtaaaaatatcttagaaaacgtgagtaagaaagaatggcttagatttaactctacaatagcaggaatgacttagatacaaacaaaatgtcttaaacactatgagttggaaggaatgtgtaagatgtaacttggaattggcatgaatgatagaaaaaatggaagaatttaatctttaaattctactttgtttcaacctgttagatggtgaggacccaaaaatcgtgtcgcgttgatgtatggttggttcaactccatgattggatatgggtggtgtatcattggatccataaatagcgttcatatatatacctaaatgttaatcatcacctagggtgatgggacataagatccatcatccgaacaaaaggtccaacaggatcctcagcttgcgtaagatccgtctgggttgtccgccctccattggactacccaaggtgcggcgcatccaccaggttcgaacgcttctgttgtatcatgctgtatgattaccattaaaaaattgcaccagatgctgtttattttttgccaaataaaaataccgaacccctatgtccccacgctgaattttattaccagagagttaaattttcagtaaatttctcatccttgctgcaaagccaatctttctcctcatactagagtgctttgtttaggtaggtttcacaatgattaataggaaggaagcaataaagaaatcggaagggttaattgtgcgtcatatgtatattagctatcctgatgcttgttgtttgatgttttggtatggcaggtggaagatatctgcgtaagtcaaaacatagaataagagtggactgctattagttttccatagg

SEQ ID NO: 8393 - DNA, 135 bp, Zea mays
ggtacgacttatcatcctactcttaaatatggttgatggtcatcctgtttattgacatcccaaccattattgttttgctcacccgaatgggtcttgcccttttttcctggcagaataagcctttgctgctaaagg

SEQ ID NO: 8394 - DNA, 157 bp, Zea mays
ggcttatcaccctcagactgatggacagactgaaagaactaatcaagttttggaagacatgttgagagcttgtgccctttagcatggtggaagttgggataaaagtctaccttatgctgagttctcatataataatagctatcaggccagcctgaag

SEQ ID NO: 8395 - DNA, 1500 bp, Zea mays
gggtccatcttaaagctaaaatatataattctaatataattgtccttgcataaatctgaaactgttatatttatcaaatagttctacaatagatatcagattcactgttggagctgctacatattaaattgtaaatccagatttaattttgcagatctattttttttcagagatccaaacatacggtaccctttatttcctttcatttccttttcttttcttttccacacccttttcccgattcctttccgccccgccccgccccgcgcagtcgccctccccaccccacccacccaccccaccccacccggtccccactttccactcccaaccccaccagaccttcaaccgstacatttccgtcactaccggagccgccactcccacgaacgcgggcggcggaacggaagcgaaccaggttcgtgcctctatctcccacccttcattccttcgtaccgcctcgccgttctcggagatcggggtccggccactgcgaattcccggttgttgtcgggttggggtttgggcgccgtgtttggcgggtgagattagattcctgctcctggccgcttcacttcttccttagaagatcgctcggggttgggttcatctggatgtgaggtgatgaggtgaggcttcgatccgttcctcctctagctccggtggttggtcgtgctggctctcggaagatgggagctgcacaaccgcgtggcgtcaacttgacctcgacctggcggtgtgaagcgcgtccagatccgatcctacctcgtgagagggccaacagcttgtacgtcggccgatttacactaccccctgacagtgttacgattttgcgatcgttgcattcacatcgtgatggctgctgctctgtcagtccactcccatacgtcatggatgctatcgactcctcactagaatttagtggcctgccggtctgccctagagggttgtttagcatgactcttctccactctacgcagctctgctacaaaacctctgggtggagcagctctacccagaatctagttcatttctcataaccagcgacagtggtgggtaaacatattcaaactctatgtctaggttgtgttttaaggatttcagagaagcaaaggaggtttgcaattctggattcaaagtgtctagctggctctgaccagctctccctcggagttttgctctggagcatgccaaacacccttttaatggcctccccattttgaagctttcgatgtttgatggcccaatcttggcattgaatcaattatcagctggaggccatgagggcaaggctatatagatctttgcgttatgttatttacctgaatgccaccgctctaatagttctgttaagttttgattatgttattttggtagcttttctttttgactttttgcagagtagacgattgaaattggtttatgtatgttcattcttctaattgcatttatgcacgggttgcagttatctagtggagttgcctccttcaagctactcta

SEQ ID NO: 8396 - DNA, 86 bp, Zea mays
ggttaaaaaaatcccctcgcctatcccatgccaaagcacaggcctaaggctcggctctggtcgcggtcgttctcacatgggctttg

SEQ ID NO: 8397 - DNA, 93 bp, Zea mays
ctgcagctcactgtgcatgtgagaaaacaactggtttgagaagtttggttcctaaaacttagtgttccagattttcatcggttgtgtctcttg

SEQ ID NO: 8398 - DNA, 724 bp, Zea mays
cttactataagagcatgccattataatttgctcactgtaaaaataggctggacagcagttacggtcctaacattttaggggcccgagacaaggtttcaaagaaaggccctttaaattatttttaatatataaatgttactaattaaacacttaaaatacatataaaaatatttatctcaaataataaataaataaaaggatatattatagtattatcttgaaattttcttctaacatgtttagatatttattattttgctgatggacaattggatcatatgattaaaattggaccctatgaattcgaagcccgtggcgaccacccctctgtcccaccatcagggccaccgctgctggagagagcacgtaatgtaatccttagaagtaatcacaccataagatcgatttaccgacgacaaacaaacaccccataagttgttgtggcagcggttagtgctgtgcggacccacatagcacatttcaccgtctcaaaaaaaacccggtaacatttagatttagacatttaagttgacctcttagccagaccgagtggacgccagttaatctaagctagcaacgcaacgccgtggtccaactataaaacccgcggcgtcatccatccccattgcagcttcagagttcctgactcctcgttcgttctgcgtttcgcgactgagatagccaaccctgcgactgcgtgcgtgcgggcgagcgagcaggcaga

SEQ ID NO: 8399 - DNA, 1500 bp, Zea mays
ttgccgagtactacacccgacaaagcctttgccgagtgctatcgaggctttgccgagtgacacaggcactcggcaaagaactcggttccggtattttgctcaccgcatgcaagggggcaggtaattttccccaccgaagggagagaaccaacttcccctttccaataaccatttcaagtttagttacctgataccagtatgtattatagtactatatataagtatggtgttattttttaaaactccaaaaataatataaaaagttaaatagctccgttaaagagtaaaggggagctggatacgggaatggctggagaggagatgaaatacgaggaaagaatagttaagggggtatttaaatgtgaatagaaactacaaatagagggatttgggagggagaatggtcgagctgtggttctttatgcagagtgaattagatgggccatggaatttgtcaaatggagaagtgtgtcgatgtgatcgtgtgaaagagtcaaagaagttaatctgtttaggctttcactaaatttacattaaaaagtatagacattcgtaattacaaaataagtaccatcacattagctatagaatacatttttttatcatagatttattagagatatacgcaatatatactactatttactgtaaacttgatcagacttaaggtaaattgaccgacacgaatacactaccgtttcatctttttgatactgcatgcacgctgcgcagtgagatgcatgacactcacagtcaaatccgttagaccatgtcacactctcagtcgctctctgtctcctctttttccatttcatgcaacctgctgatggagccctctgtcctacattcctactacccaatacccacacacacatactctctctctaggcattatttattcctctgtcatctttacctagatttcctatctctatacattcctcgtatttatatatttattttggtcatgatcgcattatttatgcatttctctcgttttctatcgatctctaggcgttttgcaacttacgcatatatattatttattcttctttgagggaatatctgaactgctgggacactgccaatctcatcttcttctcgatattctctctctaactatcaccatcccctcagcctttacagtactcgtagtcgtagtagctactaggacagcatcatcttctctctctagactctagctactagcagctagctcactacagtacgtactagctgtacagacagtacagtgtacaccatctccattcccccctcttctcctttctctcatcatccatcacacgctcaaacccaaacacccatacaagaatgatatgccactcatgacctgatcactcgagtcgaccgcagccggccattgctacctctgtggcttactcttctgcaagctttcctcttcctcctcggctttgaacaaccaagaagctcagctctagcacaccgtcgtcgacgttgcaacaaaccccaaccgctacc

SEQ ID NO: 8400 - DNA, 349 bp, Zea mays
ctcagctagaaaccgttgtttttattggcttttaatgttagtttggcaacttcatttccccaagaaaagatgaattagttttctttaaataaaatctctagaaaaaatgaagttgtcaagcttattttttactgattttcgggtagacatagaggactcggcaaaggtaaaagagaaatgtattgtgggcttactttaaagaataaacgtattacggcctggcccattaatgarcctgatccttcgtctctataaatgagaaaccctagcgccattcttctattccactcgcttcccccagccgcacgaaaccctaacgccgccgccgcttcacaggtaaaccgccgcc

SEQ ID NO: 8401 - DNA, 1500 bp, Zea mays
aaactgcccctttagttttgggcaatactgtgattttactgtgatatattaatattgtagtgtttgtgtcatgtacaatcgtaaactattgtattttaaaactataatatttcaaaaactacattatcaaacaactcttaatgtgcgcctgacaatatattaaaatttatcgacggcggcagcagtgactagaaaaagaacagagaatcaactgatatcgaagtgcctctccactttcccatttactaattgccttccggttccggatgcgctatcaagctgatgttctctctctctgtcctttgcacgatgatcgtcctccctcaaatggattctctggagtggaggaatttcctgttctgtgcgctggactgatgctcttgcacacccgacgcccgaggaaaggatttcgtttaagaacgaggaccaaatcgcaaaaaaactgctaaatggtaggggtgaccattttaaaactaaaaaccgaacctgaaccctaaccaaacccgaatagatcgaattattagactattcggattttagggtttgaattcggtttccacatgtgttacattttagggtacatgttcaagtttagttcctaacttttaaaaccctataccctagactgaataacccgatttttttaataaaaaagctcttaatatgtgatgattatgtgatttataaacttgttagctaaaaattataatgttatcttaataatattatatatatatatatatatctatatgctattttttatattcacttattgtaataatagtacttctaattaactatttattgtatatattttaagaaaacatactagtgtatctaatatttggatctattcggtggaccgaactaaaactgtggatctattcggtggaccgaactaaaactgtgaatctatttgagtttgatttctaaaattattttaaaaattccgtttcttaatttttaaactcgaaatttcacaaattcgaagagagcaaaccaaattatattaatataccgaatgcctaaacggcagtccgtcgcagagaaagaggaccgaaacaccgagatctgggaccaccagcaccaccgtcatcatcgtgcttccagtccattccctgttgccgcatgcacaattgcacacacacacggcgtgccgcatcgtgtaaacaccagggacccgcgcgatcgcacgcctattctaggcgcaaacccaagcgcggagacaaagcacgcaagcaagggccccccgccgctgtaactaaccgaacgaggaggacaagaaagcctcctcgttaagattggaatccagccagagacagggccagtctccagtctccacccaccgttccctcccctcccctcccctcctmtcccctcccctgtcgagtccggctgtccccacgacccccacgccacgcgctctctcccgctcctcgcaacggcaaaaccccagcgaattccccacgcgcccgccagctcggcggcggcccaggatcc

SEQ ID NO: 8402 - DNA, 1500 bp, Zea mays
ttttaaggtgaaggtacagaaacaatgcatagcaagtacacaagcaaacaaaactaggaaacaacgaaaatggtactccaaagaccatgcatcagattttaggacaattggttgctggatccaaaggccatacaccagatttccaggaaagcacgcagtttaagtatggcgttgaaagcaaataaaactggataacttaaattgctcaaccatgagccggcaaacagtatgacatccaacaaactaaaagagtgcaattcttgtcatacccccaatgtctcaaataccaccaaccatagttaccatactactgcattattgcctaaaattgaatggtcactttacagaaggctaagcttgcttgcatgaagtagtgttatacaagtaaatcctgagtgaatcctgatcacggaagcactaaatttgccaagaaaatgaacaaatgcagttacattgagggggtaactgtaagcttgaggcttggaagccttaaaatctgtacatcgctgaaacaacatatcccaacttcaaatgacagtctcgtgatgcagcattgtctggagtaccacttctacccgcgagcaaacaattctcaggaagacgacaaaaaacaacgggtgtagtcattaatatggcgttactccagcattttaaacaaaaratacaccttcccgccgttttatagttaatgttcgttagctcaaaatataaaaagagggcgggagtacatggttaattggttatccgttatgttactcatctctcatgaatgccttttgagaagtttgggtctaggaaaatactaatacccatgcaaaaaatagtaaacttaatctagtgacgaactcaagacatatacttaaccatgtgaagaggaactgaaatcgctaccgatctcaagcatttgcttatgactcaaactagataactacgttttatttctagtcacaatacataaaccaagaacaattaagcctaacaactgtcacatgggttacaaaggcaattgtcctcgctagttcaagtgggcataagcaaagcaggtgaagatttgggctagccgagcatatccgacaatacaaactattcatacacaagacaagagaggatctgtcccatgaaaatagaacccttaaccctcagctggcagtattaagcaacgaacaaaagaattcgcaaatcatgaactttacttgccattagaggaaaaagtaaacaagcaacatatttatgccattgttcaaggagacccgatcgacactaacattaacactaatagcagccgtcgccggcatcacggagcagcagcgacacatgtttaagcatgccagtgttgccggcgacgagactgatatatagttgacacatctatcacacgacacatgtaccagcagtataacaacggaaatcagcagcagactaacagtacaccgcaggccgactgcggcagccgccaggccggagggcggcggtttgattgattatagatcgggtcggcgg

SEQ ID NO: 8403 - DNA, 1105 bp, Zea mays
acggcgtgctgaattgatgttccatcccgaaacatgatgaatagaagtttctggtggccgtctgtcgttctagaactgttaggccctctttggaatcttactgtttttacagttttgaaggaatactatggtttaaaaagtcaaaatctgtttgcttgtataaggtaaaacgcagtttcgaataccatggtctatctaaagcgtagtatttttacagttttgaaaacttcacttggacttaagttttcaaaggcttagcagccataccgctgcctgtgatgcgtacgcatacggcacacggctaaacagttcttagtatttttgaaaactataaacagttcttagtatttttgaaaactatggttttagtgtggttttgaaaactttgttgccaaacacgtgcttaattagcggctgaaaattggctttacagtcttctgtttacagcagtgatcttttttttgttgtcagaccacgtcttttagcttgtgcactaccaaacacctaaaaacacgcaatttcctctattcttgttccagggccggaacttttttgtttgtttgaattcgttgaagaatatatccactcctgttttgtttggcatggattctatcgattttatccagaaacgtcactggcatgagagcgcagaaaaaatatcgcacgtacgagtcagatgtggtccacatgcgaaatgaaatatttttatccggacacaataaacaaacaccttattttcacaagagatttctctgtcttaacgaaaattagtttatttttttaggaaaacagaaatctttcggaaaaagtcatttacacctagtttgggactacaaaaccagaatagattggacgagataaatatgttcgagagtccagataaaatactccaactcctactacctcatcggaatcagagatcatgcaacaggaccgttcattacagatccaacggtcgaagcgagacgactaccggcccgcaggaggctaataattggcggccccggtttcgtccccacccccatcacccaaaacacaagtagggttaggaaggcggcggccagcggcgagagcgcgagaggaagagcaggaggaggggtcggcc

SEQ ID NO: 8404 - DNA, 117 bp, Zea mays
tgtaagtcttactgcaagaagggcagctgtgcatgttaagacccatacatagcttctcttgattacacagcacggggggtgaaaacttgagatacagttgatctcctggttcagagt

SEQ ID NO: 8405 - DNA, 1500 bp, Zea mays
ccccccgcttcttcttatgttagccactacaaaaaaatcatagtggatcaaccatcaacgatcaacaatgagatacatgtctagcacctagggtttataaattgcagggcaaaccttaaggattggggattgctgtgctggagcctagagggtttacaaattgtagacacaaaggggagggcgggagttgggagacagcgggcgccagctgcagtgttagagggatgctaggaccaggcgacgggccataagagcagtggtagagggatgctaggactaggcgacgagccataagcatcctaactttgtgcactagcatctggtgactaggcggttaggcgaccttgtgctagtgtctaagcttagcggtgtaacatcccaattttcaaataggggattagttaagaaaaccttagttgcataatcccaaaaccctagcatcatcacacctatttttggaaaaactatatatgtgcatgaatggtgattgttataagcactacacatagctattttcatcttgctagcaaatggtagggatttattctacacctagaaacacatataaaaaaagggaaaaagatagaggaaaaaagaaaaggacaaatccttttctgctcggcccatgccgattttggcccaggggccgcgtccgcgcccccacgcgtccacgccgtctccccttttyctctcgktaccatgaatttgagttgcctctcgctcctataattgatacatgcctccgcgtttacttaattggatccttggaattgaattccattctaataaaagtaatttaggcacatatcaattaagctaatacagttttatgcaaaatatatttgtacactattattagaaagatatcggagatacttatgtgttacatttttattatagagatgtgagtcgaagaaagccctataaattgcagtgtagaatcatattctaataatacataaaattatatccacctccagcctataaatttaaaataagcttatatctgaactttgaaaagtgatgaaatgctaaattctaagctaaattctaagctaaataaattactttattaagttaattttaattcctctaaaataaatggatccaaacactaagtaaggtttttttttcatcaaacacccatctggtaaaaccagactcgagaagtcgagataaaaaccgcgcgtcatttcctgctgggtcatgcttcgcgagagccgagaggcgcagcaaaacgcaaaccggacgggcagaggttgggaaaaagttagccgccggcagcaaatgccccaccaatcagtgagacatacgagcggctatgggtacccgacgccacgtccccgcaacttcacaacgaacagcagaggtaggagagtaaggagaggaggaagagcactgccagtgctaggggcagtcggcaggcgcggcgcgttcccctcagtccccttccccggctggtcttgccgggagtaaggggaacgaagccaccggcgcggc

SEQ ID NO: 8406 - DNA, 591 bp, Zea mays
gattataatttaaataccaacacactagaaaggcttcatgctagttaatctaagagagaccacaaaagtttgaaagaaaatccaatttgaaawgtcagtgaaagaacttttaatagttcgattgcacgataattattccagaaatgtgattacacaacatttttactcctacaaccagataccaaattgacgtacatctttaaatttaaagatatcgataggtgatccatccaatggtatctgcaaacaaacgcaagcgatgcaagtccgtgtgttccgcgccttgtcgccgcaccgtcgcatcctacatgtgacgggggtgatgcatgcagcatgcccagatagtcgcaggcgcacggctcacgttgtccgcctcacgtaaaggtcggtgccatcctctcctatctctcctcgcgcagttccacttcccattttccgccttcgtccgcatcagggacacactgcctccgatccgcatgcggcaagatcctccctcattctccaaacatgagaggagcagaggaggagagatctggcaccgccactgatgcgggaggagaggaggagaaacaggagaggagcgtcggcctg

SEQ ID NO: 8407 - DNA, 1166 bp, Zea mays
gctttgttttgtactgtaagtacgaacacgagcgcgcagtaatacatgccaaacacgttttggttctctttttttattagaaaaaactgttcaaaaatgaagtctaacctttctttcgtctctcactctcaccgtccaccttgtctcgctatctttttttactttgagtttgaaactaaaaatatattagaactgtcgcaccactgtatgtagtcacacgacacgagtctatggcctggccattcaggcttcttgttcgcgtggtggcttgcgttctttattacttattattttggacaaggtttaagttaaatttttaaaactttgactataaataactatttcgttatttagttttaaaatataatatttatatgcaccgatttattttaaaatatatttttataaaagtataaatgtcttaaaagtttatttatattaaaccattgattaaaattatattttggagattgtgtcactattgtaagcgataactagtaggatacgagagagagattacgtattaagttgaacagtagactatccaaacaaatccttaataggcatggtctaataacactgtagacgattcagagaatccagctctctcattggacctttgaggttagattattaatacaagacgacatgcatgtctccatcaagtgtacgttgccggtgccgggtgggatgacatgacacccgtcgaaatcacatgctcttctttctctgtccattgaatgcaacttgggattcgaaccaatcaaaggtacggtgggctcgtgcctgtctactgcgctgtcgttgtcttcttcgatcaagaagaacaaaagctgcccgccttggagaagggaaaaaaaaactacgctagcatctcttcgtccccagtcggtcactccattcagcgttgttaaaaccagtgccattagccatcctagccttcaccctcgcggagaagaagaaagaaaccacctcacctcaagaacagctagctgcaaggataaaaaaaaacaaagctgctgatctatatataataattaggtagctcgatttattttttggtgtgttttgcatgcatatgccgcctcacgtactcttggatattgtgcatggggtgcaggctttgcagtgtcttgttttggagagcaaaggatcatcgtcaagtg

SEQ ID NO: 8408 - DNA, 109 bp, Zea mays
ccgccgcgccactgccacggcaactgcctaacgcgctacacctacagcacgtgttactgatgtgcaggtgcactgcaccgatcctcaactggagacacgacacgcttcc

SEQ ID NO: 8409 - DNA, 1014 bp, Zea mays
  unsure (1)..(1014): unsure at all n locations
atcatttttcatacgagnacttgagttatcttcatataaaatgttaattagtttttgtaacttatttgcaattttttagtgaaactagaatactttatgaattttaaatattgcggtgttggttctacaatgttcttgtgataagcaactttgaattgcatgatgtcaattttaccggtttcctttcttacatctgatctatcatatacatgattatgtattgcttaacttatggatgggttggacaattaatatcatcggatgaactacccgacaattatccggtacctacccgagtagtatccgttatccgtttcttacccgtccggattattacccggtcccgtcctgtatccgtcccgaatcttaactacccgtatccggtcccgtatccgagagaaatacattagggtaggatacaggatgaccctgtatccggctgtatccgtcccgttttcatccctaccgctggctgtatgcactaatcacgcgaattgcgctttccgccgcttcccttccgttaacgatggtgtggggtctggggctgcttggcattcaacgtgatggtcctgactcctgactcctgtggactcttgcttctcttcgtcgaaggggcgtgggcgtgggcgcgtggcttgcgcatgctggagcgagatggaagccatcgatgagcacacacgaacacacacacagacacgtcaacaggggtgcttcttcgcttccattaatccagcctttatttattcaacgaacacgccactccggcgaaacacgcacggtgactgcgcggatttgcacatgtcacgcacgcaacagtacacactaagcgtcggtacggtataggcacacgcacagctcgaatcataaaccaagccagcgccacgccttccactccgtccaggcgggcggcgggcgggcgcgcgcgcatctacacctgttctgttattccgccatcgttagttgctgaagttgacgaccgagcggtacgtggcgccgggcgtccaccccgcgggg

SEQ ID NO: 8410 - DNA, 1500 bp, Zea mays
taaatgtgcatttcctcttctaataatatatacactacggcaattttcttgttgttttcgaaaacataattgaaggggatagttaacatataatacaatgtattcaggtaggtctttgtatcattagagtatccttactgttcacagcaaggacttaggagtcccatgcggctatgcctatgtacatctactctgctttcgattgtctctaatagaatgtgaaaaaaaggaagacgtaaaactgtaaatgatattatttaacactgtttacataaaaaagtttaaaatatagatctggcggagatagcctaatgactacaatcaggtgattaataatagtaaaaggcttaagcccgacgtgaatacattcatccagcgctccaggtgtacgattctttttgacggccgaccaaaacaaaagcaaaataactgtggtttctgtcacgttcctcgcgccgttttaaaatccgacggctgtgttgtgtagtagcagtagtatttgtatttctcagcgaagcagccacgcccacgcagtctggaagcgtttacatgacacgtccacccatcctgacctatcgccaagccaagagctacagttcccaagcgccgaggaaaagccggcccaaattccataaacacccaatccctagtaaagatttaccgtccagggtccagcggctgacagatcggttccggctggttgctggcagatcgtttcatcgcttgtcacgacgctggcagcagagccttcaaatcctgtgtctgcatgtgcagctgctcctgcgcgcaagtcgcaacggtggtggctgcagctgcggcgtgctccttcgctggaaagtggggcagtatcttttcgcatctcctcgactccgcctctctcggatctcgccgaaggacgagcaaagtctgtttctttccccctctcttcgcctttttctgtttcttcccccttctttatactcgctggcagcggcgggcgacggtcgtggtgcactgctgccgcggccgcgcggagggaggcgagttcgctgttgcaattctctctctctctcttcttcacctgccgcgggcgtcgctctcgtgtcatctcatctccatgtggcatctcgcctcccactgagcgagcccctttgtcctcacttgcagggcccctgatcgcccgcttctactacaactatattctgtcgccagcgcacaagcggcgggggcacggggtagattcggagcggctcttggcttgcagtccagacgcccttcacccctgatctggaccggagggagcggctccttccgtcagttgttcttgctttgcctgggcctcttccacctgcttggtgttcttcacaggtaaggcattgacactctcatgttcagttctgcaacaattgcgctgtcccctgccgcgcccgcgcttgcggggtttgttcgatctgttctgtttccaattgggtctcgctgttgcaggagccggtgacctcggacgatatcttggaggacaag

SEQ ID NO: 8411 - DNA, 1150 bp, Zea mays
gacagcgacgcaggacctgaacaaaatcatgagcgtgttaagctaagcccacgcaagcaaatctgcaacttcggtagcgtacggcgaaactagcccaagcgtgctcctgggttggctagtttgtatgccccgtttgcatggaggcctgcgatttttgcgatcgaatctcccggtggcacgggacgacggcttgagccagtgggcactcgccggatttagagcagaagggccacgaacgccaccggatttgaacaggagggcggcggagctggtcgagctccacgccaccgagaaggggagccgtgccgccgagcaggagactcgcgtcgtccaggacggctaatcgagcaggagggtgagctttggaggttttgtatttaaacttgatttttgtaggttttgagctttcaaaaaatagcaccagaagctaggtgtttatttgggcttccagattttcgaaagcaaaagctctcgataggcccaaacagacagcttcttcttaaagtcttcgaaaatggcaaactgagttccaggcagctggagacggaaatagacgggtgaatatgagaaatgggatcgagacgcggttgcgaagtagtggagcagaacggccaaccaccgcgcgcctactcccctccctctcctccagctccagtcctctctttgtgaagtcagcgcgatgactcgagtccccgcccgaactggtcgtctccttcgccgggctgcaccccaccacgcggaggccgggtttagcatcgccttgctttgtttagctgcggttataaccgccggacgccggtgatggccacgtaatccggtgtccgctcgttaaccacaaacgtccgagcgtcacctggcgtcggctgtctggccgcgcggactggagcaatcaaaatctctcggccggcccccatacgcgccgcggacacccacccaccaccaccacacgcagtgacgcagcccgcccctctctctctctctctcggttcctgcgcacgcacacacgcacgtttccagttcgaccgagccagagccccgccccgggcagtttccattcgctgtcgcgctcctcctcctcctcctgcacatcccctccccccgaattcgagccggaggaccgaagagtagatctgcgccgggcgaccagagg

SEQ ID NO: 8412 - DNA, 53 bp, Zea mays
tctgttgttgtttctgaggtcaaccgcatacagagttgcttgactcctcggcc

SEQ ID NO: 8413 - DNA, 490 bp, Zea mays
ccctccacgactagttggcgttgagctgtgttgatgcacgcctgagtcatctccgttatcctgccacaaagaacgcactgctgttatgacgcccgccgaaataatcaattatcacttgccctcctctcccataagtacaatcgctgtagtttgtacgagtaaatcaagaacatggagcacgtagatgtaatagttagctgctaaaattatacgtagattttaaatatctatagctaatatatagctaacaattaataagcaatatctaaataaaaattatagccgaaaagaaaattgacaatcatagaggagaaaaaaatagttgacatccttgtgtcgttgatctccgtccggcgccggcgccggcgtccgatctctcctttcctttttgccttttctcctgcccaccaccccgccacaaccctttcccttctctgcttgcttgctgctgcagtgctgcctccccctcgcccagcagcagggagcagcc

SEQ ID NO: 8414 - DNA, 391 bp, Zea mays
tttgctacagctagtatcgttgtaagtatgttgaaaatctttttttattattctagatttacttgtaagtaacacggcgcaagaaaagcgtgtggggggagggagcgaatagtatgtggctattgcagcattattgccttttccccattcgttgagatgagagggagaggaatgaagggaatttttgggctgcttgttgccgcactctttttataaagtcgacccaccctcacctaattttaatgtcaaaagaacccgcagcagggaagactgagagtctgggagatagagagaggagagggagggtttcctcaaagagaacccgaacccaaacccaaaccgaagcagagcacactagcgttccctcaccagggcgtccatcccagcagcc

SEQ ID NO: 8415 - DNA, 334 bp, Zea mays
ggtgagagtgagacgggcggtgactagcgggcgcttaggccgacatcggccccgcagcggcggggtagggtgcgtcgacacgcgggactgcgacttgggggggattgattcccttcgctgtgagcaaaccatacccaaatccctctctcccgtcctccctatccagcttatttggttgcggatttcttagatgtggggtcttactgaccgaattatccatccacgggtggtctgtttgattaggttccctctcttctccggcgcatgcgtgcggggtcgaaaggtagggttcataccccaaagtttgtcattggggacaacaccagcggcggcg

SEQ ID NO: 8416 - DNA, 695 bp, Zea mays
cactcacaccactacacaccacatacacgcacacacactaaattaatttagagctctagacctttaataagtgagcatgcgtaataccgctgaaggcatacgcgtgtgtactatattttcctagataaatgacgcgccactcagacttaaatcttagtcaggagcgctgccggccagtgggcagtggcctttgccactatgccgtgagcccttcgcgagtttttttttagttgctctaacacactgtaggacatacgtttttcattagcaaaggaaatgctttttttggaaaagaaaagtccattggatttaacggcgacgccacaatctcccattcccgcggcccatctcaagcccactcctggaaaacagacccacgtgacgtcagcgatccgggttcatcccccacgaaccaatccaacgccgcgcatccctccgggatccttgccacgtcacgaatccaccccactcgcttccacgcagccccatccatccatcacggatccgacgcgccgaactccacctcccacggattgcactccctccctcctcgcgcccaagcgcacaccccctcccgcctggaggccgctacagcctacaagtagcactcagcccggctcccgtttaccgccgccgacttctgattctaccaccacccgcctcctctcgagttcgatctgtttgctcccccagac

SEQ ID NO: 8417 - DNA, 130 bp, Zea mays
ccggtcagaagctagacgacgaatcgaacatgaattgcaactcatcagcatgcagcagctagtaccccggctgttctgttctgttctgtccgctagtgtcgtcttctgctggtgagcgaggcaaactaat

SEQ ID NO: 8418 - DNA, 126 bp, Zea mays
ggtaacctgcgtctcgcgcgtcgtgattataacttcgtcttttcgttctttctaccgcaataaacgcaacgttgaggaatatcctgtacaagctcacatggttcacatggacttggtcatcctcct

SEQ ID NO: 8419 - DNA, 1333 bp, Zea mays
tggaatcagatgtttagaccccagataaatttatcagatttcgaatcgaatcgaatcgtgtcgcaagtcaacctttttgtaatcgctaaaaatcttgattcaaaaatatctgtgattttcggtaaaaagggaagaaatttaaaaaaaggaatatcttcagccgttctctctctcgattttttttcagccaccgccgttccctcgtctttatccggccgccgctcagggaaaaagatcccgccgcccctcgcctgatttttcccagccgtgctcgtcttctacgcgcccagaccctcttctcctcctcaagctgcccagccgccccttcgctctcaccctctctgctcgtcgcgaccccccagctcctccctgccgcgcgagcttgcccctcctcggagttctttcgtaccgagcctccttcgtcgcgccccttctgctctagctcgctttttgccgtcgggttggccacgcaggcgcagtcggccgcggagacgagcgcgtgcaggctgcggaggcgcgcgtgacgaaactgaccgtcccagctcctcgtcttcccctagactctctccttgccggagctccttctgctctgtgctctcttgcccatggcgccgatccgtccaccatggccgcgtccctctgctcggagctccctgcgcgccggctccttaatcggcagaccgcgcggctgccatggcgtgccttgagcttctaacagccgaccctggccggatctcccagccgagccccttccccacccattcctccatcttccggtgcttggagcccatctccctgctggccatggtgcccctgtagactccatacatggcaccattgtcccggccgtgatgatgtgccgctcggcctccctgcaccgcgctttggtggtcgtgcgcgcccagccccatctccctcccagctcctggcttgcccctgcttccatggctgaccgcgctgctcccctgcgcttgccacggtgcccttctccctgcttgcgcgtgtagatgtgccctctgctcggtcttgcccaagctcccagcttcctgcacacgcgaagctctctgctcaccgtcgtttctcctctgcgaccgctcagttcctgcttggtgcccagcccgcttgttgcggacgcgggccgccacgctgccaggctgctctctctgctcggtctcgacctctcgcatgtgttcctgctcaccctggccacagctgcccggctcggccgctcctcctattccctgcgctcgccccgccgcgcgctctcctggttttccctgcgcgcagccacgagcttcgctcggcctgctctagatccgtagctagtcgctct

SEQ ID NO: 8420 - DNA, 165 bp, Zea mays
attcggactgatcacagaagtttgtgtcatcttcaggatcagactttgtcaacggatatgcagaagaaagcaatgaccaaattggccggactgtaattttcagtacaatataaaaagggagcagaaaataaagctgcagatgccctttctagagtggcccataat

SEQ ID NO: 8421 - DNA, 1500 bp, Zea mays
tgctgactgacatgtggggggaagggtcaagacggggctgagacgcaaaggcagcgcgcgcagcgcaggtgcaggacgacgacggagaaagaaagagggctggctggctggctggcctgggaggctgggacggacgacggaggagtgactccgctgcccggcatcggcaggcagcgaagcatgcttgcacagatgcggcatcatggcatcgcccctcctcctcgaaaggtcggcatcctttttagcccgcccaagcccaaaggccaccacgccactcgaccatcacagttcgctccgtcctgctacccagctacaacgcgccactcttcctcacactacgacgacgccttgccacggattcgatcgtcgccgcttgtctgccctatcatctcactccccccgcccgcttgcttttatatctggagcttcccaccagcaaagccttggcattgtgcttccttgctttgtgtgtggcgcgctccaggtgccagccccaggagagaagacaagccgaggtgtggtttatctgtttgttttgcacattccgccttattgtaacctagctataggccaagagaagctctgagtcttgctcggcattgccgttcgtatccgcgcatactcactcttgcatgcttgcgtccattcaccaccaagctgtcttgtcgttgccgcccgcccatgcttcagctcggcacagttgcttgcattgcattccaggttttcgcgacgacggggcttctccagagcatgtcaggactcaggagccggccggcgccaggtggcgtgcacgccgtcgatcgagttcattcgattccaggcttccagcacgctgcacgcacgtagtagctaggtggagaggagcattctacgtaccactgcgcgttcgtgtaggcaggcccctagctagctagctagccctgtgctctgcgtgctcctgctgggctttactcctactctgcctcgtagtagtcgtaggaggcctggccatggcatgcgcggcgtgaggacacaaaagccgcctgctttcttgggaaaaggcggggtcgtgctgtggtcgccatggcatgcatggccgcatggggggacccagtcccacacctcatagcccgcgtttaggcactagcagcttggtggagtagtacaatgtacaactacgacgactgctgcgaatgcgtttgggcgggttggggccgggctcgtcttcttcttccacctggcctttttactccaccctcctctttgcctgctgttcgcgaaacggcaacatctcgcttgccatttaccactctcgtcctctctcacagtggcatgcaggcgcggtagggtagagttcctcacttctcgcccatcaacgatgacgaagtgcgcgtaagctgctgctgggaaacggagattggatagattcgccgggggtcttgttggcttcaagagagcccgagttctcctttttccagcttgggtctggtacgccatctctgggtctggggactgtagatg

SEQ ID NO: 8422 - DNA, 264 bp, Zea mays
ggggtggttggggtatttatagccccaaccacccaaacttgaccgttggtggaggccgtctgttcgatggcacaccggacagtccggtgcacaccggacagtccggtgccccagccacgtcaccagtgccgttggaaattgaccgttggagttctgacttctgggcccgccttgatgtccggtggcgcaccggacatgcactgttcactgtccggtgcgccagcatgggcgtgcctgacctctgcgcgcgctggcgcgcaataa

SEQ ID NO: 8423 - DNA, 1324 bp, Zea mays
attttggtggttgaattgcccaacacaaataattggactaactagtttgctctagtgtataagttatacaggtgtcaaaggttcacaacaagccaattaaaaagaccaaagttgggttcaaaatagagagctaaaggcatcccgaaaggctccctggtctggcgcaccggactgtccggtggcgcaccggacagtgtccggtgcaccaggggacttcgcccagaactcctcagcctcgggaattttcagaagccggcgcgctataattcaccggactgtccggtgtacaccggacagtgtccggtgctccaagaggacgcggctctggaacttggcagcctcgggaatttgtagcggctgctccgctataattcaccggacatgtccggtgtacaccggactgtccggtgtaacagcggggcaacggctacttcgcgccaacggtcgcctgcaacagcaattaatgcgcgccagagcgcgcaggcgtcaggcacgcccatgctggcgcaccggacactctacagtacatgtccggtgcgccaccggacatccagacgggcccagaagtcaaaactccaacggtcgaatcgcaacggctttggtgacgtggctggcgcaccggacatgtccggtgtgcaccggactgtccggtgcaccatacgaccagtcagccccaccaaacggctagtttggtggttggggctataaataccccccaaccacccaccattcattgctccaagttttccacttctcaaccacttacaagagctaggcattcaattctagacacactcaagtgatcaaatcctctccaattccacacaaggctttagtgattagcgagagagatttgctgtgttcttttgagctcttacgcttggattgcttcttttctttctcacttgttcttgtgatcaaaactctattgtaaccaaggcaagagacaccaattgtgtggtggtccttgcgggaagttttgttcccggtttgatttgagaagagaagctcactcggtccgagggaccgtttgagagagggtaagggttgaaagagtcccggcctttgtggcctcctcaacggggagtaggtttgcgagaaccgaacctcagtaaaacaaatccgcgtgtcacactcttcattcgcttgtgatttgttttgagccctctctctcggactcattattattatttctaacgctaacccggcttgtagttgtgattaattttgtaaatttcagtttcgccctattcaccccccctctaggcgacttttaattggtatcagagcccggtgcttcattagagcctaaccgctcgaagtg

SEQ ID NO: 8424 - DNA, 621 bp, Zea mays
ggtcggaacgaaggttgaactagcgccgaagctgcgcgcaaggaakcttcggctcagtagcagaaaaaggaaccgacttaaggaggaaaaggctatctaatcctcgatagtttgttcttaagtcaatagagaatatgaagggcatgaatgtaattttacacaggctgtgtcatgtgcctataaatagatgaacagtacccccgtactattcacgctgacttctactcgctcgcgcgtcactcttgtactttttgccttctgtcaagccgaaggtacaaatgtaattcaatgttattcttatttgtttatgataatataataaaaagacatggataatgtcatataattattcatgctattttctcatgtttcatatgcttcgtctctcttcaatatatatatatatactgtgatgatgaggtatgtccttcatgaccttcgtccgaagattgttatatcctaagggaaataatgcttcgagggacgaagaacattaaccattaacctctttttgtgttgccttgttcttaattcatagcatttgagaacaagtctgcaacattggcgcccacctctagtatactcacttccacaatcttcggcaaagcatcaaccttcgtc

SEQ ID NO: 8425 - DNA, 347 bp, Zea mays
ctgcctcctgcctagagcaatgcgagattatcaacaccagcacagcctccctccctccctcggctgccttttcccactccttccagcgatcgatattcctccttccttccttccttcctcgtgaaggcgtcgagtgagtcctgcgttcttgctctcctctgctaagcacttgtcacaggaagaccccctcgtattcgcgtgctcttgccttcacacccgggacgggagttccttgctaggggagagagcttcccttgctcgtgtcctcactcactcactcattcaccgacggtcccagtggactgaggtgagacttcggtcggagccggccggacggaacatacagg

SEQ ID NO: 8426 - DNA, 607 bp, Zea mays
gctcggtaccccatgtcaaatagtcgataagtcgtcgtcatttcgtgcctcttccctcgcagtcccgcacgttagtcattacaccagtccaacgccgttccgagctcccggcacctctcatgcacgattgtggcaccccactaaaaatcaatcagcatccctgctttaaatccatcgcgctataattgaattggaaactaaagtcccctcacctttacgtttcactggaatatcggtcccacgcttgagaaaccctacacgacagtgccttcaacacgttacaacgccatcgcctaatggaaaatatctcgagaggtcggggtggtcggtatcatgctagttgttttcgtccgctggctaattagtcgtgctcttttccttctcgcttcaaaccaaaccaaaatcggagcggcggagcaaaacgatccgtagcctcgcttgccttcgattcagctcgaccagagcactaaccaggaagccaatgccgcgcaaatcgcgagatctgtagcgccaatcggcttcatcggcggtggggcgggcatggaagcgtcgaacggctccggcggaggggcgcccgttgtgctcaacgttgtacgacctgacgccc

SEQ ID NO: 8427 - DNA, 879 bp, Zea mays
aattaatacatgtgctagtcaagtgatcatcaattaagctataacaatgatggcacgtatcttgccttgagcttgactgatatcatgcggcaaagggattagtacgtgaatgtatcaagattcagccgatatgatttttatgtacattcaggagttagtatgtcctgctaggtaccgctactgacttgtggtctggaaaggttccattcactattggcaaagggatggaacattggaacttgcttatatgattgtctctagtgcaagtgggagattgttactgatatgcccaagaagcaatcatacacaattcagattaggctctaaatgggattagaggtttaatggggtgcaacccattaacacgctttataaatatatggaaaggtgatagggttaggccactccaccacatgtgcaaaccctagtcgttgcattcttcatacctagtcgcgagaccctcgctgcgcacgcggtgctagtacacatgtgcacgacgttcgttctccgtacgtgtggactatgtggaagcgcagctgcgactgttgcgctgacacactgcggaggaggagacgatcgtgatcggctatttcctcttcatcgacgcgtgcatatgttgtatcgtggctctaactcgttttctactacgctgtgtgtataagctgtaatgattcatgatcttttaattgcaagtttggtgcttgacaccgcgttcctgttcctaccatctaccaacacctgcaccgcagaaccaaacctagctgcgcttcctccagatctcggcgctctggccccatggccaccctcgttactagctccagtctctccgctcaccgcccttgcgccctctagctccggatcgcccgcgcacacgaggcc

SEQ ID NO: 8428 - DNA, 382 bp, Zea mays
gccaagatatattatcggtcgtggcgtcgagcaaaggatctaaaatcgatattaagtcgtccaggtctaaacgttattttttttttcaaaaataggctaaaaaaaattcggtagttccgacacttccgggtccaatccgagagtcggcagacgtggggacctgccattggatggcgctggatgcccttcactcccgtcccagattcatcgtcctgcagctcctcttccatctccgatctgctgccataccactaccacaccatggatagccaaactccactgcataacccgctgcgaagaaaccttctaaagtgactaagtgatcgatctccttgtcctgaaaggctgaaacctaaggcgagagaggccacgggagagcgcc

SEQ ID NO: 8429 - DNA, 1151 bp, Zea mays
aagagatgattattatggtttaactattatgtattgttattttgttgcaaaatctatgacacctagacctcactcagctaaagaggagcgtgagcgtgtgtttcaggatactgacactatgttcaagaaaacaataattggcatgctagaagattttatagttgatgcttatatgacaatgttcactgtaaaatggctgatggttgttctgtagtaaaataagctcatcaaatacatataccggtgaaagaacttgatattttgtttgtgtgttgctggataagtttatggcaggctatatcattgttaagcttccacaaacttgaacatattttaatacttctctcaaacataggagacaataacttgccaccaccgaccttatcggctctttagatccttaagagagaatgagagtaaaagacgtcagcgaaaatagagatgatgatgggatttgtagaacccatgtggtgcaaatttcaaacaagagttcaaacaaaagaacacactcctttttaaagaagatggtaaaaaaaaaaattcaactgtttcacttgtgacaaacccagatattacgttagaaaatacttgaatgctaattcaaaaggaaacaagaaacctgcaaacatagttgaggctggtcggaaaatttgaggtatggtggagaagaatgcacgttgaagaaaggggagaggatgacggctgggtcctcattaaattgagatttgagatggagagaggggttgtagcagggacatttttgggcatacaaaaatactgacgcctgcatatgggcccagctaaaacgtacaaaatagcacgtcttacgttccacaaaaaattatagtaacacatttacaatattataaattgtaacagtacttttttcagctcgcaaaaataaaatgtcaccctttaggtttaacactaaaatttctcgtggattctatggccagcgtaggtacacaaagcccctttctcctccgcatgctcatatttaaatcccacagtgcgtgctgcccgaaagatttgggtatccctgcctccgtggtagaagtcctggcagctccagctccaagcgcattagctcgacctaattccttcttcaactgttgtgtacttgtgtgggtgtctctctccctctgcccgag

SEQ ID NO: 8430 - DNA, 1251 bp, Zea mays
ctctagcttgctttttagtttctgcatttatattaagtatttaagttttaatcttgtgcttatacttatattgtttatgattgaaacttagccattgtggtagagatagcaacaattagacaaaacctagtttgcacattctagtttgattatttgcataagttttgctttagtgatttatttgtggtctagtttagagaaagttttagaagttctaattcacccytcttaggcgtcacccatttccttcacactcgattkgactgcctttaatattttaacacaatttttcgttagcctttcatccaacggtgttgtatttggacctggatttagtgaatgacatgtttggtgactttctgtgcactaaacggcatggagacccaaaaaatcgactacaacggttgtgtgattcgaaccaaatggtatggaatcaaatgcaaggctaacgaaaatgatgttaaaagattaaagacactcgaatcgagagttaaaagtcttaccaatgttggcttaccgtgttttcatttaccaacttggtctaccagatattttctggcgtatttacgaatatagataaattaatttagaatgtgcgaattcggtatcatagatgcagcgaatcaaacaatatatagacgaggtctgactctcatggagcggacaacaaatagcagccgccctcgatgactgctcggagcttttctttggctgtggccctgtagcggctcccagctgtcgagtctcagttttgtgcggttttcgggaaagggtatatgtgttttggaaacgctacgcgtacgactctgacgtcatacccgcgtctgacctaagtgccgtgcggtgaagtccgagcacagagcacagtagctgccgggtcccaccttgtgtgtgctcgctgttcacgctgtcggacgtatagcaggttcatatgtgttgatacgttggctgtggcctgtgccattggggtttaccatggaccaagggacgccacctgttgtcgctgggcgggccaggcccacaaggccgtgcgccgtccagcgatctctgcagcaaccaacgcggcaacgtggacggactggtgaccacttgacagcaaccaactgaagcaccggaaatatatcgatttctgctcacgactgaaacagtaaacacacaaaatagggcgtctggatgatccttgtgttctttgtttcccgtcccgcggtgtgcgcgcgcacgtctgccgtctgccaagagragtaggcagag

SEQ ID NO: 8431 - DNA, 731 bp, Zea mays
cgcggcatcttcactctgaggcaggagatcacaatcgacagccttaagtttgtcagcaataacgctgagagctccgaagaactgaacatatgcttcagttgacttttgcaaaaggaataaattaagctccgaccggcaagtttggccccaaatgttaccttcccaaagatcatgccataagaaacaggtagcgtcattttccagagatatcaagcagtatcctcgaactgtgtctgcagttcaatttgagaatatcatgtatatacaacgtacatcaacattctttagaggacatgtgctagctatctctaaggtgtatatatatatatatatatatatatatatatatatatattttgacccagattacgctcatgcatacaagtaatttatgtgaattgcagtggattgagatatcgcattcaataatccacatggattaacaacaaaacgaacaagccctaaagcatcaaggcgatccaccagcgatagcatgaaggaatgttggcatgggaggcatatcaggctcagacaggccttcgagaaactgtaccacctcaaccattgtagggcgatcatactcattatcctgaacgcaccaacacgcaactctgcagactctttcaacgtcgtctaggattgacatcgccgcccaagcttgcatccacaaggcttccgacgcctccgttgagaagcttgtccacgacctgcacagggaaacaacacttggc

SEQ ID NO: 8432 - DNA, 806 bp, Zea mays
tatatatatatatataatattaaagagaaaatttttatacctgtttttctcacctcttcctaactgagtagagaaattatatctagaaataataaggacatgtttggtaaaacggctcttcctatatttttttatttggtgtatgagccaaaaaaattacggcaaagaatattcagcatatgctacttgctggtacttccatactgcagagttcaaaccgctaagcatatgctacttactggtagctgctagacatattcagctaagcattcaaactgccattatatgaaactgcattcaggtagagctgccatatgcagctaagccaccgcattcatatgctacttgctgccttgctgcgctggcagttgctactacagagttcaaactgcattcacagaacaaacttcgtggaacaagctccatgaaccgaactgctactaaaattaaataatagtagtttgatattataaatattatattacatgataaaattaaatgataatagtagtagtttgatattataaatattagtactgtttttatgaacatagttagacatatgaagatttggctctacctgatttaattaaagctataggtcattctttttggaagcagcgactagagagtactccggtatgtgctggctttgcggccggtcaacaacatcagtacgtcaccgcgcattactccccgtacttccttccgtctctaccaggagccacgcagctctatttaaacacactcccggccgggctgcgctgccataccatccgtcgtcgagctcacatagatagatagca

SEQ ID NO: 8433 - DNA, 85 bp, Zea mays
ctcgtctgtcttgaactcattcatcaatgaaggaagtcgatcgaattccctaaagccccccatgtttgtatgatgtagatatgac

SEQ ID NO: 8434 - DNA, 1500 bp, Zea mays
actatctaagagcgttgtattgcgtgtggtttcgtatcatattaggcttaggtgtttctcacggccctatctagaaggtaacaacctatttattagccgagatgtaggggagaaaatagatcaccttactcactttgcatgtgacgcacaatagacaatgcacgaaactcgtactttaaaggagtagagatatagacagagttagaaaggtgggcttttagtcagtcgtggtatccaatactgccgggcatgacataagaggataataagaaggctaattgcccacaagggagtcttacaatagcacatcgcaactgcattactccaagtctccaacacacagttctttggcacctagagtacaattcttcagctaacatgtactgatggttggcgctggagcagctctctcttcaaccatcacctgccatctggtaaccgttttatgttcttcgacaacaaagctcctttttctagattgtcagcaacctccacttaactgggtgctcagaattttcatggaccacggatcgctctagtcgtaccagttcagaaacgggggagcctggcccatatgttgtctgacaggctccttttttttcctgctttggttttcattttgctttttaccatcaaagaaatttgatcaaaatattccatttgcaattaatggaccaagttctttttgctttgtttcattttgaaggaaatttgatcaaactgttcctgtcgcaacagttgttttctttcctgtgtcagccagcccatgggttgtctgacaggctcttctttttgtttttgctgcgctgtgctgcaatttgaaggaaatttgatccaagtatagctgcagttttctttctcgacattgctctcaaatgaaaaggcttcggccattgctggaacggtcagtaggtcgtctatgacaggcttctctttattttctcgctttttctgcccttcagcttctgaataaaaacccgtgcaaaatattcctacccccaatcccccatcgtatccttacaaacagttctctaatttgttacaaaacctagtagaatcgtgctgtctgtcacaaaagaaagtggatgagttgacaggatcgttaccattcttaagctgttactttcctacagaactgtcgcttcctcgagatctttcagtacaagcaaggctagagctccacgagtggtgacggaattgttgtttatctctgtctgatctttcacatcgccaacaactctctcgaggcatgcggccagcagatgaacgcttctgcagacacacatcacgtcactacgcacgcgatcgatgctatatctcgttcttccttgacgatcacagaaccagccggttgatgcagcatctttgtcagccgcaggaaaagcctctgaaaccgctgatcgctgcctgccctcggtcgcttaccgtgctcgcctgctttccgtctccttgtgttctcagcagggacgacgtccgtgcgcggcccgacgtcgatcgcca

SEQ ID NO: 8435 - DNA, 554 bp, Zea mays
tggaaaatagttttcatgttaactacctaaattattgatttagaaagtttttagagaactactggagttgctctcacccgcccgcgcgcctcctcccttctccgtccgtggcaacggaagcccccctataaccgcggccgccgctgcaactgcatgcacggcacgaacctcccttctttctcaaattctctctccgcctccctgctccgatgccgcggtgacgcgtggtgcatgcgtgcgcgcgcgccttttcccctgcctggatcccccgtcctctctcgatcggttccagttaacactcgcagcctcgttctcgagtctcgactctcgacttgagtcgccagtggccacgcgcgccgggacacgggcgcgctttctcgctgccgcgccaaagcaggaaacagagcaacggccaggaaggactcacgcgcgaggcgaaaagcgaagcgggtgggagaagcgtgggcgcctgggctagtgctcccgcagcgagcgatctacggtagagttccgsccgggcgcgcgggagaggaggaggtcggggggaggatccg

SEQ ID NO: 8436 - DNA, 540 bp, Zea mays
tatatttatctcttaaacctattaatgctcattacattttcattatatacaactgatggtagaagaagttgaagcatgtttttaatgtatgttatgtattaatattttattgaataatttatatgttgtatttattgaataatttatatgttgtcacggcayacaagatactagtgcgagtgtacgacctaaacccttaggaccatatcaatgagttaacatggaacgaaacgtcctatttgcaattagcctcgtcatgttgctagaccggcccatcttggcccagatggaaagactaaaaaaacctgcagaaggccattaaccaatcggcccatttaccctcgtgacttaaaccctagcattttcgagacagcccttcggaacatcgtgaccgttcgttggaatctgcgagtcaatcgagatcgctcttctctccgtcccctgctacatataaggtacctccggccccaaactgcacgagctctctctagcattacccggcggcggaagcgtaagcgcaaaacgaagcaagcggccgcc

SEQ ID NO: 8437 - DNA, 340 bp, Zea mays
ttgttttggtggctaggattgcgatgtgctcgcgtcaggcctggcgtgaccgacgcgagcggcggtttggtagcctgtctttcttgagggctaagataataaaaccgtgcgctagtttgggagccgcagaattggaagagattggagagctaaaatcctctccttatttattttcaaggagtaaatagaaatcataatagaaagagcaggcctgcgagcagcgagtgccctttgtaagttgcgagcctgcctgtcaaaccataggcgccttaccgccccccctttcttttttgaattagaaagaaggggatgaaagacaaagaaagagatcaggttattt

SEQ ID NO: 8438 - DNA, 1500 bp, Zea mays
acttactcggatagggagctcggggagcaagcagtagaaaagcaaaatagcgaagacagggaaatgggggaaggggaagttcttggttgagtgcggttgttctccgataatccggttgagaacttttccagcgatgcagaggagagatcatttacaaagaaagctatgactaggctaggatattcttcataaagatactctggacaggatcatcgattcgcttccatggttgaaagtagtgggactgccacataatacaatgaaaatgaattcattctcggttgagcaggagattctgatccagaagatgccgcagaagactttgaaacggttacaaatggattggctcactccgctctagatttggttatgccagccataggcaaaagtgagaaacctcaccctcgggagaaaggaatatgcctcctactagaagcgttggccaaggaaatacccccgtatgagctgctttcggcaatgggtgctgcggtcaactagaccaaagaggaagggctactacctccagctccagttattagtgggcttttttctctatgggaatacttaatcgaattcagccgtttttccgaagaaagaagactcctctctatggggcaaggcatagaagtacaagtgggaaaacgaggaatggggcgtcaaactgttggaaataaatgggktagttaagtgcaaagctgatgggtctgtcgatagatagttggctcgcttagtagcaaagggatccgggtaggtagattagaatgagacattcgttgaaagaaaggcctagtctgacgcttcctaattgaatgaactgatcgaacttctttgattcactccaaagcaaggagattatatgataatcagcaccaacgatttgaaggccaggatgaagtaatatcccttacgggaatcraacccgtgtcttcgacatgaaaagacgatgtcctaaccactggacgaaagggaccaaaaagcaattcttcatatacctaagaaaagagaagagaatagaagtggttccttttctttctatacgaaattcgacgatttcgtttgtgttcatgttggcgatttcagatgtgaatgaggccggtcgtctccccttcctacgggttcccagtgacacatcaaccacgccccttccttttctccgatcataaataacctgatctctttctttgtctttcatccccttctttctaattcaaaaaagaaagggggggcggtaaggcgcctatggtttgacaggcaggctcgcaacttacaaagggcactcgctgctcgcaggcctgctctttctattatgatttctatttactccttgaaaataaataaggagaggattttagctctccaatctcttccaattctgcggctcccaaactagcgcacggttttattatcttagccctcaagaaagacaggctaccaaaccgccgctcgcgtcggtcacgccaggcctgacgcgagcacatcgcaatcctagccaccaaaaca

SEQ ID NO: 8439 - DNA, 274 bp, Zea mays
gttatttatttatgcatgactgtatgagcttcggtccaaattcagaccatccatatcagatgaaggtgctggtaatctcaagtcacagatcggaccgcccattctcttggaaaatcatctcccgccgtcagatctaggtcacccggcagccatcctataaaacctctccatctctcctccttacttccgtccccgccgccacgccagagaggagaggaagagcgcgcggagagtgagagcccgggagccgggagaagcagcggctgggagcaag

SEQ ID NO: 8440 - DNA, 438 bp, Zea mays
gtgactttgacatgagtgggccttattattaagagacggtgttgcgagaaagctatgttcacagcccattcaaatcatgctgcaacgctcaggaattttattttcaccaatattgccgagaaaatgtatatgaaaaatctgccgcacaaaccgaagcgttttacttccaagagatggaacagggtaggaacaaaacgtcgaacaatctcctaagactgacttcctgaaaattgctgaagtctctgattatcatcggttgtttaacatcygtggaagcgatgaaaccgcagtagtacatgtatggtctcaaatcacttttgagataagctttccagatgcaagtatacaacaacacacttgtatgtatgcctaactgccgcaataactagaaagatttcgtcaaactttggcttctgaacagtacccacaaaatgctac

SEQ ID NO: 8441 - DNA, 860 bp, Zea mays
ggtctcggtgccttcacctcccctcccttcccccgtcatggcttaccccttccggacttagcttcgagccgccgctgtaagaatacccacacattgattccggttgccactcggcagatctgacccacctgtcaacgtagtctgccgggagtccatcactgtgccggggcgttactcctcaccgccgctgtgttgcctcttctgcggggttgaggtattcccgcctgctgggacaagtttgcttgcgcctgcaagctgttcgaccaaatgcttcttcgaaggaaattagtctctcccacttgttttcagcactgctattttaaaactaggaagaacaccagaataggtaggaagaaaattgcactatgtcttgtcaaacaacttattattcgctgtaaccgaagcatttgtgcctccccaccagaagcaattagtgaaagcactctaaccttgtttatccacgcttgcgtgctataagtttgatactagtattcgtctacaatcgttctatcggtttaacgcttctacctgttagaaattggcccttgttatcagaatcacattgtctgatgctttggttgctttgtgctattcaaatcagtatgcttaaactggctaaacacgtgatgttcatgtagtccatgccatagctagtagacatttattcaagcaccatttgttctacttctacctcaggtttcttcaaacatttcatcttccacattgattttttgctccttgaataattgctcttctgtgtgtgttgtggtgctgaggtggaatttatggatacacgctgttgagctaatcacacctattggtcaaatccatgaaggtgaaggcgaaggtgaagcagcagg

SEQ ID NO: 8442 - DNA, 1319 bp, Zea mays
ggttcattgacacgaacccgcatgaccatcatcttcatcgtcgaccaccgtctatgaagttcatacctgcacaccacaagcaaagataatgttgctcaaacacattcacatcctggtttgtccatacgactcaaccaagatgttactcttgttgacaattactcatcacaatctaaaccaaaaggacacatatcaacctcatgttcacagtatccccttaacaagttcattgtcagcaccactgtacaaacacaatgattaacagaaaaggaagaaggaagaacccatttaagtggcaaaggctagataaaagccaaattaaagttatcgaaagcaatcaaatcttagtccctaaaaaatgagcaacgactcaaaacaaaactgactagctctcaaaaagaggtagaaagcgtcttagcagtattggccaaagattacagcaaaatcatagatttttatacatatatattggctagtttggcaacttcattttctcgcgggattcccattttttcaagggaaaatgaactgatttctcttgtaaaaatgaaaatcttttgggaaaatggtattgccaaactagcccttaaatatcttatactccgtttgtccaaaaataaaatttgttttcagatttttattagattcatacaataattagtgtatgtgttttgcatatgtatcttagattcatcataattcatttgaatataggcataaataacaagtgctaaagtgaataatacatactgtagttttacttaatctaatatctaaagtataaacatagataaaaaagagaagagattatgtagaggatgtatgagcgtcatctatttagaggacctttagagcaactctgagatgctctttatattcttccaattctatataaatagagattttgtaaaaaaaacttataacaatttatctaaatggttatacaaatatagctctattcaattccagatttctcgtaagtcaaatatagaaaacatgaatgactttataaagtacaaataatatatagaaagactgctgaaaattaaaaagatatagaaaatactctattcgtttttttttatttgtagtattttagtctaaaaatgaactagcgcgtgacaaatattcaaaaacggatgtagtaatttttatacaaataactctctaatgataatttaaagagtaaaatttaaaaaacctagcctaatccccgagcctcgcacctcgcacggtcggtcgcactgaatagcagcgaccaaaccagttaaccagcccaacaaatccaggcgtgccccgtgcgcgcatccctccgcctc

SEQ ID NO: 8443 - DNA, 449 bp, Zea mays
caactgagagaaccaccagatcctagaagacatgttgagggcttgtgctttgcaagacatgttgagggcttgtacttctcacttcacgcttgtactgtcatttccttccgattgaaggtacacttgtaattcaacaatgtttttgtttatgcccgataataatatatgattgttcatgttgtcttttatattctttatatttcatccttcgccattgtttaatgaatatatgaaggtatgtccttcataaccttcgtccgcaagccattacatcctaagggaaataatgcttcggaggacgaaggactttaacgattaacattttctatgttgccttgttcttaactcatagcacttgagaacaagtccccaacattggcgcccacctccggtgaactcacttccactctgagttttttgaacaccttcggcgatcataaaccttcgtt

SEQ ID NO: 8444 - DNA, 171 bp, Zea mays
ggtaagccgtctccattcccaggctagatttgcccgtgtccttgtcaattgattatccatcgtggtggtgcgagctctcgtttggtctgcgtctgtaatcgagttctcgcttgctgtggtgtctcgtgatgtgatccaggtaggggaggttcggctgggaacaagttccgc

SEQ ID NO: 8445 - DNA, 65 bp, Zea mays
cgtgagtcaagagtatattgttataggtgctgagctccaggttttggttctcttatttttttggc

SEQ ID NO: 8446 - DNA, 147 bp, Zea mays
ggtgaggagaccaagcgaaaaaaatcacgctttcattgcgaggggggaggatagggaggaagacgccaagccagctccagtccggcacccgatataaagcggcaggcacttggattgctgacgagatgggactcacacgccgtcaca

SEQ ID NO: 8447 - DNA, 234 bp, Zea mays
caatttccgttctaatattaatccgaaggtactgcagcctaccaaaattttcttaagtctgttcttgtgtccatgtacttatgtgcttcataactaatatcctccatataacatttccatgctacaatttccatctacttaaatatggtcacagcacaggttttcgaacacggctgaacacgcgcgcaaggcgtgcacagtacacgcgcgcagggggaggaggagaacaagagg

SEQ ID NO: 8448 - DNA, 644 bp, Zea mays
gatattgcaaacatgcaaccmatccctctttgtgcaataactgaggtctatttggcataggacaacaactwacatgttaactaagatgctattatgttgcctttttcgcaatagtattctgtttgggcctcgatcaggtccaaagtagacaatttttttagtgtagctttgctgaaaaatcacaagtaaaagtgtaaaacacaaaataatacatgcttcaggatatctcacaatgtgaattttagttagcctgagatgcatgcccaaagctgcattactgcaagtaggattctctctctcccaagacatgtttatggcaatagggcagtttgtagataacaaaacatgtatctgtgatgcacacaaatagagatctgacttactatataagtatgccagataaagatgcaagtatgaaccctagtgaatataatttatgtgaccaattggtctcaaccaaggaatgtatgatgtggatggatgctatgaattatgaaatcttcttgctgtatggcagctttgtatatatgatatggtcgacacaaactctttcatgatttacagatttagtcccatggtatttttttaatcccatttctaaattcgtatattgcaggaaactattccagcacaggtacccaagt

SEQ ID NO: 8449 - DNA, 1450 bp, Zea mays
gtcgtttgtgcgcgatgtgaatcgagggactgggtggtggcgatgcagcggaggagatcccgggcgcatggcccgctccgacaaacctcgaggcgggcagcggcgacgcagtggaggagagccttggagcatggtccgctctggattcgggggaggagcgatggtttcggcctttcatgtgatggggagagctgtctgcggggctggttggtgagagcagatgatggtgcgtgatcgtgcggcttagattatagaagagtagaacgggtggctgagatcgtctaacgacagaacgacaggctacccttacagccttaataggtagtagagataatacagcctacaatacaaaacaatattttccacaatcatatgcatgatttgctgaagatcacatcttctatttcaaatttcattacgtgaacactacaatttgtagtgtaaaatagtgttttgaataaccatatacacgatctgaagacaaccttcagtagatcgtgcacatggttgtgtaaaacactattttgcattgtagattatattgttcacataataaaatttaaaatacaagacgggatgggagataggatgagtaagttgatgttgtatcccttgtagaaagaaactgccgctgctgcaagtgtgcttctcttctctctcagatcagtagcagcagtagaagggcagctgctgcttattcatgcagccaaacataaccctattattaggtgccattaacattatttttaaaataaacttacttaaatttaaaatgatttaagtcatcaagaaacgagataagtttctttggaacggtgggacggaggagaaaacaacttggacggactcctccattcctgtccatactgagggcactgtctagtgacatgatattcaaagcttgtgccaggcaggcatcgtgaccacatgagctgccaaaaccccatgatggcacagcacctgaggaattgccgcttctctgaactttcgataagaaaacaatttcagaaaagtcccagttagtacaaaccattcggtcatggtaaaagtaacatttgaaggaaacctcatcctctccccatttgagatattccctcgctcgctcagcaggacgtagcggctgctgtcaacaactggctgtccggcaccgcatttaagcttcaccctcccctctggcctcctccactaaaactcggatagatcttagtgcagtgcttccctgttccctccatcaagaaacagcaaagatccagtgcagagagacagaagcgccatggcactctgaacaagaaaagaaaagaaagagctagagagagatctcactcagccagtctctcacaacacaataccggcaaccaccaagctgatcttgctcccaagggcgtgggcagcagcgccactcctgctgctgctgctcgtcctgcacgggagaggaggccacggcgtcggg

SEQ ID NO: 8450 - DNA, 1326 bp, Zea mays
gaaccccctctcacgaagttagatcgactggcgtggcgagcctccgtgacgcctccaaacctccagcgatcagagcataagatgcggcgcggcgctgtgtgtgtgagagaactaagatggcgttggtgcttggcggccaaccagttatactccgtttaggtgtagaatccatttttctaaattttattgtttggttccacgtggaattaagatttaaaatcagagtcccaattctctcaaattagactataaatagaaacctactctctcccaatacaaagtcttgtccatcggtattgcgtggaattagactgcacaattccaaactttaattcagtgacattcaaacataaaattataattacatttcatttcaatatcatatcggatttggtatttaacctaatttaattccatcatctccaatatcgacatccaaacggagcgagctgggccacggccaatgaccatcttttcttattttgggctgccagctagcggacttagcatttcttaaccattaaggtaataagaggattagtactacctttgttctgcaatatttatagatctctagcttatttttgaactaaaatataacaaataaaaaaaacggataaaatatagtttatatataatatatttttgctagccgatgttggcaggggccattcaatacaaatattcatgtttatcaggaatccaaaaatctcaattttgagagagcagtacagtaacaattaatgtgctggtatggaataggaatacttctgtaactttccgtgttggtccatgacatctaattaatgtgtatgacataaaattaagggggatattgattaagacacatcttgattaagctaaccagttgttgttttaaaaaaaacgtacaacagcctaaaagtgtgcatatattaagacacgtggatatggatgtatacattcacaaaaatcagatcagccaactaaagctcttacggccaggccatcatcccgttccgccgagtgagcacatcacatcagatcaaaatcggcgcgtccaagcgtgggttccggcgtgtagctagtacacggggagacgagccgggagcccctggccacaagtctccccggcgagtcctccaccacaagctcgcccggcagcggcagctcactgattgctccagttgcgtgctcgcgcgcgccaagctcgtcctcctccatcgcagtcggtggccttatcttgttcgtccttgcctccctcgttgttgcgacttgcgagacgacaggacaggatagcgagctgggcctgggagtatagaccgcagacagagaggtggagcggcc

SEQ ID NO: 8451 - DNA, 68 bp, Zea mays
ggcaagacgatagcgcaagctccggtccatgaccaacaacctgcctgcgtgcacccaccgtctcatgc

SEQ ID NO: 8452 - DNA, 350 bp, Zea mays
tgcattcagaatgtagagagtgacaactaagatcagctaggtatggatttggatgtctggtagtaagccaagcaattaacatctccttgtgcatggagatgcaggcgcaggataccagccacgcatgactcaggggcgttcctatgaccccgcgaagccgatggctaggagcgacacatctgactgtcagatccgcgcgcgcctcagttgtcgggtgcaagccatggaccaaaatagctattagctagcgggtagcgcatgacatgaatgaacgaagaaagagcagcaagaagccgtgacggagtagcagcaccccccggcaacgcgcagaggggagaggcgaggcggcc

SEQ ID NO: 8453 - DNA, 198 bp, Zea mays
gtagtttgtggtggtgacaagcgctattacgattgtcacagagatgcatgcatggttggcttctagttcctgctggacctggagaagagcctgctggagacgaatacgccgagggagaaggcggcgacggcgacggcgatcacctccctgttccgacgcggcggccggtgagcacctgcccggtcgctagcttctgcc

SEQ ID NO: 8454 - DNA, 1014 bp, Zea mays
tcttcggaaatactaaaaaactgttttcaaagccgaagctttaaaactaaagactcagggaatcttagcgcgcaaaagctaaaaatcgagcgagcgagagcaagtgacaagagagcgtaccaaatgagctcgcggtatgctcttatttatacgctcggtgcggtaaaagtggaaagaccccgcctgtcagtgaatgttgctattctagcaaagggaaggtgttttttcggaccttcggcttaaagccttcgtccatgtcgcaatctaaatttattattttaacaaattaatattgcgaggggctactgttggggccttcggcttccgaaggtcctcaaaaacatgatttaacagtgtttctagagtataatgtgtgaacaggtatcttcggactcgtatcagagagggagaagctcaaaagatacgaaggttgacacagcgccgaagctgtgaagcaggaaagcttcggcatgttcgcagaaaagggaaccgacttgaagatgaaaaggccatttagacctcgatagattactatagaattaccaccaaatgtaaagggcatgtatgtaattttgtatgggttgaaccccgtgcctataaataggtgaacagtacccccgtactgttcacgctgatttggtgttcacttttgcgtcacgcttgtactttcatttccttcaaattggaggtacatctgtaattcaatgttatttttatttatatataataatgatatatgatgatctacgtaattctttatgtttcttgtaattcattcttcgtcaatatgtaatgcatttataaaggttcaccctttgtgaccttcgtccgaaaatcattatatcccaagggaaataatgcttcgtaggacgaaggacttaaccgattaacattttctatgttgccttgttcttgaagcatttgagaacaagtccccaacattggcgcccacctccggtgaactcacttccactctttgaagttttttatcttcggcgatcataaaccttcgtt

SEQ ID NO: 8455 - DNA, 544 bp, Zea mays
ctggttgggtggtaggtgtggtcgtgcacccacatcaccgaggtacaaggcctcggcttgaatttgggtgcctatttctctattttcatttttaattaaaaaaacgtctagtttcttctaggttggatcttgaacatatgaatttcatgatttaaatcatattatttttcattaacgggttatgaacaaggtgatctattcttataattcgagatgaactgaattttgtttttctttcttttactttagttacatagtcatgtatcaattatttttgaactaagccatacctattttctgtctctggtttttctgtggtaaggtatcttactgacaggtgggtctaagcccatgtagcactgaaagatctcagtggtgaagttgctatatatatcggaaattaaagcaatgttccccagtggagttgctatgtatatatcaaaattaaagcatgggcacattataacttgtttccttgttaatatttcataaggcacagaactcatggactaagcttgctgtggagatcgacagtccacaagct

SEQ ID NO: 8456 - DNA, 182 bp, Zea mays
cctgaagcagcagcagcagcagtctttttctttcagcaggtgatgcactgaaaccgttaagggttcctgttgtttgtttgatcgcttgtttgtttatttatcatgatgatgaaccgtggtgtgctgcctgctgcgctttgtttgaatagtaatgattccgacaatgatgtgtatttggttgg

SEQ ID NO: 8457 - DNA, 235 bp, Zea mays
ctgggagcctggactggtagcgttgacttgccaaccatgcatttcgatatggatcgatcagagactagcactagctagcttgtagtattatataaggagggagcaggcagcagcactctcctacagctccagattgtattcaaagagaggcagcgcagggtgcaagaagctgtccctccctccctcccctgtgcttctgctagctaggtgcctgcggaggagagatagggatacg

SEQ ID NO: 8458 - DNA, 1500 bp, Zea mays
tgaactggagaagccattgcacatatgacatattatgctaaataaatcaccacaaggatgcattcactaatctatcttgtgacatcctgaataagaaaaagaacaaacccagtgtcggaggctctcacatgagtgggttcactaatctatctcgtgacatactaaataaaaaaaggaacagacctatctcgtgacgtactaaataaaaaagcataaacccagtgccagaggctctgagatgagtrgggtctagtcgtctaggaaagggaccaacagaggcaggcctttttcccacaaatacggagaagctgcttcgaacccacgatctggtgactcggtaagatagctctcacccaggcatgcccttcatctcatgagtcatgacagaataaatgcttaaataaattattttctgaaaacgactgcttactgtatccatggtattattcttgcacggtctgcaaaaccattgacccctaggaacttttagtacaccatagcaggcttggtgcacctacacaaaatacaggccactgtaaatatgcagtaatagtagggcacatgtacagagtagtatgaaatactttgatatagcacttgctgcactctattaatcgattgcaaggctccaggtctgagatcccacaaacacagcatggagaatttgagctgagtcttccactgtatctgtacaagataataagcagaatttgtcagatcggttagtaatgaaagaaactagataaatatagggtgtgctcccaagaacatatcctttcttggaaaacaaatccataagatacatataatggaacctcaacctcctagcattcacttcatgggctagcacagcattgtctttgtcactgccagaatagcatactgatttgctcccgaatttcttaatcctggcaagggatacacttgttcttcgattcttggttcctgtacatggtcgaatactaggttagtaaaataaaagtgccgtttaatagtgcatcctratacagtatttatgtacaaaatacatctgttgctcatgcgaatagttaatacataatctggagtatgtgtttttttcagtgaaaacaaaagagcagtagttgtgtggcattgaatcaattcttggttgtgtaatgttgttttagaaaacaaaaatgggtttcttaccagttccacaagtcgttgaaaaaataatttaactgtttactacatggtgaaccacaatcaatctttttttcctgaaatgacttcaaagtttctaaaaatactaaaaaaagtgctagctacaggtcatatagagcaacatcttccatcttatggagcataatcagtttcactaatatacggccaaccatactatggtacttttctcataccattttttgaagcttcttttttttcttttctcataccattacttgatgatgatattgacaggcaatttatttccacatctgttagaccaagagagtcatcttctccaatgactgaaatgag

SEQ ID NO: 8459 - DNA, 204 bp, Zea mays
ggtagctaacgtcacttcttcaacaaacacaaactgatgaaaaattctgagatatgcattctgcattagatccttcaacacacattttgtgttctgtgctcaggtagttgctgctggagacttgtgtgcgatatgccaagaaaagatgcatgttcccatccttttgcgctgcaaacatatcttctgtgaagattgtgtatccga

SEQ ID NO: 8460 - DNA, 1370 bp, Zea mays
atgatgctgacaccagcgaatatggaggacagagcagcgtgttctttttttctacgtgccacgcggaccttctcttgggctatcgttcgcccctagccgtcacatggtggcaccggtatctcagactcctttggccactgggggttcagactgtcaaatcacctgatcatttgcacggccagagccagcccactcatcagtgactgacagcacggcgcagaaattcatgtgcagtgatttgactgatctcgtcacgcacctgcaggggcaccgacgcacgcaccgtgcccatcacggactcacggtgggggaggctgctagtgccactggctgtcctgagtcgagtcctgtgacgccacgaagcgaaccaaacagcaacagttgacccgagccaccggcagataactatcggcgaacaaacaaggcagaagaaaggaggatatcagaagacggttgtaattgcaagaagctgcacgaatcaaaagagagttgctggagtaaaatcggcgcccatgccagcagaagcggcgaaacttccacccccaccttcccctcctgctgcgtgtgtatacatatttactcgccccggctggctcccaccacctcactccattcctgacggcggtttgaccttctgaccggagggagagagagagagagagagagaggagaatcatagctgctgcgttcgatttgcggagggctggaggggacgcgagacgggacaggacggatcttcgacggagcgttgcccgattcgtcgcagttcccggacaagggaggaaaggcgtgggaagagggaggacgcgcgttggtctccgatccaagaggtaatctctccgcctctcgtgtcggcgcaggatccgatcctgactttccgaggagtttttgaggggggaaaaaaagaagggttttccttggaggctaccgagcgctacttcggccgtgtgggttgattcgtactcgtgtggtttgtttgttttgctcgctcgctcgctcgcttgcttttaccgagtgatctgaatgatgttgactgtttatctgagaaggtagcggcttatcaaggatttaataaggttccactcgtggatttggatttttctggccccctcttttggtctgtcctagtttgttaaggtggcttcggttcggacatttgcttgcaaaattgaagcgcctttgacgtgcagaagtagcgaaagtggttcgagttgcagcgctccagttttttttttcttttcttttttctttccattcacggtttatcgtcagaaccggtctggttaaaaggcaaagcttaatatcgtcgcccccctccccctttttcagctttgttaacaccagagattaaaagatagcgccgtagcgca

SEQ ID NO: 8461 - DNA, 105 bp, Zea mays
cggtattgataaagtcttcagagaatactttgcagttgagaaaatgagaaaccacggaaggctttccagtgatatttttcaaccacaactggtccaatagctaga

SEQ ID NO: 8462 - DNA, 954 bp, Zea mays
tgccgtgaaccgtgatcagatggaaagataaaattaacatgttatctgttattgtttctttcctttgaaagaatattatttcttttatgatcctratattacattgaactctttagtgttgtctatgctaacatactactctcatttatatacaggtatgaggttccatcacttttggtcctgagacttttatgtacatattaacctgatgtttaaaccttcctagaacggtgtctatgcaagaaaagctaggtcacttttgatcagtagactcttatttgcaccttgcacacatagaaaagaccccatcacttttggtcacaagacttttatgtatatattaacctgatgttgaagccttcctagaactatatgtgtatgcaagaaaaactatgtcacttctggtcagtagacttttatgtacatatgactccactgttgaagcctttctacaactatgcttgtctatgtaaactctgcagatacactattactggacacttaagtatgctagtttaatacaacttgctgcttattgtaatctaaatttgtattactactgctattgcactattagtatataaaaaaaaagaaaattacgcgcgcaggcgcgcgcgtaacgcactagtaaacaataaacgcaatgagagagcaaggtattggtgctccctgtcggctgtcttcgccgctgcgtgtaccttcctcttccagccgcgtcaaacccgagcgcgaagcatccacgacgacgcccccaacagaatacaaatataataataaaaaaaacccacaggtcacgaatggataggtagatcgctcgaagcgattgaaaaatctgcctccgacaattcctagcgcgattcagcagctgcctcggatcggatcggatcggattggaccggcgccggaagaggagaggaggcgtgggggggttcggggcctgcctcgctgccgccc

SEQ ID NO: 8463 - DNA, 1500 bp, Zea mays
aaacggctgaatattttgcttcagtgttgcaccacttttattttgatgttccttcatccaacatattgctatactattttggtgataaaataacaaagtttaggttttaaaatagatgtatgcgttatgttttgagactaggacgtttgctagtggggctctcttaacgtagaccgaccgggttctgcttcttaattaaagaggtgtttgattttaaaacttatttttagttttttttattttatttttattttagtcactaaattattaaatacgaaaactaaaatagagttttattttcgtttttatcaatttatagattaaaataaataaaatatatagactaaaaaattagtttctaaaaaccaaacatcccttaagtttaaaatgacatttttgaaaattcacgtcatcatcgtcagcatgtagcaggaggaagaacattggcgcgccgcgcgcatgcgtttcaccggggcatctgctctcgtaggctgcccaccgccctcggcgccggacgcgcctctgcttctccttctctccatcccctcccctcccctcccctcccaccgtatgcgcaacccgcgcctcccttcccggtcccctccctccaccacccgcccgcaggcgcaggcgtcccccgtgaccccgtcgaccgcccctcggccctgccggtggagttagtgctggagatccatccggacttggatttctcctcggtaagaattctatccaactttccttgtcgcggtcctgtggctggcaggcaggtgtgcccttttgtggaaactggaaagatcgttccttctgtgccgggggatatcgatcttttcactgctgccctgaattctccagttccttccaaatgttctttctccggtggctcggtgcggactcgtttgctgcgtcgatcggtgtagttagtcggtggcctccatttgcaacattagttagttcttctttccttttcttcttctttgatttgcaacatcagttgttcttttctttttcttttaaaacaagggaaagccttaattgttttcgccacgtgaaacccttcggtttcgtttgagggtactttctggtggaatgccacaggcatcatatataatttttttgccgctatcagtgctggtgctcttttgttgcatgtcacaaatggtacacgttttgtattttaaaaaaatataatttgaatgcacgctgcttccatcgtcacctgttttctacataatttgattgatacaagttaaatttactatgtcaataacttgatacatttatgaggacgacaagatcatcatggttcttagatctccttgtttcgtctcttgatctaaaggatatctgccaagcagtcttttacagtttttgtggccagtgcctttcatcgtggcggactggcggtagtgtaaatttcttcgtctaccatgagtaaaacttacgtctccaggtccaagcaaggaggttttggcaccatacaagatcgtcgaaattgcggaa

SEQ ID NO: 8464 - DNA, 1500 bp, Zea mays
gtggcgaaaacaattaaggctttcccttgttttaaaagaaaaagaaaagaacaactgatgttgcaaatcaaagaagaagaaaaggaaagaagaactaactaatgttgcaaatggaggccaccgactaactacaccgatcgacgcagcaaacgagtccgcaccgagccaccggagaaagaacatttggaaggaactggagaattcagggcagcagtgaaaagatcgatatcccccggcacagaaggaacgatctttccagtttccacaaaagggcacacctgcctgccagccacaggaccgcgacaaggaaagttggatagaattcttaccgaggagaaatccaagtccggatggatctccagcactaactccaccggcagggccgaggggcggtcgacggggtcacgggggacgcctgcgcctgcgggcgggtggtggagggaggggaccgggaagggaggcgcgggttgcgcatacggtgggaggggaggggaggggaggggatggagagaaggagaagcagaggcgcgtccggcgccgagggcggtgggcagcctacgagagcagatgccccggtgaaacgcatgcgcgcggcgcgccaatgttcttcctcctgctacatgctgacgatgatgacgtgaattttcaaaaatgtcattttaaacttaagggatgtttggtttttagaaactaattttttagtctatatattttatttattttaatctataaattgataaaaacgaaaataaaactctattttagttttcgtatttaataatttagtgactaaaataaaaataaaataaaaaaaactaaaaataagttttaaaatcaaacacctctttaattaagaagcagaacccggtcggtctacgttaagagagccccactagcaaacgtcctagtctcaaaacataacgcatacatctattttaaaacctaaactttgttattttatcaccaaaatagtatagcaatatgttggatgaaggaacatcaaaataaaagtggtgcaacactgaagcaaaatattcagccgttttaaatcttaacatggctaaacgatccaactcaaatttaagctcattaacgagtcaaatcgagctgaccctttgatctaatttcttaacgagacgaactggttaacatcatatctcaaatttgaacgagccgaatcaaactagcttttaatatacatccctataccctacctagtggtagggatcaaccgacttccacttagacaatcaggatttttttaaaaaaattatatccgtcgttccgtagacgttcagtctacatttgaattctttcgaccgaaatatatttcaaatttagaattatttaaataaaaaggggaaagttacggtcgaacaggctaacgtaggcccacctccttgccccaagaggcatgttcaccggctgggccgtatttttctacacaggtatcaacccaagtgacctcctctctttcccggctccggtcgcgaatgcgcg

SEQ ID NO: 8465 - DNA, 665 bp, Zea mays
tttttgccgagtgcccgacaaaaagtatacggcaaagaagccgttgccgatgtacagttcaccgagacttcgggtgtcgagtgtcacaatcagcaaagccttcaacgagcgtttttcagtctttgccgaatgcttcagacactcgacaaagaagctgttttcggtagtgatttatgtctatttagttttctttgattgcaatcgtattcactaattcatgttattatatacagagagagagagagagagaggtgaagtgatgtgtaaaattaactagttttcacccaactcatggaccctgatggatcggagaaaaacagtgacagttggagtgccacgtccctctcttttctctctcttttgtcgctccaaccgtggggcctagatgcagtatgcagtagaatgtactagcccacagtacaacatcactcgctctcgctcggtcgctactccactctcacgctgtgctggctggcactccgcccggctgcccttaatccttatatagcgacccctccgagctcagtgactccccactctccgtgctcttggtcgagtagttccctctcctctctctgattcttctgcttctcggtctagctagctagctcggtgcctcggccaaccgggcgtcgcgcgctggccggcctgccaggcaagcaaca

SEQ ID NO: 8466 - DNA, 383 bp, Zea mays
ctgtctgtctcctttgtccttcctaacgctagtctagtctccttcgttccactcgtccttgcttttttttttcttcttcctatcgtcaaagaaataggttcagtggttcgacctcccaaaggtwaaagaaagacatcgatattaaccctccggatgatgatatgccccaaccatctataccccatggttcgttactcgggaattcggagaggtcagatgagatagatgggtgtgttcaaaatggaatgatcccctttctcatgttttcatttatgttgtccacaaacgaataaagagtccgaaaagacgtacgcataacagactcggtacctaggtcaatgggttcagtggagaattgcgtatagaaaggagcaagaaaacgt

SEQ ID NO: 8467 - DNA, 604 bp, Zea mays
atgacctgaagactgcaggttcgaatcctgtccccgcctaatcacgtcagatacttgtacgagtcctgatcacctgggtaaaagaatctatgttcaagtcgcctgcctaacaaatagacgactgcgtactgtagttagtctgttccgttggtccgatccgaaagtgttgctgtgtaaaatagagattgtgtgggtgttcagtctcacaatctcctccttttttgttctggctggttagagcagaggacttaaaatcctcttttgcttaggactcaaaatcctaacagagtggttcgaatccacctcagaacgagagcgagcctgaacgaaacctaacgctgcgcttgactgggaagactgctgcgctccctgcgggtaatagcaagagagtgaagaacgaacgatcctaaaaaaagtaagcagtgaatgagtccgactcgagttcgtgggtcaaaggcgaaaggcagattcggaaaggataggatcctcctatcatgatgattaagggaagagtgaattgaaagagatagagatggttcttttgttcgggagacaaccattgtagattccagccgagaagaccaggaaaagagaaggataaaga

SEQ ID NO: 8468 - DNA, 181 bp, Zea mays
ggtagccaaaaggcagcccatctcactttctctccctccaccctgaaacaactcagggcatttcgtttttggttaatctgcatgctctaatcgggcgcgcagctcggtaaggggtgagatcgaggaggctgagaggagggaacaaggctgggaccgcttctacgaggccaagaggaaggac

SEQ ID NO: 8469 - DNA, 1500 bp, Zea mays
aggaaaagcaggagcgggacgggagggcaagggcaataataatggaacggcacggcgcccagagtcgctggctgtgctgccccggccccgggatcagcgcagatggtccaaaagcgcgggagggcggggaagagaacgaaccgttgtgtggcgccgctgcgctgtggccgggccgtcctctcctccacggcctggcggccgttacattggcggcgtgtggctcgtcgctgtccccaggcccagacaccgcattcacgccgctgaccggccattaccaacgccatgtcccctttgttgtttttttttaccatccatggaccacggtgaaaaaaaggataggcaggcaggcattggaaggacgaaggacgggaggaggaaagagtgagaaggtgtctcgcccgcccgttcgttccgttgcctcaacggccggctctcggcaatcaatcccgcattgaagcgcgggcgttacccaacgcaggagcgctgtggcggttggttgcctgttgttcgccacgagccatcatcatcatcaccgcttcttcccacgcatcgcatggcgtcccggtcactcaatagcatccaactgaatccgcacaggctgaggctgcacacgcacctaccttatcagttgcgtacgtatgctggcgctgtggccatggccatggagacatggaccgggccaggtctgtacagttgttactgcgcgcgcgcgagagagagacgcagacgctgcatgcgtggataaagaagaagacctcgctcgctcccgaatgccaaagcgcatgtactgtgctgtcactgtttgatgcaagggaatggaacttttttttttcaagacaataataattaaaaaaaagttccagtctataccatccgagaatggcacaccaagcgaagcgccccgaatcgggtaacctgatggcgctagaatagatatcctggcatggcaaccaagcagtttttcttcagtggagtggagaaggcgtgagagagagcccgaagatgtgaaccggtggagcgagacgttggagcagtgcagttgggtacatactgtacagcagaactcagatgtgctttgtactgtacgagaagaaagaaaaaaaaacatacagcatttctctgatgcgcggcgcagcgcatactggtactgggcgtctggggctgtgcctgtgtggacagtggggctaggaagagacctctgcgctgcggctgcgcacccgccgtacgtgcacactagtactacaacgctacactgccagcgcaagttgcgcggctcccaataaagagctatacagctgctcatacatgtcctcctcgccccaagctccgattcacaccctgcgcatgaaaggctgcactcctttctagcccatttaaagctagctagctagggacacacacagagcgagcggagaacagggagcgcgtggctcagtgcgagcgcgcggaggcaggcggagcagagcaagcagcggggagcagttctgcctgcgcagcccg

SEQ ID NO: 8470 - DNA, 1500 bp, Zea mays
gtcgaattgtggataatttgggatatgataataagactcggtatagatatgtgccttgcgaatgtatcataattggattaggcgcacccctcacctgatcaactgtaactgccttataaattcaatcaaattgctatataatgtagatttttcttctttgtgaggtttcagtcttctgctgcaattaataacagttataatattttttactgatctgggagatcactgtatctgtattctgtagttacaacttacaaggtagagcaaactatcggcaatggcgttttcatcaggtatactgtacgaaaagtgaatataaaaaattgagcagagcttgtttttggagatttctcgcttgggagaaaaatcaaaatagtgactatacaaattaaaagttaagaacaaatcatgtatgagttgatatatgttaatgtgacgctagagttgctgtagctttatctttcatgtcttggtttggacttatgaatcgtcgattcctgtccggttttgtggcgttgtcgatcagatagtttgcttttcttattttccatactcatctgtgagcaacatcgaattcatttttagccttttgccaaactgtttctccccctacgccaacggattcttgcttatcccaattcccacgcatcactctctatccatgggcttgttcggttagctctcaatcaatatggattgagtgagtttaaattccaaggaagtcaaaattcttttaatttttttttcaatcacatttaatctatatataatgagaacaaccaaagaagatctaaattaagtgggattcggtggatttaaatcacaaacaagttaaatttatttttaattttttctaattttattttatttatgtataatgcgaataaccggacttaagaatgagacaaaacgacactctaacgacaggcacgcgagttgaggtgggtgacaactgacaggcaaccaggagcctgccgaaccggccgggcaagggcaacggatccgtcgacggcgagagcgaatgtcgcggccgccgtcggtttcgcttcgtttgcaacgaaaacacagagaccttgttgttgaaagacaaaaaaagaaagcaatcgaacgcgacccgtacagagtagagggcgcagagcagagcagagcagagctaaccgcaagtccgcaacgctagccaggccaaacatagggcttaacgcttggacaccggccactagtccacccgtttgtcccgcacctgacctccgcattcgtgagcctgtcacgttgcgctggcctctttcgccacggcacggcaccgcacggcacgcgcaccaatacagcactggaccactatatatccccccgccccgcgctggggccggtccccagctagcgagcgccgccggtgccagtgcaacagaacacgcaccacacgggcgcagactgcagagacaacagatcgatcgtccaatggcgatcggcgggtcggaggccggcgggggaggcgcggggagc

SEQ ID NO: 8471 - DNA, 1500 bp, Zea mays
cgaaaccatctgaatagccaatccgtccaattttggcaagacggtggtcaaaattatttgtttttttagtttggtggcccaattgaactggagggtagttttatggccacaayatgttattttggaaattgtaaaatactccatytgtttcaaaatataatccgtttgacttttttaaccttaaattagtcacttgtcttgttaaaaaaatacacaaaaaaaactttaagtcatatgtaaaatatatttgttaataaatagaattacaatgattttttgtttttttacaattttttaaataaggcgagtgctaaagttatgatcaaaaaagttttacatttttgccaaagaagctaagaaaatttgtaataattagctaacgttcaaagctaagctcttgttttgacattttaagggcattttggtttatagagactaatttttaatccataaattactaaacacagaactataaagactaaaatcaaggttttaatctctatacttggtaatttagatactagaaaagattaaaaattagttcatataaaccaaatataccctaaaatttaactatattatttgatatcccgtatataagaagtgctgctgcatgcatatgtgcacatatagaatgccgacctttaaaattagatctaacgccaatgcgattgttttaaaaaccccttctatttatggctggttcgttttatagaagaaatcttcttgatattgtgcatgattaatgctgattttaaaggccaaaatttcataccacgtacacatgtgcatcaactcttgatgtacacatgatatcatcagttctatgatttaagtgaagcgctcgtcaacgacgagacatcactggcaactttaattttaaagtttgttgtctcagccttttaaaaatatctgcgttcacaatacataggggccgtttgtttcggcttctagcagcttctggccaccaaaagctgttgcggactgccaaacgctcagcttttcagccaacttctataaaattcattggggcaaaaaccatccaaaatcaacataaacacataattggttgactcgttgtaatagtaggaatccgtcactttctagatcctgagccctatgaacaactttatctttctccacacgtaatcgtaatgatatttagattttccccacagccagattttccccgcagccagatttttagaaaagcttgttagaaaaaagctgaaccaaacaggcaggtgtctgcgtaatttgaaaggaggaaagaagaagtgctgtatgtattgtattctgccaggcagtcaaaaaatgcagagtgccaaaccgttgtcacaaaaagcacagcacgcagcagagactcgagacggtctcccatttcgctctccccctcaccttcccgcgtcctccctacgtttcccagcaaccgcctccgccgccgtgggcgacctgccgcgcgcccgcgcccgcgcccgcggcacatgacgcggccccgcg

SEQ ID NO: 8472 - DNA, 606 bp, Zea mays
tgtcgtttcgtatatatgttttatttatactattttttacttccgtgacaacacacgtgcacatatctagtatatcttatttaagcaaatatacaaaccgtagtttgttctgtattaccgatgccccgttgatccacaaataccagcctccgcccccgcgctagccactccttcaaacaggccgaaacagagcccggcccacgagagcccagaatcactcgcctccctccatctctgacccagtcctccctgaccgcctgacgacgtcgtgttttcttccttccccggtctcattccacgcgcccgctcctcttcgccctcgtcttcctccatcccacggtcccacctgtccctctcaccgcctcgttattttttcgcccccatctttgaacgccgggactccaactccaccgttcctccctcttcgttccctccgatcccgcccctataaatccagtcgcctcagccgccacagcgggccgcaagcacgtaaccacacagctcactgctgctcccgtcttcccgtgtcctgtcgtgctcccgtcgccgggggcggaagggttcgcgaggccggcgggcggttagggatttctccggagtcccgcg

SEQ ID NO: 8473 - DNA, 126 bp, Zea mays
ctaggcatggtgaccaccttttgggcacatggaattcctgagttggcgatgagtattgttgcattgtacactttaatattgtactgtgattaggctttactcgcggtggatgtctttcaccgctag

SEQ ID NO: 8474 - DNA, 169 bp, Zea mays
aaccgcccggccggcgcgcgtcgttggatatatgatgagtggacgtgacagagtgtccgactatttcttaatttcgtcattttcctccttccttctaataagatttctctctcaccctcggccccccttcacgtgcgattgtaggtgtttgacgcttttgtaataatgc

SEQ ID NO: 8475 - DNA, 1500 bp, Zea mays
tcaacaacccaacacatacctttttagcgcatgattgtttctctctgtagctgccggtcattcgtttttgtgtttgcgcttgattccttcgtcgttcgttcccagcagagtggccgaacgtggtcttcattttttggtggcgcttgattcttttcttcggtgtttgttctcagtacagcattgtgttaactccttgaacgagctcgttgtgaatggagctgacacccagcacaaacttctggtcgtacgggagcgagagggcacgtgggagtcagaggacgagcgagagctggaatttgcctcaacagcgggagagcatttgggcgctatgaaggaaaatgacgagtcgtatgcactagccaaagatgcctagcgaagggacgtggataacgagccggatgaaaaaagataggctgaaagcgagcctgttggatgcgattttatctagacttttctattttttaccgattctgatcaatttagagagactgttggagttgctcttacttgtctaagtacagttaaaaaactgattataataaagaaattgatttacttgtctaagtacagttaaaaattcataagaaagtgacttacttgaaatgacgctcataagcccttcgccccttttgattatttgtccaggctttttttttatttaagtcgtccgtgacttaaaactacgactaatcttttgagtgagtcgattagttaaacgattcgatattaaatcgcccaagtcgtgtcgacactgtatatcgttgccaaaaaatcaatacggattagtcggccgatttaaaatcactggattgtgccattctgaagtctgaactcaaaactagaaaggacgacagatcgagggacaaagtagtgagagacggatgaagaagaaacttaaagagagtgagagacggatgaagaagatgaatacttaggcatgacgtattctgtgtagaaactagaccgcatgaatgtcagggcaggaagcagtcaacattgttctgcagctttgtccgttgctacttactgaagatttcaacccacaaaattctattcacaacttgcataagaaacatcgggtcatcggccatctcacgttctgaactgaactcatgcgagtcctccaaaatagacgacaaaatcgccgagatgaaaatagtcagcacatttatatgacgatcaaggtagtcaatcctgtccacccagacagactgaccgatttatcttctcttcgtaataacttgaaatttcccttcaatcctgagagttcatgttcatcactcctttgcccgctaaaactctctctctctctctacacacacacacacacacacacacacatatatatatatatatatatatatatatatatatatatatatatatatatatatatataatataaaaattatagacaaattatagatcttcagaccaattatagaccttacgaggagcatttgcattttcatccttatccagcttcttcagtagctgtaa

SEQ ID NO: 8476 - DNA, 430 bp, Zea mays
agcgagacaaacgacgcaagccgtttatcttgacatggagtattccgggaccacgaacgcgggagaaacgcgtcccaaggcgctagcgttctgacccatgccacaccggtcgatccgccgctatacgctgcagaacagaatagtaggagcactgtatatttcaccatcagcactgtagctggatcggctcacatccacaacaggccacggcgcacgcggaacacacgtagcagtaccacgtggtccacggccctctctggctcgctcgccgcgccgcgccgggctatttgtaccctcgcccgcccttgcgttacccaacaacgcctcctccagtccttcttcgtaagccttcaaaccgacgaatttgagcaactgcacccagagcgcgatccattgccggggaagaagcaacttgttgcgagcctcctct

SEQ ID NO: 8477 - DNA, 171 bp, Zea mays
ttttttgttccttgggaggatagaaaaaatatatccttggttttcttgaacaggtttgatttgtttatgcttctagctcttgtatttaggctttttgggttcttgctcattccgttgagcttccagataacatttcaggtgtgcttctgaagggagatttcgttgaacagg

SEQ ID NO: 8478 - DNA, 655 bp, Zea mays
tactttctaggtctacatgaattagttgttttgtgtttgttctaagtcagactatttaagttttgacaacaatatatataaatttaaattattttaaactaaaagaattatatattactatggctaaagtcatgatgaattcaatgactttatttttatattgtaaaatgttatgataatcggtcaaaattgatagacaaaaccaaaacgactaaatcacgtgtggacggaggactattagttcaattatttcattacgtaaactatttgcattgtcaggtgattcagtaacggttcacttaaagctctccacgtgtcgtaatcggagcagttggctttgctagtgctgattgatatgccacggcgtttgccattgccaatgcttttagctggactgaaggaggaagaggacgtccgccttgcagcagcgaccagtggtcggagacggccacacccgccaccaatcctcctgctgcaatacgtgccatttctttcttcgcttgtctcccgcgaaaaaatatctacagcggctggacctacatgtcacagactctaatgcagtgcgggaggctacatataattagctgatgcagaaaataagaggagattgttcatcgagctgtcttgtccccctcttggcctcttctttccggcg

SEQ ID NO: 8479 - DNA, 238 bp, Zea mays
ggtattgaatattgatggatatgaagatctattttcttattggagcctcgagatagcacatgtctggacgtatggtataggatttggtttctgcacagatttgatgttctcggcagttccttctctcgtgttgttgcagctggatgtgactatgtgaacgactctacaaaagttgcataccatgtgctcgatagaatgtcgatgaggtatcccgtacaggaagccagtcctaattcct

SEQ ID NO: 8480 - DNA, 1185 bp, Zea mays
ctcagttcaattatatgtacatgcatggttcacctcggctctcctaaaagttcaatcatatctacatgcatgatgttaaattactctacaaagtgtgggggactgcgagtttgcaatttgctaatgcttaatccataataaggcacgatagcaacggtaagagagtcaggaaaaagccgaagctgacataggaagaaacagcaaaagtagacttgatgtgatggaatataaacaaagatttagccttgaataggagtagaaaatagttctccatgtgcatgaaccttgacttgtggtttatgttgggttttaattcttagcctacccaacttgctttggactaaaagtctctattgttgttgttaatttttaattcataataagcagcattggcaccggtttaggatttaaaagcttcagcatgtccatgagaccagactactgtaacagaagtttttgcacatcctcgatcgtaaactgcccccctcttttcctgctgaattatatgaatcctgaacacataatgacataactggcacgtagttgtgttcgttacttgatgtggggccgttggtaaagcatgtcacaatcagaaattgcgtactatttgatgtttctcatggctagcatacaccatttattttattaatagaagggaatacaaatgcatggtaggcatttgttgatctcacctcacgtttcttctgtttaatgactattccatgaaatcattttcaacacattcactgctatcactgaaactatttttactgatctgcaggtggtayaataccagccaccgcacagctggtttcatcatcctgtcatgccgtgtcatcgcactcctttgcccgctcttcgcgtgtaccaacacatgcaccctccttcgcccccgctgcatctcatgacgacatgcgcaagacaagaagctcctcaccgttgtaagttatcgggtacaacagttcctctacataactccgcctgccttgagaaactaccctattatttaactatgcaagactcatcccatcctactctatcaaacacgaatgttttatcgctccttgccctgtttaatcagggatgccactgtacatggtaaatttctctctctcgtggacagatgctacacgtgccctgtttataaattttggatatatcttgatgtatagctagcattgggca

SEQ ID NO: 8481 - DNA, 137 bp, Zea mays
tcttgcatgcctgcagtttacttaattatactgaccttctcatatggcgttggatccgtgatgcctcctccattcctgaagctatttggaattcattgcctgaatcagtgttctgaagtgctatctaacagtcagaa

SEQ ID NO: 8482 - DNA, 923 bp, Zea mays
cgaccaatattaactaccttggggggagaaatgccagtgtctgcgtcgttgaacagctccaaatcatccatcagaaactaacggaccaggaacacacgacgagttggatctggttgggggagagaagttcaacgaatggggcagcgaagttcaacgaatcggggtggaacacagcggggtgggcggcgcacttcaatccggtcctagaaggagaacagcgagaagggagaggcggagtcccagcggagtggggggtggagaaactcaagggcgaggcgggagaggcggagtcccagcgccgtgcgtgctctctggtaatggcgtttgagagaaggagacgagagctctctggtgcgtttgagagaaggagaagagcaagaagggagaagactggaaagcagcagagcactcacggcgctgggacggcggctgtctaaacggctctaatctccgttcaaaactggtaatggcgtggttatgtccattttgaagtgagggttgtccccttgttttccataatagagaatccctcgcctacgcctccaaaacgtcgaagccgcatctaaggacatccataatagcaaatttctccgacccaggcgtagccaacgtacgacccggcctactggcccacaatggcttgtgtaagcccactgtaatggtagcccagacatycacgtacgagcttgcgagttaacaatctcgctctcgctcccgctccggtccttccctttcctggacgattccattccattccgttccgtgggtaatggatgacaagtgggcccgttattgacatatggcattggcaggcctttgtttctcagtcctataaggccgagaacaggcagagcaccgggatctagggtttcgcacccaacacccggagtgagcggcggcgagggatcggatcgtcggcggcg

SEQ ID NO: 8483 - DNA, 741 bp, Zea mays
gtgaatcactgaatggtactaaactatgcttttaattcgttagggacaccccaacccagataacacaaagtttctatatcatgctaactaagcaaaaaaaaaagatgatgtgacactattaatcaaataaaaggaattgagaaatagattttttttattagaaaactatgtatacacgcaaaccacaacattaaaatatgtaatttgtaaacgagggaacacatgtgtgattggattggattggattatatatcctgtatgtagaaactaactaagttgcgcatatatatagtttctatgttttatattgtgtgaacgtaaattaatagacaaagaaacttatgtttagtttctagcactgtgcctgcccccttatccacatatatatcaaacgtacgtgttagatcaaccccacgcttcgcttctctaatttatctctctctggcgacatcaccccgagttcttcgcggcgtgctttaatttatcttcaattctaccccgtgaccccgtctcaatttcaattttcacataggttgcaaagagcgggttaaaccctctccgtgtcgcgtccttgctaatcacccccatcgtcctctcctctccctctgctccggactccggtagatgtagctctcgccatgcatcccccctcccccacaccagctgtccacctaacattgtcacccacacgtacgcccgggcgcggaagctaaccctaccgcgccgctcaaagccatagcc

SEQ ID NO: 8484 - DNA, 1500 bp, Zea mays
cgtcagggccgtgagcccgtgactgcatatggaactttttatatgtactcattgcgtcgagaggtcaaagtgtcaaatcaacaatgcaattcgaaaacacactagtattgtgtgttgcggccaacggccatccattatttctacccgatagtcgacatcgccgaaccaactagcactcggaaggttcgcttccttggttttggggctgctaatgccgcttacatgcacatttgacacctgatgatactaccgtgcgcatcaatattgtttctttattctctactatatactatattaaattaacatttttgtacatcgtgcattacgtacacgaagcgcgtaggtttgttccttcttttcacttctcgtctataacaaatgaaccttgagaaaccacacaatcctcatataataggaagccacattcaccacttctacatagtataccaccccactatgtaaaacagcataagtgatctatgaaaaaaagtcaggtttctttttaagttatacctttattggacttttagctaaactaatgtataatgtttgttcttatcaatttaatatctgatatatagatcatatgttcactctgatattaaattcatttttatgaatatcaaatataattgtgtgtattaaatgagactcttgtccgtctaccgaaatgaagaggggtaggctcaggtgtcgtatgtggctcgatcttagccatctgatgtcgatctgacacctaagattggactgcaccataaggtgggcaactacttttatacaatattatttagaagagaaatatttcttgttttttcttttcatcgtggactatatatagctttatctacacacatgccatatttttttattttcatctagggactctccccatcatacaaggacttgttttgttattctaattccatacgcattaaataaaattataagaaattagaaacaattttaacttgctagagatttgaactcattcaatcccgtccaattcacatgcatggatttaattaaaacgatggtgtcataaatgtttcatagactctctaattaatcagtgcaagatagcaaggtcttcacaaaatcacattgtgggatgtttcattttttccatctagcacgtcacctgaaaaaacatgacggcttcaattacgttgcaagataaggtggaccttagattgaaggattgaaataaagaacgacgggtaaataaagatagtttctttcacaacctcctcaaacttttttttcaatataatgttgccatgcatgcacgaaacatccattgcaagctaacccctccctataaatacaccccggtaccttcattctccgggacaggaccgcatgcatatatccctgcctgcaccacagaccacactactactgcactaggccggacatccaaactaatataacttgcaagctaagcgcgtgttccctacgacgaccgatagagctagagctgcaggaagaggcagaccgcag

SEQ ID NO: 8485 - DNA, 719 bp, Zea mays
ctgcagcgccgccagagccaacacaaaagcagtgcaagaaattgcaatttgatttgttatgtgaattgcaatgtgtctcctatgaagcgatgggaacaaggaaaatacctgccacgagtggaaaaatggcgccagtttttttttccggaacttgctacatggttgtcaaatgtagaaaaaaaataggattagatgaaaagtgattaaaatttattaagttaatttagagagctgttggaaatagttttttttgtgataactatctaaataattgatttagagtcatttagaaaattactggagtttctcttacttataatggcttgtagcttgtaggtagcttgcataattgtactacgttagatccttaaaattacttgagagtattagattagaaatagagagaagcgccgcacgcaggggagaacagagctgtcagcgtatattacgttagatccttaaaaggatcgcatactgcgcagtaatctcatgatcgcgacttccaatggctagacccatcaagtgagcagatggcgaaggcccaggatacggagccagcccaaagttaccttcgctaccggttctcctcgctgcaagtctgcaacgagtgacgagcccaccgccaccggcaagtcccctccgccgtccttcagtaccggaagaaggcgaggcgcccaaccgagagcaccaggggaaaggaagtgcgcctaggcatcgac

SEQ ID NO: 8486 - DNA, 1500 bp, Zea mays
aaagcgatccatcaccatttcactctactgttttttatggaatagactaaattaatccatcactattctatttctcaaaatatatttattaattattagtactagtataagaaattagattttctactaaatttaaagaatagacttactctatatttcgcgaatgaaacacaccgtagttatgtattaaaaaattgaacgtaaatgtagttatgcatatctaaattgagcataactttgtgcaggagctagggctgaccatgagccttagattttacattacaagatttaaggatcaaaattggattggtatcgtgctctaaatttattaattttagactaaattaatatttaggatcttaataaattatgaagaaatatttgaattgtgattcattactagtagcgcggtcatctgtactttattgaactatggaatttggactatacagattctaggaattatgaccagagctagtctgtacaaacatggcttctttatggtcattcgggacaaaacccctgaaccgacgctaagggggtgtttggttctgtggactaaagtttagcccgggtcacatcaagcgtttgactttcaaataggagtatgaaatatagacccaaccaactgtactagattcgtctcactttttaatctttagctgagaaattagttttataatccgattacatttaataccccaaacggaggttcaaacattcgatgtgatagagactaaattttagaggggcaaaccaaacacacactaagcacgaaagtcaaacgcagctggcacagacctgaaatcccgccgacgccggcagctgcctatctcaatcattgaaaacgtgagaaacacaaatcactaccacacctctcaagcaatttatgttttttttatatcttcataaaataaaaacacaaaatgacgacacgcgacacggcaacacgccgtcacgaacgcgcgagtgtgtccggcgaccgacccgcggcctgctcccgtactccagcccaatcccaatcccaatcccaatcccaatccaacctgtcccgcctcccgcgcatgccgcgccgccgaccccgtccgcggcctgcgggttcggcatcccgcccccacctcctcaccaaactcccccaacccgatccctccggaccgcgccgcgcagacgcgcacgccttgcatttggcttcttcgcggcttcagcagcgaccgcgtccccgcccccgtcgggcaccaacccagcccaacgctctcccccctgctcctccccttttcctctgcccaccaattgatagctcacctcacctccgcgcccgttgtttcgtgcaccgtacttcacctcccaccaacctctccccctcaaaaactatccacccctccacggctccacccctacccgccgacgagcgcgatcgattgattcggttcgagccgggcggaggaggagggagcgccgcggggcggggtgagcccaccagatccgactaccgcagcggct

SEQ ID NO: 8487 - DNA, 373 bp, Zea mays
ggttagttgatcccttctctgttcagacctctatatttgcttacatattgcattttgtggtctgaggactccgtgtaggctgcagcccagtcctcattgttctgacctgctttctttgcagcttgctctttgcgtctgttaatttctttctcctctgattctgtgtgtgctcgctattcctacttcttgtccttttcatttaggttatactcagcgaggcggaggatgaaatgccaaaggacgttgatttacttccagcgtcatagaggcaaaaaaggatagcagaattgcagacaaggttatagagttagctgatggtgctgtgagggttaagagaaggaaaggtccatggagaggagaggatttcacactg

SEQ ID NO: 8488 - DNA, 1500 bp, Zea mays
ctgccctaggtgccgcaaagtaggaagcaacgggcaatggtcttgttagggttattgtgtctgtgttgtaatagggccttatataatggtagaaggcccaacaacacttttataagtatatctcccaactcagttagtgttaggttttcacttttcaacatggtatctagctagtttttgtttccatcttcccacccaaccccaactgtcactataggtgatcagatgggctaggtcatatgggccgtcacgagacacgaccaatttggcacggtacgagcacgacacggcacgatagtaactgtgtcgggccggcacgaggcctgtcatgggccatgcttgggcttaggtacaagcccatttggtggcacgagcatggctcatttattgtcggcccagttagcacaatgctagccacggatagcccatcaaaccgagcacgacccaatacggcccatttgtggcccaaccttgcttgtccttatctaacccaccatatatataaatatgaccaactcgacccccactttaaagctattttcgagttctgataaaaatgagaaaaataagcaacaaaatagaaaagtttaagtaattttcgagatctgttacaagatgggtcttgggccgccctgcacggtagcccgacacgacctgtttaaaactagccgagtcgtgcttgaactaagacttcgggcctaggacgggcacaacatgtcctgctatttattcgtggcgtgcctcggcctgattaaatcgacacgtcccatgacaggctcagactgtgccaacacggcacgatctattggccacgtatactcggatacaatacaagaacatatatatatatatatatatatatatatatatatatatatatatatatatatatatatatatatatatatatatacatatacaaggttggtgggccaagccctacaccaacacacggcccaacaattacaaatgcctgcttgaatgcggtcagtgttatttgtcgtcagaatgagcaattccaacaaaagggactcgaagagatgccactatgctccttgacacaaacttctggctaagtgcttgtgtttttctgaagtttatgatagtcttattcctgctttgattataatttcgctgctgtttcagacacgtatactcggagacacgtcggagtcatcgtttcgatgtttattctacctttgcctctgacttatacaaggcgcactgctttccttctctgaggtcaaaatcgctgcacttgcaggatgtttggtgggtcttgcatcagcgtcattgtttttctttgactaaaacttctgaatatcataatcgagaagccaagcaaagattgtgttcaaaaggtcaagcacacatgctgcatatgggctgactttttcgtatggctagctagctagatgtcttcacaagtgtatctctctgatctctccattgcatcccacctttgcatttcgctcgcttgcagagcttgagggtcccgta

SEQ ID NO: 8489 - DNA, 864 bp, Zea mays
ggtttgtcatgtgcaagcggagcaagcaccactgctacgacgcccaccccctcctcatgctggttctgcttgttgctgctctatgtagaaagatgattcaatgttttaatctgataaatggaactcatgaaacatttccccaagttgcattctgctcgagagagtgggagaaacggcaaacgtctgcaccatatgtttctcctttgtattgtaatattctataagctacaaacaacatatctcactctaaacaagatgaaggaaaccagtgagtttctattgcggttaggtgcaacatggatcattacgctatattttggttgtaactgagttgtcatatgggccaaatttcattgttcttcttggatctgggagcaaaggatgttctattggtttgtgccctttcgtgtattaataactgatgatttatgcctccagtttcctaacctgaggaagcacatattggttgtactgagtctgtaactaagagtgttatattatcaatatttacgctgatggttatgaagctatccaaagtgaagtagttttggtatactcatgataacaaacaagattcgtcacgagctttgaacgatatacatgccttcaatgccagggaggtgcagtgcatcgcgtccgagaaaagaataacgttgcgtgcggctagctctgtctgagttgatcgtgcgaaaagtgtgtccttgcgctcgaaatagcttctccctctacctttacagactttgttaggactcaggaaatgacctagcaatactgtcactgccacctacattctataatactgtacgttccagtacagttccagttcgcaaccaaggagagactgagttatgccagcggcgctac

SEQ ID NO: 8490 - DNA, 685 bp, Zea mays
agagcaagctagacctgaaactgcagaactattttttgaagctgaagctattccaaaaaaaaaactttaaacttgggggatccaaacaccccataaaaagctttggcgcaaataatactctatggagctgctcaatgcgctcccaagcactttctcttatcgagattcgacttggaggcacccatctctcgcagtctcgctcgctttgtacctcccgcccctcacacggcgacggcagcggcccgcgttcgcgccttctctctcctacgcaaaccagcacggaccgcaccgcagtgctgccgtacggtgggggtgaaatgacggccgacggcgccgcggagtggcaaactcgtagatatctcgcgaaagcggccccggaagtcacagcgatctgctttccacgccggactccgttgcagccggccaccttttcctccctccttcccctctcctagtctcctttcgcctccgaattccgatcaccaaaaaaaggcctttcttttcttttcgtcgccctctcggtgctctgcttcgctgcgtcgcccgcccgtctctaaaagccttgtgtggatcgtggacgccgacgcggccgcagcagcagccacgggacgggagtagaggcgcagagagagagaaagagagaaagagagagaggttgtgctcgctgcctgccgctgagagacgg

SEQ ID NO: 8491 - DNA, 242 bp, Zea mays
ggtattattgcgctcttcttattctcgtatgatcaattgaattcacttgaagtaaccattcttcaaattcacattttgagagactgtttgctccaacagatgaaaatagtgtccatgactggtccacacgctatgcaataatcaaggggatctgtgagggcttgaaataccttcacgaggaattgaatcctcctatttatcatttggatttaaaaccagctaatattttgttggatgacaat

SEQ ID NO: 8492 - DNA, 293 bp, Zea mays
tgccgagtggtgcacggttctgccgctcccgtctcggtcgtggatccccgccctcctccccaccgccgccgcgaccgcgcacgctcctcgcatcccgcccgccgcgcttctttccatcctcttccttccatacccactcaccgcccctcggctctccgtcgatggaagggcgccattgacgccccgcgatcctcgctaccatccccacgaggccataccctccccgcacacacagatcttggaagaggccgccaccccgcccccgttcttggccccatcaccctccccacgcg

SEQ ID NO: 8493 - DNA, 1148 bp, Zea mays
taaatatatatgaatgacaacaatgttaatattacattgatactttcggcttgctcgaaggtgaggatgcgagagagtgaatacaatattgtgtgaacaacacgatgctactgttcatctatttataggcacgagacgtagcccgggtgaaaatatatttatgacctcaacatttatctatgaacataatatgaattattagggattaagtagtctttgtcccttctcatccattatcgtacttagtcttcgtcatcacttcaagccgaaactctttggctatagcttcgtcgttcattttcatcacctccggattgtatttacatcttgtaataagagaaaaatctttatcccgaagctcccctctaaaataacccatgtcacactagaaacatatggttagtcgtgttttttagtacctttaaaaaagaagtcctccaacaattatgttcttaatagattagtatagatagacgaggttggtgttatcgagtaagaaacgagtctaaatggtattctctatttttacgttaaaaatagatccaaaactttttttaataaaagtattgccactaatattttttatttacataattacatattctagaatcggtcttgtaatatttatttctgtacagctgcttagcaccaatggattatggatctcaggatctacgtcttctataccgacggctcacatgcgccagtaaagccccaagaaagaagtccaataccgggtgcgcgcacgcagatggaactagaattgaagtatctgaagatatttctgtatcctttctagggtgtggtttgtactctttctagaagacgaccgcgacttctcagaattcgcactaagcattctagtcctataacttcacaagtttttttttctattctctgctggctattgtaaggctctgaatgcaaggtaytccttgtttgcgaaaattttcattaatgaaggaccgacctgcaaaagtagggaaaaaggatatttatcatgtagtccgatccttatccgttgtaccctcaccctctgctttatatactgccgaaggtaatcccgttcgcagtcgcagttcacctacgcggaaaatcactagtgattcactgaacaaaaaaaaattacaagaaggaatcgagagcaa

SEQ ID NO: 8494 - DNA, 1500 bp, Zea mays
gtgcttgggctgtagcctcgacccgtagtgctggcccggcgcgacacgattatttttttattttacaaaaaaacgtatatacctatatacaatttatatccaatattaaaaacatcttagcgtgatgttctactggttagacagtttcatccagtgtctcccgtcctttcatcagggcatgagttcgaaacccacctcctgcatcgttttttaacaatttacgttgatttaattaaatggatcaacgggctaatgggctggcccgacacagttagtaggccgacatgacgtgcatgtgccatagttgtggcccgcgtgcatctagctcgtgtcggacatcgttacgctgatttaattaaatggatcgacgggctaacgggctggcccgacatagttagcaggccggcatgacgtgcatgtaccatagttgtggcccgcatgcatctagcccgtgtcgggcgttgttacactgatttaattaaatggatcgacgggctaacgggctggcccgacatagttagcaggccggcatgacgtgtttgtgccatagttgtgtcccgcctgcatctagcccgtgtcgggcgttggcatttatagacgtgcagcagattaatttgaaatagctgtgaggggttatttgtaaaaaaaatgacgcatgacgaccgttgaaactgatgctttaagtatattatagattatagattatagattatagatataggcatgagaaagagatttatctggctttttagctgagaccttttaagggacagaatcaatattttgacttttgaaagctcaaagacctatcgtatcttgtttggttttttcgcttttttttggttgtaaattcggcccggttagcgccagtggcagccagacaccacgaccactcgagcagcccaggagtcgacaacaactccatatccacgcgaccacgcagcgtgaccgcgatcccactccatccagtccagcctcgctgtctcccaccagtccaccaccacgtgacagggtatctggcatggtaactgcacaggcttttccgttaggtacaccacaggttaatcttgtcactgtgcaacggcaacggtcaagcgaggcagaacatgggtgtattgcaccgtgccgttgcaatagcacaagagtccactgactaaccagttgcggccaagtgacagcggaccctgcattcctgattgttatagtatttatttcatctatagcttttccgctataaatctggccgtcttgccatttgtacatactactctgcctctgactggggcaagcaaagcattggggcttgggatttctcgaagccataaaagagtgagccccaaaaagaagcctaccaaagtaccactacgactccgcctccggctccgagagcagcagcctcagtaccaccagtccagtccagcctccagctaggggaagaagaagaagagcgaaggaaggggacgggggcgaggaaggagccagagcagacccaatccctca

SEQ ID NO: 8495 - DNA, 133 bp, Zea mays
ggtctaggacgagggagggacccaccgcggcgactggggcccacgttttatcggccccggacactgccctgtgggcccgttgcaaaacgaggaatcagtcagtccagagtgtttttttttttgttttccctgt

SEQ ID NO: 8496 - DNA, 1061 bp, Zea mays
atccttgagtttgtcttgggattgacaggccacccaagacgactctaaatgacgtagagctggagaggggtgaagattagaggaagaaatctatattacggcctacttctagggtaaaatgttaaagaactaaaggtatattggttgtttgatcgattgtgggttcttcaattggacgtaccccttcaaatatataagggggggtctagacccgttcctaggtgacctccaacaactcccgcgggattagaggactaaatatgcgaggagataggagttttaactgtcattcaatttattcggggaccgtccgcgcctatgactttatgagctatatgtatatatatcacgttgtagttgttctcacttagaagtgttgaaagtaaacttgagatattgatagttgtatccaaagccaagagtaaatgacatatagaattttctttaacaatcaaatatgtattaaaaaactatgtgtttgttgttacatcaacctacattatgatgatgtgagatatcatacagtgtcaaatatcttctgaaacatgcatggttacaacttgctagcttggtyctctgagaaatccagagtgtatatgatgcaccacacctcctcccatgtgctaggtgtcattcagaaaaggaaagagctgaataatggagggatgggccggtagatagatagctctagctgatgtgtctgcacttggataattccagcctgataatatacctgacctagtgacccatgcttgaagcatttttgtttttgacgtatagaaataaaacagaagaaaatagatgcttttataagttcacttgattgattgcacaggacattctcctcttatgcagatgtcgttcatatacaggaagaaatggcacttacagtgttgccactagtacttaatgcagttatttgttttggtactagcatgaagatgattctcaatgttcttgtttgcaaccacaaaccacttgattgaggtgtggcttgtctacattcctgacttggtcagttctcttgatttcagaagatatgtgcaatttgcctcagcgcc

SEQ ID NO: 8497 - DNA, 139 bp, Zea mays
accgacctgcagcgcatgcctggaagaccaacaggccctcgccagctggtcgcgcacacggcctggcgtttgctgaaaccgccgatttgtacagcatgccgcagcatgccgccgatgtgatcctggggcaggagtccgc

SEQ ID NO: 8498 - DNA, 594 bp, Zea mays
gctgcgcccccccaccggcgcctcctctttaactctcctcgcctccgttaccgtcttccccctttccacctccccccaccccgctgtgctcatccatcgaccgcgacgagcccccgcccgccgattcgactacgtttattttttttatttcatttgatttgattgcaaagcaccgcagcagcaggaggaggggaagggagggatcgttggaccgtcgttcggctggatggtggaggcggttcgtcgatttgagggcaccgggtttcttggacctgcgtaggtacgtgctcctagttcggttggatcttagatttgggtcctggatgggggtattgatccggttttccgcctgatttgaaaggtaaaaaacaccagccccatttccctctcggccggcggatggacgcgagggaggtgtgaagcctggtcgctaactgatgctcgtggagagattcggaggagaggagcgcgccgtgcggaggcggtggaggaggaagcgccgacgatttggacagcgcagcgacggaaggggagcagcaggcggacgaggagcgagccgccaggaggacgacggccgccgccgccgccgccgcc

SEQ ID NO: 8499 - DNA, 1500 bp, Zea mays
tggaatgactctctttatgcttcaacatgtgtgtttgacttagagatagagatttgagtttgatttgcaaaaacaaaccaagtggtggcaaaggatgatccatatatgccaaaattgaatcaaaaccaatttgagtttttatttgaagtgattttgcacttgttctagttgctttatgttgtgttggcataaatcaccaaaaagggggagattgaaagggaaatgtgcccttgggccatttctaagtattttggtgattgagtgtcaacacaagtgcttaaatgtgaatcaatgcccatggatgaacaaagtgcaaatctagagcaaagctatgtttctaagtcttagtacattggttttgggtactaatatacttgtctaagtattagaaacaggaagaagaagaaaagaagagagttggctgtgtacagccaagaggttgtttcggtctggggcaccggactgtccggtggtgcaccggacagtgtccggtgcgccaggctgcctcggccgaagaggtcgctctcgggaatttgctgacggcgtacggctaaaattcaccggactgtccggtgtgcaccggactgtccggtgagccaacggtcggccgggccaacggtcggccgcgcgatctgcgcgggacacgtggccgagccaacggtcggaagggggcaccggactgtccggtgcgccaacggctcccgcatctgcaacggtcggcttcgccatttaaggaaaggaatcgggcaccggacactgtccggtgtgcaccggactgtccggtgcgcccgacgacagaaggcaaagatggccttccagatttgttctcaacggctcctagctgccttggggctataaaagggacccctaggcgcatggagggtgacacaaaaaaaacaacctaagagcattcttgatcatccacactcattctttgcgcattcgtttgtcattctaagtgattcgagctccgttctagtgagaactttgagatagtcttttgagctcgattcttggccgtgtgtgtgcgcatttttgctgtggatttgtgtgtgttgcttccctcccttactccgtatttccttgtgaatctcaagtgtaagggcgagagactccaagttgtggagattcctcgcaaacgggatattgaaaggaaaagcataacactgtggtattcaagttgatcattggatcacttgagaggagttgagtgcaactctcgtccgttgggacgccacaacgtggagtaggcaagttttgtacttggccgaagcacgggataaatcactgtgtcttctctgtgttgaactccgtgtgattatcctattgtgcaagatcttctctctagccacttggcattaactgtgctaacacttaatcaaagttttgtggcttaagtttttgaagtttacaggatcacctattcaccccccccctctaggtgctctcaattggtatcggagctgttctcttcaagaaagggactaaccgcccgaagag

SEQ ID NO: 8500 - DNA, 414 bp, Zea mays
agatcgagccgagcctctttcgccagctcgttcagtcacggctcggctcgtttgaagccctaagtagaaggaaaaagaaaccaattagttatgggttggagatttgacttgaaaagttgaacccgcaaatatgtgaatttctgtctccttttatcctcgttaaacaaattttaagatataattttatgcgggtttaagaataaagacggaggaaccaactaccacccgcccagcgcggcagcgccccaccccttgctgactccctcagtcggtctgtccctctatttcgaaagagcacactgcacacgcctcatccttcgtccagacgcgcccacgcctccgctgagagaataggttctgtgcgagggctccctcgcactccgcaagcacgccaacctcagtcgccagccagcc

SEQ ID NO: 8501 - DNA, 359 bp, Zea mays
ggtaagctaattttagatgaaatttattgttcagaggtgtatcctcaatcaaatcgtcctgtgttttagtatgcaatctggtgaacgatgaacttggcccattgtggaaaacatccacacacgtccacacacacatggtattgtgtagaccatcagtgttctgtataacttcatatgaatatatgatgtatatctcggtaacatttttagctactaactgtgcataccttttgtacttatgttattttttgatttatcatttatctgatatcttcactttttattcgtataggagactgaagtggtgaacacggaagaaggttgccattttactaagttaaagttagatcattggagca

SEQ ID NO: 8502 - DNA, 532 bp, Zea mays
ggtaagaaagaagaagaagaagacggcggcagcgaagagcaagcacaccgttccgtgactccgtcagtttacggaacgggtggacagcgaccccgaacgggccggcccccacggttgggctaccgcgtcgtccaaaggccaaccagatggagccacgtgtccctcgagaggacggatgaggggggaagaaggatgagactgtgttcaacggttgctctcggtttccccctcccctaacactgtagccgctccttcaacggcgtcctcctcctcctcctctcccttcctgattctttctctctcccgctaaatcgatgggcacgctacgccgtattccttccccgcagccccgcagccgcttcttcgcccgcgcgctcggaatactccgcaccaatcctagctgcgggcaggggttccagccgcttcttcgcccacacgcccgctcgctcggaatactccgcaccaatccgtgtcggaccggtacgtgtgcgagatctgcgggcaggggttccagcgcgaccagaacctgcag

SEQ ID NO: 8503 - DNA, 1058 bp, Zea mays
ggcggcgacacgagtgaggggagggggaaggtggcaactatgtcgtgggggagtgaggaggccggaggtgacagggtcgtggagagggatgagagataatctaaataatattgtctattagatttaagcaaaagagatagaattatctagtgattcgaacagtgagttttgatgctgtgttaagtccacgtgcaattagtttgaaatatataacttaactcataaaaatagcttcaatagtgctctgttttacaattttttataaaaaaacataagacacaccacaaaagtagactagtgtcctatccatattttttacatcattatcaatattttatttttctattaatataatttatttttttttctaaaatacatgatttagtgcttaattgttggagcacaattttttagtgttttaaaaattttaaatgatgtagtgttttaattttagggcactattttgagtcattttgttgaagatgctcttaagggtgtagggatgatttggttaggtgggttttataaaatttaaactgatgaactatatattggtaaagatgcatgactatggatatagatagactattttatattatacttgaataaaaatatatgttatgctgtttaggtgagtgtgaatgtaaagtcatctattttttacataattcggtaaaactggaattggtactttatatagtatagatttaatttgtaaataaaggagagagggtaaaggaaagaaagaaataaataagagagagaagaaatagtaaatccaggacaaacatttaggaaaaatataatatatgctaaggaaaacaaaagaaaaacccccgacaacgtcgcaaattccagcgctgtttcgagcccttccccgcgccgccttcctctgtcgtctccccgaccctgcattctcctctctgggaagattcaaatcccccacgggccacggcccacgccacgccatctctacccagccacggcgagcgccaccggccccgccgcgccgcaagaactctaccgtaacgtaaccgagaaaccccgccgccggcgcg

SEQ ID NO: 8504 - DNA, 652 bp, Zea mays
gcatgtatacacaacatccaatatcaaaatcttatataaacacacatacataacatctatattatgtaaatcactttgcaaagccaacatcaatataaaccaatttttaatcacacacgattttacaattgccctccatcagttgttttttcattattagcaaggctagcttattttcatagaactaattgacgtatgacccggtagccggtaatacgcggagtcaactaaagtgtgtttggtggactaggtacactcctttaaatagcactggaatctagagcgtttctttcaagtcaattataaaactgaaatagcattgaaatcacacagtatgaatagattattaggtgatattttataatcaaatattgtggtaatcatggagaatcaattattgttaatgatttgaactgataggtagcgtcaatttgatgcaggactaatttaaaaaatcaagatatggtgaatttgtattgcgaacaaaatgtaatataataatatataatggtagggcagattgtgcacagattcctgatctcacatgtccctctcgctatggatgttcacttgttctgttctatagacttttctgagttttctcgttgagcaaagtagaaatgtacaagtttctctactccgaacgcatttc

SEQ ID NO: 8505 - DNA, 1500 bp, Zea mays
ttatgagataatccaaattttctttggcacgtatcggcaacaattatggagcattatagttgagcttgcagatatatatgcatttcaacatttctgtcaacatctgtgcaagtttttttttttgtagtgtggctcatggtttataactcatttcagtcaacatctgtgcatttcagcattttagtcaacgttgaaccaaacagcttctaattaactcattgggttgtctaaataatttgaggatggtccgtactattgattaatatatttgattttatgtacagttattacatttccatgttttctagcacttataaacgtgctcctttattgactaatttaagtttcttcttcaattggtaccaaattccatctccagtactcctagtctcttgttgttcttttaagactgataacttgattcaggatgtatgctttgcaagttctgcaatttaataatgtacttactgattgatgtatcacctgacaaccgaactccttttataacttggatatataatgtgtcagctgatcttttggtagtgacactacttcaatcgacatttttctatgttcgccttgtactcatggcctgcttgctgtcaatatttttcacttcgaaaagttacaagccaaagtaccgaaattgaccttgttctagatcgtttcatttttctggatttgagaagcacttagctctaaagcatgttatttgattatcacatcaaaatttctgaaactatgttatcatttttttagttttatttcattctgtgatgaatcttaacataggatgaactttgaaaattgatgatccgtagataagtgtaggatgctatgtatttgttgctgtttgttttagtacacctcaacgaacgagttatgttcctttccagcctacctgttaccttgttgctagccatacaccataaagagaacgcaggaccccgttaccttgttgctagtcaaacaccataaagagaatgcaagacatgaaaaattgaaccaaacaaatcccgctttgccttaccatgcaacgggtaccactgcaacctgattccattaacgttgccactcccaccgacagaaccaaacagcacctgagtgtgtaactttgctgctcccagttataatatggaagcatattttttcccttcagttaaactgttgtggcatggaatttgaccgtgcatttagcgattccagaatttttattgtcttctaattaaatatctgattgcagaaaatagtttttcttggtactgccagaagccatgtattattttggtggttggatcatcataaatctcatgcttctgccacaatttggctgtcttagttcaaggctgttaatggaatatatgattgttttctcataaatgttgcgttatttagattgatgtgtaatttaaggattttcccccttttgttctggctgattcctagatcattttctaatggtaccttaatgtttgttatgttggcacgtagggtgtaaca

SEQ ID NO: 8506 - DNA, 230 bp, Zea mays
ggttatccatttggtgtcacagaagctatcagcgagaggagctgcgaccgttggttgtggagggttcgcgactcttggtgcgaacggccacggtcttttttcctgggtgtatgggtggcgatctagtcttcggattgactgtcactagtttggggaagctgctgtgtttatgttttttttaggttggctatgtgcattaggcagaggccgggagtttgtgtaccaagact

SEQ ID NO: 8507 - DNA, 397 bp, Zea mays
gacttgagggcaccatccaacaacatctagcccgttatgtttcataataacccaaaagtaatagaatgaaaaccaaatcaacgacatgtgccataagtgcttaaagattgaatcttactttcggagttgaaatttacgaggagatcactttaatctctatgaataataatttagagtgtgaaatttagatgcacgaaagaaagaaaaaaactcaccccgcggggaggtctcacaatccccttgtcaaaatcatcccgtccgcccgtttcccacgcacgaatcccagagcgtaccacatccgtccagaagccgcagcagcgagcaggtcaggtcggcagagagctcgacctctcgctgacggcgacgttcggggccggcggaggacaggaacaggacg

SEQ ID NO: 8508 - DNA, 169 bp, Zea mays
ggttatccatttggtgtcacagaagctatcagcgagaggagctgcgaccgttggttgtggagggttcgcgactcttggtgcgaacggccacggtcttttttcctgggtgtatgggtggcgatctagtcttcggattgactgtcactagtttggggaagctgctgtgttt

SEQ ID NO: 8509 - DNA, 516 bp, Zea mays
tgcagttagttgtgatgtgctttgttgttcttacgatgaatgtgccggtctagtttcgtctgggttggcccctctgcttggccgcgtttgtcgtttagatctatccaaatatcatcgtttgttgatttcgaaattggggctgttttgctcatgatttcagttcaaacttcaccatgcttcatgttttggaattgtaattggtggctatgttaattgtctagacaattgtttagacttcagttcagatttgtggacttgctgctgcgtaatgctatcctctgacactggcggtttggttcaataagttgtgcgggcttactattttgttgaattcgatgttgaaatctgttcgttcctagaagggttttgttcaacttgcatattcacttcaacgctccgatgcagtatacgtttgttcccttgcccgccctttgacgttgtgcagtttctgaatcgcaggagaaggctccctacgtatctaaggccgagaagctgaaggttgagtacacaaagaag

SEQ ID NO: 8510 - DNA, 577 bp, Zea mays
gggggggggggggaagaagaagatctcctggtagtggtagctactgctaggccaaaggaacggattttggccctgctgagaagcaacagccagcaggatttgcatgtgtatcaaatctggtgaggcaggagggggtggaggaggggatttaagattctcccctgtcatttgttttactgtcatggtggacccctccctgtgggcatgccaaacaaatccatgtcatttaggccaatggagttcatatgtgataaaggctcccaagatgctcctatgtagtgccaagaaaaggatagggccaagataagaagccccagctattatattcttcgttcttgcagcaccgaaattcttatgtgcccccactccagctatatatacacatccttagtggcttgttcggttagaagtgaattgaaagggattaaatgtcttgttagtcaaaattgaatagaaagagatttgatctctctcgatccccatgcaactggattctaattctagctctctgtttgattttgagcagtagttgttacctctccccatgggtttgtgtaggtagccatgtcagttttaa

SEQ ID NO: 8511 - DNA, 1051 bp, Zea mays
tgcttatctatgtaattagttttcctattaaattatatgtaatatttctaactagtactcaagcatttgatgtgacggaactaaagattagtccctatgatccaaacgggctcttaaatatacaaccgacttaaggcgatgatcataagatctataactatgtgagcaagaaatggaccagccatgaagtgattaaattgatgctccagactttcacgttaagaaatgctattctagttacactaatccgtttagttagagggtgtttattttaaagaatcaattcattctaaataagctgatgaatcatgagtacatttcataaatttggtgaatgaacttatttatcatattattactaattattagtttataaaaataaaatggtaatttattttatttcataaatcaaacaaaaaaatgagtaaaaagatgatcattactcaaacaaacacgctattaattgatcacgattcaacataaataccaaatcacattcatggacggccgtggagacgtggatttgcgttgatccattcatggaaggatcctcgtcttcgccactgaatccaaagatggtgtgcgaagaaggcggcggtagaaaaggaacgtagagcacagagcgcaaagctgagaccgagacagcgagacgttgacaggcacaggcaggataggaagtgtcgcgaaacgcgaccggcctcgtcctaccaccggtcgatagggatctcggcctcgtgccccaccgccctctgtctgcccatcaccggatcacccctcgtccccacccagcgcgtcacgggcacgagctcgagccctcgtaccctcgcgtccgcgctctccctccctcgctcgccgcgctccgatcgaactcccgtccccgcgtggaggagagcagggccccacgagggccctctcgcgcggcgaccccgtggcgttcctgcgcggctgcttctcgttcgggtcggcggggcggaggcggcccaaggcctcgcccttgccctccccgccgcgcctgaccgcggctgcggcggcagcggacgacggggccaag

SEQ ID NO: 8512 - DNA, 144 bp, Zea mays
attttcttaaattttaacagtgttttgttgccaaactggattctgggtctggaagatcgagacgcacgtacgtgcacaagatggagcctataaataaacagtaagcatctcagcccatgcattgacctactgccagcaacgacg

SEQ ID NO: 8513 - DNA, 552 bp, Zea mays
ctcgcgtccacacacacgggggctcccctaccaaccccgtcgcactcagccagtgaccagaccacccaccttggggcgcaaccgcatctggtgtggtgcgcccgtcgtccggcgccgggtcagtgtctcctatcaccaggcggacggcaggcaggaggccacggccgcgcaacgcaagctgccgcgctggccactggcgtggcgcgcatcggcacatggttggccggcccatccaagggcgagggaggcgtcgcggagtcagctcagcccgccaacaacctacccaccccgattgccatgccatgccagtctctggcccccaacaacctccctctcccaccggtggccacgctatttaagcccgtgctcccccccaccgttctcctcaggaagagcctagctagctttccccagctcttcttccacagcactgtctgtctgtctgtctcgcaattagctgtactaatccgctagtggcactgctgctactctcgtgtactcccagctatctcctctctatactcttgtacgtacgcacgtgtcgcaaccgca

SEQ ID NO: 8514 - DNA, 1082 bp, Zea mays
ggtcaacaaactgaggggcttctgtacatgcacctcctccatggtatcacaaactagatccgagactggttgaattggggtttattaggtgtgagtctgatcacacaatctatagaaggggtgtggtgggtgagagactgattgtgggggtgtatgtagatgacttgataattataggcaaaaatagtagtaatatcagagaatttaaattgcaaatgtatgatattttcaagatgagtgatctagttttgctttcttactacttagcaattgaagtaaaacaaagtagttctagtatatcattatctcaaggatattatgctctgaaaattctagaaaactagggtatgttgaaatgcaatccatgcaaagttcccatgtagccaaaactgaaattgaggaaggagagtgacattccacttgtgtatgcttctatatttagaagtgtggtagggartttgagatatttggttaataccaggccagatattgctttcagtgtgggatatgtaagcaggtatatggaggcacgacatgaagagcatctaactacagtaaaacacattttgaggtacatgctactacaatcaaggttgggggtattctatccaaggaacaagaacatgatagaaatgtcgggatgcagtgataagracctagctggtgatatggacagtaggaagagcacttcaagtaccatattcttcctataaaaaagtactatcaactagcaatcctccaagcaaagtgtggtggctctcttaagttgcgaagctaagtatatagcagctgcaacaactgcctaccaagctatttggctgacagggttgctgtttgaattgaaggatgaaagagcaagtgtgttagtgttgagtgtgtcattgtccaagaatcatgttctcatgattgatccaaacatactgatgtgagatttcatttgattcgggtatatgacaacatgaagaaaattgaagtgaagttcatcagaacaaaagagtaattgggggatattctcaccaagcctttttgcaagaataagtttgctgaattttgcaacaagattgctatgtgtatcaaggatt

SEQ ID NO: 8515 - DNA, 110 bp, Zea mays
gctggaagagcctatggttcttgctatattgtagcaagaggtaaatagagatgaactcattgttgcaaattccaacatgagcgaccgagcgatgtggttttggtgtcatt

SEQ ID NO: 8516 - DNA, 1500 bp, Zea mays
cgaccggaggtggggagggtgtctgggtggtggccgagctaagagacggtcggaggtggggaagagagagggggtgacggctgtgggaggaggggagggaagacctagctagatactccctccgtttctttttagttgtcgctggatagttcaattttgcactatccagcgacaactaaaacgaaacggagggagtaactttcaatgaatttgttttaaactcctccgatcctccttggctccttgtactcgtgtgcctcatgtactctccttgtggtcgcccttcggtggctgtgggcgcgaggtatccgctgtcgacaataagcgaagtcctcagctgttgtgggtcctgcgctcaaacatggtgaaatcaaactgggtaaatttgatcgcgatcgggttcagccttcgctccaacactatactcatcagatcgagaaattagaatccaaaacattttagaggtgtgaaatatttttaaaaaattatacatgtatactcaaggttaaatcgattaggaaaccttactatccttactgggcatgaagcaatttcaatagcatttcagctaaccacaacttatgtgaagtttttcctggtttttaggtagctaaagcaacctagatacatgatgagagagaaatatcactactaaacttttctagagaatagccaaacaacagatttcataacttgcatacttatagagtgtttgaatatactagagctaatagtgtaactaaacaatgtaactaataggttagctattatattagctacttttagtaaattagctaatagttagctagctatttgttagctagctaattccactagtaattttttgccaactaactattagctctagtgcattcaaacacccctagattttttttgagacaaactcaacaattggccttttcttttgaagctaacaattgtgcccatactacatgtcaaagaaaaacgcagattaacacaacaacgacacgaagtcaccagttgacgcccttcgtctcagctctgctgtcctctgattaacacgacaatttgaaacccgtttccatggcatggcatgttacaaggtacaaaccagccaacccatatatatggcaagttactgaactaaactagtacgagatccaccatcgagcgagaataacaaacgtcaacatgcatcaacaaatgcagcaatcttgatcgctagcactgttgggctttacatattcgaaacaaatcatgatcacccatcaaataataatcaccgtcacatgcattgatgcatccacggtcacgggaagtttaacgctctaataatttatcaaacgttgcaccagtgttgtttgctgctataaatggcacaccgagcagcatctccatgaaccatcacatcacaggcgcttattagcagtcgggttattaatataaggccgcccagccagcctaatcactccgcataattcgtgcttgtgatcgagcagctgtcgctgtgtgtgtata

SEQ ID NO: 8517 - DNA, 318 bp, Zea mays
cctgaaagcttggaacaaatatacaggtacaacaaaagttaacaaataaatggtctagataataaaaacatatagaaatatgttgatgtagctgttagcaaatattaagtcacctgcacaagttcatcaccaaaagacaagtattttggtttatctgccttcgagtaaactcgaatttcagccccagttcgtcttctcatttcagtaatcacctgcccaccttccccaagaatacagccaactttgtttgatggtacaacaagccttgtacttgaatggtgtttctcagaggatgcacttactttatcgtggagcaaa

SEQ ID NO: 8518 - DNA, 642 bp, Zea mays
ctgcagccactctcgatccatctcgtagcgatgtactgcttgggttttttttgttgttgttcctttgttctcggctggaatcttgcttcgtggtcctgtcttctcaggttggcctcgccccggtcgccgggttttttttttcttcctattttcctccccaaaaccttcccgcgcgacaacgattgtggaatgcggagcgaaattctctcttgattttggttgccagggttttttccccccaccgcactcgtggatgcatttcgcgcctgcatctccgtcttgttcctcccaggccccaggcgggttttttgggtgtagaataaagcaaggcgcgggattctcgtctctttaccgttcggtttcctcgtgaggccgttcgcatggcaatgctgcttgcttggggaggatggtaaagcagattcctttcttgcgattttctttcccagtctgcatttcggtgccccgttcactggccgcggggagaaaagattgtttgttgcttcaaccgtgtgtgttcaccgcgcaatgcctgatttttttttgtttccgtgatagccttctttcttccattccatgacacgctggtttgtggttgcatcgcaggattcgtcggtggaggtagcaggagtccgcagcaacaag

SEQ ID NO: 8519 - DNA, 1370 bp, Zea mays
gagtatggtggatgacatagggctcatcattaaaaatagtctcgaacgtctatttctttatttatgagataatgcatttttatagaaattagtagccaaggcccctcttgtctgaccaaaacaaatagtaagaatagacacgtttgtagtacttttgacaacaaatacaacaacacatctaacgttgattaactataaggggtgtttggtttgagaaatcacttcatccaagataaggtgatgcatcatgagtctattcatcaaatttaatagaatgatctcattcttatattagtactaactatgagaaataaggtgatgatgaatcaactcattccattccacaaaccaaacaaaaaaagtgatgagtgaaaagatgatggaataactcattcctcgaaccaatcaccctataagtatctaacaatattgtttgtcagagtataaatcccaaagcgaccaattgtttggaaacatacgctagtattttggatcaggtggtggacaggtggactacatgacactatactaacaaaaaagagctgcacataaattagggaactagtctggcaaacctctgctgtcctagtactagtactggtagtagaatcgtataggagtatttgtatgagctgtgtttaagcacaaaaaactgctttggccagcggataccgtcactttggatgcagcaaataatgaggcggttttatatggcaaagatgaaagggtgtagaagtctagaagatgagtcattaaggaatcaggattactagctcgttattacgcgtgtaaattgtgcattttgcagtccctttcgaaatgactgagcgaaagagggcaaatgtgcgagttctttgctcaaccgtaatctcaaccagatggtggaacatgctaccacggatgaagaggtcagaagtgcagcacggggcagggcagggcattcgtcactcgaccgttgcctccaggtacagactccagccatgccagaccatctccccaccctctaggtctaggacactagcgccaacgacaatggtcacttgccgctacactgttagacagtagccagcacactccacaagcttcttctcttgcaggctccagctgcagcccggccggcctccttccctaggattcttttgcagcttccattgtctccccggctatttaacccacccacccccgcttcgtctcccatgtcccaaagcaaagcaaagcaaagcaaagcttcaaagcatctctgctgggattttagcaagcggcaacgacgagcgacccaaaaaagcaatcaatagtcaccatatctgctcctctcgctccacacccccctactctgcgacttgaggcaggacaggaggcagagacgggca

SEQ ID NO: 8520 - DNA, 561 bp, Zea mays
ggcgcgggacatgcgacgccccgcagcaacggaccaacgtccaacggtagtctatccggcgcggcagtggcacacggacacggcgccaagagcacaagacggagccggagcgggagcgctcctggctcctgcaacgtctacctctcccgtctgagcctgccacggcccagccccacccaactactactcgcagcgtggcccatactgtcagtgagcgtgttttccctatcccccaacggtcgagtactgacacccccgcctcttaaacctctctttcatctttccccgcaccgcatcgcaccgcgagtttcgaaaaccccaaccaatcgcgcctcagatcacgcgagggcgtgagggggaattcgctctcccagcctccgctcacccgtcgatcgatcgtccgggccaggtatccgtccgtctggtttggaatttcgattgctcgtttggattggttcggggggctgtgttctgctggcttgcttccgccctgatctctctgctcgtgccgatcctcgacgggacgacgaaacacaggggctctccggcggcaccggggcc

SEQ ID NO: 8521 - DNA, 85 bp, Zea mays
tgtttctgtacgctgcccagtgcccctcccgtgctctgtggcaagtgacaagtccatccagtggagaatagctttgctgtgcgtc

SEQ ID NO: 8522 - DNA, 442 bp, Zea mays
accgtaattcgtacgtatgtgagtgcgtcgcttgctggctcttccactccgttccattttcattccacttggtgacccatacatagtttttatccatacatcacacggcatcatgcacaatctcccatgcacatacgataacactattagacaaatcatgtatcatgcttatccttgaatcgctggagatattattcggcggtggttgccatagatagatgtatctgttataacaaactccataatcatcggctgtaaataggagatcacggcaaccatccaaaactatctctaagattgtaatyatgtggcgtttggccctatataaacatgcaatccgccagcacaaggtgcaacggcgtttctcatccaatctacttccatactgcagttttctacatggtaccagagccaagccattgagatcttcctcaccgaagct

SEQ ID NO: 8523 - DNA, 577 bp, Zea mays
atttgaatacatcgatagctagtgctgagctacacaccgatgcaatgcaagtagtttgaacaaagtaatgcggttatagtagactggagtcgtagcgagctatgagaggaagaatgtaattcttggtacacaaacagttcaaattctaagtaaatttatgttaaaggacattaatgtttataatataaaataaatattattaggctagttatagaatatatatatatattttataataaattaattaaagacgctgcttaatttgtactaggcacatagaatccatctctctccgccgtctacaaataaatacccctccagctctcttcctcctccctcttccgctcgtcccgccaatcgccattattaacagctccgcggtccctccctccctcggtcggtcggcgtcggtccctccctccccacccagttagtcctcagcctatcccgtgcccgcgcagagcaccgcctctgctcgacccaccaccctctgtgcagagttaattaaccttgaggtttccgattgcccttcccttccgctcctctcgcccattcgcggcgagattcagcggcaagg

SEQ ID NO: 8524 - DNA, 1479 bp, Zea mays
ctcgcactagcggcggtggacaggtatggtatggcgtgaagtttgttcagtggacatgaggctcccccgattctcagccgacccgctcacccacatgaagagaggagcatcgaatctcatctgatcgccgagatgtcatgtgtgtgtgtgtgtctgctagcgctgtgccagcacacgacacgaactgaaggcaggcgtgtggctagcttcgcccaatggacgcgattgaagctcggcatctgatctgatgccgtgaattaatcctgtgtccgtttaccaacttgacctgtcggtgcgagatggtgaggacaacttcagatcgcgagcacatatatgggagactgtcaatctagctagccttgagaactgtttttttttcttctctctctctctctctctctttcggtaccgatcacatccgccggccggtttccagctgtacgcagatttactccctttctttttcttttttctatttctatatgaacatgctgcgtgtacaaaacaattcatctactcgatcggatgccgctactcacttctcacatggacacatggtgtttcccgatcttcaaaggcgctgcaatgtcgaaccgaccgctgttgaagccagatcaaatccgtagctggtcgaatgtagaccgcaacaactgtcaattggcgaacaagaaggcgagaaccagatgagggcatcgcgctctagcggtgcaggcgggaccacaaactgatcgaccttgggcgccagcagcagacaccttccccaggcaaacgtgtcaacgaatcatggcaggagcaggacagaccttccgccggaactgcctcgacctggtgccacaagcacgacgacgacagcatcaccacccctggagcacaacacaattccgccacgaacagttcagcagagactgcggtagggaactccaaatgagctatagcttcagttttgtgcaggcatgtattgatcgctagagggaaggtaaaaaagaaagagaaacaggtggggtagaccggtttttggtaaacagagaagtttttggtaaaaaaaatcgatgagctcgtaaaatcttggatcgggtgaaccacgaggtcgagccaccaccatgcaggaggagccaagcatcgccgatccttctccagaagccaccaccgccgccgcctgactagcgccttcctttccagtttccaatagcaataccaaactagaagccgcatcccgcgcacggcgcaccgccacgcgtggtttcgcgagagagtgtcgaatcgcatcggtcgtccgccgggcaccaccagtaccaccgagactggttcgctattgttaggcatctctgtaatattccctcagcatcttttccccgacgccgcccggtaccgtatatatataggccgcggctccctgcttcccttggatccaccgcaaacaaggtcctgacaacccacgccacgacgacacaacaaagcacaagcaccgcagctaaaccc

SEQ ID NO: 8525 - DNA, 1500 bp, Zea mays
aaacataaacgagttgtttggctatgcttctcagccattctggctacgggttatggctgttgttttggctctgatttttctgtagatttcaagcagacgaagcggttgtaaataccagctgaacgatatcaaaagatacgtgtcttttgttggctagaggtgtgtggatgtgggtttggagcaaacgatcatggttcaaatctctatttatgcataagtttagctttttttaccgtttaaatatagataagtaaggataggtgcacgaaagaaagtgaaatctcgatgcagtcatgtaccgtgccacataagcaaacatgagtacatgacatgccatgtaatttaataaaagagatataagaaagtttcatgggattgaaattttggatacactgttttctggacaaatgatgatatgacatgccttgaaaacagtgcgataaaactatttattggaaatggtcttaaccaattttccagtccattaaatctttaatcaattaacccacatcatagtacacaattaaacttaactctacacattcttctattttttacgcagtgaagccattacacgcgtaaaaaaatattaaacaatttgtactagtatgaaacattaatttccaccgttacaccgtcgtcgtgcatcacgtgtggaataaatcgtgcacaagagaggtttaaattttggttgctaattccacattcatatctacctgactaatataacacatatttttatgttttatgaaaacaagttatgccaatatgatatatagaaactgtagtaatatagacatctataaattttatctctccacctggaggttacctcctcgtttctacggtttaacgattttcaaattcggcctaatcaagtcaaggtactcctaattgatatacgtttagttaaaaaagtgaaaggtccgctgcatatgcttgtcgggttcacccaatcacccctgcgctgcttcctttgtcaggttcagtcgctcaccaatctgccgttcacacctctctcgctgcctttatttcctgttggcgacgctctcgccaggtcttcggcggcccgttcgtcggcgactagcgcctccgtttgccaggtcttcgtcgtccgttcgccgtcgactggtgcccagcaggtatgctcgccccttctcgtccttcctgcccttcgaaaccgagcacccaaaccctacagcaagctacttgcatccggatctggcacagttacaagcgtacacatgtattgtgcgcggggtgcgtgtgtgtgtgttttttttatgggggggtggggttacgtttcacgtttgtactttgagtctgctgtatacttgtagcatcattaaattgtttggtggtttacttgtgaaaatagtatgaataacttgttataaattgcttcagggtttacttctgaaaataatatggataccttgttattgaggagcggatcttttactatctatcgtgttctgtcagccaggtacatctggaaga

SEQ ID NO: 8526 - DNA, 901 bp, Zea mays
atgtgccgacttgaattaccaggaagctgatggtgtccactgcccacctttgcaaatctaatcggacttagttatgtgaagcaagtattaggtgcaagcatgcaagcgaaccccctgggtatttagatcatgattcaaccatatatgcaaccatagtttatcaagtgaacttttgatcaaattgcgtgagctggtgggggtttaaatgttaaatgtgatctatggttggaccatgatctaaaggatcgggaggcttgcttccacgcttcgcataaggcttgcttgaacagcagtcttttcccttggtcagtgatgctatttttttttttttttggtaaatacatatttgcgtagtccattctgcaggtgtagccaaaggtatcaccagcatacaatgtaggtttactaaaggacttcaaacgattttgaggtcacactttttttaattaaatttggccacacttgggcatgttgggtctcctggagaggtggttctgtcaaggcctagagggaggctatctgtctcaagttttaatttcaggaaactttgcccacaaatccattagcaaactgatgacgttactaccagaaacaggatgctaaattgctatatagatacactttctacactccaatacaaagcagatggtctaatctagtaaccaataggcaggacactaatctaatgtttgtaccgaatgatgggtagccataagcccatttccttgtattgtacgaaactttctattgttgatttaatgataatttacttttgttaatgctgtgcaggtcagtattttgcagctaaaaggataattcacatttgttgctatcaaggtttttgaaagttttatatgattcagagaaatatatattcttcggctagtgggtctgctcattg

SEQ ID NO: 8527 - DNA, 1500 bp, Zea mays
atgtcacgtggctcatctggcactcgtagatctcgcgcagaatcgcttgtcgtgttcgtgtaattttttctttcttattcgtgcgtattccttgtcgtctccgcctccccatgcgacggcgacggccgtcgtccccatggggaatctgtcccgtcccatgcgtggaactgtatgaggcaccccaaagccgagttttttaaccgagccgcccacaacacggccgtgagagagcaggtgggatgcagagggaagggaggggagccggagaacggtgttggccgtgggctcgtgttggttggctgtgtcctgtgtgggattcttcctcgcggggggtccctgcggccgagacggggttcgtccaactggtctggagacgtacctttttcttgcccttttgctgattctttttggatgtatcgcgactgggagtctgggagggaaataaaagacatcgttgatgattgtcgcactgcacccgatctggctttgtcctcgagggcccccacgtattttgttcttgttggctggggttggtgggagctgtgtctttcactgccgccgttgcgagaagcatgttgcaacttgcatcgccgaggcttttcttgcaagcctgggttggcgccgtctgctgtagaggattattaagtggctgatagatgcacatgcaccgatggtccagtcgattagttctgtgatgatacgcgctgattactgacctaagtctcaattatgtgcttcccttctgttttccagtgccactgctgaacactaccatgtgtgttcagtgttctcatgggcaccctgtgcagttcaccacggtggagacttttccgatgccagcagccgtgcatctaccattagtacacatgggtctcaccaaaccatctattcaattgttgtgatttggccttaaattcttaatgatggatggatcaaacatcattttccaactaatatgtggtagtccataaaggaatcatgggcaccagctgatgtctttttcattttcctcccttgtaactcctgtctttttccttttaaaacttgcaagacagaaacaggaactacgctgttcaatgtggtcaattatttttgcattaggtggtgtggcgtttcattagacattacatgtcaacactttttttgtttttttttcattactgtagtgtatgctgtgattgtgcacaattattgtgcttggaactgattggtatgttggttgttaggtgtgctgaacatgtatgtgcttcaacattttgtagccccccccctagtgattgctatgttcaaggcttatctttttttcccttccaatacagaatgcagggccttgatatttaatgggctggaggtggtacatgcatgttcgcagtgacaagaacacattgaaacgttggtttttcattgacaagaggcttgttaaagcatttttggtgcactaaccttttgttgtctgtaattggtttcacaacaagtttcttggggggttgtgtcctgttg

SEQ ID NO: 8528 - DNA, 237 bp, Zea mays
ggtaaggaacggtgccggccgtgttgtccgtagacgattgagggggacagaaagagattctttggatgtttttctttgtttcctttatttataccgagagataaacaaaaaaaaaacccagagacgaaaaaactttttttcttgaaccgccctgcttcccctctggtgttgggaatttgtgattttgacatacgacctgtatgggtatttttccggccggtgaaggatgataccagg

SEQ ID NO: 8529 - DNA, 1292 bp, Zea mays
ttgccctctcgttgtcccgatcacttttgcaacggttattaatgtgtattcacttcgttgccttttattagatttgtcgtattgttattataggcaccttaggctatgtttgcatagtctagtattcaccccaatacacatgagttgagggggatkggggtgtaaattagtccctcaattcatgtgtattagggtgaatactaggatttccattcctccaatatggcccaaaaatctgatagtcttgggagcatcggtgccttgggtcgtagcttaagagatggacaataggtggacttcctcaactgctgtgacatcggtgagctcaaccataggtggacttcctcatcagcaacctagagaaactgccacaattcctcgactatatggagttgtacagtcctctagccttcctgtatgcatattgagcagcaagtttgtcttcagagggagcaaatttgttggggtgtgtcagaaccagagggtgttgaagatgaaccataagatttcaccaagcttctgaaaacaggccaggccaggccaggcctctcgtagcttggttccatccctcgcctcctcctgcaactgagcaagaacgtaggcaggcattaagttgatccactagcatactgacggatatgcagaagtttgcgaagcaggtatacgaactgatctttaccaaaacgctctataagaatgaagccaaattcaggctgtgctgaacctgactgtaaccatcctgcagccgatccaatgaaattcatagtagcgacctccacccagactataggatcaactccatgcatgccatcaaattcagggaaaataagtttaggtaactgtcccagatagtttgtgttttggaaatctggtgaagaattgaactcaaccgaagcatggaggaatgtggatgaggtggaaggtggtgccccattggatgctgatctggtgagagccgaggatgctgatctggtgccaacggtccttggatagctctgcacgaacggcgtcgatggagtccttgacgctctccaccgtggattctagatgggatttgtttggacaggtgggcccctcagtccacaacagatcagccccgcaccgcgtatcggactccagaaattgcgtatataaataaacaccacgcccatatgcaacacaacgcaactcatcgcacgcaccatctgcaccatctgcgctgcgcttcgccctctcgagtccatcgtcgctcgagatccrtcgtcgtcgtcatcaccagcagcagcaccaccaccaccaccagcgagttagcg

SEQ ID NO: 8530 - DNA, 1500 bp, Zea mays
gattaattaattcccgtcggcccgcgcgcaagccgacgggaattaaggtagccgacgggaatgctttggattgctgtagtgtttgtaacctttaacggctgtaacggtcgctagtgggccccacaactttagttctgacggcctccatgtaagccgtcagacataaggcgctattgggggccttcctctttcgaatgtcctcaaaaacacgactaaccatctgcttctagcataatgttgattgttacaggagcttcgtcacaaacaaaggttcatgatgggagttttctcttccgtccaaggtcttcaagacgaagatatagtccaaaaatgataacaatgaacgctgaagctatagtcgaagagtaacaggttcagcttaaagtggtgtcgaagatcaagcatgatgctgagccgaagaggaaaagattagttggtccctaatgatttatgttacaattatgaacaaatgttaatgtcataaatgtatttttacccaggctgcgtcccgtgcctataaataggtgaacattacccatgtactgttcacgagggattgtaatcacttttacgtcaacacattcgaacaagccgaagatatcaatgtaatgcgaatcttattaatattcatatatttatcatgaagtaaatatatgaattgatatatgaatggataatgtttattatctctatgaattgttattcttgtgaatgatgaaggtgcttccttcgtaaccttcgtctgaagatcattatatccaaaaggggataatgctttgtaagacgaaggttcctaacctttaacaattgtgttgtcttgttctttatttacaacatttgaaaacaagtgaccaacaagcatataggctcattttcaactcattgtttcggtcttttggctaagatcaagtgtaatatttgttttaccagtccaatatctggtatatgaacaatatgttcactttaacattaaatttatttattatgagtgtttttatgtggagggttcattaagattctcaactctcaagtgactcttagtcacctaatcaatattattaaatatagttagactagttaggttatatggatgaatttcttatatgcatctgctcggagaaccgaagattgtatatgtcctagagccacacggatgttttacaaagaaatcaaattattctggctccttgcacttgtaccatatgtgatatgtcgtctctacgcctctaccacctccctatggaagcctattaaaaccaaactgaaattaaaaagaaaatggatagttttattttagttccaagtttccaactgaccacgccgacgccgcctccgacgcctcctacaaaaacgtctacggtggatcgctgcccacagcacggcgctcgccctctcacaccggctgcgccaccgctgccctgcatacttgcctactataaaccctaactaactcccgccgcacccgctcgccttccatcgcacgccaccaccggtcaccgg

SEQ ID NO: 8531 - DNA, 183 bp, Zea mays
agatagtttgattttttttcccaagttcattgcaaaactgtccaggcccaggagcccatgaagaaagaagaggcccactaacgaaacggggtaagtatatcatatctttatcggataggacacccccatctcaacgcaaacccaactgtcttggttgcgcaagcaccaagcaggtggaagatg

SEQ ID NO: 8532 - DNA, 65 bp, Zea mays
agtaaaagatgcaagattattaggaggaagatcttgtcagggctgcatgcaagcttgagttgtca

SEQ ID NO: 8533 - DNA, 332 bp, Zea mays
tctaattaggtttcgctcatatagtaaacatttgctaattatagattaattagttataataaattcttctcgtcatttagtcttcgtctctaattagttttataattagattacatttaatatttataattaacattgtttgatgcagcacctactaatcagggtaccaaacacagtcatattcaaccctcgattgaaaagaagccaatgacaaacggtcgaacagcgctccagcctcgtctttcggctacgtcctttggcacttccctccgttcctactttcctaggcaaacggtcgaacacctcagcggcaaggctcggcgccaccaccc

SEQ ID NO: 8534 - DNA, 301 bp, Zea mays
ggtatgtttactacaatacattaacagaagcatggtttcttcatttcatgaatggttactcttgtcataattttgtcactatatagatatgaccttcattcctgaacagccgttcttttagaatgcatcaaattaaacttccaaaaatttgacctctggtatgaggaagtagttacatctgcattgtcataatattcatgtattttcgctttgtcataatattcatgtattttcgctgcacgcatatgactagaaaaaatattttgaaaaaaaaattgcatgttttagacactgttgaagt

SEQ ID NO: 8535 - DNA, 184 bp, Zea mays
ggtacgccttgcttattctcttctgaaaggcaacaaataaatttgaagtcattctcgacataaaatttctcttcgaatgtaactagtttttaacctgatcttgttcaggtttgacccatcaaaattcgacgctatatttagcaagtatggtcgtactcatccagatgcgttgacaaaagatgag

SEQ ID NO: 8536 - DNA, 370 bp, Zea mays
tggcagagtgcgtccgactcaatcgtggattgcggtgaagatgtggtgggcgagggggtggctacctgttgttgaaggggaatggtggctccgtggctggatacgattagggtttacggttgagggggtgcctacctgggcctaacggttgaaacctgggcctaacggttggaacagaggccgtccgactcaatcgttaaccaggggcaatgcctgtcttttagggcctgtttgtttaaccccatggattatataatctagattatttttggaggattatataatctggattatataatctggattatataatctgagtagtcccgtttgtttatccagattatttgagttgttaataggattcttttgt

SEQ ID NO: 8537 - DNA, 1500 bp, Zea mays
tcaactgagtaatgtctttggttgagtcgaatggactaaccgggatgttagtgtgtacaatatgtctcttagcttgtggtgcgcaggtgtggagtttggaagcagtggtcaatgacgaaggtgaaggtcttgcagggttgtgctaatggaccagaagcgataaatgacaagtgctagaacttgacctagggattggagaagatggatgacaagttgtgaaagggaaatgtgcccttgggccatttctataagattttggtgattaagtgcccaacacacattaagggaatgagtatatgtcaaagggtggacaaagtgcaaatcaataccaaggtatgattctagacttagtacattggtttttgtgtactaacatatttgtctaagtgctagaatcagagaaaagacaattggaaaagacttggctcgagcagccaagactctgctcagtctgggtgcaccggacagtgtccggtgcgccaggctggctctggtgaaaaggccgctctcgggaattcgtcggcggcgtacggctaaaattcaccggactgtccggtgtgcaccggactgtccggtgtgcaccggactgtccggtgagccaacggtcggccgcgcaatccgcgcgtgacgcgtggccgagccaacggtcagaagggggcaccagactgtccggtgcgccaatggctccaaatcttcaacggtcggctgcgccagaataggaaagaaatccgcaccggactgtccggtggtgcaccggactgtccggtgcgccagtcgacagaaggcaagaattgccttcctggaatgctctcaacgggtcctagctgccttgtggctataaaagggacccctaggcgcatggaggatgacaccaagcacactttgagcattcttgatcattctcactctgactttgcgcactcgtttgacattcttagtgatttgagctccgttctagtggtgaactttgtgatactcatttgagctcaaattcttggctgtgtgtgtgcgtatctgctgtggatttgagtgtgttgcttccctcccttactctagtgctttcactttgattcttattgtaagggtgagagactccaagttgtggagattcctcacaagcgggaaagagtaaagaaagaagaacaccgtggtattcaagttgatcattggatcacttgagaggggttgagtgcaaccctcgtccgttgggacgccacaacgtggagtaggcaagttttgtacttggccgaaccacgggataaatcctcgtgtctcttgtgcttgttctcactgtgtctattgtgtttcacaagagctctccttagccacttgatttcattgtgctaactcttaatcaagttttgtggctttaagttttaagtttttacaggatcacctattcacccccccccccctctaggtgctctcaattggtatcagagtcgttctcttcaagaaagggactaatcgcccgaagagatggatcctaagggatagggg

SEQ ID NO: 8538 - DNA, 1500 bp, Zea mays
tgtttgacatagaaatagagatttgagtttgatttgcaaaaacaaaccaagtggtggcaaaggatgatccatatatgccaaaattgaatcaaaaccaatttgagtttttatttgaagtgattttgcacttgttctagttgctttatgttgtgttggcataaatcaccaaaaagggggagattgaaagggaaatgtgcccttgggccatttctaagtattttggtgattgagtgcaaacacaagtgcttaaatgtgaaaatatgcccaaggatgaacaaagtgcaaatcacaagttaaggtatgtttctaagccttagtacattggttttgtgtactaatatatttgtctaagtgttagaaacagatagaagaagagaagagaagacttggctgtgtacagccaaggggctgcttcggtctggggcaccggactgtccggtggtgcaccggacagtgtccggtggtgcaccggacagtgtccggtgcgccaggctgcctcggccgaagaggccgctctcgggtttttctccggcgacttcggctaaaattcaccggactgtccggtgtgcaccggactgtccggtgagccaacggtcggccgggccaacggtcggccgcgcgatcggcgcgcgacacgtggccgagccaacggtcggaaggaagcaccggactgtccggtgtgcaccggactgtccggtgcgccagatctgcaacggtcggcaacggtcggcttcgccatttaaggaaacaaatcgggcaccggacagtgtccggtgtgcaccggactgtccggtgcgccacgagacagaaggcaaagatggccttccagatttgttcccaacggctcctagctgccttggggctataaaagggacccctaggcgcatggaggagaacaccaagcattccttgagcactcttgatcactcacacatcaatctcgcgcacttgttcgacattctagtgatttgagctccgttctagtgtgctagtcttttgagctcaagtctgggtcttgtgtgtgcgtattcgctgtgatctttgtgtcgtgtgtgagttgctaatccctcccttgctctgtgattctctgtgaacatcttttgtaagggcgagaggctccaagttgtggagattcctcgcaaacgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccactgtgtcatctctgtgattggattcttgtggttattgtgttttgactcctctctagccacttggcataaactgtgctaacactcaatcaaagttttgtggcttaagttttgaagtttttacaggatcacctattcaccccccccctctaggtgctctcaattggtatcagagccgttctcttcaagaaagggactaaccgcccgaagag

SEQ ID NO: 8539 - DNA, 1500 bp, Zea mays
aatcaaaataaagcgaagcaattagaacctgccacatggcaagaggcgatcgttatcgacatggccgcaatagctgttcagtaccaaccagtcagtatcgaccgacgcggtcccaacacggtcaatagtaaccctggcggccgatcagtagcctcgacaaccacaagcgaggctattagtgctggcaccatgtcgggtgatactgaccatttggttgtgccacatgggtgggcgggcagtagagccaagcgccggcactcgcctaacatgatctaaaacaatcgataaaactgacagattggttgcggttcatgactacctagacctggtcgaccacaagtagaaaatgagtcgagccgagcttgactcggctcgtccatttcacgagctagagagttaggctcggctcagctcgaagtcggctcgcgagctacaccccgatatatattatttcattatatagtaaattattaatatataaacataaaatataaaaatattattcaccattatgaattatcttatatttatcatcaaaggctaagaaataagccgactatctataaattatctaatatctatcattattctacatattgattaatttggtacaactagctcgctcgcagacgctccgaacttgatctgactcgtgagcctcaagttttttttctagccttaaccacatgcccgcgaggatgattgttcgaggtgattagcaaacgcaaacgatatcaattgacattttttattagtttcattaggtttagagataaaattatatcatgtatgtcactcgtctagtatcttatttgttatcataaatgttctaatcctttttacgtcacccgaatacaattttttactctttcatgtcatagtaagggactaagacatacaacattttacatttaacatttggccacgacatgtaagagtgagatattgaattcgagtaacatacgaggtacgatgaataaggtattacacaaaattacagtggcatatagtgaattgaattgttctatttttactttttttttgcctaacataaagcctattttatttagtactttctctgattcagctttaatttttatgatttattaattttattatatatctatatattgtatagattaaaaaataaaataaattatagatttaggaaaaattacattcgggtgatttggctgttgggtgttgcgttccctacttgctcttttcttcctccgcttcaacctgtccccagcgccccccgcgcacacactgtctttctctgcctttctttccctagcgccgcgccggcgccgccattcgatcaggccgcttcgccggcgacagcatattccaggtatgccgtcccttctgctccttctgcgagaattcaaacaccccgaactccccaaatctagtatttgtattcggatctgaccatttttcactgggcccgcccctgattcgcaggtcggttggttttggcacttcggaccggcggcc

SEQ ID NO: 8540 - DNA, 1500 bp, Zea mays
cgtgttcgacttctgcgccgggccggggccacttgtgtgctgtggacatcacattgccagtttgttcgttaccgggctacattgtcctagactcctagtactggctcatgcatgcatacgtgctcgctttcgtaatccatgcaatgcaaaagaaccggtcgaaaagtctccgcgcacgaatttccctagttaagtcaaaacggcatcatctgctagcgcgctagtagtagtagtaattaatactcctaaaaaaggtcaggaaaaagaccggtgcctggaaactggcctgctagcttttgggcttttggcttgcgtcacgcacgcgggagctcaaacatttgcttgagacgctgggaactggggggatgcatgacggcgacgaacggacggattaaagccaaacggatttactatgttattggagtctttgacacaaccacacacgtctgtcacacatattactgtcgcgaagaaaaagagctgcagatacagtaccagtagttgtagtatcttcttgatttaacttgggaccgaagaaacagccagagccagccggcccggatcagctaaaaatgtgaatcttcttgatgattaattgcatagtcagcatagatgtaggttcgttatatacccacgttcatatatcggtagccaaattgatcaccgccctgcaaccttcgataatcttaggtgtgccaaatactagccctaactttaattttacagcacccaacccaaccattcgctgtaagctgcaacacctgcctgctgttcgttgaaaacttgcatggagttccttgaccttgactcgttccagcctcgattgatctccagcaggtgactaattaaacgaattaaactagcaaccccggcccgcagatgtcgccgtcgtgccagttcccggtgacgctcggacgacgtcgtcgtcgtcacatactcacacacgctagctagcttgcgcgccaccgcggcgagaggcggtagtagctatgctaggctacgtacgccaatcaactcacgctaacggaggaggaggccgggcgccgtctcagggcacgcggcttctggagccacattgtcgccggcgaaaaaaaaacgctgctagaacgtggacgagttgctaagctagctagacaagacaatcattcgacgaagctatcgaccggaccggccggcggggaagtttaggtaccgactggtggcggcatgacgaacgaaacatgcatatgcattcgtcccctcgtcgtcgttggcagctctcgctcctctataaataccagcgccatccgcttcagatgagcatcgatcccagcaacgcacggagcgtacgtacattgcagtagctagctatagctggccggccatcccctctcgctcgctgctaaacacgttccagcttgtttgctcagagaaacagcgcgcgcgcacacacacacacatcatcatcatcgattcatcgtacacaggatcagagagcttaattagttctagctctgctgc

SEQ ID NO: 8541 - DNA, 262 bp, Zea mays
ggttagctgtccaatgtcttttgcaattctggaatcgggagaatatacttgtatatatatatcttacatttatcaaatagggagaaattaaatcttgatatcttgaacgttgttcatcgtgaattttgtcgttttgtatgcaatactaatatacttcatctagtaatacaaaaggtacaagaaaaagaaaattgcacctggctatttgtcttaatatattatgctggaacatgacattgctatatgatacttcttttgcagc

SEQ ID NO: 8542 - DNA, 844 bp, Zea mays
gtccgacggcggtgccaaaagtttgaagcccgccgtagacagtgtcatgtttgcaaaattctcccctcccccaggccccaactcgcaagtcgcctgccagcccggttagcaaggaagcacgcaggatatttggtgcgcgcgggcggtgtgagcggtgagcctgcaaaagccagcagcagcgagcgtcggtaggggagcccgggcagcggagcacacttgccctctccacctggaaccccgagcaggctccgccggccacggccggtgccgcgacgactcggcacgcgctagctagctagctgttcctcttcccgagggccccaccactaccaccatcctgccgcccggcctcgtgtggcggatgatgattcctagggagccgtggcggccggagcacccttccaactcctgatcccgagctgacccccgcccatcgcagcggcggctcttccgcagcgtctgtgtccaggtgaggttggtgccccacggatttggagttgagttctaggattttcggatttggtagatgcgtggttagtcgctgctggattgggtaggttcagtcgtggatctgggagttcgatttagctgcattccttaactgttaagtaagtagctttgaaaatccgctacacttgattgaagtaagtagattagaggagcagcaagctggacactggagtaggaatttgagcctcgtttgcttagatgaaaccaaacttagtccgtcttgttgctgcaaattcccgtctttcgatctataatatcgctcacggcaactgctattttccccgcctgtggtcgttgtcgtagacttatgatgatggagacccctcaaatcgag

SEQ ID NO: 8543 - DNA, 1462 bp, Zea mays
ctatttacttttaatgaattttctaaccttcaggactaggcatcaattacaggaaagcgtaggggctagcgtaaaagaattcccaagactcatcgcactattcctgtggacggcgggtcattttaataaaaatccgagggctcttttataaagttaccacagtgaaggggtatcagccgagtacggccgtccgattagaaacgaacggcgccaattaaatctctctacatcgcgaatcggtacgagctcgtgagctcaggatcccgatccaacggtctacaaacatgattttctttcacccgcacatccgatgataaccgtccgagatcgacacggccgaaacgttattccccaggttaagatctgggccgcccactgatcatccaatgacgcaggcgcatttcccttacgatgcactcacgcggcggtgctgatgctcagcacggcggcaccatggccggaatgtggtcaattggcgcacggccgacccaaccagagcgaaacctacatcgtaaggaagggggaaaataggcggacacggatggacaacttattccgggaattatagggtaaaggctcctagctccagcgatgtgtggaccagcggcgacatcgagcgacggtgaagaattcccagccaacaagcccatgattcgtcccggatctaggcgctatacaatgcacagaggaaggacaagataggggccggaagttctctcactcgatgggcgcgggttagagccctaccccacgatgggtgtgcgggagtctgcggcgacttgactcaccagcgagaaatttcccggggttaagcgacccacgggccctagggaccaaacgcacgcgaccaccgcacgctggtgaaccccgcgaatcttcctcgagaccttaccggaggcgaggcgaggattaagtatggcggtgactcacctttccccgatgctcactcgcggtgacgaagaacactcgatggagctagaatttcttgcgaggtctccaggtaaacaaggtgcggcggccctgccccgcggtcatatagggacggctggttcggtattggagcgcatggcgtctagtgatatcgcgcaggtagttgagctagagccgcgcggtttgttacagaggagtagagcgcaaggaagatggagtcagacgcggcggtctaaagtgtggcggaactgcccgaattattctgacttaagtgcctaagtcccgccttaaaggctagaccacacttaaattggaataacccgtcaatcctttggatctagtccgacgaggccactgacaggatcaagtaccacaatctcactcgaaggtgagtcacagagcaaatacaataaagcataaaaccatacattaaggagtattaagttattacatcatcatcggagtttttgcaaaagtaaccatcattgttcgaagtgcagcggaataaaactaacggtaaataaacagagag

SEQ ID NO: 8544 - DNA, 1500 bp, Zea mays
tctcactaattttagcagtatggagcaatgttgctacgactacgacgcagtcacgagcagtaccaaacaggccctaagtaggccacaccgtacctgtttaagggcccgtagttacgattatgggccttgagcccgttattatgactacgggccttcgtttccgcgctgccaattcaccgggacagaagaacacggcgcgaacttcaacaaatagcaagcacagatgcaactttacaagaaagggatccccgctccagtattaatgaccactgtactttcactttgcagtacactcgaaaatgaacgagcaaccttcctagccagggtactttcacttcaaatgtgcaatgtataggatctgtttggtgttatttataaaccgtttatggttaaaataaactgaaactagatggggaaaaaaaggataatgactaagaaagtaaacaacaattgtcaaagttatttcttatgtgtgatgatgaccccaccmcaagtgtatgctgscctaatgcttaaagttattttttttaatgcatggtgtgtctatcatagcaattgggtgatgcggcatagcattatctataatcgtgataatgtaggtattgtttaagtggccagagagaatccaaaatctgtaccccgatgaacaataaatagcttgatagttgtcacttctaactgtacttactagtaagaacaaacaaactaaaccatttttagattctcaccacattaggatcctcatccttgtgttcaaattatcatgagctgctaaatattagtgtaactagtttctaattaaacgatatccattattactcctaattaatattaagaaatgcgatgtagccaaccaaggccacgtttggtttgatcggctaaagattactcactccattttaatgagttgtgttatgaatacttttaagggatgtttggttattttagtcaccttttaaattttagtgactaactctagttcttaaaaaaatatattttagtatctcgtttggtatgttagaaactaaaagtgtcactaaagtttaggatacaccaaccaaacaccctctaaattagatagagactaaacttaggcctccaacaaactttagtcgtgaactatgagaatgtttgaatgtatcataattaatagttacctgctaaaattagttgcatatatctaaacaatctatctaatagttcaattattagttatttttagcaaattaattaatagttagctagatatttgttagctagctaatttcactagaatttttagccaacggactattaactctagtgtatttaaacatttctaagagagctgatttggtgaacaagtatcacgataggaatcacaaaatagcaattaaatttcttttcatgatctctctcgatcacgggtcactaaaccaccataaaaaataccaaacactccttaaacttcaaccaatcacccctcgttgacctagtaaactccggtatctcgcctgtctg

SEQ ID NO: 8545 - DNA, 1500 bp, Zea mays
aaagggagaaatagtctaaccttcttcttacctaagcatgacctagtgcattggtgattgcctttcccaagcatcttgttactgatgtcgatgtcgctggacctttgattcacttcacagaggccatagttcccttctttttggcatctcatggcggaccattagtgttggttgtggttgacaccaccaagattttgccctgctctatggtgttctaaggggtcactatcctctcacgtcgattgcacgtgatgttgggtcattgcgtgtgggccctaggctcgcgcgtcagtgacccaccccgacgtcagaggatcccaacacgttctaagcgaycacacctttgccccatcgattgacaatgctccaccatgcataytatgtgaggtgcaagatggaaggcttggcatgcatgctcacaagagtcgactaggtataacatgttttcatgcactaggatccaccacccctccgacaatttcttgatggctggtttgctagataggaaaatgtagtggatacatgtaggaggaatccccttgctactcaatattgaatagcaaggggattactctccataggtctcctccattttttgtccaccaaatcagctctgaaggggcgaactggtcatgtgtgttgcatggttgcgccttggtgatgaagtcgcgtcgctctcttgacattgctgggcgtgcgaggggtgacggaagtgacaggggttgggagagatgatggattttacaattttcagccctacttggtggtctttttattactagtacaatattagaattatattataaattgtgtacgaatcgagtcactgagtgaattcctaaggacatgtaaaaaactcagacgctgacttggttttctaagtacaagagacatttaagaaactctgtgatacaaccctgagcctctgtaycataaatacagttaagagacaatattacatagagagttttgaaaagacggattgttcaccaatagcatgtctcttatattttgtttaatctaacccctagagaccctttaaaagactacatataaaatgggttgtacatgccctaattattgtattgcacacatcgcagtcgagtcgacactcgagactcgacatcatgcactaatgccaatgcccttgtgtgtagggttggtaatggatgacgatacaaatgtttctatacaataagagttaggattcttaaaaaatttagtttaaaaataaataaaaatagagtctgatcttaatttgattcgatcttaatttgattcgatttttaaattttatagtgtaattttagagcttgcctctattaacacccctactcatgtgtgactggctataaataaccataaccactatgagatggactaaacagcagccagtatcagctgcctcctctctttctcgacccatagccacatcctcgccccgcgctgcggagcattcagtcatttgccactactctcacggcctcaccaagctcttcc

SEQ ID NO: 8546 - DNA, 227 bp, Zea mays
ggttaaacctcgacacgagactacataggagtagcactagcacccaacaaacggccaaaccagacatccagccagcccaagtgcccaactagtcaacctgcgatcgatcacatgcctacacacttcctatatatagcgactcgctaaaccatggcacggcaccggccacgtacgactcacaagttcacactccacagcaagttcaccactgagtagcagctaccgcc

SEQ ID NO: 8547 - DNA, 783 bp, Zea mays
gtctaatatatgtatagcacaagacgggaataagagcttttataagtgtctctatcatatccgttgttatctgtaatgagaaagcacccctgattattgtcatagttatttgtacgggataattgaataacgagatattacccccaagcaatttaaatatctgtaacagtttccgctgtaaaaatttattgatctgtcgtcgagtgtccgcacacaaaactccctgaatctagactggggccagcacaaaaaaaaaaaaaaaaaccggtcggcatccaccatgctgccatcgtcgtccgacatccccccctgtgggctggaccaatctttctacgttatgcccatatgagaccccctgtgggcttccgtcgcagtgaacacgcacgcagaatgaaaccccaccaaaagcagccttttcgggatcaccatctacaactgaccagtctttcagcgttattcgaccctgcctgggatgggggatatggagaactgaagaaaagcggctgagccacagaatgaatatgatacagttacttgcacatcaccagggtcatcttctggacaggcatactgacaaatgcgtgcatggacggatgcccgtcgaccgcctttaatttggtggagcaaagcgcaggtccaggtgaagaccatcaggtgtttgtacacttctgtactctcctcctcattccttagtggccaacggatctcaggaccctataagtaagtcccttccgtattctggttctgaaacagtagctgccctgcctgactcctgcctccagc

SEQ ID NO: 8548 - DNA, 61 bp, Zea mays
ggtttcttttctttcccttaattaagaggaactgtgaaatgattttttattggatattctg

SEQ ID NO: 8549 - DNA, 360 bp, Zea mays
attttagactattgtttggcaaaaaaggaactaaatgagactaaaaattagagattaatttttaatctctttaaccaaacatcctctttgagtaccgtgcaacagtatcgaagttgtatatgcccttaccactacgtctaaaaaatggcattaaataaggccggaagcggttaattgaaaatcaatcccaagacctttcctctctctctctctcctcctccgttcagatccccgcgatcgaagaggccaggccaggccaacaagcggccaacccggcacagctgcgcaagccaccgcaccaatcccacagcccgaggcccgatccagcgcccggcggctggggttcgccagcggcccgcc

SEQ ID NO: 8550 - DNA, 172 bp, Zea mays
catatttcttcaaacagattcaaatcgtaccagtcacatatgttttactctaaaaactacactcaataccagaaccaaactaaaatctcccctaaaaaccgagcacgaaaatcactataggtacaatgcggtctagaagagagggtgcagtaagaacatcacagcaccaacg

SEQ ID NO: 8551 - DNA, 670 bp, Zea mays
taaacggcggcgctttgctgcagcgccgcactgagatgtggctaccttgtccaactgaaactgccgctacagtatgtgtgcggatcaggtcaggtccgaaagacgccatcaacccgttactgctctcgtcgcgacacagcctccctcgaaaatgttactatcacctatcaccatctacgaatgaagctttaaaacaacgacaagcatcgagctgatgaagcatctagcctacaaaagcgagtggagccgcgatcaacatcgggagctcgtgccacgccggctcggttaggtgcggtgcggtgcgcgacagaggttggtgtccggtcctgtaccgctgtacggccgtaccctctaggcacccccgcgcgcgtcctacctacaccaccgtcggcgtcgtatcagggcccggccggccctgtctcaccgacgccgcttttatacagctcccacctccactcctctgcccctctcgtctcgtctcggctttgtatatagcccggaagcctgcttgcgcacaacaacaactctgcatgactccactagtccaccatccgccgcctccccttgcgggctgcaatggacggggtatttgtgctagagctttagaggcgcgcggcgggggtgcgagtgcgagtgcggccgccgacgcgcgggcgaaggaggcagcggg

SEQ ID NO: 8552 - DNA, 1500 bp, Zea mays
attttacatattaaagttctaccttgacatgttgaacaagtgttgtcgtggtggtgtgtctgcctaaactatgtaagcttgtctttattgggattattcatactttgtaatcgagcactttaatgtactccggagaagcaaggataatgttttcaagtgattagtgatgtttgtgaaagggaattaggcttacacctatttcctaattgattttggtggttgaattgcccaacacaaataattggactaactagtttgctctagtctataagttatacaggtgccaaaggttcacacttagccaataaaaagaccaagaaatgggttcaaccaaaagagcaagggacaaccgaaggcagccatggtctggcgcaccggactgtctggtgcaccaggggactccaagccaaacttcgcaccttcgggaattttcagatgagcttcgctataattcaccggacatgtccgatgcacaccggacagtgtccggtgctccagaggagagcgactctgaactcgccagcttcgggaaaccgctccgctataattcaccggacatgtccggtgcacaccggactgtccggtgagccagcggagcaacggctacttcgcgccaacggtcgtctgcaacgcattaaatgcgcgccagcgcgcgcagaggagcagagcacgcgcgggtggccacaccggacagtctacaggacttgtccggtgcaccaccggacagccaggcgggcccacacgtcagagctccaacggtcggaacccaacggcctggtgacgtggctggcgcaccggacagtgtccggtggcgcaccggactgtccggtgcgccatgcgacagcagcctccaccaaacggctagtttggtggttggggttataaatacccccaaccaccccacattcaagtcatccaagttttccaccttccaactacttacaagagctaggcattcaatacaagacacacccaagtgatcaaatcctctcccaattccacaaaagcattagtgttaagtgagagtgatttgttgtgttcttttgagctcttgcgcttggattgctttctttctcattctttctcattctttcttgagatcaaactcacttgtaattgaggcaagagacaccaatcgtgtggtgatccttgtgggaactttgtgttccaagtgattgagaagaaaagctcactcggtccgagggaccgtttgagagagggaaagggttgaaagagacccggtctttgtgaccacctcaacggggagtaggtttgcaagaaccgaacctcggtaaaacaaatccgcgtgtcacactctttattcgcttgcgatttgttttgcgccctctctctcggactcgtttctatttctaacgctaacccggcttgtagttgtgattaagtttgtaaatttcagattcgccctattcacccccctctaggcgactttcaattggtatcagagcctggtgcttcattagagcctaaccgctcgaagtg

SEQ ID NO: 8553 - DNA, 749 bp, Zea mays
tcatatattaggctaacgtcacagaattcgtctcggataykccaaagaaatcttttacgaaaaaaaaaacattttcctcgcatcggctgtggctctatcctagtctcgttcttcggtttggccgtatttgcatcgcacgacttggatccttgcgatatcaatcaaaaaatcctatacaaaagttcagtcttcagagtctccgcagatggagctctccgctggcgttgtgcaacgaacaaagctcatgtcataatcaccaatcgataatcggctgatgataccaaacaaggagtcactaattatcccaaggcgcccatcggctttaaaatatccgagttgcgtgcgttgccatcctctcttgctcggtcgcctttcccggtctttggtgtggataaaccggctttcttgctgttctcgatccttcttcaattcgctgtagtttttccttttgtcgcttgctcttgttctctttccaagaccgaggaagacgagtcagatttggtgattgtgtagagcgtacaagtgattgttcttggagaagcatargcctctcttggctggtaatgttctatccgttcatctacttgtacttgttctcgtttcaaaattgatcttgttgtaacgttctgcgacatggttatgtgttcttrtgcttgctgttagaaattgccaagaattatcagtttcgcattctcgtcttgggtgtagctcttgtcttcttgagcaaggaggcggaggaaaggaaagac

SEQ ID NO: 8554 - DNA, 1500 bp, Zea mays
agagtcgtcctcttacactcggcactttcggtgcaggtgctgaggtgttgacccggcgaacgagcgagcgaggcccctcccgccgacgcgggcaagcgatcgagaaaaaagcctgaatcgagaacggttggtgctgctggtcgacgaccactgtttccttttcctacgctacgactagcgtttggtgcatggcagtacgccagtacccgtgcgtgaccgacctggttttgtgctgattaaggacttgttcgtttacgtcggattggtgggtcggaacaattccgaaccggattgcttctctaatttatataaactttgattaactggaacgattccggatgtaatccgatgtaaacgaaaagacctaaggctgcgttcgtttgtttaggattggggcaggaatggttccaggtgatcaaaacctatacaaattagataagcattcctggttggattggttctaggtcacgattccggaacaaacgaacacaccctaaggccttcttcgtttgtgtcggattgtaactgaaatcgttccagcaaatcaaagtttatataaattagagaagcaatccsattagaaatcttttcgacccacaccaatccggcacaaacgaacaagacctaagtctttgttcttttgtaccacattgcataaaaaattatttcagttaattaaagtttatataaattagataagcactaatctcaaacaaccgaacggcacctacggaagatagggaaaagcggtgtccggctcatgcctcccgtctactgttggcctcatcaagcctgtcgccctgcccggccaagagaccgagaggactgcttcttgcttcttggagcgtgatatatcctctgatgggttgggtgtgtaagtgtggtctgactcgtgcgagcctggtccactggaaacaggccgttccttacgtatatgtgcatgtaattaggagagatgtttcagggcttaagctgcagcccgtgggtgcagccttggcgccgtgtaagcaggcaaccaaacgagagtcgcagcatggtcaacacatacacagaggctgaatgggcagctgcagccgtccagcgagaggaattggatgcgcgggcagctggtgagatgagatccgtgctgggcagtggactgagcagtgrgcaggccatcttctccggcggcgtccgagtatatcagtcagtcaactcctcatgtctgtcacgtgacttcccttccctttcgtggacctggcttccttttcatgggcctggccttcaggaggcaagcaagcaagccattcccagcccataccacccacctaggagcggcccatcctggtgtgtcgcggccttgcgggggaagcgtagaaggcactagaagtagaaggtagcagcagccgccaccgccagcgaatcacgtgacttcccctccccttctcccctctccactccatcgtcaaggaaggaacacggccctaactaaaccctagctaagggaagggaaacaagacc

SEQ ID NO: 8555 - DNA, 241 bp, Zea mays
tgaatatcttttctaataaaagaacaaatgaaaatatcactaagtgaatgaagttatccctttgttgacctatacattggtagtttctctttaagaaatttaagttaaatcatatcataacaacaatcatacaatagaaaattatttctttaaaataaactatttatgtgtgaactacatagctagaagcatttgcaaaaaataggataataaataaatatgtatataaaaatctatagta

SEQ ID NO: 8556 - DNA, 405 bp, Zea mays
gaggaaaaggatataaatttaaataatgtggcgcaccttttttgaggcggtcatcatgacggagacgaaacggcgcctgcttcacctgccagaggtgtcgcgtgccctgccggggagttaatgcgacgggacgggcgattcgcggggcatctgttgtgcgtgcacgggtcgttcgaggaacggaaaaaccgttttgccttcgagtttgaatttcacgaagggttcgggtgaagtttgggtggatctcgcccgggcctttatatacccggaagaggggccggtggtggttctttaccctgccatctgcgcttgccttctgcttttgttttcgcaacctaagagagtagacagagaagagaaaatcgcgcacctcatcccctccgcttccaccgctcctgctcggcg

SEQ ID NO: 8557 - DNA, 579 bp, Zea mays
aacttagatgattcattaacatgagttaggatgtcaggtcaactcataaaaaattcaaataaggcaatccatgtcgatccgagttgaccatgaaccaagcaagccaatgagccacgatcatttcgtccgactttagcaagggagcttgcgcgaactgcgacaacgacatcccgtctatggttgtaattatattataatttaatttgtataagttgtagaatattttgtatattgttgcaaaacacggatacctagctagtgatattgatgaaccctgtggcctgacccagtgccagctcgttgacatgaaggcttaccgtccgatacgagcactccaaggcgatccaacggccgcgatctggaggaacggtctcctaacctccgatatttcctttctcccttatcgccttcgcctccgcggctccgcctcgctctccaaggttctgccgaggtttctcgcctccccgctcccccctctccgagtctccgtccttgccactcctctctcccctcttccacctcaatccaatccgaccctcaccattgtagccggaactcgcagcgggacactaggcgcgc

SEQ ID NO: 8558 - DNA, 546 bp, Zea mays
gttttaaattagctttgcaatgataaggatattatgcattgcgcgggatcaatacatgctatttcaatacaccgaatcgctctaaaaccttacaatccaacgttaaagcgatgtagaggagcgtgtgtgcgtggccttattgcttcgatgtggacgagattttatttggcaggaatataatatataatttacaggtaacatgctataattaactgccaagatttgatgctataatggtacacgtaacgtatgcttaaccgacgccttccattcttccatgattcgcgcggtgcccatgtgacgcgacggacctaaaccctaaacgcgcgcgggtgtcaggtgtgtagcggccatcgataatgccatgcacggactgggattggtagttcaagcgtccccatttccctgtcctgtgtctgcctataaataccaccccagtcgatgccctccacctcacacaccatygaaacacaaaccagcagcaggcagagcaacgactagctgccaggcaagccggccgggggtgctgcaagagtgcaacaaaca

SEQ ID NO: 8559 - DNA, 1500 bp, Zea mays
tttatgttcgctctggaccaccaaaatcaatgggttctacataccctaaaaatgacgtatcaaggatccgttcatccgaacctgccaccagttggttgatgtatgacgtacgaaatggaataccagcgggttaatttgttgttcctcagacgttcgtcagtcttttgagaaagagtgagtactgcagaatctaagcgcgggaattagttatccagttaataaggatttaatatcccaaccatgctttaaatttaaaaaatgggacatatacagtttggtacttattcatcggttcacacacgggtatatgcacgattttgtaatggattattttgcctatgtatggaacgccaaaaaacttggctgtagagcccttcatccaaatagtcctcaaatgctaaatagtttaacaaaagtttttactaaattttagcaggtactaaactttagccttatgaaaacagaccattactttgtccacggaccacggcacgctgtgcttatcaattttgtctgtggcagatacgaaatggtaatttgggttacagcacacagcaagcattattttagtcattttttggcttgagagagcagtgaatggatgcttgtgcaaaccgtagagataaacgatagtacagtgaaatatcgacaacatgattgctaataagtcaagaaagtgaggacgatacacccccttcgtcctaaattaaaaattatttcaactttgtcaaatagtcaaacattataattattgactaaatttacataataaaattatataatttataatagtaaatatgcattattagatttttattgattatatttttatagtgtacctatttaatatcataaaatctttatatttttaaaattttgattggttaaatttgaagtcttataatttaaaacgacggaatacataattgtgtgttggtacaatcatatcttatatcccaacaagagaaacccttcatggagatatttgggcgagacactagacagtcggcaattcttgaaaggtctttgaaatgtcagaagacagattccgtgtctcagcgtgagacattatcttgatacatcattttcgggaaaacaaaagatggggatagtttatctttaacatctcaattaaggtactgcactgaatttgtgaagccaggaaagagcaacaagactcccaataaaacttgaaaagaaaagaaaaaaggctgatgcagaggaaacacaaacactgtgccccgtcaaattcagagaggccaccttggtctttgtttggctaacacctgcaatctcttataaatagcacctcacctttagcaacatggtaaccgcgcgcacaatatcccgatcctttcattcatacatacataaaccaccggagaggacaggcttgctagctgctggctctgcaccctgatctctttctccagttccacttgactgacgacaacccctgactctttgaggacaaagttgccatccataccaaggccgtgg

SEQ ID NO: 8560 - DNA, 1500 bp, Zea mays
ttgagcctaaggtttgtagaccctttaattcagacaagggcattgccatttcccccgtaatttcgatgcagctcctttagccatataacaatgaaaaccagcgatcctgcaatcctgaaagggtgaatttatgggagaagcgtacaactcctttaatagccaatgattccaatgaagcaccagcctacaagaataagatagataaattaacagggtataaaattgatactaaccacatgtagtaaaagaaacttaatccttccaccacatcacgtatatgtgagtgctccctgttttttcattacagtcttgtgatttccattttatgctcgatgtaggtataggcatctgatggaggacgtgttgtctctactcccgcatgtgaagaaggacaaccaggacaaggtcgagtccaagcagagcaaggggaacacgttgaacaagctgcttgagctcaggagctgcttcagttgcctttcttcgaggtatagatattctactgtgcctccacacagctggtggaaattttgttatcatagatacgatggcggctgcttacatgtgggagtcttacactgtataagtcagtggcgcaaatcaaatctcaaacttgggtttggtccacctttcatgaaatgaatgttttctgggctttcaggtattgagtaaggagctcccattttgctctggtgccaaattctctactaggcaattgacgtttttactgcatttgtgacatctgccttcccacaattataattgttcaatatatgtatgcattagacttatcaattttattaacttattgaattgtatgtgcatgaagttttttctttcatgtattacaccacatgacatagttctttaactaatggcagtgtaccttttttaacctttagatggctaaattcaagggagaagatgatttattagcaggctctatgagcacagctgcacagtcaagacataattcttgggcctctgcaggtgattctcacccctacgctgacattgcttgcccttcaaaaatattcagtcaagacaaaaaagaacttactaatcaaatgtcattatcagtcaatactttaagataagtagaatcgatgtcccatacgacattctagccacgcacttaaacatgtgccagatatgttcagatcttgtgattcagcagaccttgacgccgagcgggcctccgcggaggcagtagccagatctggccattgagtgcccygacgccgctgcttactcatccatcgccgcggtgacctgctccccctcgggcatatctgtccattgacaccaagcatgttctttcttgaactgttctaaaagttcagtttcatggttgtttattcttttgatcaggaaggagagaaagggagaatcagttagaagaaagaagagtctgaaagctgagtaatttacctcaactttactacccatgttattaagatctattgatgatcgtcccacttactcgtatgatgcacagactta

SEQ ID NO: 8561 - DNA, 1363 bp, Zea mays
tgaaaattctttaaaaaaagaggctaaaaacaaaaaaaaaattcggggtctgctgcctgctgatacattcatacacacagacacaggtagtcaggtagatgatctgcagcggaggcccgccgcgaaacccagcacgaccgatccatccacctcacaccgcgtcttcgtccagctcactcccccgccgcgcccccgctccgctcccctctcttcctcgccgcgggtcgcgcgcagccaggcgccgagccgccgaccagtaaccgacgtatatctcatccttccccctcccccctgcacagccccctctacaactccccgattaaaccctagaatctcccaactcccaaatgcgcgcccccacctaggcccccgaattcggcatccgctccgcggaaggtacgggatctatcgcgctctgctccctctcctcctgcgctggtctggttctgatctagctcgagctcaccgcgccgccgcgttggcgttgtgtatttcgccgccggttctgtgatttaggaatgggaaatttggatccataccattaaatcgttgccgctgctgctggtgtctgtttgtctttgtttgggatgctcgtgcatgggaatttcccccgattcgttttttccggtgccgcgctgggatggtttcagccggaatcgggttgrtgcctcgaatgaacttttacttgtttgattaggcggaagctctgaggtttccaggtgatgttgtgtgcacgcacacacctgcaactcagctgctgcgcgtttcctgggcgactctgtagctgcaaggttttggtctggcgtcgacgacggtcatgccatgtgctactctcgtgtagtcgggttgtttgttaagtcacartctcccactctcccgggtagatgctctccaggactggacttcaggtggtcaggcacttctcatttacggcttgcttggctcggtatcctttcaggcgctgcttttactgccttatcgaaaagactggagttttgttgccatcttttgcagagcccgaatataggactttggctatcaatgcctgggtggtgagttgggaatgaatttttatttggcttccatgtgcctctatggtttacctttcgttatgtttttaatgggttccttttgaggacctgaatattcgatgcagttacaatgtcagaaacaacagacaagagcatccaattattttaccgcttttattttcatggaagcatccaattattttaccgcttttattttcatggttattccatcttcgggacattatttaagcatgaagtgacttctagattgcaattaatgttgacttcccaatgttacgtgtcttgcaggtgtgcaagccagggtgcacaca

SEQ ID NO: 8562 - DNA, 1500 bp, Zea mays
tctacgcccctgctttcttcttataatgcaagctgcgtgtcagcttcagaccacagctgtaaatgcagtgacagcgtctgcgcaacgcggccacgacgacgtgcgcactgaaaacccgtccggcgtgtatatacgatgcaaacagcagccccctcctgaattacactgaattcttactagaggtctgaattcttacagtgaaaatcttattgaacgctgctgtgcagatctgctgggtttccctgaaccaaccgccgcggaaattggtgggcggtggctacgccagtgcgtatttgcgtctgcagcggcgtggaaaatgcgaggggggcggtcatagaaagcagcggtggagtggaagtaggcagagacgaaggcgcgcgagggagataccggcgacggcgatgcggcagcggccggagaaggaccgccgatcagcaaggcccgctcaatcgacagtcccgttcgtcttcggcgacacgccaagcagaagctgccaagtacagtggacaattggacatggtgttctcaagccctcgacagcacataatataataactctaaaaaggaaatctgaagctgccaagtacagtggacaattggacatggtgtcatgggaaatctctggtttgagttgagactttcagaagtgtggtggattcgacgagagctgggtaattaaagtccatcgccgagtgatcggatcgggatttggcccctgcagatctcgccatgtgcgtatgactactgagcgtacgcgagcgagacactggacggacgctgcgtgcgagaaaaaaataacgtcggccggcgacaggtgagcactgaggcacccgtcgccacttgaacaacaagcttgagctgaggccgggagaagagatcgaagaaaaccgacggctcaacgagagctgctcggcgttggcgaccacacgctgacggacatgccatcgctctcacagtctcacctcgcccgggttcaatcacacgctacgctccagcagcagcaccagcaccaccaaacccaccgtcacttgcggccgcaagcactatcacgcgaaccgcacaagttaaatgaagcttcgtggctctgggtctggacagggctgcgctgagtgcgggctcttcctgggcctgtttgggctctggggccgggctaagcatgcattttccagtcacatggcctgctaaatcactgaattgtaagagggccccggggtggagccgctgcaagatgggacttttgaaattttaaaaacgcacactgaactgaaacaacgctgaagcaaacggagcactactgattctgctaacaaaagaagagaaaaaattactaattctagccatgcacggtcagactcgagaccactcatgagaagaaaagatgcatggagaaattaacagctggcttcatcaacattcagggacagatccaggttactagaactccagaagagaaacaaaccgcaagaagacgagctcttttgtgctcgacaagcacgaacc

SEQ ID NO: 8563 - DNA, 103 bp, Zea mays
gtgtatatatagagagagagggaggctaatgagtaatagtatgtgctgatcaaacaagcacaattttttttttttttgcattgtgaccaccatagcacacacg

SEQ ID NO: 8564 - DNA, 459 bp, Zea mays
tggacgcagcggcctggtgtggagtcggaggcggagcgccgccgcctggctgcgctctcgagtgctgcggcctgcggtttcggcagtgctgcccttgctgttgcggccttgcggggtccggttctcggctgcttcggtgttgtggtgagacgggtgagcggagcaatcttacgatgccgcgagacgggtgagcccaaccaataatttcattgagccggcccaatcacactgaccagagctatgttatccaacccgataccacaccaaacccacgacggcaccgcagcaacccattccatagccacgcgagtgacgcgacgcgacgcacggcctgcctgaggcagcgcatctgcttggcggccgggagcagccgccgcttcgccttcgtgagggtttaagcgacgaagagaaaggggaggaagcgagcccccaggaaggtgcagagggagagggtgggag

SEQ ID NO: 8565 - DNA, 424 bp, Zea mays
ctgcaggggaaatgcaccatgcagcgcggctcggccccagcccccagatccaggcacgcaaccgagccgcggcccccctgcgcccttgtcgtcgccgcaccgtccgtccccgcccgcgtcaatccgtcgtcgtcgtcgtctcctcgtcaccccgcgagcttttttcaccgctgccctgccctgcccccgcgcccgttgacgtttccggcccccaattcgaaagcctcgcgctccccgttgctcccttccttgcctaggcggcaacgccctcgtgctttataacccagcggcccctcccgcgtgaggcaaccgagacgggaggagaccagaccagcagcagcccatccgaaccccgcctcctcctcctcctcccgggttcgcgtgaggctgtgtgctgctgggaggcggcgccggcgccggcgcc

SEQ ID NO: 8566 - DNA, 579 bp, Zea mays
atctatatttgtattatttgctaacataattctgtagaaattttaattagcttgatcgtgtggttcggttattagaaacccaaacggaccagcgcagggctgcgcagcgttacgtgttctagtagtattccacgcagtctatacacactactccgcgtttgctcattgcgctgtacctgctgaatgccacacacaccatcgacatcactgcgcgtctgtacccagacgtcgtggcccctaaaatactgtaatggagagccatgaacacgtacgcgaggtgggtcccaaatgccaaccacttcgcaacttgcccagttgccctcttccgcatgtccctcgctggctggctggctggatggcccccactccaatcggcgaggcgaggcattctccgcaaacccctccacaccccacgcactcacggtcacgcagaagccagaacccctcgtctcccggcgcctgttccccgcgcgcaccgcggctacacataccctctccccatcccatttcccagatcccaccaacgcagcgcagggatcgagtagcccaccaccccaccccgcgacgctaaccgacgca

SEQ ID NO: 8567 - DNA, 549 bp, Zea mays
gtgcattcatacaagacacaattagattgaatcaaagcctctccaagtcccaattccactcaaagcaattagtgactagaagagagagttttgcccgtgttctttgagctcttgctcttgtattgcttttcttcttcccatttcttgttcccaagtcatttgtaatcaaggcaagagacaccaattgtgtggtggtccttgtggggactaagtgtcccaattgattgaggagaaaagctcactcggtctaagtgaccgtttgagagagggaagggttgaaagagatccggtctttgtgaccacctcaatggtgagtaggtttgcaagaaccgaacttcggtaaaacaaatcaccgtgtcacactcttcatttgcttgtgatttgttttcgccctctctttcggactcgactttatttctaacgctaacttcggcttgtagttgtgcttaaagtttataaatttcagatttgcctattcacctcccctctaggcgactttcaattggtatcggagctcggtacttcattagagcctaactgctcgaagta

SEQ ID NO: 8568 - DNA, 1500 bp, Zea mays
ctgtggtaactgtacatgagtggctacgcgaataaggtaccttcttggattggatcaaaccacaccagtgtgcctgtttgataagatctggtttgattgtttgtcaaaacaaaaccatgcatggctacaactaaaccaacccttcttggcgtgaaagttggcatggctaaacaaactcaaaaggcagagtttttttacggctcgttcatttgtctcggattggtgggtcagaacgattcataaccggattgtttatctaatttatataaattttgattagctggaacgattccgggtgcaatccgacacaaacgaataaggccttatacagaacgatgcaaacaatgccaagaagatagagtcatttatagccgtcgcatttgtttgargcatgcagctccagccagtctagctatagattccaactgcgactcagtccaaatttcgcccatgcctaatcttttacgtatcgatctcgtgactttctctgctactactactagtacaatcctaggtcgctcccgaattttctaccaaaacgaagcagtaacacgcactgtaacagacatgtagggcccgtgggccaccacccacgtcgtcgcccgtccgtcccttccgtgtccgtcgtccttctccttcccggctcgtgccaccctccctcagacatctcaaatgaagtctcaagtggatagagaattacatatcacacatgcgccttccgcacaatgcagcagagtgtgccggccacaaagtgcccgcccggcaacttttaacagccctcacacgctagtaaattttttagcccttatttaaatgcactagagctaataattatctctaactttttagccgattcaaaccgggccgccttagtttattcatgctgtaaaggagagccagcatccattagctgcagcagctccacgcactttgcaggggcatgcatgtgaccaatcgagaggccgtgcccgtgcccgtgcccacaagatttggtggtgcatggtggcaggatggagatggtggaccgcgaactgcgtcatcagatcgatcagcctgctgacagcctttggagcttcgtcatctgttggttacttgtacccgtgcaccgaagccaagcttgcttgtatgtaatgtacataccgcgttggcgccacagcgctacgtccacgaatttaactcgctgaatccgcgtgaggtggcaggcagccttgtcatgtgccaaggcaaggcaaagcatgtgagcttggccgtgcaacgcctctgcagccgcgagcttctagccctgtgctgtgctgtgcatgccttcctataaatcctagcgcgcgagtagttgcggcgagccgggcagtgagggggcctgcagtgagtgcgggcgctgggtcctgtactcctgtcctgtcctgtcctgtcctgtgtgctcactggccgctcagccgcgcgggaagtgtaggttggtggacagggaagctgagggcaggctgcctgcaacgccaatacgcc

SEQ ID NO: 8569 - DNA, 64 bp, Zea mays
ggaagcagtgctcgtcgactttctccgcgcgaacgccgacgtcttcgtgtggagtccctcggac

SEQ ID NO: 8570 - DNA, 283 bp, Zea mays
taagttagttgcatattttgggttgaatcacttagttgatttttgtagcacgttttgttgaattacgaatatgatattttctttttaaattacctatatgcttatcgcacaaacatttatattgtttgttatattatatgaataacttacaactcagtttggtattgaaatttgtattttagaccaaagacaaagtaagagtgtgctgaaagaagaaattgacctacttaaggtggaaccaaacgaaagcgaaggtaagataagtgatgaggatgcaatagcc

SEQ ID NO: 8571 - DNA, 386 bp, Zea mays
taagttagttgcatattttgggttgaatcacttagttgatttttgtagcacgttttgttgaattacgaatatgatattttctttttaaattacctatatgcttatcgcacaaacatttatattgtttgttatattatatgaataacttacaactcagtttggtattgaaatttgtattttagaccaaagacaaagtaagagtgtgctgaaagaagaaattgacctacttaaggtggaaccaaacgaaagcgaaggtaagataagtgatgaggatgcaatagccatgtctgagaaaataactcaaatggaagagcaactggtacttcttagaattatgatggataacaaaatcagatttttcgcaaagacatggttatgcaacaggc

SEQ ID NO: 8572 - DNA, 283 bp, Zea mays; identical to SEQ ID NO: 8570

SEQ ID NO: 8573 - DNA, 166 bp, Zea mays
ggttagtgcgactgcaattctcttgggtggttcatcagtttccaacaaggattccttttttgattccagcggtgtagtatgccagtttttcctaacataattctgcgcgattttttttgggcaggacttcttcgtgaattcacgcggaaacaagctcttcacttgc

SEQ ID NO: 8574 - DNA, 173 bp, Zea mays
taccacatgcagtccaccgatggagctgcacctgcacctagcgctgctggagcaactgcggccaagcaacggagtcgtgcaacggggacgggggctgcgtcgccggtccacatggagaggagatgagatgagagagacgcttctggaagttcagtgacacagagtacaagtgc

SEQ ID NO: 8575 - DNA, 77 bp, Zea mays
ctgctaatgttcagcatccaatagtttgcattgatgttattaaagaatgaataatctctggccctcgtgcaggcctc

SEQ ID NO: 8576 - DNA, 602 bp, Zea mays
tgaattttttttggatagtttacgtgagtattgttgtgagccgtcgcaacggatggacaaccgactagtattttttttagaaacagataattgaattttcaaattaaaaaatataaatggaaaaatttcatatgaaaaaaaggcccaacagcagcagccttttactactgctcagctcagacctttccaaactcgcgacccagcgtccatacacacagcagcctttttgttctccccgcgagcgctctctttctctatcgactggcgacgactccgccaccgccgccgctctacgcgagacgcccaggtcttcgccaacgacgagcatccggtacgctcacccaatctcttcccttacttactgctatgcggaaacaagcgcccaaaccctaaacttggttatttgtaatcggatctgatgtgatctacaagtttatatacaattgcaaaccccagattacgagctacaggtgctaaacccggtcaaactcagtatatccgtccgatccatacacatctgacgcttaattaatgatattattgtcttattcatattcatgttatggtttagggttagagaggaagaaattgcaaccgaaaca

SEQ ID NO: 8577 - DNA, 526 bp, Zea mays
gattgataccgacaccctgtaactttttaaagaaaacaaaagaaaattgttattgcacgcaaggtggtcgtcttcgttttcatcggcgtgcaaaacagaacttgatgacgaggccttggtaaagtaaagaaagagaacaaaccctgtgtcggaagacacagcaaccgccgtcgccctcccccgccaaaatcgcaacaagaatgtccacaagccacagccttgtcttgtcttctgtatctacatcctctcgcaattccccatcgtcttctacccttctgtcctccgatccccaccctccggttaactcctcaccaagaaaaaggaaccggccgtcctcgttcctgtcgtcgctgttctttcctcgccattaccggcgtataaaaccagccctcggcctgatcgcacagcatccggccaagcgggagtagtccctgtcgtctgtccaccaccctctgcgagtacgtctcctcctcccgtctgtctctctctgtgtgtcggtctgccgttcccgccgccgccgccgcag

SEQ ID NO: 8578 - DNA, 756 bp, Zea mays
ggaggcccaatcagtctctgttcaggttgagcggtcacctgtgccgccgtccactccattttatattttcagcaagcaagatctgattaattaattattattgtgtcagcccaattgccaatttggccgcaccaaacagacaggagagtgacgagcgagagcaagaggacagaggagtgagaagcgcaagtacaaaaaggcaaaagggtgatgaaatttcaatgccccaatgattgttcagccaccaacaactcaggatttcattctactccaatcaagcgagattaaagaaacgattttttttaaaaggtggttgttatttgtctcagagataatgatgtctctactgacttaaacagatacagtatttattaagtcagatgtaattttccatcgacggtgtcagaaaaggacatcgctctgcactaacaaatatcattaccgccaataacgtaatgcgagtcttgcagcttgcgccaccagagagctactaaacacaattcgatcgagagcgagcgagcgagagagagagagagagagagagagagagagagcagggctgaagaagttggaggaatcgctgccagtggaaagcggcagcagcagaagcaagaaccagcaagaaaggggagagagaaagccgaaggacttttcctcggattgcatccttcgcttttgagggaaggagaaggaccctctctgtcctctctccatccttgcggagggcgctagcaggagcagcggaaggaggaagag

SEQ ID NO: 8579 - DNA, 146 bp, Zea mays
aagaggaggacgacggccatctcgacgaccgtcggcagcggttgcgccaccgcccgccactgcccccgcccttgtcgccgccgccgccggatacgccggtgactcttcagcttccgccgccgccgcctcccccgcccttgtcggag

SEQ ID NO: 8580 - DNA, 828 bp, Zea mays
gaaggcaattgatccatgttaatatcatgtgcatcatcttgttatgtactacaaagcaagttcacgttgttatgtatgaagcaagttcaaatttatcttcattacaataattaatatcattgaacttcttcatcctccttcattacattcattatttttttggtccaccatgaaaaatagaaatagcgtggctatttcgcgctaaatttacgacatttaaggctatagtggttgtagctaaaataacgtctaaaagtgaaatatcgtagctttagatccttcaaaagtctatagcccgctatttgaagctttgaattagatttatggtgacataaaagaaagagaaatagaaagaaaataaaaatagtcttttcatcctgaaagtggactgtccaagatattttgtgagatgaagagataaactgatttgtaataatggtacaactgtatcatgagatattatacgaatagattttatttagtatgagaacgtcataaagcctactatattattaatcttgctgtaattcgtctcgcatagacgagagcattgatggatgatgagtttgcacacgtctattgtgtcacgtcatttctccagctcaggtgctataaattacagttcattccttacgtcactgcctctacgtcagtgcctccaccattggtaatatagtttttgcttaattttagttaacacaacacacacacgcaacactgcaacagcgcaaggccgtcactctctatataatcgtggaccacacctctttccctcgaacatcgggctactagcattgttttacacccgctgatactgcaactgcaacc

SEQ ID NO: 8581 - DNA, 240 bp, Zea mays
agtaatggtatgaatccaagtggtgatcttttaatggtatgaatccaaatttccccttttaaaaatagtatagattgaattctccccctcaaacaaaccactcttcgcttcgactcccactcccactctccctttccactctcaggctcccactccccccctaccggctaccctacccatcacacacaaacagccactcctcacctcccccgtcctccggttcatgtcctgctgctcccc

SEQ ID NO: 8582 - DNA, 1500 bp, Zea mays
taatttattcagttactggacacattgtaatatgcattgcaaaacaatgtctgaaattaagagatcaatgaggcatcttaaggatattgagttagatgaggaagtagaccatgctttgcttattatgatgggtgagtacaagaagaggaataatacacaatgtaaaagacatcgaggttcagtttttggccatcaggttcatgatcgtagtagagcagagaatgatagaaaattatatcaagaatactttcgggctgcgagggagaagagcagtagtggcagtgtggaacagacctccgtccatccggtggctcggcgccgtaggggttgcagggccaggggacaagtgcgctagcgacggcgtggggaggagattgatcggaaatgtcggtggaagttgggcgacgtgggaagaaggaatagagccaatccagctgaggcctaaatttaagaccgataggattggatttttgacttgttgatcttttagaaaaaaggggttctgttggaggtgttttttaagagattgccctatatttcaaaatatcaatatatttagaacttctattggagttactctaatcgtatcagctgcacttgcgtacaggctaccggcgtcctcagccacgtaagaaaaggcccaataaaggcccaactacaaccagcggatatatatactggagcctggcgagatcaccctaacccctcacactcccatccagccgccaccaggtgcagagtctttcgtcatctcttctccggcgaagaacccccagtcgcccaccaggtattggcaccctctttctcttccatgtctactgtgtgaaatcgagttccgaatctctaacctcgagctatttggctatttgatgcgtactaatttctactccgttttctagatccggccctgggtactagtgtttcgagatagcatctaatctgaattttttcgttagctgttagttatccgttctattgtgcagcaataccgatatgcagatttagctcgtagctctttatgttcctccgttgctgtcataacggttataattgcgattatatggcgagctttacaatcttagttattatgatactctgtctggtcgaatctactattaagtagaacatatggttttacaattctatgatctgtgatcctattattgtcctattagggctctgatcccaactcagtatcatgatttcaaagaaatttggttgatgggatatgttttttctgtgcccataagttgttactcaagctttgaattaagctatgacatttcagaaacatagatttggtttggattttggttcagggtgcttgttagatgtaatatctgcatagttgtttaaggattatgctcacagtaacagtagcagcattttttctctgttcattgaacgtctgtttaactgttgtcacgagttgacatttcaagttctaacactgctctcatatgtgccttcagatcacttgttaaactttgttgaggggtg

SEQ ID NO: 8583 - DNA, 964 bp, Zea mays
cggcgcccaaatcccacgtcccatcccacacccttgatgacgacgacgagcgtgtcgctgcatctcctctcccctctctccagtctccactctctccacgccgtcctccacgcgatgtctctagactgcagcaaccgctccctcttctttcactctctcatgcgcaccggattcgccttccccgtctcagaaaggtctccaaggaaaccctcgctcccctccttcctcgccaccggccgccagatctccagaaaggcagagaagggtggagccagtgcctcagagagctcaggatcgaccacggtacagtgaccggacccgctatgtgaagcggagggagaaccaatcttaccagagatgatgtttccgtctctgaagatgtaaaatgtcacggtttccacaagtgtccaaatgcggtactgaagatgcagcagcaactccccactactcatatgagaatggcatccgttctgtttgccgcgcattttaagctgtatatgcttattatgcatttgggcttgtacctcagtcgatatgaacgatgtatcctttgaactaacgcattataatttttgaaaccgttttagccagaaattaatcaactgttgatgattatcatatgatataccgcatgatcatctcggaaggggcccgtccgttcgatcgttcccctctcacaaactgctccagtactccaacccgttaaactgttgatggtgacatgatgccacattgccactggcagtcatatgcatgccgtcaccatcacattctggtagagataacggtgatgcaggcaaacgggacgcggagggtgcagcccgcgatctgcaacgtgtggcgcaggcaggtgatccccgattcgctgccttatcctctgctactgccgcaccaaagcgtgagcaagcctgcctcccgcgagagcgctcaaccagccaagccggcgtcagaggcgagcagagaa

SEQ ID NO: 8584 - DNA, 1133 bp, Zea mays
tgaattttgtattggattttgtaccagaatctcataatctaaatatataattagataatagaatttgttgtggtatctaacttctcaaaatttgtaaggagctaaacaccaccaaagtactcaccctaagaccgtataaaaaagtttatctatatggttatccaaaacactgttttatactgttatgcattatagactataatgtttcgtagagtaaaatttaaatatatagactacaaaaggcacagcttcccatggcatcacggccacgcaccgcaatgcatcccaatcccaaaaccccataattttgaacaaatcacaaccccccgttttccaacccaagccaaaccaaagccctggttcgtcggtagtccgtcagcgtggagtgtactgtagccatgtaggtgtgcaatttgatactccctcacacactcccaggcacacgtttccccatacacgcccacaccatccagtccagtccagtccagtctagtccgcctcttcatttcatgctgtattttcatagcagcagtagccagtaatagatgctgccttgcgcggctgttactactactcactctactcctaccagtggagtgtgtagtacgtggtcacaccacaccacggagaatcagagtatcagaccatagtataggagagcagagcagggcgcctttgcatcgcaaggtcactcgtgtccccactcgcctccgtcgcctccacgcagcagcagcagcggctcggtcgccagtattcatagctgggggtagggcgggcgacccgccgcgactgggagaaccttggacatgagttgaaaggccctatcttttcatgtccatgtccatctcccgagtgaaagcgagcgagcgagcgaccgattgattgacgtgtgatgcctcactagctggagagcgctctctcctttgtggcaaatctcatcagcaacagagacggctggtgtgacaccttgtgaaaacgcccgctcgctcgctcagtcgctccgtctctctctccctccctccatatctccctttgccacctgctgtctccctcctcatctctctccagtcgagtcggcagtctctaccactctgcttcctttcccctcctcttcttctccagaaagcagaggc

SEQ ID NO: 8585 - DNA, 885 bp, Zea mays
cgtgcctgggggctaatcgggccgtgcccgtgccggcccagcgtgccctgtgttcggcctaggcacgacactacccatcgggccatgccagcatgagcccggctccagccgtgccgtgccatgctccgggccggcccgattagcccgacactattggccatctataagtggacctgaatcttccatgtctattccaaggtttaagtaatgggtttaacccaaacacgtcttttgttttgttcggttggatcggatggtatggtattaagagagattaaatctctttatatttaattttgattagcaaaacaaataatcttgtttgattctctttaatcggtcttagtaggttgtcatcatatagacgggtgatacaccggtactcatttgattggaactattcatgatcatcaatacatgatcggtgacaaggtcacaatgtactcgcccctaattgccgccctgtctggcaatcagtttcccccattcagatcgaggcatctgtggggtttctgagtttccacttcggctgatctgattgtggcaaaaactcctccgtggtacctatctttgggtgatgcagctaagttaaaacagacgacgccaggtagatgcatggagctgtatgcctgccagagcacaaggcgcctctgggctggcatgccagatttaaccacggcaaagcaggaagccagacacgagtttgttgattaaccgccacaccgttgccttcttgaggccctggtttaaaaaccgagcccctccgcctctcctctctctccaagcccagctgccgtcctgagcctccgtttgcggtgcgacagctcctccaggaccggcccccgcgcgcgtgccgtacgtgccagggacgacgccgggcggccg

SEQ ID NO: 8586 - DNA, 182 bp, Zea mays
atgttcttctatttggcaactccagtatttcaagtttttaagacagattatcaatcatgtattgattgtgatactaccatcacacggtcacttgcagaaagaaagagatgcctcaaagtttgataacgtggtgctgttgcttcaagacatgttagaagtgataacaagagatatgatggtta

SEQ ID NO: 8587 - DNA, 704 bp, Zea mays
ggtgcgtccaggctcccacatcccattgactcaagtgtgccatatatggatttcagcgattattctatggcgcagtcagaattttccaaaagaatagaaaccctacctttaatgtcagaacctaacctttcgttgcttcctcccagatttttaaatttggggttgcagctgcagtcaattccaggtgaacccactctttggacaaaatagataagtagatttggatatagtgatatggtcatgcttggtgtagaattcctgtcagagggggactggagaagaggtttgatgcctgattcaactttgggtacgagaaacaaagttgatgtggatgtgttttttattcaatggccccctcaagtaccaattattagggactactctcgatgatttgatgatgatgcgatctgcataccttgttcctccttatttttactttgtttgcataatgtctttcatgatgatttggtgaaccatgccttttggatcgaccagtttttgggtgtccagtggcatttgctttgaaccactacttgattgccagcaaacattttttgatttgcatttacgcttcttgtgtagtttcccagtaaacttcagttagctgcatgtattggaagccatgagaagtcctcagatttttttcctttgcttcattgcaacctgttcactgacaatgttcttttttctgtagctgcaggggt

SEQ ID NO: 8588 - DNA, 112 bp, Zea mays
ttaaatcctagatttgccactgggaagtgaccgagagaaaactatctgtgccacttagtggtttgataaactatgttgtgataccaagttaccaacgttttgaaatcaataa

SEQ ID NO: 8589 - DNA, 1500 bp, Zea mays
aatcggatgaagataaagtttgtatgaaaattgtagagctcgaagagatctataactttgtagtacatcaattttttgtttaaacacatctttagatcaaaatcattgaaataatgtccaaaattatatcatattaatagactttatcattttatgtgtgagcttaaggttatctccatgtgggaatttaagattttctttttatatactatttattagtattggtaacttatatgcgacttttggtcgacgctacaatattttatggatttaattgtattttgatgattttctacgacaagaaattaataatacataaatagcctcgaaaaatcgtgaaattttacggaggcacaacatttatccatatataaacgtaaaaaatgtttggatcataagatctataagatacccgcgtttattctatttcactttcacttatttgtattagttatatgtgaaatcactgtaagtatccaagtttcaacataatyagtactttactttatcattttcatatgaggaattgagttatcttcgtgtaaaatgtttattagttttgtaaactatctgtattttttgagtgaatctacaatattttatgaatttttaatactgtggtgttagttctacaatgtccttgtgattagtaaatttgaattgtatgatgtcaattttatcgttttactttcctacatttgatttatcatatacatgattatgtattgcttaatttatgtatttgttggatggttcgataattaatatcatagagacgaactacccgacaactatccggtacatatcgaccgaattattacccggtyycatcatatatctgttccgaatcttaaatacccgtattcggtaccgtatycgagagaaatatattaagataggatacagaataaccttgtatccgactgattttcatctctatttccagtccgtcgccgtctccactccacgcaggcacgcacccatcatttcatcaaacgccgctcccgcagcccagcctgttgttggtactgatccagcacctgcaggctccacctgcaccccatcgtgcatggacgtggagccggcgacagcgctgtagtaggcgggcattcgccactgaatccagtcaatccacacaccacaccaaccaaacagctcagcgcgcgggcgcggcacacgtagatacagggcaccaaacaccgcatctcgaacccgtcacgccgcgcggtgtatcagcaaaaaaatgccccacactcccacggtcccacccggcgtggcggctggcgtacccgtccccactcgtcgcccatcttccgtgacgtcaccccattctccatcggttcccttcctcgcctcggttcgcgggtacccgagtcgcagacgcacctcaatcgcaaccttttggactcgaaggggggcaatagacagcagggaaagaactgagcgaggagattcccaaggatctcgtcggacgctagaggaagggacgggggacaggcg

SEQ ID NO: 8590 - DNA, 471 bp, Zea mays
ggtaacaaagctctttgatcctgtatgcaggtctcatgtcttggtttttcttaggtcctttcggattcttagggaaaactggttgaatcactgtctcttttttctcctgaaagttactagaaacgcctcttgcttttatgcctcacaaacgcacgattctgattctcgtatcttttctctattggcaaccatagttttttggttagttcttctagaattcagtaagttcaaatatgttgcatttagttgttctaggaccaccagaaaattgtaaaattatttgaataataatccagcttaccagccagattgttttcgtggagtatttctgatttcaaaagcgtttttaagagaatataaaactaaaattattcacagtgatgccctatttgtctgccaagaatcagttaacacgggtattttttatctggctaactggtcaggtagctttgatgatgtttcagtaaccta

SEQ ID NO: 8591 - DNA, 1469 bp, Zea mays
gaagtgacggcggtcacttcggctctgttggctgaggggggcgcgtcaggataaaggtgtcaggccacctttgcattaaatgctcctgcgatttggtcggtcggtgcggcgatttggtcagggttgcttcttggcgaagacagggcctcgggcgagccggaaatatgttcgccgctggaggggggcctcgggcgagacggaaatcctccggggtcggctgcccttgtccgaggctaggctcgggcgaggcgtgatcgagtccctcgaatggactgatccctgacttaatcgcacccatcaggcctttgcagctttatgctgatgggggttaccagctgagaattaggagccttgagggtacccctaattatggtgcccgacaagtagtaaaattccgatacaatacaaagggcagtaaatcatctatctttgcagttgatagatgtagtgacaacatatgcatatgtggtcaatagattatggtatttgtggagtcttgaaggattcaaaatacataatcaccaatcacaaatttgcaatgcttggaaagtctttgtgacttagagcattcaggtcaaatatggtatatttgacctagtgaatccttccttccgaaaggatacacgaaaatggtatgtttagagtaaatatgtgtaacatatttctaaacatacattacttatcgacggagttcgagatagaggatatgaattgaaagaggttttcaattcaaaataaactatcttgagtatcttggatacaaaattgtctatatccaacatatattgaagaaattcaatatgagagaatcgttgttatttgattcttttcggatcatgagatgtgctattgtatcttgcaagagcatccgactggatattgctttgcaatgatttgctagctaacagcacatgagatcaagttatgatctccagatgtactcatgctctccttatgtttggatatactgatcttggatatctatagaagatccccaggtacaagatcaatgacatacttccagtaagttggacctactgtttgataaatgttgatcaacagagattaatggtcacttacactaatcattctatagtatagaatgatatactacatacagagggtatgtggtggtcatgatttttatatcactgaccttattatctatgaagataatattactttgtgttgtttagattaaaaacaagttaccaactaagtctctaacttactccacattttaaatgtgtttgtgagtatgtatgggatgacttagtgttttgtaaagatcagggggatttttccctcttgatcgaaagaacttgtttatacatcatgttgtactcttttcttcgcatgagtttttccctgcttgggttttctcattcaaagtttttaacgagacaacatcaacacaagacctaagacctatgtcgtatcatctatttttcccgtagaggttttcaagg

SEQ ID NO: 8592 - DNA, 52 bp, Zea mays
atctggaccatctccatctagtagtgaagccttttgtgatgccctgggtctt

SEQ ID NO: 8593 - DNA, 943 bp, Zea mays
gtttgtttagggcttcccctactgttttcgctaaaaaacataggcaaattagaaatatataggtatatgcccgtgcgttgctacgagagttaaaaattagtgtaaaacgtagatagaataacaaacatcattataatatgttatcacgtatcaccatgctgcaagtctaaataggatggaatggatggctgatggagtcttttgtaccctatacaaaatcagtgacccattgcaagttccttcagttacatcagaaattcagaatagcatgtgtacctctagtttcaaggatcttccaaagccattcagggactatatcaaaaccatatcagtaacttagtggttattagtcaaggcttaaaagctcaaagactcgtagtattacattttttttatataacaacaattgattgctagaatttaaagatatcacttggtgtgcaatgcaatcgagggtggatcatgctaaggcatgttctaaacctctaaacttaatagttagcggctaaaattagttgagagattttaaacgcactaattattagttatatcttttaaatagctattagttgttagccgcttcaatctaattaaaactagttaatttataatttatttgacttttttacctaagtttactagctcatcttattcaaaagatttcataattgttattaatttttactaggttatcttttaagatataatataatatactttaaatgtggctttgaattttttttgtttttcccgtaaaaatgagtaagacaagcgtgataaaaaaagttaaataaattataaatcagaattcatgaatcattagctaactaatatttagctttagaggtttaacggaggacttcatacaatcatacgtcgtcgttgtagaaaaatgctacacgttttacgtttttatcgtgtagccgagcaaaacaaatactaa

SEQ ID NO: 8594 - DNA, 97 bp, Zea mays
tgcagtggttactaatatactgtgctagccactaggtaatctaacatttctgcaacgataccagcttctcttcttgtttacatggagtgcaacagag

SEQ ID NO: 8595 - DNA, 243 bp, Zea mays
ggtctgtgatagactactaggctgaatacctcatggaatcttggagagaaaaggggatcttggagaggtttgtgacacactactgtggtgaatagacctatgcagaagagaaaaagggaaagagagaatgttctcaatgaattgaagtccctatgtcaaaaacaagagcaaggagctgttgtacaagtggcttgtggaaggagcatatcatatatttgtaggagataactttacacttgattc

SEQ ID NO: 8596 - DNA, 1500 bp, Zea mays
aagatgacttaatggttgggttggatgaatatcatggtttcatggccttgatgagcttcagtttgtctagtttggctgcctagctatgttccttatgctccaagttaaaagatcacatgaaatgtcaattatatctgagaaaaatcattactatttcattgaggttgagtgctttaatcagctgatgcttgtatggttcaattgacatatgttgttgtaatgatcttgcaaactcttgctcattctgtatttatctatgcccatctctactgtcaatcttgctcttttcatttcgtcgatgatgacacaattggtggatgcatttgttggatgcatgtgcttttgctatctaagctgggatgcacatctgtgtgatgtctgactatgttgcgttcttctttcgtggcttctttgattgtaccttgtagccagcaatgacatgaattgatgaagttaagttaaatttgtctgaggctaactcagctgatgcttgtattgttcaattggcatatgttgttgtaatgctcttgcaaacttttgctcgttattttttattcatctatgtccatctctattttctgtctatgggccaggccgactacggccatctgccaaacacattctcggtttggcagttgggcagttggcctattagccaagctgtcaaaatgggtcgcgaacacgatctcgcctgggccgagcttatttcgtacaggaacacaaacaaagtgacttgcaccaactgatgcatcttgttcgtcggagttcttattttgaccaaaacatgtgcacgcttctacggtgatagaacacgtccaatgcgttatagccctctttggtcgctctctaccacccctgtccaatgtgttatagccctctttggtcgctgtacactgggcacatccgttgttttgtgtatgtcctcagacacgctacattttttttcttctaaatgttgtatctggtgcccaatcagatgtggtgtctaatgcacacctacacatttggtgtaatctgctgctgaagggtagccctttctcgctacattactcctcatattcggtgttttatttggtgcctcacacggtctgatgctgctaacaagtctgttttttcttcatgtttccgctctccttcggtcagtcttttttttttccatcttgtgttttgtactcttttgcattattcgacgtattttccaatgcctttgcttaaagtgatgattatatggatcactcatttgcctccgtccgaatctactgtgtgaaagagacacagtaacacagcagcacgcccccactctcaagtttcgtcactcgatccacactctcaaccagctcattaaatacaagagcatgtgcagaaaacaagctcataatcgacacacacctaacagagtaacagacaccaaacaacgcccatcactcgcgccgtacatcctgcctcctcccgcgcgcgcgcgcgcgtgcacgctagctagctgccggtcgcctcgccacc

SEQ ID NO: 8597 - DNA, 678 bp, Zea mays
gcctggaagacaagccccagcagagtgggccttgggcttggacttcagggagagtgtggggattcacaggattcatggctgcaagccattcattggaaggggtggagatgagaagtgattggattcaaatgggaagattctccttttacaaaagctggctcattgtaaaagctgacttattcacctccaaacagggtcacagtagctgtatgagtgctgcaatgttaatataaacattgtacgtttataaagcagtttcatgaatgctctgcgaaaagcaggtatacatggtcatgatcatgattacatgaatgacttgtttctgctgtaaaattacatttcattgcgccatagaagtaaccattggctgggcaagaaaagaattgatgccaggggccaagcagggtactacgggacagagtctatagattcgatggttctagacttctagtgccaaattgtgaagcatgggtggtcctgtgattaaaaattaagtgaacaaatcaatgggtcattaagaggacatgtactaataagttgggagtaccatttccaaaatgttgccttttcactaatctctgagttttgccccctcatttattcattgttatacttgtgcaggttagtgagggtcttgattttgctgatcgtgctgggagggcagtaatagttactgga

SEQ ID NO: 8598 - DNA, 1491 bp, Zea mays
cgacctgcaggggcgtgagatctgatttgatggaggtgccggatttttttcaacggataggccaaatttatctatctgttctataatataaaaggattataaaaaatcaataataaattacaaaataacttttcaggagctatcttattttcttctatatccatcgttcttactatattaaagcttctgcggtcgtcctgcgttatttttaaaaaaaatgttttatatatctttgaaattaactcgcggcctagattaaatgtaatctatatcttatttattcgcacaacagtgttctcgtcgtcgtcgccctagaaacaaatctcgtccatttcgcaacaacctccaccagcttctccctcgcagaccagatcagatgacatttatatcctatttattcgcacaacaatgttctctccttcgtcgcccctagcaacaaatatcgtccatttcgcaacaatctacgtctgcttctctcgtcgttgcacacccatgcctcgcctgctccttggcgcccgccgtcgtgcctatgtgtaatgtcccactgcccctctaatttacttcctttcttttacttcccctcgctcacgcactacattgaaacatggtatgtgcaggctacgacagcatcagcgtgtgagggcgccggagracggcggcgcgtgccgaccatcggtcccgactggcgctcgttccgcgcctatctgtacttcaaggagcagctctttgatcggagggatgataccttgtattttcgagacatttactagaattatgttcctaagcaattcactagtgttttatgatggtatgggattaccatcacttacaattgcaaataaaaatgtctaaacttaatagtaggggtgtgtttgaaaaaagtcctacattggtaactctgacttttgatatggcatgacagctttacgtttggaacaagcatagccctttcatccatatgactatatgagctttctaggtctgttcacctttacgactgcatacttaccatgggtagatgttcttttgccccgtttcttgaatgcccatcaccctatggattcacattttaagtaatttttatagtgaacatatttgtatgaaaccaatcatctttattatgtggttatgtctgaatgttccatgacatgcgaaatgtgggattccgttggttgcacgtccttttatattaggtagattttttgaaacctgagaaaatggataagaatacttgtagaagaggaatatgcacaattatattaggtcgaagaagccgccactgccggatctggcgcagcgctagggcacaacgtgcgttggcgaggcaggcgagcgtgccgtgggtctgcgtgcccttggagctcctccaggtgacgtagggccatcacgccaattcacagttcgagatccgacgctggagccgccgctccaccagctcatcggcggtagctccgtgcggacagcgacgtcgacgcgtcgtcatctggtggc

SEQ ID NO: 8599 - DNA, 354 bp, Zea mays
ccaattctcggtaggaaaaaattgggcatttcccctttggctaaaacccaccgtggaaatgggccccgtgaattttttcggctcgtttggaacgcgctcacccgggccagcgctctcccgacccggcgcacagttggacagttggtggcagagcggacgacaacgcacgcgcgcctcttcctcctcctccccgccgccgccgccgccgccgcgcgcgcctttgcgtgccccataccgtctcctccaacacgctcccctcgttggcatcaatttcccatcccacctgtccaccgtcgcccgccgctatctcgcacccgaacccagcgcctccctcgtcgccgccggcgcgccgcc

SEQ ID NO: 8600 - DNA, 502 bp, Zea mays
gttagctagctaattacactaataaattttagccaactaactattagttttagtgcattcaaacatcctcttaaacggccaaccaatcagatagtacggggaaaatatgaccgtgtggcgtgtgcaggtgcaggtacacattcacgcgaagtacaggtaaacgggcactccggacagcattactatttactgcatcagtaccacctccgtcaccagagccggcgccgtccgacttccggccatctcaggcacccgaactccgccccgatcccttgcttcaaaaagcaaaaaacaacaacaaaaaaaggactgaaagagaaagaacgccggagcgggagcctgaccctgacgccatctctccatccttctcctcctccctggttcagatctctcatcgtcccccgctgcattccatcccgaccccgtttgccactggtcacaccctctccatcgcttcctgccaccgaccacaccctctcgatcgccattcgccaccggccaa

SEQ ID NO: 8601 - DNA, 300 bp, Zea mays
atagtatttgttcgcagtagccatataaggagagagtttctaggttttgatcgtacaagtttcttttagcctcagtaaacacatttcgttattactaattttgtgttgctgtcccttaaactatgcttttacataattatttttcatcaatatttagtttgaatagttgcatttagatggatagtttattaacgttaaaagtacaatctctatttttgctgtacaacatatctaagttcatatgtttgattatgtgcaggcttcataagtattattgctttattgctttaatattatcat

SEQ ID NO: 8602 - DNA, 1500 bp, Zea mays
taaaaaaaatataaatacagcattatagtgaatatatagagaatttgatccgtagtatataatactccctctgtctctaaaaaaatgtcgtttgacttttctgagatcatgtttgaccagctcattttattcaaaaaaattyataattatcatttattttcattacggtttagtttatcataccatttactttaacaataaactaaagttttctatattttcacaaatattttgaataaaacaaattgatcaaagttggcctcaagaaagtcaaacgacatcctttgtgagacggagggagtaatacataagagaataaaaaataaaatatatcgcaccacaaagggatcaaaccagccaatctccaagatatgagcccaaaagctacagaccacctaatcacattctctctggtgcttgaagctgtaaatgttttccatatagtttaaaacttcagtgtttaatatgtgttggtcctgcacctgcactacatatatggtataccatggtcgctctatccggcatatcctatggatccatccctagttggagaattgagaagaagaaaaacggccatccgcacaaaggctcacgtgtattacgatgaaggtaggtaccatcgagcgacatggttgcggcttgtgcggcgtacgtgtttgtgggactctccatccatccccagcacgtcactctctgcttggacgaacgcacgcagatgcagacgcagtggaccattcgtagtaccgctaggttgtgcgtgttctctagtgacgatacgactgacgacacgaacagatcagccaggccagccaagaagcgcagccacaggcgatccgggcggcgcctgtgcatggccgaaactggagtggaatcgctaggtgcacccggggggtgatagaggattcgcagcctggcgaagctagaccggacgatctggaggcagcggctgcagatggataaggcaggcaggcactcctgcaggctgcagcaccctgtgggctgtgccgtgggcctagcatagcagtaattaataattgcgccctgggggagtgagtgctggtaggatggcgggacgagtggccgcatccgcgggcaggctaggctcgcatcgcatagcagctagcgtggtccgcgcacgccaggccgcgggccgggctgggccggccggggtcgtcgcgcgccacggcctttaaatgccacaccatctcccccgctccaaacacccacacccacaccacacctcacgtctcctcactacccgcgctctcaggcagcgcacctcgctcctcctcccccacagcgctttccattttcgtctatctcccgagaaccctcctgcgcctcccaaagctctcttgttcgttgctccccccccccccccccgtgctggttaatcatccccttcgatttcgatcacatacatataatctctctcagctatcgcggccgcgcgcctgatcgacgtacgaccggtctggtacgtacgtgtgctcgcccgcc

SEQ ID NO: 8603 - DNA, 169 bp, Zea mays
aggtaaagctggccccattcgttaccttgcaggcgtaatttattcattcagaataaatttttttcttcaatgttctctcaagttaaggcttaagaaccagaagtgtgaggattgtttcgtactagatattctgccttgccttgtactacttccttctccgagtattgta

SEQ ID NO: 8604 - DNA, 1354 bp, Zea mays
cacatctaccatattaaagaggaaaattgtaaaactaaatatcataattgtaactaataatgaagttaatgtggtgccataaataatattgttactttctataaatttatatagtgcaacgatgtgaaagagactctagccgaattggttatgtgatatgagtagcactcctcatgtcctaggtttgactcctcatgggagtgaattttaggatgtggttaaaaaaatcctctcaagtctaaggctcggtcacgatcgtttctcacatgggctacgataccgcggtcgtataataatcattattatgaagataaaatgtctcaacaaaaataattgggaggcccaaggaattgaaccccatatttatagaaaagcttattaataatgctctactgattgaattacatctgctccatacatgactctctatctctctcccaatctccatggttatggtttttttcctaagaaaaatcttttttttttcccaaacacggtatacatttctggaagttcagctctttctcgtcagacttttgcgacttcaactctgaacacctttaactcaaatagtggtagaagattaccatgtggggaagtggaacgcgctggacaatctcatttagccaggcctatacgctccaacgtcccgtgagcttgcagcttgtcccgactcccgactgacaccaatcaaacgagaaaccctccaatccaacacaccagccatatagtgttgtgtgtgtatggcgtgtactcgttgtcctacagcaaatattgatctgtaaattgtttccttgcggaaaatatttgcttcaaacagaatgacaaaataaaataaaaaaatagaagttattactccaaagaaaatcacaagcaaaataattgtattcatatacaaaataaatgggatagcaactagaatcgctgccactttactatagccaaaccgtatttggatactcaatatagaatctgaactacaacgcacaaatctgaaacgggaatctgaactccatgataaaagaaaaaaaatataccagaaattacatcagcatattcactctgcgccaaattctgcactcggcataataaccagcataagcgttgcatgacgtccaccgacagtaagccacatagtcttcagctctagaaagacaatcaaacaaatcacgagctcaaaaaaaaaatggtatttataaaaactgttagcagaagatttgctggttacagaaaatcagctagatattcccaaatttattagacatgcaatgcaagggccctctagtctagaatatacaacgtaacacgcatcatctgagttaaagcgcaggcaagcagatcgtcctgactcctg

SEQ ID NO: 8605 - DNA, 892 bp, Zea mays
ttctgtcagtgtgggcaaagtgatgataacccagcatgatgaatgactcagctggctgttgtaaccatgtgccgaatgatgaagaaaccgctttgcatatgtctgatgatcaccagatgaatggagttagggcaagttcgaccgctttgcatatgtctgatgatcaccagatgaatggagttagggccagtttggtgcggcggcgcgtctaagccgcggcggctgaatcggccgccatacctgcggcggcaaaactacggcgcgccgtggcggcttaggccacgcacccaacagccccttaaactgctgttacttttttttttgttttttttgtcagattataaagtgctggatttggcttggcaaggtgagaatgagagtaacctttactagcgctcgctgttgctgtgcgctgtgcagggcgcatctatccgcatctccgcccccccccacggtggcatcgcctcgcctcgcgtcggatcaatccatcccctcgccctcgccttctgctcttcctcatcgggggcaggcggagccgcagagggaggagccgccggcgctaggaatccccaatccgtatcgctcccccaacgattttgagtatattgctgctgcttctcaagcctattcttattgtagatcgaatcgatcaattcgctgcatcgactgatagtagatagggttcatacgcccattccattgattcgacgatgttccgccgcgactgtgtgggatcgccgccgccatgacccccggctacctccctccaccttcgtatcccgacgtcttgaccaaaccccaaacctgactccgaccccggttccccgctggaagagtataatagccaaaacacaagcggcccgtgcgcaccaaccaccaccggagcaacagg

SEQ ID NO: 8606 - DNA, 1500 bp, Zea mays
aaggcgtgctgcttccttgccgccgcctcgtccggatcgagcccccgcgggggtccgagtcaccattccactaggggcatatcagcaccatccggcatgattttttctctgacagacaagtcccaaagagagcagcaggtgtgtgtctttctcgtagggttcctccatcagatcagaatatagtttcggttgtctctcccgctaaaaggccaatgcgaacagttaaaagaagacgccgtatccagctgcacaggaagaaaaaaaaagcataatcatttgcgctttgagtgcgtcacccacttgctttgcttcccagcagaaagcttccgttctttacctcaagagtttgtccaatgccaatggcacgtaggctttggctagaaacaagtggcaacggcacttgcttgaagtcatctgaaatccactcatgtggtggactggtggtgcagtttgagaaggctgagctaaggctttattgttaaataatgccaagcgtccgtgcctgagcctcaagagacaaaagaagagcatgagtgagagttgagataagttcaaagatgactgacaaagcactgatagtccatagcacctctcagtaaagcatgctacactacgggtcagctattcgaatcacctcgaaagaagttgcttcagtccacctaaaacttgatatttcttccgaataaagtctacatgatgcaaaataaaaaccattttaaaaataagagggcaacagaaaactttggcattccaaggcgtagaagcacttttcaaatctagcaaccttgtgtattattgccttgctagaaactagaagatttcctgaaagaaacatgtaaaaaaaagcgagaaaacttataagggctagtttggaactccattttcacaagggattcatatttttycaagagaaaataaactaatttaccttggtaaaatagaattcccttgcgaaaatggggttcccaaactagccctaagacttatttttcagtatatattcctatacctatctcgacaaatacaaattataaatgtgagcagtagctcccctgcatgaggtttcaggactgtacctgatagaaatgtataacgctactatctagagcaggtgcgaacctgatagggagtgagctggacaggaaactgaagtttgttgaagccggtcactactgagtactgatgacaggtataccatctcgaagaataacaaggaccaacatgtttgccactactgaagctagcatatcctctggtccacttcaaagtaccgatggctcgccttttctgctgaattattgctgcccgcagacccctgcttctttttatagcaatagcaaagcagggggaggcacgacaacacaaacttcagaaaaccctctctaaacacagcaatggagagagtacctggagtggaagagcagaagtcagcagaccaagttaaccaagctggtctagctgatgagagtaccacagtaccgtggctgaagttgggtcttg

SEQ ID NO: 8607 - DNA, 696 bp, Zea mays
cgttccagatatatagctacatcgaccaacaacatgtataattacataattataataccttccaatgaagaccaattatatgtccaaataatcaatcccacataaatatgtagctacaacacataacaacctgccttcactctgataaagaaactttttgtagactacaccgggacatggagtctccatcctgaaatgcaatctgcgctcaccctacctaataatggcaaagcaatgctgttttgatcatactcctctaggcactaactaataatattccctttcttgtaaactatagttcatgttgactttatccttaagtcaaactaatcccttttttgtaaactatatataatattcccatcgatagttatctccgcagcttacacatcatcctccctatatttaaacttcactctacaaacagtgaaacgatattattaaataatttctaatgataatcatctaatgctattttcctagaaatgatgggtaaactccaaatatgttgatgacttcatgcaactccagtagcgacgataccacttactcttgtgtgacgtgacctgacctgacgggtgtacattatatgtttatttaattaaatatatagctaacgttctgtgttgtttgcaccatcagctgacacggttttagggagacggaggcttcgccgtgggcgtaagctgcagcctg

SEQ ID NO: 8608 - DNA, 593 bp, Zea mays
gctgcacggggatactcaaaccaagccacggccgagttggatcagtcttctctaaccagagccacttagcctgcagtgcccaactcatcaattgcaaattaggaacaccaagaccccctaaacttagtggccttgtcacactttcccagggaacaatacaacttccaccattcaccttctttcgccctttccaaagaaaccctcatcgaatcttgtcaattgatttaataacccatttgggaattttaatggcaacaaggagataaatcgggatggcagataagacaaaccgcaccaatgttatcctcccggccaggttcaataaacgagccttccagttagggagtctgtctgcaattttatctatccacagcttaagatcatttcgcttcagcttcctgtctgagattggcagacccaagtaagaataaggaaatgaggccaaactgcacctcagcacattgcagccctcttgaaccacatgctcctcacatctgataggaatagcataactcttattcatattggtaaccaatccggaggccgacccaaaacaattcagaatcaatctaacacatttcaaatcttcctca

SEQ ID NO: 8609 - DNA, 92 bp, Zea mays
ggtattttggacaggacgaaagctgaaaacagcaattgaaattggagatcaggataacaccattgcaatgctggattctcaccgatagtttg

SEQ ID NO: 8610 - DNA, 1500 bp, Zea mays
aaaataattcgtgtgatattataatgttctctcggcattaatttattctatttgagtgggaagatttatatcaacattacatgtttatatcgttaatataatattattgttccggtaatattttgtcatggattttgcttatcatagtgacgtttgtcgttatatatttatattttatactaattttagctttcctggcaacgcacggtcaaatacctagttattattgcaaaaggaagaaacagagcggagcgaaaagcatccatccgtcgtggacgagcgggtggatcgggtcacccttgtgcctgacgcactgacggtcgtctgatggatcgacgccccgcgctccgtgccaagcggatgcagccaccaccaacagcaccaccacggagcgcgggggcggggcccggcaccgagcggccgcggcggacgacaggaggacggtgcgcgttgccccgggacggcgcccgtgcctcccacccgatcggacagccgcgtcagcgcgcgcacgcgcatcacaagaatcttacgaaccgcgtgccgttgctcatcgcccggcactcaacagcaccgccgcccggggctggatcgggtgggtggggactgggggcctgacatggacggagcgagagcgagcgacgctatagaagcctgtattttgcgtgcagaaaatagcatttatttacttctaatgccctttataaactgttacccgttctccgttcccaatcatttccatgacttgatcccgatcgctgtgaaagttgtccgtccaatgtgaccgggttccctcagttccaggataggagggaggactcagcatcgtcactcaccggtcgacgtttcagtcacagcacagcacagcacggccacgcttgtggccgcaaaaagcgcaacacgatacggcgttccttgctgcctccgttatccagtccaagtgtccaactcggcaggcacaaaaaaaaacccgacgcgacgaccagacgaaaccaagcgcaattgcccgccccagaaaacatggacctcagccgcatagttttattagtttatcctggaagacttgggcttgggccggccggtttgactcggcggcggacggcgacgcgccgacgtgtctccgccgccccgctcacatccgcccccgcgccatccgtccacgtgttcgcgcctctggaacggactcccccgcctgcaccttcttttccctcgcgccgcggcgcccgttctttccgagtcccgcggatataactacaaccagccgcccccttcctccgcagctccgctccccttcccccctcgtttttcctctgcrcactttttctcgtttccagccttccaggcagccacgcctcgcccgttctcggatcccctccaaaacggtcaaagccaaaccagccaaatcgcgcgcggcggcggcggcgacgagaacgagacggacgcgcgcgcgcgctagctgaatcaggtcaggaaggaggagagccgccggcgagcacagcagca

SEQ ID NO: 8611 - DNA, 211 bp, Zea mays
ggtgactcggatattagtccagaaacagacctaggctgtttgcaatgttcctctagtttcatctgagggacaactgaaatctgagagtagggctgatgatcaacaggctgctgaaccaacagtttcagttcgatcagtatccagggaaaagcctagtgttgagatcgccaggtcaaagtccgcagctgggaagaggaagaagaaaaaggaa

SEQ ID NO: 8612 - DNA, 1241 bp, Zea mays
agtagcttattcaagcatcatggttattaaaacggtaaaacgttaaaacgttatgaaccacctttttaacatttaaacgtttaaacgaacgttgaaacgtcttttcagacaatacataaaatttcaattatagaatgtgttcatacataaattaagtacttgagttcacaaaacaaaatgaaacaaatcaagttcaaccacacaagttacaacttgtatatatgatcagtaaccataaactcttgatgactgaaagtctgaaactagggagtgcgtcaatgtctgaactggaaaactgaacctggaactcttgatgattgaaagtctaaaactagggagggtggcgctgaactgttggaggatggagagggaggagggggcagaggagaggagaggagaggagggaggctgtcggcactggacgcctggtagccctgtgtattttttggcctgtgaaagacccaatacacgtagaacgtcctgaacgtgcttagaacgtccgaaaacgagaaaacgacgtttaagcgacgtttaaacgtgataaacagacgttcttcatgtttttgctaaaacgaccggacgttctaaactctatccacatttttttgtttaaacaatgcttaaacgacgtttaagcgacattttaataataatgatgttgattttcaggattaggatatgtagcaccgaagttgccatcctattgtaattctattacccttgcataaaattggttgacatgaacaaactagctgtggtcactgtcgattatcaataatgtcgttgatatttgtattgcatccttttggttcattcaaccattccaatgtttgaattatttgttggcgaaacaagcagaagcttctgaccccgctttaccgctctgtagttttctttcatattagacctgcatacttcaccttttatttttctcgcacctatgtttctctttctttcgttagtgcttggcttggtgtctgtcatatagatatatgttttgacataatatgcactttttatgagactgttggttattgtggttattcttgtaccatagcatatgttagaaacttttagattatcttgtttgatttgcaacgttagtcaagttcgcaagaatacttatcacgcatattacatgccacaggatgtggtaattgttgccacaaggaggatcgtgaggccgcccaagaagggttcagctgttcagcgccctcgcaccaggactctgactgctgtcc

SEQ ID NO: 8613 - DNA, 1500 bp, Zea mays
gacttcacgctgaactcctcaccttcgggaaaatccagaggcgcttcgctataattcaccggactgtccggtgtacaccggacagtgttcggtgctccaagaaagggcgtctcaggaactcgccagcttcgggaattcgctccgctataatttaccggacatgtccggtgtgcaccggactgtccggtgagccagcggtgaaagggaaatgtgcccttgggccatttctaagtattttggtgatttaatgtccaacacaagtgccaaagtgtaaaaagatggacaaagtacaaatcaaggagaaaggtatgtttctcagacttagtacattgttttatggactaatgtgttgtgtctaagtgctggaaacaggaaaaatccaattggaaatgtcttggctcaagcagccaagactctgctgagtctgggggcaccggactgtccggtggtgcaccggacagtgtccgatggtgcaccggacagtgtccggtgcgccaggctggctcgagcgaagtggccgctctcgggaattcaccggcgacgtacggctataattcaccggactgtccggtgtgcaccggactgtccggtgagccaacggtcggctgggccaacggtcggccgcgcgatctgcgcgggacacgtggccgagccaacggctagaagggggcaccggacatgtccggtgcgccaacggctctcaggctgccaacggtcgactgtgccatttttggaaggaaatcgggcaccggacagtgtccggtgtgcaccggactgtccggtgcgccagtcgacagaaggcaagatcaaccttcctagattgctctcaacggctcctagctgccttggagctataaaagggacccctaggcgcatggaggagaacaccaagcattcctacaacattcctaagcaccaagacatcgattccgcgcctttgattctttgcgatagcaattagagctctagttgagtggtgaactcattgagttgtgttgtgagctctcgttgcgacttgtgtgcatggtgttgctgtgatttcttgtcttgagtgcgttgctaatccctcccttgctccgtgcttctttgtgaatttcaaatgtaagggcgagaggctccaagttgtggagattcctcacaaacgggatatggagaagaaaagcataacactgtggtattcaagttgatcattggatcacttgagaggagttgagtgcaactctcgtccgttgggacgccacaacgtggagtaggcaagttttgtacttggccgaaccacgggataaatcactgtgtcttctctgtgttgaacctcttgtgattatcatcttgtgcaagatcttcgctctagccacttggcatcaactgtgctaacgcttaacaaagtttttgtggctgtaagtttgaatttcccaggatcacctattcaccccccctctaggtgctctcaattggtatcggagccgttctcttcaagaaagggactagccgcccgaagag

SEQ ID NO: 8614 - DNA, 445 bp, Zea mays
tcagcacgaggagcagagaaaggcggctaggttttctcaccggcggcggctagggtttctgtttcgaagcagctcgcgtcgagtacaatagacggcgtgagcacggagtgagtttaatgttgaccaccgaaccaaatctctctctgttgtccatatcagtgtttgcctgttggctgcgtctccaaaacagagaagccctcggcaacgcctccaattcttcgaaaccgcttctctgatgttttataatggcaattgtctctccgcccgccggaaccaccaccgttccagaatcccagcgacggccgctggctaatcttttcccatccccgaaccaaacccacctaccgttattaagccgcccccttctcctcccactcccgcgcctccctcctttcacacccatctcgatcctcccaacccaaaccctagcggacgcaccgctgcc

SEQ ID NO: 8615 - DNA, 110 bp, Zea mays
ggctccctaaaaaaagaggctaatcctaccagtttatcgggcgactgcgaaattgttctctgagtctgatagactcaataaattcatacttaagattagacggcaggtcg

SEQ ID NO: 8616 - DNA, 445 bp, Zea mays
tggcagcggtgcgtccgctagggtttgggttgggaggatcgagatgggtgtgaaaggagggaggcgcgggagtgggaggagaagggggcggcttaataacggtaggtgggtttggttcggggatgggaaaagattagccagcggccgtcgctgggattctggaacggtggtggttccggcgggcggagagacaattgccattataaaacatcagagaagcggtttcgaagaattggaggcgttgccgagggcttctctgttttggagacgcagccaacaggcaaacactgatatggacaacagagagagatttggttcggtggtcaacattaaactcactccgtgctcacgccgtctattgtactcgacgcgagctgcttcgaaacagaaaccctagccgccgccggtgagaaaacctagccgcctttctctgctcctcgtgctg

SEQ ID NO: 8617 - DNA, 274 bp, Zea mays
tgtaagtgaacttgttggtcctatactctgtgaatagagctttggttaaattgaattattggtgtttgtaattcttttatgtttggatatctacttgtttttatcaatgccctgtattgatgccagcatgatttggctgatcttttttccttctgcctgaaaatgttttgcataacagtgcgtccagtggcacgtaaactgtaactacattgctaccggctctagcgacaaaactgtaagactatgggatgttcagacgggtgaatgtatacgg

SEQ ID NO: 8618 - DNA, 860 bp, Zea mays
acaagtatagaatggagacgagctcgcttgctagtgaagtaatggagaaacatggctataaataatgacagtggcctatgtaaaatagtgcagtctctagtgaagattacagtcacacgtcgtcatcttccatgttaaaaagataaaaagatagacttgatttggattagttaaaaatagaaagatgtaatgtaacaaccaaatcgagccttctttgcctttcaacttgtaaaccaaggcgacagtgaatgttgcctcatatatatatatatatatatatatatatatatatatatatatatatatatatatataaacacgtagatatgatgatgtgcttgcgcataatatgccgagattgcttaatacaataatcagtgggcttaaagcctgctgcattcagcgtgggtgggccaaaggcaaagaaggccttcttccttctgttccgttccgttctgttccgttccgttccaccaggtgaaggaactactgaacgttaggtgtgggccggaccgggccggagacaactccccagttgaagtgagccggtgaggtgtgggtgacggcagcgttacgtatgatgagcttcttcatcatcgttctttcaggaggttgagggaaagaaattaagctgactagtgtctagtaacaaacggaagacgacaggtagtggtagtggactggtggttaattgcttctttgtttgcccactattatagcaggcacacagcccgcacgtcattaataggctacatacaatacgtcacccaacctctcgtcctcttcctctcaataatataatccccttcatccatccattccatatccttagcttccattccatccatcatatcgcgccc

SEQ ID NO: 8619 - DNA, 1500 bp, Zea mays
caacttgcctgacacttgagattccagttaccaaggtgattcttcagatccttgtaacctctctgctagtcgtagcaatacaaacaaacatagtatagacaaaattaacatcacaccaaacataagtacaaactgaataataataatctacgcgttgctacgagatcgcgggatcgagaaccactaaaatcggagttacgattaaggagttatgattttatagaagatttgtgtgattaaaatattaaactatattataaattggttagtgagagcacctagaggggggggggggggtgaataggtgatcctataaaactttaaacttaagccacaaaaactgtgttaggcgttagcacaataatagccaagtggcttagagagaagtcttcaacaaaacacaataaccaacaagagatcaatcacagagatggcacggtggttatcccgtggttcggccaagaccaacgcttgcctactccacgttgtggcgtcccaacggacgagagttgcaatcaacccctctcaagtggtccaaagacccacttgaataccacagtgttttgcttgctttttcttaatcccgtttgcgaggaatctccacaacttggagcctcttgcccttacacttgaagttcacaaagaagcacggagcaagggagggattagcaacgcactcaagacaagaaatcacagcaacaccacgcacacaagtcgcaacgagagctcacaacacaactcaatgagttcactactcaactagagctctaattgctatcgcaaagaatcaaaggcgcgaaatcgatgtcttggtgcttaggaatgttgtaggaatgcttggtgtactcctccatgcgcctaggggtcccttttatagccccaaggcagctaggagccgttgagagcaatctaggaaggctgatcttgccttctgtcgactggcgcaccggacagtccggtgcacaccggacactgtccggtgcccgatttctttccataaatggcgcagtcgaccgttggcagcctgagagccgttggcgcaccggacatgtccggtgcacaccggacagtccggtgcccccttctagccgttggctcggccacgtgtcccgcgcagattgcgcggccgaccgttggcccggccgaccgttggctcaccggacagtccggtgcacaccggacagtccggtgaattatagccgtacgtcgccggtgaattcccgagagcggccacttcgctcgagccagcctggcgcaccggacactgtccggtgcaccaccggacagtccggtgctcccagactgagcagaaacttggctgctcgagccaagacattttcaattggatttttcctgtttccagcacttagacacaatacattagtctttaaaacaatgtactaagtctgagaaacatacctttatccttgatttgtactttgtccacctttttacacttaggcacttgtgttggacactaaatcaccaaaatacttagaa

SEQ ID NO: 8620 - DNA, 1500 bp, Zea mays
tcgcatctttcctctttacattttggtctctggacggcggcattttgtcgctgtctcgccgaatggtttccagggatcgaagctgccttttgtttcgatcgcttgtcgggacggttgtaatcggcgaaagctcgctagaggctgtttttgccgtttccctggactggacgcttgtcgtgcccgatgccagagctcgagaacaaaaccgttatcctttttttttctttctctccacttctcccccgtcggtttcaaattccaatcatctggggcgcaccaattgttgttgtttgcctttggaatcttgaatcttccaaccgctgaattctttttttttttttgccctgactctcgctgtatcgagttcccgactttggccttagatagatagaaccagggagctatacgctcggctcgaacccgactctctccctgcgttgaaaaattcggacagccggaaagagaatttgcgccaattttattttcttttctttttggccattttgctcggcagcgacggcgaggagatgagccgaggccccgccatctgccgcgctctggctagccgttggagtcgcaccaacgggcacatttcctcctggcccaggaggccgggagtgccttcagcggaggtaatataaataataaacagataaacatgtcatcttttacctcgcccatcctttctaccgcaaagaaaaagttggttcctctccctcccagttgcattagtttacgctccataacaggagccaggcagccacaagagcgacggtacttttaacggggacttgcctgtactaatcatcataactaagccactagttagtcgtcctcgtcccggtggcctggacgaccgggcagcgggcacccctccaccaccatttaatccgcttctagcttgtttctctatctctctctctacccccatctctggcagcttggcttcgccattacttggcttgcaggagctggccgtggagttcccgtgaggtggagaccaagccatgactgactcgctcgaccctacccgcacccgaaagagacgcttcgattcctatgcataaataggaaaaaaggagaggaggaattcgagaaaatcaccgcctctcttcctttcttcatcgccctgcccttttctcttctcctctcctctccacctaccgaatcccgtcgctgggggtcctcgatctggttcgcttgctgcgtgactcccagcctctgaattgtcttgttgtgccagacggatttgtgtctcttgacattggattgctgctcgtgttgttcttgtgtgggcaggtcgggacgtgcggtagattggtggtggcttcgtggcgctatcaatgctggtggatttgagcaggggcggtgggtgcgcggatagacgcctgagaaatccgggtgcccggggcagtgctgctccggaaatctgacctgccggcggagaagaattacactaacggccatgctgatggcccggtgaagcgcaaggtagccgcg

SEQ ID NO: 8621 - DNA, 884 bp, Zea mays
atttaattatcgtaattgatacgaactaaatgttagtcatgactcatgatagacgaacagtgcctcagtcatcctgctcaggtggccttttatgaatcgtgtaaagtagagaatgtagaactatagataatattgtttataaaataaagtttaaaatataggatatgatatggaacaagacaggagatagtctcgccgcatgcgacgtccaacggagataaggaagcgattgtacacgtacccactacgtgtcgtccgcgtgcaaagctactagcgaaggtagtaatatttagagcacggagacaaatattctagaacgtagacagtaacatttagagcacgggcattatattgtacacgtacaatatggcaaagagccggagctatttcgaaattcgaacgtgtatcaaaacaacaagggctaaggtaggcaggtagcagtaacattctgcactgtcccgttggcccccacgcgcagcacagtacatgtccggcctggcgggcctccactggcgtcgtcctctacaagcgaagcacaccgggcctacatgtctaggtgggcccccactaccgtcctcctcctcccccctcttcatcgaagcagcctcctccagctcggactcggagctccacataataatatctgctacttgtttcctcttcccagtattgtgattccttccattcgtgaacagaattcccctccctctctagatctccccctgctaacgaaggtcagtcatgagccctattcgcgctgctgctgctgcacgtaggcggccggcattattattgcctttccggccaccactttgcactgctgtgtttccagtccagctgatgatatacacgatgcttcttcagacagaccaccaccaccagta

SEQ ID NO: 8622 - DNA, 84 bp, Zea mays
ccttccttgagggaagcagaaccgccttgaccgacgtgactacggtacggcccccaaacccggaacggcagcgaaacgacagcc

SEQ ID NO: 8623 - DNA, 186 bp, Zea mays
cgttcggtgtaaaaaattgcagatgcagaggaatataaaacatcacccaccaaaaacatatgaacaatgtagtgtttgtgtgatgggttactaacaaagcaactccccgatgaaggcgcaaaatgacactatgtgaaggatgggatgaagaagagaagatgacgattttctctatgccactctgca

SEQ ID NO: 8624 - DNA, 676 bp, Zea mays
tatccaaatatagtcatattctattccggatttctcgctagccaaatatagaaatgtgattatgtgaatgactatctagagtgtatataagatatagaaagacttggaaattgaaaaaaatatagaaagtgattttacgcaaataactctacaaataataatttagcgaactcttgaagttgttctaaagctatctccacatctttttattttaaacttaaatatataaataaaacaatctacattataacacagtgcacaacaatagttggcttggctatagcctaactcaaactccaaacgacaagcaaccacagaagaagcaaacctaccgctcgcagcaaacagcagtgctctccactccgaatccgccacgtctcctccggccgcacgaatccggcgcaaaaggcccgaggtgacgacgccggtgcacacgcgattctatcgccgacatccgggtctcgcctgtagggccacagccagtagcggctccgggcccgcctgtcatacgaagccgagtcccgcgctggtttctcgttaactaataagccctcaccgcgcgcgagggtggagtagacgcaatcccacgcgaatcccatcggatcgagtccatcagcacgccgaagaataaaccgtcgtcgaggaggaagtagggggccgcgaggtggacttcagg

SEQ ID NO: 8625 - DNA, 1500 bp, Zea mays
gagttccttttgttgctgtgatttgtcattggtcgaagaggactaactgcagcgtttgtctacctacaatacttgtttctttgttgttgctgtcttgtagtgccagcagcgatgcctccttgttcgtgctcggcaagtcggccggtgtgagcaaaatccgtacgtcatcgtctccagtggtgccattctccgtggctctgcacacggtcggggactcggcggccttgctggatcatttgtgccgccaaacggtatgtttcagacttccttgaaggcattgaattgtatgatttcagtcgttgccacgacatagtttaaattataatcaaatacttgtagagtttgacacaggatcacggtaatctaaaacatgtagcttcttgcgagcgatactcacctcaacatggcagtgttaaatagcaaaccaccaaaatataaacgatcagcatgatagaccaatagaggtagcatgtaggaatgtggcccggagggccaaacacacacacaagtatagatgaatttgtttttttaatttagcttagtttactgtattttatataccatatttcacctctattttttttaacatgcccctaataatcatgttttgggaaaaactttttagcatctttttagagttgctcttaaactatttatcttgaatgtcttggttggctactacacatttaattacccgaagactgcacactcttcgttgtgcaccaaggtatatatataagcgaaaggtatatatataagcgaaaccatttttttattaaggaaaatatagacgaaaccaatgtaaaggctgctatttattgtattagtgacgtcttttccagctctgttaaagaagcaacatattaaagacacaataattgaacaaactttcgcaacagatagtctcgagaaagtttgctgcgatgtggtaccagaatataggttttgccaaaaccatctgccacttgcccacttcctcacccaaaattctacagtgctcatttttttttctctcccccttctcaagtttttcattcctggtttggaggatatacaattatacacaaatttaccatttccattagcaaagaaagacattgggctcaagcccagcccaaaccgatgggatcggtcgacaccaatcgaggcacgctgtgcgtcccgccactgcagaccgcagtcctagggtcgagggcattttcgtccgactctgccaaaccctcacactgacgaccacttataaattcgctctctagggtttacctgctccgcctccgcccagccagcgccgccgccgctgccgctagcgctcccctcaggtaaccaagaagaagaacgccctttcccctcgtttagaggtcgacttcgcgttgttcgtctgctatttcatcgccaaaatctgtgcaaccctccagattctagaaatcgtcgtgtcctgatcctggatctaattgttttatcggaaatgattgcttcaggtaaggaaggaggcaggcgagg

SEQ ID NO: 8626 - DNA, 825 bp, Zea mays
tgcagatggtgctgctgtggcgtcagcgcacctttgtcacggtacataatgttgcgctcaagcagaaactgccgaaactctggctctttcaccttgagcattttgcacaactggcgaaaacccagcgactcatgcacatcaacaaagcgatcaaagaattctgcctttggggccgtcagcgccagttgctgttccgccgcacggcgttgctcaaactgttctgcccaggcacgtgccgcttccgccggattggtgaaatcgggcagatgggtgaatttttcccgctcctgccagcggtccagcagttcggcggtaaagccaggggaaagacgagcaaccgccagcagcgagtcacgtttattcagctgaaactcctgacgtgtctcaccttcatgctcgtaatgattcaccgtgacaggctgggaaaggcgctgcgcggtttccaggcttttaatcaggcgcttcacttcgccatgcgtgatgccggttattctggcaatttcacggctgctcatcagcagtgttgcgttgagagcagcaagactttccgttgagatcatcatcagtatcacctcttacaaacgtggaacagtccatcagactgctggataagtatacaatatactgtttgcatatccagtattattttagcccgtactgtaagaaatgcctctctgcgagatatcgcacaaagcgcaactgcgccggaccccgctctgcacccgataccgatacgcttgcctattcgactattactaccaggcttagtcgattcagtttaaataaagacagcctttcgttacgcttatttatgaggagccgatt

SEQ ID NO: 8627 - DNA, 124 bp, Zea mays
aagttttgactcgtgatgatagagtaggttacaaagatcataaacgtttgtagcgaaaaggcccaagtttttgaagcctaacacttgtctttgtaccaagtggggctatactaactgaaagtca

SEQ ID NO: 8628 - DNA, 1500 bp, Zea mays
ggttaaattataatctgtccatattatataattcaataaattttaaacgttcaaaatttgttggattatataatatggatagattataatctcaaacaaataatctctaaggctttgtttggatactctactattggcctcaaatcctcaatccatatgttaaggtggattagcagtggcggagccagcctaaaaccagagcctgggcacctgttaggttatttttatcgacttgaatagacacgttaaactgaatcaaataatattgtcaggatagtgtatgtttgattttaagcaaatggatactgtcaggtagtgagtctcctagcccttgtgcgctgctcctccaagtcattgtgcatcgctggtcaaagcgtgaccgcctcaagctcacatagatgattaataattggtttagacgacaacgaatggcttagcgctccgtattaagcagcagcaccaggcttcttgtaagacctcatgtgctctgtgttgcggagcccgggcacgtgcccaggctagccgggccttggctccgccactgtggattaggatataaattagtttaagttacatctcaatccacctcaatataaatggattaaaattaatactaaaatactcaaacttggtctaagaagttattgtacgcttccccaaccccaatatgatagtaccgaccataacgacaacgtatacaccggcgttccagcgggcgaaaaccatgcattttatgatgaatcacgctggcccagtaggcgcactgcctgcatatgcatgcatgtcacgtcacattatttagatgtaaaaatagaataacgagcgttcctgcctctttccaccgcggaggacaggcagagggacaaaaccacgcgatttctcatgtggccagcagagatcaagctacaagaaaaacaacctggtcacggggttccatatttgacgaatacagtagtgcaagttgctcattagtcattagataagtctctgttacccaagtatctaccacataattaaagtaataaatgtcattatttgcaggtccatcagcgctttttaccccttcgtgaattgtgttcacagtatatttttattcgcattatgtcaggagacaagcaggagtacgtaccacagtgctatgcgcagccgctgatatggccaaacatgcgaaaacaaaaatcgcaagaatttttaatctagaattatgaagagcgttgtgggctgctcggctgctctccccggcccagtcgtcgtctcattctcgccagtgttataatatcccccgcgcgcgcgcgtggcggcgacccggccgtctataaattgggtacactctgatagcgagagaactcaccagacttgcagctccacaccagcaacagcgcgacgatagctagctagtagtagaagcaggcagcggctctagttgtcgagcgttccacaggtcatcaagcaccggcgtttaattagccatccgctccgatcgtcccctcccctattccc

SEQ ID NO: 8629 - DNA, 1500 bp, Zea mays
agctatatataacctatacccagaaatcaagtaccttacaattgtgttgaccctaattcacgtgtcaacgtactttctggcgacttcgttaggcaatgatcggttcagttatatcctacagttaatcttttccaaactacacgtatccaatttgttggtttgatagataattctttgtattctcattactgtatattgcatatggcccaaaagcctctgattgcatctggtattgcttcccctagctatcagcatgtggaacaacaggttcaagagcgatttttagcgatccagtgtgttaggagaccatcatgttcacacctagatctaattaaggtaaagaaaagtggaataaccgagggttgtcctcttaatcatgctattagtaagattgtttccaaacactctcaattagaggatacaatgtctgatgttcctgttgctaattttcctcatgatgcatatactactggatcaatcccagttgttaggcaatcataatatggcatgtgagactgtttcactgtcattatgatcataatatacaaggcaactatataagggtgaaagagtctccagtggaagggtgaaaggaccaatcacacaccaatgatagatcctgctaaaccatatattagaactatcttacactctcctaccatctctctttattctctctcattgtaagaactcacattaagaaggattctaacatgaaaaactcgatgctggacatagggatgataagcccaaactaagataaacctttttgtgtcttgagtgttaaacyactaattaagtctcacacatcaatctatcaatcgatccactaatcacttacgcatttatgaacccgcgacggcactacaccataacacaactcgatggagccgtgcacggtctatgctgcacgtgctctaatgagttgccctatggtgacacgattagcctagctagaggtggtgcgactcatttcagccccacgtgtctttgtggtgttaatttagcaaagtttatcatcatcgtcattattttcaattacatatggtggtgttaatattatatttaaatacactagcgatcctcaaacttgtaagaatgtgtcatttagatccacgaacattaaaatacaattgagtccctaaacttgttaagtggtgcaatcttaggtccatgatgtcagttgcatgtgtgttccatgctaacatggaattactaacttggtatgtcttttatatttaacccctcaactttatttgtgtcycatgaataggaccttgcttccatcttctctcttgctaaagctagcctgttggataccgcgattcccttcaattcgctattgcttatgtttgtcacatagttccttttctctactcctataaagcaccagtttccattgtttccaccattgtgtgtgtcacgcgtgcgaaatgtgtgcaacccgtcaatctcgctggaactgtggctatgatcccatccggttgatttgttggctcg

SEQ ID NO: 8630 - DNA, 1500 bp, Zea mays
tccactgttgccgcagcatgcgaatggtaatgtgccggaaaactgccaccactttaggcaaacagccgcctcgccgcctgacaattctttggcgcgcgcaatataatgatttcctgttagaaaaaaaagcaactaatttcgtcaaaagggagaatcatttcaggacttggaacggttcaacgcgtacgtacgcggttttccttttccgagggatggaagacgaacggccgaaagagagagggtcgtagtcgtagcttagcagcttggatcggagggtatgcatgggctgccatggaatggaagagagcgcccgcatcaccaccatccaatcggaaaacgcagcgtgtgatcgagctactagcttcggaaattcttttccttgtggaagtcatggccacacgccggcctgatgactggcatggcatggcaatgcgaaggggagaattcaacgtgtcagcactgacacgcacgtcgtcaattaaacacactccatcgatccatctgtccgtcacactcagtcagtcttgtacatggaaaactgacggtgttttgttcttctttatttctttgtttctttgtatgaatgtgtatgtgttatatttgatattatttccctcctagctagctctatgcgtacgatcgagattgtgttctacaggttttaccgcgtcaaaattcaacgtaagtacggcctgtgtcaaagtaaacaaaggccatccacatcgaaaggaataactctcgatcgatcgcaaagctgtggctctacggagtgaagcgggaaaaaaccctaattaaatccctaaaaccctaattaaactagctagactgttcattagcaacgtacagggagaataagtaatatggacgatcatgtttgtctaaacttcgcggatatatatagatatagtgcacgtgcgagtgtgtgtgtaaagtgtgcatgcttatgcttgcaggtgtggtagcaaagtgatgtgctaattaaataaaggtttatcgacgatcagtgctaatatatataaaaagaagccattaaaatgcatatatataggaagaattaattaacatgagacatgaatggtcaaggtcgtcgtcaagaataacggattctcttcgatcgtatcctttgagaaagctacgggtgcccaacaactgcatgcacatgaattaagaagggctagtagctagctagctagtgtgcaccaatatatggaccaagtcgtcgatcgtctgtcaggtcaggccactcacttgttcatctgcagcaagtctactcttagtttgcattgcaacacacacacacacgacgcaggcggaaagcgacgacagcgcatcatccccacacacactctctcgatcagctcgctaataatgacgccatgatgtccccggcctatatatgcagagggaacccggcctgctctttcctctcatctctatcagctcatctccaccggccgccctccatctatcgtcgtcgtcgtcgtcgtcgtcgatccatcc

SEQ ID NO: 8631 - DNA, 123 bp, Zea mays
ggtgagcgcctgaccggcagcaatctgccaaccttcctttctcgcgtcgtcggcgtcggtcagtaaaggctgctcgtgtcttcgattggcagggcgagggagtcgcagaagtccagggccagg

SEQ ID NO: 8632 - DNA, 90 bp, Zea mays
ggtagctttacttttgatgatgcttctcccctggcagcagaattgcaggctatcccatggccataatcctacaagccaccccagctaccc

SEQ ID NO: 8633 - DNA, 1194 bp, Zea mays
ggttagccctaaatttctgaagcacagggttgtgggttcaagtgctcactttgctgcactattttttgtggatgctaaatgtggagagggtaaaaccataatagcacaggtgtctatattaggtttttaatacagtagtataaatttatggtacaccacattctataattaattgaggtagaccgtgttttaatgtgtctggacagggtaaaatcatagtagcacatgtgtctatattaggtttttaatacagtagtataaatttgtggtacaccacagtctataattaattggggtagacygtgttttaatgtgtctgggctgtgtcgtacaggaccggcccagatgtaagtgtataagaaagatgccagcaagttattatgagagagaaacagaaacagagcagagtgtgcagaggtagagcgatcagcgatgaaatgaagtgcatgcaaacaacaaagcaatgtgcgtacaggcccattcctctctctctcggtctctcctaaccccgtcctgtgtgtgattccctcgtttgctccgttcccagctttcctcctcctcgcacaggctcccctctaaaaccctctgcctccactgtaaatctttgcaaagctgatttctaacagcaagaattcgctgtttctgttaccgcaccctccaggggcctatacatccagcgcctgcctggcttgcttcattcgtggatctgagagcattttgctgcattcagtaacattctcggaggggatttctccgtgctgcttctgtggatttctctgagaattgtcagcgggatttgtgagcatttcgtgcggtgttttcatggttcctttgtttggcatgtgttagcgaattcctcagcattgaagatttttgagtcccctctggagtgttgagggtcactaagttcttgatcattcactaaatattgtttttcagttttagtttcatgtttagaggacattggtactgttttgcaaccattccagattgttgcacatctgaaagtttgcacacctttgtgggaaaagaatgacgctttatttttctggagaatgaattcctgtggcatctgatgctctaggaccataaagcttgcaactttagtgctgtcctacctcagtagactgaagctgtttttcccctgcttggttggtattgatcgtcgtgggcaaagcagaggaagaccctccc

SEQ ID NO: 8634 - DNA, 1457 bp, Zea mays
gaggtctttttttttacaagttgcaagcagcacaagtgttacagcagcctatgagattaacccggtaactttcaggcttcagcatctgtggagctgaaaccggtgctgtaatttcattttcaccttagagcgggcaagtttcaagtgttagggttagaacctaggtgtcgtttgatttacgaaatgtaaagtaaatagcaacggtggtaacaagtttagatagtccggtattattttataatgtggtatctgattacgattcggtactaaacaaatataatataatgttatcaattatccatcacgttacaaatatgtgaatcaaacgacactttaacactacttattagtggactagattttctttctttcttttttttttccggaaagagctttggagtaattttctttgattggttgttaccgagtgaaggaccaataagagggccaatcgtcggtgtgcctgcgatttgtttaaaatcgagggatttattagtattaatatattatacacctaccgaggtggccaggccactagtgcgccacccataaccacgctaaaatattttatccacacataaatcacacacaccagaatttgccgacaataagagattagtagactacctgccagtcgtaggaggcacataaagtacaatcacatgtatttggacgaatattatttgaaacaacgattgaatcttgccagcactgcagcacgtatttaggtctagtccaccaaacacctcatcaccaaacaatatatcaaatcaaacacaaaaatttacaaatctcattaaacacgtgctaatgaaccttatatatacacacacagtacacagactccctctctattgtttgtacattacagtacacaaaaaagtccaaaccaaatcgacccaaagaaaactccttgatcgccctcaataaaaaaactaactgtatatctgcccctcacaagccaccaccaagtcaccaacccgagtccratgtatacgcgcggcaacaataatatcctttcctttcttttgtataaaaaacacccgcctccgtctccatctccggtgagcaggaagagggggagggaggaggccaagagcgcagcggcgaagccatagccaagctcacccgatccagtccctgccgctcccagcgtgccacagccagtcccgcgctagctcagctcagctcagattcacgagctcgtctcccagatccagcttcgtctggttgaattctcttctttggaagtaaatatgtagttttggccggaaaggccggctcttgtctctccctggtgttttttgccgccgttgctcgatcgaaatgtgacctttttgcgcttcgcaggtgctggtgggcggcgtggtttggtgctttgggggcctgcgtgttaagtttctgcgttctccgggctatctgcctgtcttgctgcggcctgcggcggcggggtggag

SEQ ID NO: 8635 - DNA, 634 bp, Zea mays
tgacggaggtcagtgcctgccgaaggtggtcgaaaaagggttcaccggaggtgggcgccaatgttggggacttgttctcaaatgctatgaattaagaacaaggcaacataaaatgttaaatgatactatccttcgtccttcgaagcattattcctttgaggataatggatcttggacgaaggtttatggaagtctcattacgaagttgaaccttcgtaatgaacttccaataaacatcgtaagataatacaaaataaagatataagatggataaatgtctcacagatacatcaaatcatattcatttaatatattgaatcattaaataccaatagtacctatgccttgacaaaggttgtattccgagagatgcgattgcaaataccagaatctgcctacagtaacggaatactgttctctatttataggcacaggacgcagcctgtgaggaattacaagtatgccccttataaaaacttacaacattgactcagacctttatgggctaaaaggtcattctatctttaagtcggtttgcaatgccgaagctttacgaagaggaaccttcggctatcttgtataaacagcttcgtccgaggatcacttctttctatgagaccttcggcgacgaagc

SEQ ID NO: 8636 - DNA, 1500 bp, Zea mays
aggacacaagttatgcgagtgcagagtcatagacgaaagctaacatatctatctcaattaagttttttgtaatttatttatggcttatctaggttgtatgtttatttttctattttagtttgctatgctagtgttaggattggctaaattttttcaacagagatagcaaaaacaccttgtaaaattaagattcattacaataattttttactacataaaaaatagaggtcttaatttaagaaatattttttttaaagctaactactcactcttctttctcttacgcgttacagtttcttcggttactcaaagatagaccactgtctttgtcctggacacgcatagagatgtcagtgggtaaaaacccgctgggtattacttgcccaaacccatactcacgaagaaaaaaatcgcccgctaaaaaactcatacccatgacgggtataaaattttgcccaaacccatacccactaacatcaacataaaaaataattcatcatgtaaataacaatcaatacattaataagctaggataaaaggaacatgtaataactaattttagcttaaaatttgttacatgaagtttatttcaattagaacatattcaattaataatattatgagacatatttataaggaatgataattttaaggcgggttttaaaaaacccatgggtttgcgggtatgggtagtggaagaacaaacccatgcccacgtacccgttgggtttccattgaacccgttaacaaacccatgtgtacagaaatagacccaaaccctaatagagcaaaaacccatcgggtttcgggtagcgggtacccattgccatctctaatagtgagattctctcaacggtaagattcttaaaaaagttggttagaaaaaagaaggaacaattggatctataccattaaaagatccaaactttagatatataccatggaccccacatgtcattgactcatgtggacccacatgtaagtgagatagtaatggtatggatccaaagtggtgatcttttaatggtatgaatccaaatttcccaaaaaagaaccatgcactcttactgtggcgccaacagggttaaagtgggcgtgagtttaactgtaccaaagtgataaagctcgcatgcggcgtattaagctggcgaagccttgcgatgttacaaagccaattaactcccctcctacataacgacccacacgcacgcacatccactatccccggaccccgggccagtctcacctccttccctcgatcgcacgccactcccgtaggaatcccgaatccccccacccaaattcccgtctagccgtctacccgatcgccgtccttctcgctgcccgtaaaccctagcccagccctctacccccgccgtcgttgcccgtgcgctgtcgtgctcgggctgcccccgcggcgccgcgagccaaaccctagctgcctcctccagatcccgattccgcagggaagccggagaggtgagggccgccccgccgcag

SEQ ID NO: 8637 - DNA, 257 bp, Zea mays
ccttcttttcttttcctatagttaatagggagcatttgttctgtctgggtgtttttcagtatagttaagtgttaggtggattgtggaacttgtatttatctaaagtgactgataagcttttgtgacactgatcgattttactgttattttaatctcttattctctcttcccctgtgttgaagctgagatgaaattggaaaagaatctaagttttacaattcctgctacttctaatttcagcgtgaatagcaatcacc

SEQ ID NO: 8638 - DNA, 579 bp, Zea mays
cgtcgtcattattattattattattattattattattgttattattattattattattattattattattattattattattattattattattatcattagtccattagtttagtgagtatcaaatgagtaaacatagcttgaggtgcaaaccaataatttggtgcaaattgtgcaaatcaatatgttgttggaagtggaggatgtatttgaaaatatactagggaggtggaaggattgttttgaaagctaatgcacggtgacaggttgttttgaattttttttataactgcttgcacaatttacacaaagtttggtttgcagctgatgcgttcccttttaaaagagtaaaataagggtacacagatcgtcgttccgcagcgatagaaatacaaaccgtgtgctgcatccaaagggaaaattgcaaacgtgcaaatcgttttgaactgagcccgccaacacaaggcccactgaacgctgcgtcccgatgggccgttcacacgttcacggctgggcccgactaaccgcacgggtcgccgtcggagctcggcgaatctgcgcagacgacgagtgagcgcg

SEQ ID NO: 8639 - DNA, 661 bp, Zea mays
cgtacacgatttgagatgaacgtgccagccgccgtgcaggaaacgacgaagctgcaggcataactgtgcttgtctgcaaatgttttgcatcgtcttttagcataaaaataactcataagacagtctccaacaggctatcctgttttatcttttattttaaactgtgctctgtaaagccgtgtagtctgaaatgtaagataatattttacatagaacatagtctgcttggcacagtctaaagcagtgaaagtaggcgcttcgtatatcatgagaattaacagggaaacgctaactgttttaattttgcatggttgagagcacaaaaggatgacaacatgcgcgctcagcctgtgaaataccgaaggagaggaggcttcaactgcaacgcgttcaaaaaacggatgggcttcttgaacgcaagtgaagcatgcaggcctcagggaggggctttagggcttgcagcgggtaggaggggctcaatgcaagcccaccgaactagatgacactactagtgctagtagtttattggtaggtgattgcatgtttgtataaactacaatagccttgcagaactcagagggaacgaatagagtagtgctgggagtttaatttagtgggtcgaggtagtagctgaagaccaaacaaacacgctggagagagc

SEQ ID NO: 8640 - DNA, 614 bp, Zea mays
tctggacctcagaggccccagccgagtgttaaatgctcgccctctgatcgggtggatcgcgattggcagcgacgcttccgcaccgggggtgtggccgtggcccgtgtgagacgtgagagtttagagcgcgcggtgcgaaatccccgcgctgccctcgcgcgccccgccccgcccctctgccagcccgggcccctgtccgagccgggatcgcggcgcccgaagaagatatcgtggccaatacaggcaaacgccatcgccacgcccccccggcgggccttttccttcctttcctctactctattgatttatgcctcacaccgacctcgggcgcaccacaacgcaccagtgatcagtgcgtcgctttcgctcgctttggcaactcccccctgctcagtgctggcaattgctgcctgcgctcgtagtcactctcacagtgcccccccgccctgctgccagagaaccagaaggaaaggaggatcccgagcagtcaattgccctgatcctcccccccaccctggggtagtaagagaaagagcgaggctgaattgctgtgaggcaggcgagggtggttgtgtgtgtgtgtgttgctgcgctgcgcaggctcagtgcgggcg

SEQ ID NO: 8641 - DNA, 103 bp, Zea mays
ggtttcttggtccatttactgatgtgctgattcattgtctggttggttcttgaatcactgtctcaccgatatgagctacacaaacttctcgcaggactacaag

SEQ ID NO: 8642 - DNA, 813 bp, Zea mays
tctgcaatttcattaacagcaccgccaatttcatggaggggacgagactcggaggggaaacgagcgagtgccgacgaggaggagcaaacgacggaaacgagcgagtgccgacgaactcagcgtcgccagaaacagcgccgcgaggagcaatgaggagagaaactggttgatccgttttgtkgaatgggtcagagaaactctgacgtaacactgtccaggtaaacgaacaatacacaggtagagggatcaaagcgcgtttaagtaccaaaagaccaagacgaaatatgttataatactataatctcaatcgacacattcgggatactaacttttagaagcccactaagggcttgtttggttctaccccaatccatatggattgagggggattgagggggttttaatccctagtaagtcaaaatctcctccaatccgtatcaatcccctccaatccatatggattgaaaataaccgaacaaaccctaatgggagcttcttggttcaaaaaaaaaaaactcaacccaaacccccaacctattcgagcgacgaaactggaaaaaagcacgcgacgacgcgacggtgaaggggaagtgtgaagggaagcagaagcgagacaaatccccacccggctccaaaccctagccacctcccccgtcccccccttttcgtcccccagatctcgctggcgtctgctccgcctcgcttcgatgtgaccccaccctagggtttgagacggtgttgcggtgtgtgcgtgtgtcgcggcgattcgcgacgcgagtaggattcgaggtgtcggcggcggtgcgagcgcaa

SEQ ID NO: 8643 - DNA, 132 bp, Zea mays
ggtaaagtcatgcatgtttggtaccagtactccatgcatgaattttattttatcttctgatatgcactttacgtgtttattttgtagatgattccatattggtgcgccgcacatcctctgtgctaggagcat

SEQ ID NO: 8644 - DNA, 61 bp, Zea mays
gacatgtacttgtcatatcattgggaaggggattggcataattgttttgttgagacgttgg

SEQ ID NO: 8645 - DNA, 1500 bp, Zea mays
atgaaagtgtccttcctggcttgcagatacccatacccgcgacgcgctccctaaattcgaaatcagaaatcactggacgcgaataatttccgaatccagcagcacacgtccataacatagggcgtgttcggctggctacaagccgacaatgttgcagctgtttggactgctgcagctgcaatccatagagagaaaaatactgtagaagccgcagccgcagccggattgcagccgcagcaagccgcagcgaacaagctgattgcttacatgctacccatacaaattttaagattgcacaatataaacactagacgtatttccatggaacaataagttttattatatacggctcatataatgaagtattctatttgtaatttgctttgacatttctgttccaatttatttagatttcatgacatacccaattaaggcattgtgctgggcatatgtggcctcatatgtttttaaacaatttgattctttgtttcttaatcaacaatttcttgaaaagagtcaccaattacaataataatattacaagtggaatgggttcaagtgctccatagtgccaaagtttgtttcgttatgatgtattttgacatttgaatctcagacatgcttaggaactacttaattgaatttatgggataacaggttacctaatgtgtttggtaaaaataatatttttctgcatttacgacaatgattgcccttttgtgcaatttcatgtacttctaaacatgttcacattattaacatgtctatttattaacttcagggatactgttggtgcaaaacaacagaagatttccatgtcaacatctaagcaaccagctagcttaagcgaccccctttgttgttctcgaaacaacttcatcctcagcccatccattcgcagatcccttggatgaatttggtaaagctgcaaaatatcaagggaaaagccgtgaaagtactaacgttgggagcaatctgtttgaggattcaagcacttccatccaggctccaaaatctgaacctatttttacctcagaggtggacaatggcttgaaagataagaatgagtctagcagagcccgagacgcaaatcctgtacagagtttttctaaaggaaactcctcccaacaaccttctgtagaggattttgaaaatatcttttctaagccgcagtctgccagatatgctgatgtccatgttgacattggctcagataaatatagtgggaatggtataaacgaccagtcacctagatctgatgaatccgaagatgagatatggcttacagcttctgagattcccctcttcacacagccaactagtgccccaccaccttcaaggccaccaccacctcttgcagctaagcaaaaaaaacatggatcaaaatcaaaaagaaaagatgatgaacatctaaagcagtctaggaaaaacaatgatcatcaaagaagttcgtcaaatcatgctggtgtttctacagtagatgaactagaagattttgcc

SEQ ID NO: 8646 - DNA, 1500 bp, Zea mays
ttttcggaccttcggcttaaggccttcgtccatatcgcaatatgaatttatcattacagcaaattaatattgcgagaggctactgttgggggccttcggcttccgaaggtcctcaaaaacatgatttgacaatgttttctaaatatgcgagcaggtatcttcggaaccaggttgcgggtatacaagagcatggtcaagacgaagcttgactgaaatggaagacgatcatgacgaaggatgaaacgatcatgaagctatgtgcagaaaagcttcggcatgacagcagaaaagaggaaccgacttaaagatgaaaagccaaattagacctcgaagaattactatagagttattgataaaagcaaagggcattaatgtaattttacatgggctgcgtcccgtgcctataaatagatgaacagtactcccgtactgttcacgctgacttggcattagcatcacgcttgtacccttactttcttcaagccgaaggtacatttgtaatttgttgttgtttatataagtaaaataaatagaaataaattaataataatgttcaaagtaattatgttattttccgtgttttgtgtataaatctctcttatcttttattatgattatgaaggtgtgaccttcataaccttcgtccgaaatccattatatccaaagggaaataatgcttcgaaggacgaagggctctgatatttaacattttatgttgccttgttcttaattcatagtgttgggggccttcggcttccgaaggtcctcaaaaacatgatttaacgatgtttctggagtataatgtgtgaacaggtatcttcggactcgaatcggtaccacagtgggagaagcccaaagaatacgaaggttgacacaacgccgaatctatgagcaggaaagcttcggcgtgatagcagaaaaggaaaccgacttaaagatgaaaaggctattcagacctcgatggattactatagaattactaccaaatgtaaagggcatggatgtaattttatatgagctatgtcccgtgcctataaataggtgaacagtgcccccgtactgttcacgctgacttggcaattacttttgcgtcacgcttgtatttttaccttctttcaagccgaaggtacatttgtaatttgatatcatttctatttttccataataataatatagaaatgagttgataattatacataattgtttacgttatattccatatgattccttcttcattattatatgttgtgttgatgaaggtatgtccttcataaccttcgtccgaaaatcattatatcccaaaggaaataatgctccgaaggacgaaggactttaacgtttaacattttttgtgttgccttgttcttaacttatagcatttgagaacaagtccccaacacatagcatttgagaacaagtccccaacattggcgcccacctccggtgaactcacttccatttcttgagctttgaacaccttcggcaagcatcaccttcgtc

SEQ ID NO: 8647 - DNA, 1425 bp, Zea mays
tgttgtttaaaaatcggaggtgcattttagtttttggatgcacagacccaagacttactgcccccccgccgtctccgcgcgcctccctgtccccgctccgccgcgcgcctccctgtccgcgcgcctccgcgcaccgtcgccggcccccgatccgccgccgcggaggtcaggggcctaggtctcattggacgatgaggcgggaccggaggggggaaggaacatgagcaccggagggggagaaggaacatgggcgagcgactcacgacgacggctctcggaaggctgggagggatagcgtgggggagagaagttcgaggggagaggggtgcacacctgtggtatgggtatggccatggctggaggtttcacgtccgttgaaagccaagtttcgcgtccgcgtgagtcagaccagagaggacgagcgtgtggccatcggtagcacacgtgtcgcgcgacgaatagcgagtacgccgccaaacgcggacaggcgtctaaaaggggatcaggttttaataacttagattagattgcatagacatatttatttagactgggttgtaacacctaaattttaatatgagagttaagtaggaaggtcttcaagtttttttatgtgtgaattagttttatattttcagattattttatgccagtctattgtatatttttaataaaatatataaaataaaatatttttgtacctctttttttgtaagacgctgatttaaggtaccgttgtagtggaaaatgctataatcaaatgcagagtgagcagtattgtctagtgaaatgataggctgccatatccgtgggcttgccctccacgggatgggccggaaaacaagacgggtcagcccgcgaaatgcgaagggccggaaacaaaaggggccgagatgatcatgcctgcaaactgcaccatgcatgtttccgttatcgttagatcagacggtgagaagaataattctgatagttcagtttcaacttccagctaagaaaaatgagaagtggggtacaatcatacagggctcctatgagcctcagctaaacaaaagatgctccggttagttggatgcagaagcaggagttcttctgaatcttatcttggttctggttggtcaacctaacaaccactctgaaatactgtactaatacggaaatacacacacattgcgtagatactataccattttattgcaacgtacggtagcatacgtacttgaacgatcaatgacatccccaaaaagaaaatctagcaaacaacagagttttggtgctgggtagctcgaaatcgaattcgtctacgagaggttcagtttcactgattccggagtgtcgcatcggccactcacatcctcgtctaggatatgaagcggaagcaagctagacgatggtgatcgacggcaagctcgatcgatccgtcagaag

SEQ ID NO: 8648 - DNA, 277 bp, Zea mays
ccttctcccgcctccgaaggaaaacgggcgggcaaccttctcgtcccttccaaaatcccgagtttccccccgatttcgaccctccgttttccccccgcttccttctctgctccaccgcctcaggaatatagatagtcggagaaaaaaaaaactgagagagaaagagagaggaggaggaggcaggggagtggaggggaggggaagcatcgcaattccgaacccccacctcgccgctcccaccaccgcggccgggttgcgtccgtttcgattgcccagg

SEQ ID NO: 8649 - DNA, 171 bp, Zea mays
agtaagttgcttacagtttagcctttggtttcaatttgcactttatagaattatactggcagaaaataatagttctctttttcatagcagaactatagtaaacatctgcctgccgctgattttcttagccaactttaaaaaatctggtttactatttttttatgtgtactc

SEQ ID NO: 8650 - DNA, 956 bp, Zea mays
gattatctggttatagacgatggattaaactcgccaagaaaaaagtgttaagcgaaggcctcaagaagcaccagcaagcttgcaacagtttgctcgtgcggtgactggtgagccttgttcatattgaaagctgttcagagatttatcagccaaattctaatctaaaatataaataataacagtgtaatggttgctagttgtagatgggcctaacaacatgttgctcacactttacgaaacgcggtgcgcaccgtttgtgtgccagggttccggccggcccagcatggcagccctggtaggcccattgttagttttctgtccatccaagatgacggcctatataaagttggacaccgtagcccagaacagcagatcgcaccatcatcatgacttgaaaacccgatgccatcgggccaggtctatagattgagcccaggcgccctgctgccgcacctttccgtcaatttattcggattatctgtaaattttatacggattatcgtatatttagaataggacatccagcaacatttattgctacctgccttactttagattggtaaagagacatgtacctgttgccgatactttttggctgggtctggtccctgaccgtagaggacagaaaagaaataaaaggtgttgcaacggcacatgaggtaggagtaggcccccctggtgctgcactgcacatgccgacagagacagctcacgtccgtgacctgtttcttccgctggacccactgcgcagtgcatgggccgtccgtcgctgcagatagattcctgcggctgcggcactttaatggtgactcacactcacaccgaaagcgcctcaactctgaaggcgctacagcaacgtcgccacttcactcacgattggagtttcacctcggcagcccagccagccagtggttcctcggctcggaggaacaggcgaacagcaagagcttctgaag

SEQ ID NO: 8651 - DNA, 640 bp, Zea mays
tagccagaaactcgcccctgcgtagaactctagggaaaacttatgggaggaaagggcactggagttggaggcgcttcatgggaatcaatccgccaatgccgcctaatagaaacaaaacatttaagaaaatatggacctagcccgggaattttcagaagtcgctcgtaacagtcaacgcgcgttctccagtcgagaccacagacaacaatttcatatgaataaaatggatttgcatctacctcattcttgcgaaacaaaaactctacagtcgcaaaaaatttacgcccagactcaagcccggtatttcgctgattcgataagcgcttagaaaggaaatagacatctccgttgtcatgaatataaatctctgactcgtaccaatgaagatgctcagagttccattccggaagatcaaacagacctagcgcttgaccggtagggtatgtatttccgctccatttccctctgcattcaacccactcgccactatcggaataaggctcggttgatatttttgagattgagtaggctcctgactccgaatcttgcatatagacaccatttttttgatcgatggtctgtttcgaacactgataacagaaaagcctaaatatctagattttcaacccatgaggtcaaa

SEQ ID NO: 8652 - DNA, 190 bp, Zea mays
ggtccgctgatgcacatccgcctcggctccacgcactgcgtggtggccagcagcccggaggtggccagcgagctcatccgcggccacgagggcagcatctcggagcggccgctcacggcggtggcccgccagttcgcgtacgactcggccgggcttcgccttcgcgccctacaacacgcactggcgcttc

SEQ ID NO: 8653 - DNA, 785 bp, Zea mays
ttaataatcaagactcatatgacataggttagaggaccattgaggtagcggataaatggtaggagagaacatatctgtgtccattgtacccgatagatatagtaaattcgtggatataaaaattcgttatatccatgtcttcaagctgttctactgtcttcttttgagcgctgcagcagtaaaaaataaactagactacactgtatatatataactgcaaacagctacagtcgtgatcagtcgaacagcttgtttcggtaccattgccttctcacatatctagcgccggctaccctacgactgacaggtggcgacatttggttcgcacgcggacgcggcacgcctccggctcccctctcgaaattcggttccgattcggttcccacaccagaccgaaccaaatacgcgctctcgtgctcgtgcgcgcgcgtcgcctcccaccccttcgtccgccgttgccgcccgcactctcccttccgccgtcgtgggcgcgcggcgacggggagagaggcaggtgaggtcggaagcggcggcggaggcgggcccccctccgtctactcttactcacgcacaccacggcgcccgcgagctagcgccctagcggagcggaggtaaacgcaaacgccttctcatgcttcgccgcgttgtctgatccgacagggtgctccatgcaacgagtattatcccgtaatttcgtgcgcctgcacgatgcaggtcgaggcgggagaaaggcggttggggctccccggtgggcaggggggggggggggggggtcggaggcgggg

SEQ ID NO: 8654 - DNA, 1500 bp, Zea mays
atgggggttaccagctgagaattaggcgtcttgagggtacccctaattatggtccccgacagtagcccccgagcctcgaagggagtgttagcactcgcttggaggctttcgtcgcacttttttgcaaggggaccagcctttctcggttgcattttgttccggtgggtgcgcgcgagcgcacccgccgggtgtagcccccgaggcctcggaggagtggttacactccttcgaggtcttaatacctcgcgtaacgcttcggctggtctggtcgttccctcatgcgaactggccgtagcccgggtgcacggtcggggcccaagctctcgggctggtatgttgacgctgtcaacgatttggccggagccggtttttgcgagagcagcccccgagcctctgcacagggcgagaggacgatcagggacagactcgactttttacatacgcccctacgtcgcctttccgcaaggaggagggggggagtgcgccatgttaccctcgatgggcaccgaacatggtgtctccggtgagctgcaagcgggtaatccgagtggacgtccgtgccccgttcgttgggggtcggctaggggcccagaggcacgcccaaaagtacctgcgggtgatttgccggacccggtcccctggcgacggggtccgagggctcgatgcctccctccgatgggattccgttacaagatcgttcccgctggtctcggaaatgtcctagggtacctcgggagcgcagcccgagcctcggttatgtatcgaacgtacccctggtcatccctcgctcggtgtctgaggcgactgtgaacccttcgggggccagccttcgaacccctgatcagtaatgggcgcggagcccgagtagcctgaggcggccatggaacccttcggggggctggccttcgaacccctgaccagtagtgggtgtcgggcccacgcgatctgaggcgactgttgaacccttcggagggccagccttcgaacccctgatcagtagtggggggctcggagcccggttccttcgcggagaaggatccctttcggggtatccccctttcccggtccctgttgcaagagatagagaaagaggaaaaaggaaaaggatacgaaatcgaacgacgtggcgtaccttttctgacgcggttattatggcgaaggtgaagcgtcgcgcgctcctcccgtcagaggcgccgcctgtcccgccgcggagttaatgcgacggggcgagtggttggcggggtggccgttacgcgtgcgcgagccgtttgaggaacggctgtaccgcttcgcgctttttgaatcccgcgtccggtccaggcggtgtgctggaaacggtttcgccctggccttcatatacttgagagggggtccggtgacggttctttgctctgctcccttctttttccctttaggttttcgcaacccgggaaactttagtcggagaagagaaaaaccgccctccctgccccccgcgccgccatcttctccattttggtg

SEQ ID NO: 8655 - DNA, 545 bp, Zea mays
ggtgcggcgccctttcacgggatcatccccgggaagcgcgtccagccccttggacaactcgatctgcccatctgctttgggactccctccaacttccgaaaggaaaccctcacgttcgaggtggtcgggttctgaggaacctaccacgcgatgctggggagaccgtgctatgccaagttcatggtcgtccccaactacacctacctcaagctcaagatgtcgggccccaacggggtcatcaccgtcggatccacataccgacacgcgtacaaatgcgacgtggagtgtgtggagtacgccgaggccctcgccgagtccgaggccctcatcgccgacctggagagcctctcgaaggaggtgccagacgtgaagcgtcatgccggcaactttgagccagcggagacggttaagtccgtcccctcgaccccagcggcgacgcctccaagcagatccggatcggctccgggctcgatcccaaataggaagcagtgctcgtcgactttctccgcgcgaacactgacgtcttcgcgtggagtccctcggac

SEQ ID NO: 8656 - DNA, 238 bp, Zea mays
caaaacgctgacagaaaggtatctgctgtcctgcagtcttgcttctgaggcttcatgcaaataattagttcaattttaccacgtggacgcagagctgtagacttatttcatacagttatgtgcagctaacccagcgtttaataacacgaacacaaggagttgcagaattgcttcttcgattgcctcctaaccatttgttcccctctgcagatatcttgagttacgttcagctgacaca

SEQ ID NO: 8657 - DNA, 322 bp, Zea mays
gtggctgatttatgaaaaatatctggccgaccgttttttgatatgcataagaagcacaagtatgctgttacctgaaacagcatgcagtaatacttaaccacgttagggcttcagaaggctggagatggacgcatttggtggtggcaaccattgtaaattgtacgtttgctcccaaatcgttgcatttggcatcctctgacccactggcctgcatgtttgtatattttttgtgtgatatacggggagatgtcttgtgccacgtttcctccgtggcgtgtacattcaaacaaattggcatcaaacatgtagtaattttcgttct

SEQ ID NO: 8658 - DNA, 1087 bp, Zea mays
tctaagtgacccgtttgattaaggagaagcctcactcggtctaagtgaccgtttgagagggaaagggttgaaagagacccggtctctgtgaccacctcaacggggactaggttctttggaaccgaacctcggtaaaacaaatcaccgtgtcatccgctttattttcttggtcgatttattcctctctctctcgaacttaacttttattctaacgctaacccaagcttgtagtgtgcttaaagttgtaaatttcagtttctgcctattcacctcctcttggcgactttcaaacatgtttgtctacgatctttcttttgtacacttctacaattcaacacatattatatgattagtaccctcaaataaatcatgtgcacattgttccgcttactaactattttttcaaataaatttatagctatcttcgttctcgaatatttatcgttcgttagtttatttttaaactaaaacacgataaataaaaaagaactaaaaaagtatgtatttataaattaagatctcacaaacgagttaaatattgtttaacctcgctcagggcgcgcggaaaccactagttgcatgaatttccttgctcaaaggcagtaccatccagatccagcaagccagggtttcgccttcgtccatctctaacacagtactccaccaggatatcctaaactccagacgggatattccgtgcaagctcagttatccgctaccgccacgttccctgaccgttattatcggcatttggagaaatgaagcttcggctctgccctcggtggctcagccaccggtttcagcgccagttcaaccccgcacccgcaccccggtgcggcacggatcccaccgggcgcagcgcacgacccacaaagtcagaaagccgctgcccggaaatcgcccgcctccgctccgctacgctctcaccacctcctccgacgtctgatcggcatcgccttcgcctccgctaaaatactcgcggtccacgctctcctccaaatcccatcgccataaatctcgccacgcccgcgcccgcgcgtgtctcttccccacaccactccgccaccggcgccgaagcagagcagcc

SEQ ID NO: 8659 - DNA, 169 bp, Zea mays
gagttttttttacatcccaagtttttgttacccagctatgctattggggaagtttatttttgttagattcaagattcagacatctagactcatcccccaccttgttataagttaagttaggccttatctgacttggctaggttcacggctcaaaatctccaaygaatgc

SEQ ID NO: 8660 - DNA, 743 bp, Zea mays
attgcatatcatactgggattatttgtttgtggcatttatgtttgaagtgctaaactcaaacatgaattcaaatttgagttcaaagtgaaaatgaaattaggaaaaataaaacagacaaggaaaaggagaagcattgtacgctggtgggacaaaacctcttgtcccggcccaaaaccccatcctttaccacgtgtagcccacgatgatgaccactgtcaccgacgcgtggggcccctcatcagtcattttctccacaccagccgcgctcgtgggttgctcggttccgctgatagcgggccactcgagtcgggttctctcctgtgccgcgtgcacgccttttgtttctctagcaaatggacccggatcgttggatccttctcccacctcgtagcaagcctcaacaaagtccacaaattcctcggtgttagttgcaacaaccacccacgatagaaggagccatcgtcatccccgtaacagaagacccaacgttcgccgggagctcgcgcgacatcatcgcgtccagctcggtgtccacccgatgccttataaaattggagccggtgacctcctcctaccagaggctagaagctaaccaccgttgcgttgcatcgctgggatttgggggaaaacaaatttcaaatcgaagtcggcttgtgatggtggtgaccggcggtggaagacgagtagacggcggcggtgagtagggtttgttgactgagttggggtcgagggtgcgccggcc

SEQ ID NO: 8661 - DNA, 1122 bp, Zea mays
cgtcgtgcttgccagttcttctctccatctaggcgactgcgaggcgagtgaaggttttatccaccgcaggggaatcttccccagcaatgagcttcgacggcgcgccgattagggcatctcgccctcacccacatccagttttggagtcggccgacagttccatcgaaggtgagatttttttggccgccgttcctcccatagccagttgcggagttggctgaccgtcgtcgctcgtggatggatttcccctttcacattactgggtttttcggcattagggttttcacattttattggcattggggttttcaaggtgtttactgacattgcaagcgacctcgtgcaattcgtcatttttcatgtagcatctttcagtgacctaatctgttcatcggatttgaaggtgtacccagttacgagtttttacatctgttattgttgcaatcgagctgtctagggtttagattgcaatatgaaattatgttctaacatattttatggtatccataaaaataaaccctgaacaacggatagcagaaaccctaaagtatgttcggtgttcatttgttacccacatgaacaatggcacacatttagttaaatgggaacaaacatgcacaatggcacacatttagttggcattggcaaaaaccttgcaatatttatgcggattacgttcacatttatgatactaattaatttacagactcatattaggaatgcataaatgtattatacacgtaggcagttggatgacgtttgcacttatgctaattacttaacagagactcacattcgtctcttaattttttatatagttatgacaaaatatgttcgctcttatgctgattacgtacgtagttatgacaataattatttacagagatggacattagttttgatgccctcatattatacgctaacatgtggatgtagttatattcaattcaatgccattaggaatactgaacaaaggtatcaatagaatacatacaatgtyagttttttatatgtagcgtgtgtgtggttgttcataatacatgtttaaaggtgcaatatatatctcaaatattttgcatacaatttatgcagatttagcattgttcagaagatagtctcaca

SEQ ID NO: 8662 - DNA, 100 bp, Zea mays
tgtgcctccacttatttgtctcattttcagatgtctgcattttgaagtttggtaaatagcattgttatatgtgccaagagttttgggagttactggcata

SEQ ID NO: 8663 - DNA, 1332 bp, Zea mays
cgccttttgtttaacatatcttttagaccaaaatcattgaaataatgtctaaatttatattaaattaatagactttatcatttttatgtgggtgcttaaggttatctccacgtgggaacttaaggttatctttttatagactatttattagtattgataatttttttgtatttttcggtcgatactataatattttaatgatttaattgtattttgatgattttctatgacaagaaattaataatacataaatagccttaaaaaatcgtgaaattttacggagatacaacatatgtccatatgtaaccataaaaaatgttggatcataagatctataagatgcctacgtttctttcctttcactttcacctatttgtatgagttacatgtagggctggacaaaaaactcgtggctcggtaactcgctcgactcgactcattagtgactcgactcgactcggttcgtttaaaatgagtcacgagttgaactaacaatttaactcggttcttaacgagccaaactcgagctgacttgtgagttactcgcgagccaaacgagttttacatcactgctaatctgcaatggcccagtccagtcccacccatagtcagccgagcagcccagccacacggtgacacggcccacacaagacacgcaatgacgcttgaggcttgacgcagcagagcagccgaacagacagagacaggagacggcgcttggcttctgccttctccttccctcacgctctcggtctctccctctctctccccaaaacctaaaccctagagccgccagacgccactgtccgtggagcagagcaggctgcagcaccgccgcgccggtgtgcggcgtgccggcgtgtgccctccgtcgtctgcccgtctgcccgtctgttcttcgctgtctgctcaagacacggtgaacagtctgttcttcgccgtctgctcgtcttccccgacggcgccctagccctgttcggctgtccggcctccggcgcccacttgcccatcgccggtcggcggctcgcctccatggaagcccaagaaccggatgggcacgaaggtcattcacgtccgccaataccatgaatttctggatcaatgatcaagcgcacgagcacgaggaagaagcttgtgccagcagctaagaagatttcagcggctgctagcactgcaccttcatcatccacatcttgttgtggtgctgtctctgtatctatagaaagctccaaatctgagttgctcatttatctagatgaatcaaatgtgtccataaatgagaaacactttgatctgcttaactattagaaggtgaatagtcatagatttcct

SEQ ID NO: 8664 - DNA, 1500 bp, Zea mays
gcatgagaactcaacgtggcgctacagttacagtatgcctggctccacatcaccacatgcagtgcactgccgtaccgtgtacgtagcttgtcttgtcccgctgttgttttccctagctactacacgttgccattgtccgttacatttactatatatatatactaccagtaccagagagcaggtgggcagctctgatgttctggctcctgactgccttcacaggcactgaatcggagcaacagttccggtttctctttctattatttctcgattaataaggcgagaaaaaggcgaccagcgaatgaaatggggaaaatgtgttttcctgatagaaatcctgcccgcgataattattttttttataaaaaaaaattagcactacgtctcgcttgatagggatccgtacggaaaaagataaatcagcagatggtaggatttactttcaagacgagagagagagaggtcagttcggtcaattgtgcttgggtcactaacaaccaagaagatgccacgtccttgttgcggcggacggacgagcgagcgagcgagcagtggaaaggtaataacaccgcagctgcaggcagtgattaatcactcgctctctcgctcgctccccgtccctgcccactcactcactcaccttcgccgggaaaaaaaggaggaaaggaaataaaatactccaagccaagagagcggcaggccgcaggggcaccccccacacccacaggccatccttcaccagcacacactcatctcccacacctagcctagccttgctttgtcctcctccgtctcgctctcgctctccgtctccattcccacccaccaccaaacaccaggcccaaaggaccccccgccttcccaactaagagcaccagcgcagcggggagggggaatcagggcagcaagatccgagcagcaggagtggcaagcagcatttgtagccacagctcgctcactcaattgcagctagccgcggttgcggttggactggatcggcggcagggcagggcagggcagggcgcgcggcggtggtggtagttgcagaagtgacggtcaagttttcctcgctccttgcttcggccgagactccgcctgacgctactaccaacatctccacctgaatccatctctatctacctcgcacgaacgaacagagacaggggaggggagggggggaattgaagtgtaacccaaggaaaggaaccatgatggtgtggcaggcggaggaggaggattgatccatccgtcaacccatcagacccgtccatccatcggtggtggtggtggtggctgctgttactcgctatcaccatctgctgctgcctgctttagtcttttgcttcacttctcttctttctatccttcctccccctgtctgtttgtctgtcttattgccctccctgttcttgttgctgcttgcattgagaaaagagagagagagagagacagagagagatagaaagtggttgctagttgtatggtcgtccggtgggcgcg

SEQ ID NO: 8665 - DNA, 1500 bp, Zea mays
gcttcgatatggatagtattgggaagcaaagtattggaaatcgttgtcaaacaattcacttgatatttgatatgtcaaacaagtgtattcgatatgtcttacaaaaaactgcatttaggaccacttgttgtcttagcagctttgaattgttgtcttagcacctttgatatgtcttagcaaaaactgcaagttcactctttgatatgtctagattgaaccagtccactctttgatatgtcttagcactaaatgtgactctgatatgtcttagcattgaacttgtttgactacatggtaaatgatgacttaccatcataaagacatagtagagttcatgatgagttacaaacttgtctggcaaagtttgctttatgatggtaaatgatgaagttgatgatgtactcactgaaaggaatgaagatgtgcttacaagctcagattgattcatgaaattgctttgtttttgttggtgtaccaatttctgagttttgtttgtgacattgtgtgtggctaaaaatttgatttgaattgaagtgataggattcaatcctttgctaccaaacagataaaaaaatgcttcactagattcattccagccggattaattacatgttcggaatgagtgaaagggctggctccactgaatcctggcttgtaactgttcctagcctggattcggtcctgacctgccaaacgaccccttataaagtttctaaactggttgtatccgtttcttctctcttgcgagtcgctgagccacgatacacatgctcaaaattgagactttccagttgcggagttgccacacactaactacaacctcgttacccgggagtcaacttagggtgtgttggttgaggagtggagaaaaatagattgactccatttctattttctggatgtttagtttccataaaaaggacccgagcagctccttaagtctccatataaaattttaccataaatagttgaatgctcgagctacaccaaaacgaccggatgtgagcgctctcctcactccctcctctctacacttatatagctctccaaccaaataaaaaaggaacatattcgctctattctactcttcaactaaataaaaaatagagtgcctccattatgcttaccaagctcaaaataaaacgactccattctaaaaaatctagaaagctattccattctatttgactgtacaaccaaatctcacccttaactgcaccagccatggcagaccgctggtggctggcactcgctgctcacactcactgtccagtgtccttgttgtccaccactccctcgagtccgtgacgcgtcagcgtcaccgtccgtcgtcgcagacgagcccagtggcgactggcgattcgctttcgaaccgcagtcgtccctgctgtgttcccggttccctcccttcctcctcctatagttggcttctcgccaccctctgccttcgaccaactttctcccttctcccctccccgttcccctctccaactccaatcc

SEQ ID NO: 8666 - DNA, 427 bp, Zea mays
tgcagttcccctgaacatctgaacacctccacagtccacacaaggaccacgagttaagggaccatggattccagttcttctttctttcttactatacgaaagacgggtttcaagttcgtcttccttagttcctcgccataacgtgtggaggtgtgcatacactgacctgtccatctgagttttgatgatgatgctggctttgatccagtatagctgacattatgtggtgggcagctaccgtgttcgtcatggttgctgtcccacaggtctctccgtctctgtctgtggcctctgacgagtgatcatagtaggccgttccagcgctttaaattctccctgcctctcctcgtctcgcttcacttcagtaatcagtgctcgctagcccaccacgccctgaacctagcccggacaccagccagaacaggcc

SEQ ID NO: 8667 - DNA, 660 bp, Zea mays
ctttaatcaatatgatgcagcacctttcttttcttcctttgtcaacttccccacccctaaaccaaaccagaatcgcatggtttatgacaaaccgacaagcgaaagaggataccggataccagcctatcagcatcaacaggatacaaaaatgctaatgcgattttgttgtaattcggataccagaacaatgcttgcttgaacaacgcttagagcaatgatatggtatggctccattatttctctaactataacttgtttgtgttttagtggggaaagaatatctttatttattaaggcagcaatcaacactcgatcggtttgccgccgaattccccggcggtgccttgttcgctgcatgcaccaacgattttgttgtaagatgtttgagaagcaagcaactgtcagcactcagcagtgccaaagaggcgcctagccgcctactccatctcttgcttccctgcggcattctctcggcgcttcagatatccaaatccctcgccgcaagccttccccttcagcctgcccgccgctggcgctgcccttcttccccgcccccttccattccgtctgcatccgtcttcattaccattcttacgctcgggcggttcgtcgtctcgagcttccttcccgggatcgacgacggcaggccgctccgcggtg

SEQ ID NO: 8668 - DNA, 50 bp, Zea mays
tgtggtttactgagactttctaacatttctcaaatgaaaaataacaggtc

SEQ ID NO: 8669 - DNA, 871 bp, Zea mays
attgctgatagaggatcctggggcagagtttgctgtttgggggcatttctggcactaattttcccgtgcgaatagtaggtagtatgcgcacatggcatatatccgtcctgtgagggttgccattgcgtcttgatgaagcagaactatccaccgcatttcttcatgatctgtgatataatgtggtaataaactccaactggaggtggttgtgtttatgtgattgtgagcaaccgccatgcgccgctggtgagatttgccgtgtttggagcacgaggggagataaattgaaaattgagttttttaagctggtgtcttcggttttgctggtgtgctcatttttatcattagtcgtgttttttgttcagttttgttttgtccttctgttctatagcactaaaagggtaaaattgagtaaaaaaacacaactaaggataaaaataagcacatcagcgaaattgagggcaccctcttaaaaaaacctttcaagtggtttgagtcgtgcagccatcactctgtcacgtacctttctgaaatggaacgtgtaaaattgcaaataaccaagttcattatgttttagcgtaattgggcttttcctctgtagtatttttttcttcaagaggcttcatcagtacgcaacactcccagtaggctcactctgatgtccttgtctcccgattatactagtaaacaacacgggttcccgtggtctcctcagaaggcaactatgacccggaacccctacagttgacttgtcatggcttcgcgatctgtgactgtgatctatactataaggtgaacaagatctctttgtctactgtagttgcagcaccagcagcagcagcagaagagcagcgcctgagctccagcaata

SEQ ID NO: 8670 - DNA, 223 bp, Zea mays
agtatgtatcctgactgaccgtcagtggcgaccgaccaaccaaccaacgtcgtccggcccgggcctttgggcgttggcatctcatccctgtcaggctgtcttgctgctgcctggtggtggttcggtcggtcggcggcagcctgcaagtactatgtgcattaattcgtgctagtgtagcatagcaactgtactcacagtaggatggatctctttttccttttcc

SEQ ID NO: 8671 - DNA, 1077 bp, Zea mays
atggccgctacgagattggcgtaggcttgttgcaccctctctgctcacccttgcgagccccgcgccggtgccgtctcgttcctagcacaaacagaggccaccgtggcaccacagctaccgcgcaggatgcagtggtcggtggaagagatgaagccctatcctgaccgtactattttaataaaagaaactaaatttaactattgtagtgaatcgacaaaagaaaacttaatcataattgtaatggacaaaaaaactgaatcttttatagtatagatttacatgtgcaaacaaatgaacgacaactaaagatgaacaagccacccaacaacaactaagaattagttctaaacttttgaaatttcccaccatatttgaatcgtgttttttccaccaaatttcagattgtattgcaatctatatactagctagtgtggttctcgttcatgcatcatgacaaggttggcttcctgtggctgtaatgtttgatgacagcctcctgacctcgatcaggttttgcagacaggctagccaaaaagaaacccttaaaccagcattaattagacgacgtaacttagaacaagttttctgttgcatcctgttgacgccttttcagagcgccaaacactcaacaagaatcgtggctgtgctctctggtcaggcgcggatggtccgcggcctggggccggacggtccgcgacctggcgcaggggctagggtcctctgcctgacggccagacggtgcgcgccctgggggccggacggtccgcgcgtacgcagaggcggcggaagtcgtcggcggcggcctggatctcgctcccgggagggaccccgtcgggaagaggagatcgtaggagttgtctaggctcgggccggccgacctagactcttctaatcgacgtagagtcaaagagaagcggagaatttggggatcgagaggctaaactagaactagactagaactactcctaattgtactggaaataaatgcgaatagaagttgtattgattcgattgttgatgattacaaatcggccgtagacctctctttatatagaggaggggggctggaccctttac

SEQ ID NO: 8672 - DNA, 138 bp, Zea mays
actccactccacccacgcctccaccacagagagccgcagcagactcgcaagggggtagtgttgtgtactctgcgctgtgcggacggcggccggcggccggcgaaggagatggatcgcctgcccgagtcgacccggagc

SEQ ID NO: 8673 - DNA, 238 bp, Zea mays
gtttactgaaagcctaaggaattgatttcggaaataatgaataatggcatgcgtcttgatattgttttcttcggttcgataattaacaacctttgcaaactgggaagggtaatggacgcacaaaatatatttgacttaactgtaaatgttggtctgcatcctgatgctgtggtgtataatatgctgatggatgggtactgtcttgttggcaagatggagaaagcattaagagtatttg

SEQ ID NO: 8674 - DNA, 654 bp, Zea mays
tcctctggctatcacaggaagcttgcagctgcagaaccggaccaagtgacgtcgtcggctacatctcacggtccctggcaacgacgcagaggtcgttactgagctcgacgccgacgaagcctctcccaccgctgcctcccaccatgtctcgaccaaggaaatgcacgtgaggatgaaaaatgtcgtggaaaccagtgggatggaggcactcaaagcgattggggaggattttacctcccgcatatatgcaggatgaatctgcgtggatgcgtggccgcgaaaatgttggggaagtttgtgtggtccgttggaggagaaaaaaacacgatttcccctaaaaaacatttttcgggagttttgcatgttttcttggagttgctctaaccgtcgtcgactcatcgttgtgatacatacatgatacatgcatacctattgataatagatcgtgatgtaaatgctcctacataatttattatggctcaaaattatttctatgttaaaaataaatataaataaagtcggaccctaattcgatccgaatcttaaattggataatgatccccgtcagtagtcgggtgttgagtaataaccactgaatgacgagggagggaggaacccggacgcccaaaaaatccccccacccccagcgcggca

SEQ ID NO: 8675 - DNA, 449 bp, Zea mays
ccaaagcatattaccccgtgtacccattatatccagtaacacatcccagtaaccacatgatgcagtgcgcttttctccaatgttatcgttgactcgagccgtggttaactgcgactgattcttgcactgatcttctgttatcctcgtctaacagaagaggtcgattgacccttttcattctttcgtgggatctggtattgtttagaatgtgacggtttatctgaaaaaaaatgatggaactttttgtcctcaagcatgttctccgttttggagtattcatctgtggcccggcacagccacggtggttttgtgtgtgcatggagagacaggcagacgaaaacgaatgcaaagaaagcttgtggggatcaggtagttttaccctctaaacgactgtacttgaattataatttcagtgtcgatgtgagcatgatttccaactacatgaattg

SEQ ID NO: 8676 - DNA, 163 bp, Zea mays
gcgcggagcagcggcggcctggcggcaacgctctttgtgctgctcggggtcggggttgaagaaggctaattttgcgaccatggtacagagtatgtctgtatagcgtctctaggctacggcacttgcacaccgcatgtttgtataggctacgaaactatggagt

SEQ ID NO: 8677 - DNA, 737 bp, Zea mays
ccaaacaccccctaaccggcgttggccctaggccgctagtcaaaacaacccgccgctagtcaaaacaaccctggctctacgcgatgacacctccgtctccaactgacctctcggctcggctctcgcccgccgtcgtgctggaaggtaaaatcgcctcaccgccgccgggtttcaccggcagattggggggcggggcccctactagacagacttttgtagggtagtactggtgcgctctgctgaaagaaagacaagttccaaaacgtgggggcaccggatttttattccgcttccgccggacccgatccagccagcagccatcacgagcccggagagacctggcacagacacgcacagccgtgacacgaaccgcaggcgcatccgcaaggtgcaatcccaatccatggcgagggtccggaggaacgccggacggacaccgggtacgcccgcccccacgccgatgcgtttttggtttttcccatcatttaaaagttaaaaccagggccctctaccctcccagctcactgccagtgccactgtgcgcccgtcgctccactcccacacacacacacacacacttggcagcagcttcataaaaactcccgcagatcgcctcgtcgccgccacccacggccacgccccaccctcactccccttttgcccttcgcccgcatacacattgccccgcaagctaccggcgaccgcctagcatctgtggcgccgcgccgcctccgctg

SEQ ID NO: 8678 - DNA, 1097 bp, Zea mays
aaagctggtagtgtcggtgagaggtattcaagttggaattggaattgtaggttacagtccactagaagagggttttttgtgcagtggagcacctcgtggccagcacaagctggcctttttcgactccggcgacgccgccagcccccatcacccgtccccaaactcatcttcctagagggtaagctggtgcagaccttaggccctaaaaggcgcgtgcgcgtcgcggccctggacgaagcgttgcagatcccgcaagagttggcagcgttcgtgacttgctatggtcaaagcctccatgtcctggttgggtacgtatgagcttcactcattctcttcctgtttacacgtttaaaaataaggacttaagttcatacacgttcaaaaataaggacttaagttcataccacatatttttctagatgtgcactagcaagtctggcagatttctggcatctgagatcggaagaagaaagcattcgtaactccatcatagtgagattaagtgattatgcactcaagatatggtatgatgaaataaactaatttttgaatggctataattgatgtttgaatcagtttacttgtttcaaatatgttgcagtatttagtctctaatcactattatttatatatgtaaataaaatcacgagcaaatgattcaatgtttcaaaaatttccttggtctgtattcatctttttcttgtggttttggtcgttgtttttctctgcaaaagcagcaatcaactaatactatttaagaaggtatacattgcacattggttttttatgtttttgtggttcttaataattgcacccatcttttattgttactgagcttggttgatgtatggtgatgggtactacagtaaaagcagtttataattccaagataagaaattctggtgtttcagtttaggccatggagacacaccattgctgtggaattttgtttagtggtggtgctagatgcgcctggattttcatatgtttcgtttggagaccggaaactttatgccatttttagtgatgttgcaggctgccctttgtgctcaagttcttccgagacatcaagcatgtgcgagaacaaggagttatag

SEQ ID NO: 8679 - DNA, 1500 bp, Zea mays
gattttatcttttatttgacattatggcacatcaacatatttgaaatcttggcagtttaatcataaagagagttttatagagatacatctagatgaaacatgctatcacgtacgtttatcatacaaaagttaatacaatactttttggtaacaagcgtcatgtcattcaccatcgagactctgactggcctagcagtgttcggttggtgtcgcttgtcatgtctaaccttaataaacggtgactatcataaaagatgtgatgagtaaaatcaaagctattatgacattatcttgacaaatttttgaacacgaaccaaacacaccacgccccacgtatcttttgaacgtttgaaagggaccgctcttcgttttgcaatatctcacaacagctggttactyttgtgtcaaacgtgtgctaaagaagtagtgcaacaccgacggaccttgatcactggcccctggttttgttgttccctggctgccagtcttgggatcctcgctgcactcctcccgtcccgccttttgattccgtcgagagcacgagaaagtgttagtagtagtagtgagcttgtcattatgctgcagtaatttatgccgattataaatttataattataaactggcatctgtcaggggcagcgcgcagtggggggaagtggaatgcaggcaactcactcgttttcaacggttggtaaacaaagcgcaaaactgaacaaccgagtggcatggcaccagccagctccacggaaaagcaactccagcaagcaagcaagctccctctctctctctcatcgcgtggtgtgtacagtacagtagtgccctgtgctcctctgctgtcccgcagccgcagtgctggagctcaagcaccaaggcatccagccggcgcccacaggacactgctagccccattcaagaatcttccagctttcccaaacagaaccaaccttcggccatggcttcttcttgatctgtggtgcgcgtgggtctccgtctcccctaccggtgtcgcaatctgcagtattttttccccttcggtgctagggaaaagagagagaaaatctcacatcttttgactgcagacatactagtttgatgcaaggtcagtttttctctgtcctccatctattttctctagtctgctggtgacatttctggattatataggcgcattctgatacgagattaggtatatatatatatatatatctctggatatatatgtgtttcttgagattgttgacgcggatctaactagaactccaatctcgaatattcaacaatgtcccaatctgggttttacattaggttcttggttttttctatcgcagctttgtagattgtcttggctgcactgtcctagagcaagtttctgtcacaagtgagatatttctgcgggttccaaaaaggaagcaacgacgaattgaaccatctgcagcttcttccgttgcattgcctcgtactgcatacatctgcagcttcttccgttgaattgagccaaca

SEQ ID NO: 8680 - DNA, 1011 bp, Zea mays
ccgtcctgactcttcactgactactgaatttattgtttggctaatcaaatggtcacttccaatgccctgtagcagacaacacttcrctgtaccgatgttgcctagttgtctttcgtgcactccagaagaatctctttaagcaaacttgtgataatttgtgtgttctatctattagacaacatagatgtcaattgtcgtgggtcatgtcaatgtttacttagatggttatgaaattatcggctgtaccaatttgggtctgtctaattgctacaatgaagttattaggtgtttgtggagtagtttttatatctgacatattaaaaggatacctctaaattcttttaataaaaggtaataaaccagtaactgcatcaagccaagctgtataaaaatctttgatgaaacaccttgcatgatacgatgttgcatcacagcatactgcatcctttaggtataaaattgagcagcggtgctgaactagggacataggattaaaaatcctttttttttttggtgaaacatgtacatcttatattgcctaccggttaagatctttgagaatgctgactgatgatctttacgatgttgattgccttgtcaatcattgtttcgcctgcatttttggcagttgacgtcacgaatgctctccctggttatactgttggctattcggtctttcttagtagcgcttcggatcatcaacagtggagaggtcgtgccttgagcaaggtttagtggagtctactattgttcctattggggctaatgcaatggctcttttattgtaaactttactacctaacgactacaactcctttgatacacgttcacatcgagtgactcttacgatatcattcctggagttgtgcttactgcgatgggataaccttcctggcacactactcatgtatttgaccaacttcctatggtcactcataacgctactaccacacagtgatctgcacctcagagtactaccagaacaccactgcgaacagtgatttgcgcttg

SEQ ID NO: 8681 - DNA, 302 bp, Zea mays
ggaccaacgccccctgcaaacaagcaaggaatactttgatcgaccgtcacctgtgcacgaagccatgttgacgatggccatcgaatcaatccttctcctcacccaggtcatatctccttatatactgcacttggaggtgtttgtatatatgcacatccaccacaaacgcccattgccatcaaccccagcagcagcagcagtcagcagaggcattgttacttgttagttccgaaagcacacgtacgtctcacattagctagttccagccttcgtcgtccaggacacgagaggaaaccgcagcc

SEQ ID NO: 8682 - DNA, 1330 bp, Zea mays
tctatccacagagaaagaaaaaggcagggataagaatggcgtgtttgccctttttagtggctctgaacaacaagatacaattccttttttatcctctgttctgcatttttttcaacatagaggcggttctagcaaaccaaactaatcactcaacaatcataaaccgaatcttagcacatagctaacatccacaaatcaaaccaatccaaactagctgaaagcaaatgattagctcggggtgacttggccatatgtgcttacggcactgccaatttttgcgaacacctgttttttgctcacataggtcttgctgacagaatcatttacaaaaaaataccgagtttttttctattataacacttgttttaacaggtttctcccttatagtatttttaatgtgaccttctmtatagtagtatttacaagtgctattactctttaaaatagtattctcacctctttttattatttyattttcctttatttttcccttctcctaaacttactgtattgcccccaatccccrtcacatctgttcgttcgtttcttgatagcattcggcgccgccaaattttctaatgtctctaccgtaatagtgtgtagcttaattgtcaattcccatctgtacgttcgtttcttcacttcaccgtgtggatagtatatgccagcatcaagagcagatccctccaatacattkattcacaatagttagtcacgttttaatttcaatatttcacctccataaactgatatattttcastattgagaattagaaacaaatatactacttgatggatcaatccaacawctgcaacattcttttatgcacaaatgtactacatggtttaaaaactatcayagatttacrcttttcaggaatgcaaaaactattttatttcctgtcaagaaacgaacgaacagatgtgatggggaccaagggcaatacactcagtttagaagaagrggaaaaataaaggaaaaaagaaataatatttgaacttttggttgcatgttttgttttagtcatatatacatatttatgttgatgcttattaactactaatattgcataaatatacatttttcttgagtaaatattgtttctattaacagtctgttggtttgcatatatgtatatggcaatttctataatgcaatgatacaatttttttgatgtttgactgtgttgacatttatttcgttagggtcatataacacaattaatgacattttttcaattagttcgtataatcattggtgtatatgttgttctaactcaatgaagcgcatatgttttacattgttcttttgcaggctgctgcttcaata

SEQ ID NO: 8683 - DNA, 563 bp, Zea mays
ttttagtgggtgagggctataaatacccctcaaccaccaccactccaaccatccaagcattcaacactcctcattcaatacaagagcaaagtgcaacactccaagacacaaatcaaagcctccgatccaatcaaagtccctgattcaattctagtgctttaggacttgtgagaggatcattcttgtgtttctttggtgctcttgttgcttggttggctttcttctttctctcattcttattctcaaagccttgtaagtgaagcaagagacaccaattatgtggtgctccttgcggagtctaagtgacccgagaaatcaaggaaggaagctcactcggtgtaggtgaccgtttgagagagggaaagggttgaaagagacccagtctttgtgaccacctcaacgaggactaggttcttcagaaccgaacctcggtaaaacaaatcactgtgtcatccgctctatttcttggttgatttgtttttcccctctactcccagactcggttttaattctaacgctaaccctggcttgtagtttgtgttttaagttataaatttcagatt

SEQ ID NO: 8684 - DNA, 1500 bp, Zea mays
tgtttttagtccttaaaatatggtaaaattcgtttagtatctacacatgatacggttcttttcacacgttacgttattttttccccacgagccaggcaagaagtgccattaccgttttgtcgttgaccgaaactaatgggatatttggttgtgggcgagtcttaaattttaataaattacgttattgaaatatgtaggaaaatcaatatagtacatgatatacgattaaagtgaaattatttaatttgattatcaaaataggagttgtatttgttttctaatagaatatctcagaaactttgtaggccacatgtagatatgactcagctaccaacaaaagtgaggtagaggcgagactaaagtcattttttgttttttgtttattcttaattattaggtagccaaattttgatgagtttatttgattcaataccttagttaaccgagatagacaaagcactgggattataccaacaaggcacataaataaataccagacctagctatatcgcaagccttcatttttaatgatccaataaactcatcctctccatttattagccttctagtaccacacaatatttttgtttcattcttatatgtacacctaacccccaaaacctagaagcgacacctcctctatacacttcgctgaagtcacatggctattcctgtttgacctcctagatgtggggtcgatgccgcctccaacatttattcctctcccacttgaagatagaacacctctttttgatggtatgcctctccaacatttgtggcgcctttgctagtatccgactttgtgctatcgtgatcgacatgggctacctaccgaagagtttgtggtgacgtgagcttcttctcgaccaatcctagtgcttgtcaatgaaataacctagatggctagagggatggataatctataaaatagttctgcaaaccttacagctataacaaatatatataatatgtagaaggttttgctttctctagttattgtttgatctaggctatctctttaaatagcctattagcttatgaaagatatgtacgaagaaggcaagttattcactaaaaacacaaagagtatacgaactaaaaaggtacaacaagtgcaactgtaatattagtttagagtgaaaaccatatagagcaaatgatgacataatatttatccataaagtttggttgcttgccaacaacttacatccttgttgtggctaatctaagatgtgtgattcacgtgctaattattcaccatggcaccttgctaagtgaacatataagcataaccatgtaccagctttgtctttaggtgcctgaacccttttatcacacaccttgttgtatcgacaccgaagacataagctttgcttctagatctattgcaaccatgtcaaagaaaaatgatggttaatctaaatgatagaaaaataaatattattagttcagtaatgatggttagttcaataaatattattagttcagtaatgtcaaggc

SEQ ID NO: 8685 - DNA, 1500 bp, Zea mays
agatgactcatatgtgtcgcatgtgactcgtgctggtccagaacgggtgacacataggttttcagaacactatgacacttttacaaatatatataaaaaataaacatgataatgctaaaggtaccgataatcaacttgagtctaactagagtaagcttaaatctaatattagccgataatcaatgcgagcctaacatgattagattgagtagtaattagctgataatcaagttgattaatctaacttttgacgttgtaaactgatttaaatctcgaaagttaatccatacaatataaaaaacacataaatataaaataactcttgaaagttaattgtcttaagggcgggcgtaggaactcgctaccgagaaggaacggcgtggtaacttgctatcgaggccgacacaacacggggaggtgatgcctgcagcgagaagccactgcatggaccggggaggcgctggcagggcaggtgcgcatggttgaagtagaggcggggtaaggcgcggctagtgttgggtggccggcagtcgggggctaggcagggggctgggcttgtgacgatagggggcagtggcacgagaacaaaaaaggaagtaccttgcgtgggcgtgagcggactcgtctgcttgcgccgtgccattaggtcgtaatttcttaactttcgggaggagccccccattgaaagtttgcctcaacttcgagcggacaagggcgcgtcggaagttaatccataactttaaagagcgggcgttagccgtcggaagttattaacttgcgaccgtttagcttggagcccgtcaaaaaattattatgctcttggaagtttcctattttggtgttgtgatttaaaaacacaacttttaggaatgcaaacaaactcctcatggtatatacgatattttatatagactactatggtattctctagaaactataagagcactagaataagaactttttactctattcttctcataaataccttatcaactcagcagatttgatgatatggcacagtgtattgaaaatgaaagtccacaaactggacagctggcccgccgccccgcgcgaaggtcaaactgaaacacactgccagagtgccagattgccactactagtactgtgtgtggcctccgcgtccggcctttcaccttccaccacccgccttctttaaatttctctacggccatcggccagtagatctctctctctctactcgtctagtactcccgctgcatagtgcatacgcatccgacccggccttgccgctatatatagacacagccaccctctccacagcagactgcaccacacggcacctggcactgccagcctcgtcgcgcacggcctatatatccccagtctcttcatctgcagcgacaaaaataggaaccgagcaaaggtctggcgagctaccaataaactaccatctccacaaacaggccagcacgtagctatatgccagaactgacctagctagtagaggatcgatcgcag

SEQ ID NO: 8686 - DNA, 76 bp, Zea mays
tgcaggcctgccttctttatacggtacaagtgacagttacacacttagcaactcttccagtatacagcattgaaca

SEQ ID NO: 8687 - DNA, 929 bp, Zea mays
tggccggaaattgtttccggggggtttctacctttctggcttggatagaggaaagagatagagcgggctggctgagtagtgtgacagaatggccaggggacggaaggtgttttctaaagtttgccgtagtcttctcgtttcggaaaaatctttactgcaaaaaaattaatcctatagtatcacgtaggattaatttatgattggagaggaatgtacggcaaagaagaaggttggcacaacaaagtttagaactgtgagtcattgtatcattatatttgtaactaggggcatacaaatcacattattcttatacgattgtgctttactagaaggcaatttatcattgcacatgttctcggttagtcgttttaaaactacattagaagttcttaaaaagagtctaagatgtccttaacatcatcggcggagcttttagtaaaacactatcttttatattttaataaaacactatcttttatattagctaaaaacatataaaaaactaaatgcgatggtaactgttggttaacgataaaaatgtataataaaatactgataataaaatggatattactctcataactgatgcgtccatattgacccggtggaacttagatatcatatcccgggcctaggtcgtcgggtcacgcgcgggagagtcgtcccctgtcgccaggcgaagaggagaaacactcgaaagtaccaaaccaactgacagtcggcccataaatcatatcgctatgcgggccagtcttgcagttacacgagtgcggcacttccgccccgcggtccacagaggcacagccgaagtgtcgcagcagtgcagaggcgatagataaagctcgaggaagacgaccggcacacacgggcactgtgaatctgaggagggaaaatcacccaaaatcgagagcataattttttccccggag

SEQ ID NO: 8688 - DNA, 914 bp, Zea mays
aatttaaaataaaactatcatattctcagctcagtgttatttctcactgcagtccagaaattcactacaatccaagtcaataaaagtggagcagcctttgatccagtctgccaccagaagttgcttttatgctagatttcggtacatcatgttgaccaggactgctaatgactccagttttaatccacttagtttccacatttaataatctctacctggttctcttgtcattgcacttattgcttctaaaatttttctgcttcaaggagttcaacacggggcgcttcacttgtttgtaattgaggaaaattagtctgctttgatacctctactacttattaaggacgcaagagtagcctgtctctgactttgttctgccaccggccgttccgacatccgtgaatctgatagcccattttagggtcgctatgcacactttcttctgtgtaatgcaacttcattagtgtcgctatgcacactttcttctgcaccaaccacaatattctcttgggatgctgtcaatgggatgaatgaattgcatattttagggtctttgctacactatagagtagatgggttataaatatacaaatctcagcttcctatccattctttctatctagagttgtagacaccacatagtatacaacatcaggagcagtgctttgctcagtccacctttgttgaggctgggctgagagtgtaggagtgaagccacaaggctctctggtaggcgatccaccacactacccgacccccaccctttttcctcaacttgtaaaccgtcgccccgactactcactctaccactgcaatcgtgtcatcattaacatttcttcttcgttcttttcagggccgtcgaggatcgatcaggcggtggcgccgtcgggcagaagcggtcgtcaccggacaag

SEQ ID NO: 8689 - DNA, 969 bp, Zea mays
ccatagaataaaacttttcattgattgttttgtattgagtgatacgaatcatatggattctgtagttacctggaaggacacttacctaacatcctgtggagtccctctcaaatagctctgttgtagccttgtaggtgggccagtgtggatcactattgttagtggtggtaggccccatttgaagcagcttactagccggctgatgtgtaagtgattctatgaacctaatttctccaacaggcatagcttgtaggcttagtaagcagcaggtaatagctagcaggcacgtttggtttctaagatcagcagacagacacattttcttgatagctttgcttgcatatgagccatccgtacacttgtgcggattgcgtcaaggatagtctcaagctgatagcctttatctttcgaaaagcataatatacttttcaaaagggtaaatgatgatgcacactagatgattctgttctgccccccttatgcagtgtgttttgtgctgttatgcctacctgtgttaaaaactgatcaatgattgagacggctcacatttttttggtccacagattcattctgaactcgttattattcagtaaatcactgtaggagaaatagaattggaaaacatatatatcttttttttcttctctggtacctaagaaacatatccttggggacatacctgaaaagctttgttgccactcttagaaagtgcattccatccatataatagtctgatggcttctttctcatggaaaagacaggcagtgagatgagcccgcgtcaagcaagcactaccagcagcagagatgccacagcactgggcagtaccacggccagtaccacggtcagtcggtccactagtgaccttccctccctccccattccccaagcatgcatatatttatgtgtgtgccttggaaagcctgggctcttaaaccagaccagaaagaaggcaggtgaggtgaggtg

SEQ ID NO: 8690 - DNA, 1252 bp, Zea mays
gtttgatgaatatatctaatcagaaacctggttctctgtcagcgcatgtgccaataactgccaactgagcccagattttgcacgtctcaaaacagtattaatcagctgttctagtccccggtgtttctaaaagcaactccatagctatatagttttgtaaaggtaaatttatgtattattagaagaaaaacatctttaatagactctataaatgactattcaaatttagcgtggctccttatccctttattcgctctctatttttggataacctgtttcgctctctattcatctgtaggttgagtctgttagattagtctactctttttccgtaaaatctttttgagagagtatctaaatcagttaataatttggctagctagtttttttattagctaatcccttggagtaagtcattttggtttaacttttataaatactttttactatatatttttagatatgacgtgtgtagctaggtaaaggcatgcaaaacgatttatagtttatttgagaagcaaaggaatactttatagtttcagacgcgctgttaaatctgaggcctggaatcatagaaacgcacatgcatatgctcgatcgttcattccatgggctgatgatgagatacccgtcttaaggaacgccacaccatgcgatgaaatggcggccccaatctaatccggaatccgctgttcattcatacagtaaattaagcgccgcgcctaggcgccagtgtgtggaaagaatatgttggttgcaaaaacaaatcaaccgtcgtcgttctgacatgcttcgcgcaatcaaagtcaaaacctagctagtatgcatatgcatgcagttacctgcgctagctgcatctggaggagcatcatcatgcatgtgctccgagttggcaccgcgcaaattgtattacgtattccatgccatgagaatcaaatgagatgcacgatcgacaaccgacattttatcgccgcgcgctcatcttcaccactaagtttcagctccgatcgatccggttcccctcaatctccgtcctggctacttcctctctctccgatcctcctatttaagcacactgcacctagcttttgctaagcagatcacccgatccaccacagtcgcaactcagatcgcaaaattaaacccgcagcaaaccaagcggcaagacaatccgcgtgctagctagctccctttttctgattcttacgtacgtgcccgtactcgtagcaagcaagcaggtcgtcgcgcagtc

SEQ ID NO: 8691 - DNA, 306 bp, Zea mays
tgcatcggctgtcgtgtattgtcttcccacgaccgactcagagctccctgatctcaagatctcgagagctgcgcgcggactttgggttggagccgtgcgtatcgatccaactccatccgccgggcaaatttgagtcaggaggaaggatattcatcggcgcttctgaattgggaggacgcagcgcatacgagattcgatgagattttgttgggacacagtttcgccgtgaattggttaggagccgatttggcaacagggaagctctcgaatgggagatccagcggcggcagtggcggcggaggggag

SEQ ID NO: 8692 - DNA, 261 bp, Zea mays
ggtgagtcggtggtgattgactacggccggcgccgcactacctgcggctactgccgatcctccgggcccacgagcatctcccacggtaccgatttccgaaccccccgtccgatgaaactgattcgctctgcttcgacctgtatcgggccctcaagctttgtagcgcgtggaatcgcccgtgggttctattatagcgttgaatcgcttgttggctctagcatcttgacgcgtcacgcagatgatgtttgaccgctgatcacc

SEQ ID NO: 8693 - DNA, 820 bp, Zea mays
ggaaacacattttctttgaaaacattttttaataccatagtctaataattgccatatcataaccataattttgtacaacaatggtgccgtagttttttgatgttatcaagttccattcaaaagtgattgattggctatcatataattaaaataatttattaggactgatgtaactgcaatctataaagaaaaaataacgtagaagatacaaccccagccgaattaagatcacatcaagttgttcacatggaaaaagtgcgcgccacatgggtcccttcgcgccacagtgaaaattttagtctaaatcaaaatttctcgtactctaaaaacrcgatgatattgacaaaatcaatgttttatatactatgatttttaaatggtctaccaaacaactattggcatacgtactctaaaaacacaatgatattgacaaaatcaatgttttatatactatgatttttaaatggcctaccaaacaactattggcatacgaaacttcaaataccacatcgttactagaaaagtaccgtctctctctaaatagggcgtcatctgcttacatcatcctaatcctattatagttgtcctaaaaatatccaattataattttctgtcaaaaacaataaaaacaaaagcaaatgtcgacgaagatgcagagatgcgagtggccgagacctatttcagctagtcctacggaccatccagatccagcacacccaaacccagcagctgattcgcccggccgcatcgcccgagccttctaacagctgactcgtcctcgtcgctccggcgcggcgacaaggcacgcagccaccgcgcg

SEQ ID NO: 8694 - DNA, 1500 bp, Zea mays
gaacgcggagtaaggcccgggcgccgagctagctacaagcaagtggcagaaacgcggttaactatagtagcagtaatttagtttagtaccgtacgttaaattaacgcggagtagctttttgttcggccgttgcggtgaaacgaagcaattataatgggtaaatcaaagcgacgcgaggcgagatcgagcaggttagagctgccgccgtgattgcgtgcttagcgccggttccgcgatcagctgccgcggcaagcgcgacgcgattcggaggggcgccccggtcttggggccgttctccagcttctcctcctcaagtaactacgagctaggtcatgcatgcaaatgggccctgcagcctctggattgatgctagctagctcgctctagatccagtagctgtgggccatctagaatgtctagatagctagatgaattagtactagtattctttgtgccaggcatgcatgcatgctgccaagtgtgtgtgcgtgtgctgctgctttgcgtggccatgaaaattgatgctgtggtacgtactcgtaatcgtgatgggcaagatcagctagttttttcgatattttctcttgaaaggaaatcatcgcgtctaagtggtctaaccgtgttgcgcgtcgaccttgtttgtatgtttccttgatcttcccagccgagtacaaataaaatcattacagcagtacgctaattgaattgggttttttttctcattttggtttcgatatatgttgaatcatatagtacatcagcaactactacgccaaacatagaaagaaaaaaaaattcctacttatttcattaatttggtgcttattgttagttattgtcaccgtacgtacgtcgcaatcttttgttacaaattactttcacgactgtttgacagcatttcagcctggtcagctgagctcgctatggctagctgcagcccaaacagttcctgcaactgcgagtcttcagcgctgagaaatgccacttgttttttatttgacgtattatagtacagtactgtatatatacagttaactagttaagtttaatattagctgctagagacgcatcatctgcatagcacaaagccttgacctagctgttccagtgtatgtctgtataatttgagatggaacgaactggatgcacgaagcaaaggcaaataatgtgaccgcgcgtgtcatgcaccatcacgaagaagcaagttgcacacaccgtagcttgcggccggccagctagctcgcacagcttgcttctctgattcaccaaagcgttttcttgccccgaaatcatgcagctcgcccttgtacatgtcacctatgacttccgtctcaatactctctctgcctacaccaccgcagctcagctataaaaggacatcggctagcttgaccaggacatagattcctcgagtcatcacaccacacgcatcacatgtagatgtagctagcttagctatgctcgcgtaaaaaccctagcggcagtcacacagcaagttgc

SEQ ID NO: 8695 - DNA, 244 bp, Zea mays
ctgcagaagtgagcctaaagattcagagcaaaaggtactcataacttgcttgcaaccagtgtactcgctcggttctgtctgtgcataattactactagtactacgagcagatgactgaccatcctctgaaaaatacaccagcgggccacaccagatccggtgcgtgaagcgggactttctgctgcggacgctggccgacgagctgccgtagggcaccatcaggtactcggacaaggttgtctcc

SEQ ID NO: 8696 - DNA, 1500 bp, Zea mays
atatatgataataacatttggtgcataaccgataagatcaaatgacctccatcccacaattgatagtggtgttgcagagaaatcaagaatgaacaaatattgcattgtaggaaaaattcctggcatcagccacatttgcattgtctctatgttatcaatatgttagtcttactttgggggctattaacctacactcgacaaacctaaaatctgcatgtttaaactaattcttgctgaataccaactgcagcaccagtcagtttccataaataaatagaggaatccagtgtacagacaccaatggcctgtcctttcactccacataagcaagttcactggttgacgtgttttctgattgcatggcatcaggaagtgtgcggtattccctctctgtgatggacttcacttcgtactgctcgctggttggatctgctctctctttgggaaggaagccccgttctcgcgcgagcacccactggtcgatgacaccacatttaatagcatgtttgactgccttgtgcaagtaaaccttgtctgtgatcaggtgagggttaattaccagcatcctcatgagggctgaaaagacaaaaatacactaaatgttatagcagttgaatgcatgttcaggctagtaaaactagcattaaagtcacacaaacagaaaagataaagtgagatgcaaacagcttttaatcaaactagaataattaacaaaagtgacattgtgtttgttgcagctgcgcgatgcccaaagatggccttcacgacgtgcagaacttaggatgttagagtcctaggtagggctgggcattcggtctattakggtaattcggttctatctattcggatttttgaaatttcgggttatgaaaaatgagaaccgaaattttcaaaataattttaggaaccgaacccgaatagactcacaattttggttcggtctattcggtccaccgaatagactcgaacagtagagagactaatatcttttgttaaaatatatacaattaataattaattggaagtactattattacaacaagtgactataaaaatagtatactgagatatatatactatttttaagatgatatcacaatttttagctaataagttcataaatcatataataatatcatcatatattaagatttttttttatatttcgagttattcggtctattcgggttttaaaggttagaacccgaatcagaactcatacatcgaaatatagcacatataagaatcgaaaccgaactcaaaacaaaaaaaccgacaattcagtgtattggcctattggrgtttgatattcggttttaaaatgctcacacctaatccataaaataaaaaaaaaacagactcggctaccgagcaaaccaccgcgagcccgaaccgtcgagctcgatttttttcccgccctactctggcgcctccctcgcgctctagggtttttcaccgctctcccgttccccgctactcgcgttttgccgcaacgcgacc

SEQ ID NO: 8697 - DNA, 223 bp, Zea mays
agtaagcgcccccctccccccctccgagctgccgtgccgtctactacgtgtgtactgctagccgcgcacgcttgagccgttggtctgtcccagcgtccctcttgggcgaatgctaggttgtaattgagggttacatccgttgtactcgaggtttacagcagttatccagggagattcgtgtcattgtttcccccagtggaatggggtggtgaagaatcgatga

SEQ ID NO: 8698 - DNA, 993 bp, Zea mays
taaaacaaagtgaccatttaactactctttattaccaggttgcaatcgaccttttaatttttcctactaggatgatcacttaacccaagttgatgaaggagttggacaacctatttccaacctaggaagcagtttctgtgcacagtggcacagagacggagtgctccaatagatttgatcctaagcaaagtgtccggcttgctctccgttccccgccatttatgctgattttgacgaatcggaggggaaaaaactcgacatttagccatcattgtctcgcctaatctccttttttcgctttcgcaaaacatgctttaacccataacccacggtctgatgcaggccatgtcgcggttgtccaactgacggcacaccaagcaaccgcacctgtccagtcgcggcggacgccaccgcgatgccagtcggcgcccgcgcggccacctcggacacccagctgggcaagcaagtgccacggcccccccggcgagatcgcgcgagggaccccacgcgatcgcgcgcccccgtgcgccgtcgcggaaatcaacggccgcgcgacgcgaatcgccacggggcccctccgcttttggtgagaaatcgcccggggaacgaacgcagccaggcagagccgcagagggcagagggctcccgagtcgcgtcggccgtcgtggcaggctgacagctgatgcctgcctgacagggattggagggagcgcgaggggtggttggtgaggggagtccgcggtgaggggccgcggcttgtggtgtgtcacctgtcgcgcgctgtcggcgtcgcgcacgtcaagggcgcgacccgcacccggcatctcaccgcggggccgcgtgcgtgcgtgtatataaacgcctggccctgccactgtcccggttgcagctccgcacaggcccctggcacaggcgaggagcaggagcttctgaggtgtcgccgcgtagcagcaactgcagcttggggctcggaacgaacgagaagaaacaggc

SEQ ID NO: 8699 - DNA, 276 bp, Zea mays
  unsure (1)..(276): unsure at all n locations
gacgacntggtgtgttttcatagccgtccggacctggtgcggctaaaccggaaggcattgttgagccatggttttctctaattatcggaagcacatgactctaaatatccaaactatatatactaatgtgtgtatctcaataagcttacaatgatacaaaaatatgaactagtacgaggactgttttgcaaaaccttgattgtccagttctgcttactatctccagtttccaaataaagcgctgctctttgtctccagatttcagacccaaaatcg

SEQ ID NO: 8700 - DNA, 561 bp, Zea mays
atgtcccgcacacgtccgttacattgatcaggtcaggtcggactgagtttttttccagtcgatcaggtcggattggtaggatcgggtaacccataatcaggtatactctctctattttaaattataatgatttttttctaagtttgactcatcttattatttttttataattaatattaattttcattgtgatattttttgtcatataataataataatatagtctttgaaattttaattatttcacaaaatttttaaataagacgagccaaatcaaacgaaaggctaacactgtgacacacacgtctcctgtctctcgctttggcttccccagtcatcgcagccgaccagccgtcggccgtgcgcccgtgtttcgtacgcggcttcccatcccacgctttgccgagaccgagagggaacctcccaccgtcccacgacggccgcgggcggggcaagaacatatacccgcgtcactgaaccgccccgacggcatcgcaggcaccacccaaagcaaaaccccatttgttcgcttatctttctctagatccacccccgaagaaa

SEQ ID NO: 8701 - DNA, 711 bp, Zea mays
gggcgacgcgtcaaaaggcgggacaggacatggagcgcaaactgcagaccaaacgcctccgtcacgcacaagcaaagcaacgccgcctgcgagagagagagagagaagaagaaagctttgccgctactcgacttcgattcgaactctcagtcacagggcacaaggcaaaagccaagtgaaaaaaaaaggaactctcctcagaagcaaagcccagggctgtcgtgtccttttccatccgtgcaagcaagcaacaaagcctcagtgcctgtgcctcactcgtcggccgtcgttctagctagctagccttccttccttcgtcctgccactgccagccggccgggcagaagaaggacgaaggacacatgggcggcgcccgcgggccgccgacgtcgtggcgggcggtggccgcggcggctctggcgctgtggctgctcccggcggccctggcgctggccgtcctctggctgccgctgctctgctgcgccgtggccgccgtccgcttcctgagggtcaggaggaagctggtggccagcgggagatcgcgtggcggctgctgcgacggcgacggcgacggcgacggagaccgcgaccgcgtgccggacgagacggcgacggtgcgcgccggcggccggctccggctgctgcaccggtacctcgacgaccaggtggagctcgtcgtcggcgtcggagcccacgaccaccaagaggatc

SEQ ID NO: 8702 - DNA, 1386 bp, Zea mays
tattaaaacaaaatttatcatatattatatataaaaaccgtagcaaagtatggacatatgacttcgtttttatatttttgtttgatattttgagtgatcgatatacgggaacgataaataaaattactccgtgagcgttcgtatactagtgagcgtgcgtatattagtaaactatcagtttttttttcagaaatacagatacggaatgctactgccgagtgccgacgattaggaaacccgagctgtcggatcatacccgctcccggaacccggatcttcgttcactatccggtctgggctatttgtgttccctgcccttccaccactgcctttcctagacgggctgggctcatgggagcataacctgaagagccctcagtccagataactcgatgctgggcacaataggtagcagcccattcagagcctcgcaggccgcgcccatgcaggccaacacgtccgctactgcatgggccggatccgtaagaccgcaaccgaaagctccattctcacattcacatccactgttctgctcgcaacacacaactgaaaactgtgtcagcaagccaagtcttgcctgtcccgtgaatatataagtgtctgctcgctgctccagcaagccaatggccgcccggcgatgcagcgtctttcccagcgacggcgacgtcccaaccgcgcccgcgtatccagttttatcatacggccgccgtcgcccacatgcgaagccttgccgtgttctccccgctcctaatccccattagctcaaacgcaatccagctaatcgacctttttctcggtgcttttgcttacaggatcctgtcgaggtacactggcgccagtgtgttccgtcatcagccttcaggccgctcctgccttcactccaacgcgtgtgccccggcccgtcctgcatgcagagcgctcttccatccatccatccatccatccatatacaacacggagacggagcacttccttccaggggaaacgagagctagccgtatattgcggtgcaagacttgggatcgatcatgcagatggatttggattggattggattggattgtgtcgcgcctggtaattcaacccctaagctgaagcaaccatccggtcccccaaggcaaatcgtttgggcatatggcgtcgtaaaccacgagccagaggcagatcaagtgttcgtcaaggcgaaaacgaaaccgatccatcggtcgatgcgaatttctctcctctgcgtagcttgcaatccgagccagccacgcatttcgcaggatcgacccgtattactatatatacgtgaccaccgcgtggcattcgcttcatcagcagattaattattaaccagctcgatcgagtaaccaaccggcgcttgatcgaaacttcaccgcgaca

SEQ ID NO: 8703 - DNA, 1500 bp, Zea mays
tacgtgcatgtacataccagctcctataggcaacaccaacgtaatacgacatcctgactgctcatactattatatttgtaaactaaactatcctgctaatgttatatgaacaaatatatattcagaataaatctgtcacttctatgatgaacttttggaacacactgctgaaatacaatgtaatatatatggtcctctcagtctaccgtaggtttgctgtaactactacaattacaatctcagcacatcaacttctgtaagcactggaaccagtttaaatttgcccttaaatttatggcagcatatggtacataataactgctaacaactactctaagtgtacatataattttaatacataaccccaacgaaactgatcgtaaaaatggttcaggtycaccatgcgcgcatggcgcgcaccatacactagtaaaagtgaaacatgatgcaaagggacaaatggaataacacataagaacttatcttattgctttaacattttcagtatgtttcttattgtattggacaaatttataagcataccttcggctcctgaataatgggatgcacgaagattctttgaaggctaagcactacgaagtcgggacccttccaaagatactttttgtagggtaatgttcatctatttataggggagacgaactgactttgtacatatttacagtaatgcccatccatttttacataagccatttacaaatgacattagggtagtaatgtacttcctcctttctcagctccgcaaattccaaccctcgtcgtccggtagccttccttttggacttgtggcccaagttgccgccttcagccattattttcgttgcttgcgtatagacgaaatgcctttgtacactgcttttagccaaagcttagctttgtccgtcagtgagaatattcctgaaacacacttgtgattttgaaaatggttgcttatgattttcgttgcttgtgattttgctcttcgtttttcgactttatgattttacccttctgttttgaaaaccaaattaccgtttgcctcaccctctcaacgccattagtgaaaatcagatttggtgattaaaaaaataaaaaatgtgaaaacaatggatgaaaggtccaaactgccctccttatattatatatgggtgttacctaacaagagtaaaatcacaattacataatataacaaagggcaaaatcacaatacatgtatagacatttttgtcttttttatatcagatttaacaccattaactacatgaaacgacgcaggggtatgccaaagcctcgtttccaaaaccaagggttaaaattacaaagttaaaaaacaaggttaaattacgattgcaaggctagagaggttatactaaatgcctctatagtttacgtggctgacctctaacataaaaatgatttagttctgctaagagtttaaaaataatttagaaagcctaaaatatataaaaaacggttgatttgaaatagtaaaattgaacg

SEQ ID NO: 8704 - DNA, 1119 bp, Zea mays
tgtattgttattatagcaatggatttttttaatagacaaactttgtatgagtgttctcatataaagattaaagcaacggatagttaaaggccacaacaaatatgcagttttttgggaaaagaaaaattccatttagctagtcttttcgcctgattttggtctataattttgactttacagatgaacccgacaagcaagtctagagcacggttaggatcaagaacatcaacaatttctagcctttaaggttacaaccaattgtctctacaaagttttagaggcagcttaattttgattaacaccacaacacatggttatacatatgttattgttgcactatttttcccgttgcaacgtacgggtatttacctagtacaagtatacgacccaatagagcctagcatgtttagacgagattctaggattttttttagattcagattttttgattgtgttgtgaaactcagatacttatctagatgcagatgcatattctatggacactccatgcaaatacaatacttagaccaactccagcagtgtgcgactccgtatccgtaaaacgcgcggccgacacattctctctcctctccgtatccggctccggttccagcaacactccccatcccactccgcatgcagtctatgacacctgggccccgccagcaggcgcgcgcgcccgcgagagagctgcggagaggagagagaaagcgtggaaatggggagtctgggtacacgccgtgcgttttacggagccggatacggagcctgctggactgatgaatagtgtgctagacttcgcaaaatacggatccggagccgcatgcggagtgctgctggagttggtcttaggaaccggggaggaaccataatcccgaaaacaaaataaccaaaaagtcaagccattaacttttctcatacatcggggaagcacctttgaccggaaaaaaagtaaaccttacccccggtataacattgctctttgataggagctggtggactgggaacacaagggccaggagagtgggaaaatgcacgcttgcggacacgacgcgcacacgacaatgcttctagggcctgggggctgccagaatactccaggatcgcaagagcgaccta

SEQ ID NO: 8705 - DNA, 1500 bp, Zea mays
gtataaaaggaatgatatagagagtgttcggtttatagagactaattttagtccagctattttattctattttagtttctaaattagtaatattttcggaaagtttccgtgttggataatttagtaactaaaataaaatagaataaaatagagggactaaaaatatatatttttatactactctattaagaacctaatgtggacgtctagtgctaccacgtcttcaccctccgcggcctgccccacgcgccccgcctcggcgctgtgccctgtgtaccccacacccagcgtccgtgcaaccagctactacgcctgcccagcatctgaccccacccgtgtggctacttgtctatcacattgtgcaaaaaataatgcagaacgagcacttaaactcataacccctgctccagaaatttatcttagtatttagaattaaagaataattatatttaaataaatattttaatagtagcaaccgtagtaaagcacgatcaactggctattatctaaaaaccaaacatcctgtaatttgagagagagagagagaatgggccgcattacattgcattgcagcggatggacctggccgccctcacgaggctgactcgcacgtgctcctcacacctcttgtcttgggccgaaacaaaggtaggcgaggacgcacgcagcgcagtcaaccagatgatctcccattctccatyttccaacatctgaagaggggttccaaattctgaagccgatggggacgcagagcgaaggctgcgacggaagctggcatgccccgtccccacgccgccacgcgcgatcgcgaccccgaagcaggctcacgaatcgcaggccggggagcgcgagccgacgcccgctgatcatcaggctcaagaatagcaagacatccctcccctaaccaaacggggcaggggtccggtcagctcggccaggaattccacgagcccgtccaacgcgcgcctttgtattctacgtgctattcatgcagcgtccggcgccacaggccgcgatcggcggaggaccttctcgccgcgcatgcatctatctcagcagcgcccggccgccgccgggccgcgtgtttgtgtttgtgtgttaggccagccgggatcgcgaccgccgttgccatcctcgcgcatacggccatggcgtactagctgtatcccaatccccaactacgtacgtgcagtatagaaactagagaaaaatggctgtgtacgtagacgtagtggtggaaacttgggggagaaaaaacaagaaccgatccatcgtcaacgaccggccggggacttgctggatggctatgatcgtgtggcctgcccaactggatagtggccgccttggaacggcctgcactgcctacagctctacctggctataaatatggccgcgatgcctcggtgaattgcatgcagagtgcagtagaacggcatcagttacactagtagtgctcatctcgctggtactgctgagctgaccaccgccgatccttccaag

SEQ ID NO: 8706 - DNA, 905 bp, Zea mays
tctatcaattttggtggaatcaacccactcctcatatatatatactaattattagcttataaggaatggagtgatgatggatcaactcattctattcctcaaaccaaataaaaatgtgaggagtgagaagaagatggatcactctattccttaaaccaaacacaccataaacgaatggccacatcctgattttttttcatgtttggtttcagtcgctacgaggacagagacggacggcgcctcgtctccttatcatctctttatcatcacacaggaacgcgagggagcaaataagacacaaaacgttatgtttggtttcatgcctagccaggcaaagcaaggagtgcaaggcaaccaaatgtccaaatgtgttctctcttcacctgctacagacctcaatatgggccaactgacgtgcgcacggcccatctcagtcttactgaatgtgtcccgaacacagaaacgagcccaaaaaaaaaatccagaagagtgaagagacgagcgggcttgccgtacctggtccacaatcatagagatttcggacccaaaccgatgcgctccggtcctggtcgtctttctttcgggcctctccgagtggtcaataaaccccgcctcccttctgtcatcccgtacgtctcgacctcgcagccgcaaacgcgaaaccctagcctcgagctctatctccggccacagctggtcaggtaggaccgtaggaatctcctttcctcatcgttcctcgggtggttcgtgccccgcgccccgctgctttctgggtttgttttgatttttgaaccttctcttgtggggtgccgtgttgggttgcggagatgtggatgcggacgcggacgcggcgagggctgctttgctgattgattattgctttgtgggtaggttagcgacgaagg

SEQ ID NO: 8707 - DNA, 480 bp, Zea mays
ggtccatgtcttcagtggcgccctcgagcattgggcatgatcttctttttcaaaaggatcctaggtgcatatgtgttaggtatttaaattcagggtgctgcccttatgtcagtactgtgatcatgagcttcatgttggcatgctcgcgttgttaaaattggagtgcaccacaattaattgctattactcaatccaagttttagtgagaacagaaggcttgataattagtatggtggctgtgttggattgagtattaggatgacaattatgttgttctagtttaaacagtatggatytggccttgaaagtagaacattacctttacatgtcaatgacatgcttattattgccacctttgctcgtgtcttgtatgtttctcctcccactattttttattattgttctgaatcagtacataattgcatcttggtgtcagttgtaatatttttcacatgtggctttctattttaggttgtgccg

SEQ ID NO: 8708 - DNA, 70 bp, Zea mays
tcgccgcgttgagtgaggagagaaaaatacagagcgacgcctggggtttgggctttttgagaaatggggg

SEQ ID NO: 8709 - DNA, 997 bp, Zea mays
agacaactagaaatgaggatcactatggtgcatctatccaccatatttccgtgctccgtataaaaaatgccttataacttacatgcacaaaactaaaactccaatgacgagcaaccattttgtttctctgctttatgctgatagcacatgcttaaaattgaatttgcgtggactaacctgaaaaattacatccaaacaggtacaatcgaaaaaaaattatccagagttttagatggaaaattrgctccgttcttcctcatgacatacaagaaaaacttcacttctyagagaaagagtacttcaagaaccactatgcagccactaaattgaattttagcttttttgtttcccaaccttctggtttccttctatgctttctgttttctcaatgaagctatctgctaatgcagtctgtattctattgaattcaaccagagttgataactcttagaacagtggtttgtattggtctattacatagatttcgctattcctgcacttcattatatttagcttatttgcacttctaaattccttccaggcaatcttgtcttcattttttatttatgtttgatgagattagattgaaaatacagtagaaaataagtagttactttcataccagaagtgttgaccattgtatttttctaattaaatcttttggcaagttttaatcgtatgaagttatgaacatgatgtgtacttatggtgttcaaaataaactccgacatggcctatatgtagtttgatccatgcagcatgtacatttattttgtcatatataaactatttgaattattggcacaacactaagctatccgtttgttgagaagaaaataaatacagtagtaaaacatatacagcagcactgcagtctgcagacctggaaaacattcggaaaaatgcctagcagaagtactctacccatcccccatttctcaaaaagcccaaaccccaggcgtcgctctgtatttttctctcctcactcaacgcggcg

SEQ ID NO: 8710 - DNA, 126 bp, Zea mays
cttacgtacggtacgacggtacgtacacagtagtgtacaagaacacgagaagtagcatggcttccgaggagtgcacagggccagcagcaagataacaggcgcgtaccagagtccagagagaagaac

SEQ ID NO: 8711 - DNA, 1028 bp, Zea mays
ccatgtttctctcaaagctacttattcttttgatccatgtattctaatataaaattatgcaatatctttatggatttgttccatatctaatgggctatggatataatctatgtcttctatagtttaaaaaatttccaaagcggtggattataatctttgatgggtttaatcgaataaaaaaatttgattaagcttagattattttgggttatgaattgtgacattaatttaatttgaatctatgctaatatagagctggattggtgtaaacgaacaagatcttaataggtgaaatgtaaatgttcctcgtattttactgtcaccgtgccgcaaaatgcgaggaagtaggaaatgacgtcattagggccggtatgtttccacggtcaattcaacagaacgatgtgcaccactcacgcactgatagggttggattccagtaaaatctattgtatcggccacttgcgtgcagaatggcggaaaagagaaggtgttcagcgatgctgcagcaggaaaagaacgaactgccctgatgcgacactagtagtagactgcttgtagaagctgctattccgcacgagcgcttgaccgcccggccggtccgccccctccggctgaccgctcgccgttccgtggcgacccgcacctttgaccagcctcccaacgcccccgcacggagctcaccaaccgccttgcactcgcactgagtttgtattactgacagttgggccccaagtatgcagggtcccgcgaattagttggaagtgtgtgtaaagtgtacacctgcttcttcctggttgccatctttgcgtggacgggagctgaacgcctgaacctataaaaacccgggcagcttccgcagccaattctacagcacatcacaacgcaagaaagtcgatcgaacctgcgctagcctatatataggtcttggttgacaccgcctggtctccgagtccaagaggggaagcagcggctctggacctctgatcaatctagcttagctttcttcgagttcagacttcagagcgcat

SEQ ID NO: 8712 - DNA, 288 bp, Zea mays
agtctccgccgtacgcctccagccgatacttgctgttctttgtcgatccatcatctgtgctcgttaagtcttcactgccgaatagtatcgccacacaagcatttctgcagaacagaattgtgcacggcccatccgcattccaaagcagagaagtgtgtggcttacctgcgtacacttcagtttgattgagtgtaggtgttgctcgcgcattagaccgtctcaacaagagttttatcagagtttggtggcattaaatatgttgatatggtatggaataaacgataagag

SEQ ID NO: 8713 - DNA, 439 bp, Zea mays
tgttgcatgaaagaagtcttgtataagcaatatgcaaaacggtatcttggagatgctggctatggaatcttaacttggtgggtctcttgcatgttttggttctttttggtggaaaaggacaatgttggttggtggaatttgctccaagagggccactttgaggtgcaatccttttcaataaagcaataggagaacacaactatacttgaccaactatgcctaaccaaatgcccaccaaccattgcacctaaaacaatgaatgaagtttgttgagctatttacatagcatttgttggccgttggatactcgacggcttctttacagagtaggcaagctcttgcctgctctctgcagagttttactgatgggtacgatttctgaatgacaggtgtcaggagctgttacgatgagggcaagcgtacagccgaaacgttgacc

SEQ ID NO: 8714 - DNA, 286 bp, Zea mays
ggttggtcaatatctctcatgtgcatatccaagaattttcatcttatgttttttttgcctaattataagaatttattgattcaacaccgatagacttcatgaattcaacttattttgatagttatcgtgttaagcaacctaacttgcatcttagtgtaactgatctttatgatagccacttgaatttgaacgattttcaggtggtctactaattggcaggacaattgcagtattcttgacactgacactagctacatccctggctgcaagggaagggcctgttcca

SEQ ID NO: 8715 - DNA, 760 bp, Zea mays
gatttatgggatgtttggtttctagggactaatttttagtcccaccattttattccattttagtctataaattgccacatgctgcttaatgctagatttaggtactgaattcggatgacagcgaaagtgcaagtgccaattggaacaaggagaatacagaatagcaatgctgcagcagaatatttcgcaatctgactaacggtacgtcggtagctacagacaaaaaaatatggagactaaatatattgctctcacatgaaccgcacatgattcgtccaagtataatcatgattagaaatctcaaagaaacaacaaggtgggattggatgccgagcaggtagggggtgagcggagaaagaagcgtacagaagcccgtgtggatcatgaagagctccatggcggcgccaatggaggcccctaccgccgcgatcttcaggtaccaacccgcgaatctcatatgtccctccccaagcaaatcctcagaggcagggaggcagaggcggccggagcgagctgagccgacggcggcggcggctttgatgaggttgtcgagcgacagggccatggcccagtgaaagccaaaaaaatcctgaccgttcaggccaaatgaatatgatcgacgagcaggatcaattcgtttcctttgctgcccaaacaaaaatggggctcacggcccaccgagcccaaaaggcaggcccgcatcgcgttcgatttccaaccaatcacactccgaccactgtgaccacacgctcgcgcgccc

SEQ ID NO: 8716 - DNA, 291 bp, Zea mays
ggcaaccgttaacagctcgagtacaaaacgagagatctggctcacagtttgaaaagttctcgtagtttcaactttaatgtttccattctagctgatgtgctaaagaaaccttaaaacctatgcggctgtgcctgcacatgtaaatatcattccactctgtattacccgaacttaatcttcaactagttacttcgatgggagcaatctatctttgttagttcgtccacttcgtagtttatctgtagtacttgtaccaagcagaagttcaaggagtacctgattcgagaaaac

SEQ ID NO: 8717 - DNA, 273 bp, Zea mays
accagccttttagttgaggagatagatttgggagatggtaatgtgcgtcaagttgttagtggtcttgcaaagtattgcagcccagatgatcttactgtgagtagttagctgcaagaaggaactcaaattgtttttgaccattttctctctcatttaagatgtttgacctatgttgctgtgttttgctatgaacacctgtctgtcgttttcttctttcagaatcggcatgttgtcttgatcacgaatgtgaagcctggaaagctgcgagatgta

SEQ ID NO: 8718 - DNA, 522 bp, Zea mays
cttgcatgcctgcagacaatctgatacagtggatcaaacgtggcacaacctcctctctcctccacacagccactcacgcagtcacgcatgattctctcccaaactgcaactgcacgcacgacagttcctaggcacgcgtgtggggattgtctagggggctggcggctggcagcgccgtcgagcataggcatgcggaggcgttggctgccgcccttggccggtggcgaggctggggcaagggcacggggaagcgcggcacgcagggcgccatggctatgccgcaccgctcggctaggaggcatacgcagtagggagcgaggaccagcgtgggggtggcgctcatccacgctggagcaggcaggcgcgtggcctcgccggagcaagcggctgccgcggccaggaggcacgtgcggtgacgcgcagccatggcagagcggtggcggcgtatctcgtagtggcgcgggccggtagggacacacacaagagggggcacgagcggttgggggcttgccggccgggaag

SEQ ID NO: 8719 - DNA, 1500 bp, Zea mays
attagtgtaaaatagtgttttgcacgaccatacacacaagttgcttgtcaagttgtcatagcctaagagagaagtaaaaaagaggtcgaaggaagaagatcaatctgatatgtaggcgtaccatcaacgtagtatttttaatcgtgtgaataaaactacagcattggatatatcccgacgtggatatagatagtaacatatctcaagcatacaataaattataattataatagcaagattctagatagaaaaatagtaatggcattaattcaaataacctttttaaaagattgttgaggcagcgagacaatatcgtgtcaacgacaatattgcagcggaaaaaaaaacatcgtagaratgaatatatgtgggaagtaagcaaatacccacccctaggaataaaaaaaggaaagaggagggaacaaattaatcatcataaacatttttaaaaaaataccaccatttaagcggtggtccacccgtacagagcaaactccccatgaaatccgaaacgctttgttggagaaaatatttccaaatctatattttcgccaagaatctagtatttgtagctctgactcacaccgaagtccacggcaagggcgacgacgtggacacgcacccgcagaacgatacggtgctgcaatctagtcgattcccgcgagaggatcacgcgcaaaaatcctccggaattccaccgaactgatgtgtggggcggcagcggatcgatgactggccgggtagcgacagcccaccgccctcccccgcgcgcggctggcatggcctggcctggcgatggcgagggaggggaaaacgaacgaacggaccgcgacggcgacggcggcggcaacggagcgccggaaaccgcggcaacggagccgctagcttttcgtcgggcgcacgggaaatcttatcggctctgtggggtggggtggggcgcgggaccgggtgcagacgtgcagtgacagcccatgcccatccatcagtccatcctcaacgattgaacgcacagcgcccggcgcgctacttgcagcagctgccagccatcgtgccctactgcggccgctctcgccgcccgtcccgtcccgtgtaggccaccatcccaccccaaccgtgtcgtcgtcatcgccttatctctctctctctctctcccatcatttatctgtctatcttgatctcatctcctatcttcttcctcctagattctttcttccgcgcgccctctctctctctctccttcctgccttctgcctgcgggcggcccatgtccgtggcgcccctcctgccctgcgagctgcttctccagcgaaaaggttgctgcgccttgacgcaccaccgatccaccgccgcccaacccgagcgttctgtccggcagctaggtagcgagctgcgcggtggctgcgaccggaagcagggaggggaacagggcagcgaacgcccggcgattgccttgcttgcctgtgtgctccggccggcgcgagttggtcggtcgttccatgc

SEQ ID NO: 8720 - DNA, 885 bp, Zea mays
agttctgtgtcgcatacctcgctgccggcgcgcgcagcaacaccgcctcccccattggggatcgggtgaggtgcacacgtccgccacgaccacgacgtccggactccggaatgtgtgtctcttggccacctgatgccccgcacatcacccagtccgtgatgctaggacccacaactgcgccaagggcccaaggctaggggcatcccggacaccgtttccgatattagtttaggcattacttagaatcttttttttgtgcacaacaaaacaattgtatgtcagctctagacctgatcatgggcagccgacccgacccgccaaaaaaactcggcccgatccaaccaatgcaatggacgggtacgtgccatattttttgacccgtaataattcacgggccggatatggaccgtgatttttgacccaaaacttgattcaacccaaagctaaaaaatctgatccaatcaaaaaaaaactcaacccgacacgtcaaacaggaaagcacggcaccgactcgacactagcacttgttagatacagattgtgataaaacggcccaccttgatccgagccgaactcatactagtcagtccgttgtggcccgtggcgagatattttggtgcgcatcggcatcgcaaggtatgcgcggccagactggaaacggagatgaccgtgaagcagtcgtacttgtacactccttgtctccttcgctttggcacactggacacgtccaccacgtgaacacgtcaacagaagtgacccatcaaggggcccacaggtccacgagcccgagtgacgactgacgacagatcgcttgtgcgtcgctaacccgccgctagtcggctagtgggtgggaaatccgcagattcccgtcgctacttcggccac

SEQ ID NO: 8721 - DNA, 1500 bp, Zea mays
aaacaacattttttataactaggagcaaagggtcgcctaaacggtgttggcggtgacgactacgacggatgggacgcgacgcgtccagtaaagccaaaattactggtcgccgttttccgcacgcaccatgatgaatagtcgccaagaaaaacaagcatatctgacactgtctccatatccacggcggtcgacgtcccatctcctcaaattccgtgaaccgaacgcatggcgcgccggcgaggcgcgattggccgccgtgaacatccccctacggccctgccggctgcctcgtcgacctggtggcatgctccgatccgttactgttagccaactccgatccgtctttttgaacccacgctgcaaccaaacatagaccggtaaccattcacagtaaaggatacaggtgcaataagttccattcccaaccactaccggttgcggaaccaaagtaccaaacagcacgctagtgggcactgataaatgagaatatagaaatctatctgataacgagctctgccagtgccaccatcgtcgaaactcggcagcactagcgcacgatcccaaccaaatcattggctgcactgtatcagtgtcagtagatcacgccatcccaatgacaaagccacaaaaatacatgaccggagaacgagagagagtttgccgtacgtgagaggcacacatgcacaagagcagtgtataataaacgcgtgtttccacggagctgctgcggagggggtatactgcttactgcatatccaaagcaccagtcgtgcccgtgccggcggcccacttgcagtggtttgtcctggcctcctgtcctgtgtgaaggcacggcattctgtctgtctctctctctgtgtgtactgtgacaccagagcgtggaagcatcaggcactgcaccgtctgcacgagagcgcacatcttcaaaggctagcagcatattgctatcagctcacagttcccgcgctggcgctgctgctataaacaaacctgctgttgctcgccgctcgctcaccaaagaccattgcgtgatagattgtaccggtctcggtctccgtgtctcactctcaagttgcagctgccagcagccagtcatttcgttggcaaccagggcagaactaaatatccgtggataagagctgcactgtgtgctgctgagatatcaagaacgtaacgtacggtggaagacaaggccccgttctcgattagcccaagccaaaggtccgttccgtttacatcagtttttttttcttcaaaatatatgtgtgaacgaacaatagtttgcagtacacgaccgaaacacaatatttcatcgattccttccttgtcttctcacctctgacgattctgtttctgaaatctgcttcctgcaaaatggttccatggtcacggaattcgccatggtcagagtcagagagagagagagagagtcgtactggtcgtcacctgtcgaagattttcggtgtctcctgagccacagctgctgctgctgctggaacc

SEQ ID NO: 8722 - DNA, 697 bp, Zea mays
ggggcgagcggctggtgatcgagttgtcggtggttggatggggagtaagcggttggggagcaagctgtcggtggttggatgggaagaaggagcgagcggctggccagcgtgaagaggggatcgcgcgcggtgaagcggggagcggctggacgacgagctgtggcggctagggtagggaagattttttgccgttgcggctcgagggcaaggagaggaatttttgctgtttagtcccgtttaggagcccttggagggactagagaccctctattagttattgtgtttggggaattagggactaaaagagactaaaatgtagggactaaagattagttctatggaaccaaaccgggcctaacgctaatccattactcgtttatttgcttgtttaggtttttttaaaggatatgatccgctacttctgattctgaacagggaaagcagtgtgtgcaaatgtcatctgggcaggccatagtggcccagcctgaaattgagctgtttgtgccacttggcaattcggcccgcccggatcggcccgttaagaactgtccctccgaaacctaaggaggggtcaccctcttcttttttccctcgagaaaaataataaggtcgccgccgtcctctcctcgccggcacttcactgagggcgaagaaaaaagtggcagtatattctgccactcacccaagagccaagatc

SEQ ID NO: 8723 - DNA, 1041 bp, Zea mays
ctgcgagaaattacgttcatgccccttacattttctaatgactctaaggtaactcatcgaggtccaaatagccttttcccctttaagtcggttcgtttttctgcgactaagccgaagcttctctgcgtgtagcttcggtttaacaacaacattcgtcacgattcatcagcagccttcgtcatcaccatatccaaaggtacctgtccataaatcatacttggaagagattgttaaattatatttttgaggaccttcggaggacgaatgcccccaacactatatatttcacaacatctgtagtttacattaattgtcctgcttcactggaattataatgccttcgtatgatcaaaacattttttatttttgttaatccagaatttttgttaatgtcctgacttgacttgatgagataaatatatattccaacggaagaggctctacgggtatttcttttttaggctagtttgaaaactttattttctcaagggattttcattttcacaagagaaattagttcatttttccatgaaaaaatagaaattcattaaaaaataaggttccaaaactagcacttaggactagtttagtttagaaaccacctttttccacggaatttttattttcccaaagaaaataagtttattttcacttgggaaaacgtaattcccaaactaactcttagctttctcgatctcctggattattcctaacctttcttcccggccaaggattcttcctcgattccatccgtcgtcctccattccattccatcccacacaagatttcacccacccacgtacacatgtcattggtatgcggaggtattattcagggtggctggcgttggtctggtcggtaccccatcataccaagccaagtttcgaacaataataataataataataatccatcatctcatcttccctataaaaatatatacatacacacatgcatgcatattggtagctcatcatcgatccagcagcacacagacgagccgacacaagcagttagctatagctgctagcctgatcgcca

SEQ ID NO: 8724 - DNA, 1500 bp, Zea mays
agagtggagagcaggttgggagcagtgggaaggagttttttggctcccactttatagtataaacatagagactagattcactctactcccaccgtgcagcagtttagatttttacagtttagctctgtaagagtgattctcgctgaagcggagctatggaagctctgccaaacacccctttaatcttagcttctaaggctggctccagcaatagtctctaaagcctcctctaccctaaatatagaggaccaaacagacctctatgctctccagcaacgtactctaaatggtcctctaaatttagagaacgttgctggattctttatatatagagtttctctaaacggacatctatccatttgaatactttaaataaccggtttaacaaaactaaaatatgcacaatayatttaagagtatgacaaatacgtatgtaaaaaaataaaaatgtctctaatataggtatttgcgtatagaggacatgatttagagtatgttgttgaagagaaaggatatatagaggataaaatcttttaaagaagactgtaaagaacggatatagaggatgaatatagaggacgttgctggagacagtctaatgactttttacctgcgctgttgtgtttgtttagatcttacttttactatctaattattattattattattattattattattattatagttgcatacaactatattgactcgacgtttgcttctggcttcaaccacggtccaggccccaccccaggcgcaagcggcaagccaacgctcctgccagcaccatgccaccatcaacacacactgtttttcagccaacccctctctccgttggcgctttacggacagcgcaggccgtgtgcgcgttttaactggcacaacaggaacggcggagcgcatgcccactgtcgtggtcacgaggtttcgtccgtacacgcagcatagcagaagcgggcactccttttccgtcgtgtggggagaggtgaagcaggcattttcgaatgggcgcctgatgttctagttccgataaaaatccctacgaaccaagtaaccaactactggggaccgtcgaccatggtggccacaagccaatcacctctattctctctgcaacagatcctgcaaaaaaaaagacgcatgcagtgatgctaaagttgcggccaacccacgcaattgacgtggcaccaccgattccttccggcacgcgctcgccatcctgaccgtccaacttgaactgcctcatcgcagccgttggattccgctaactggacaataaatacattggattcctctccctctcgtacacgccaaccagcaccttttgcctaccccggcaccaccccgcctttgccttggtgttgaaaagtcgccgcgttcctcttgcctgatgaaatcaatcctcttctcgtctagatctgagcctccgcgtggcttccagatcagatgcttggtccgatcaacgacggtgagtcttgctctgttagttgattgttcgaa

SEQ ID NO: 8725 - DNA, 1171 bp, Zea mays
aaaactcctcagtgtagataccaatgactagacaaaaaacatgacaatgagcgaagacattgagcttaaaatgaagataataaacaccaaggttarcttatggagcaaagaaacgattacttgagctcaatgatacagttggagaaatcaacttcaactctctagcataatgcatggtgactaatggggtggtgattgatagacttccgctatcatttgataaagagctaatccaagatattgccaacaaaggcatggacatgatttctaggcttatccgacaacaaattgctaatgctcaactagaataacatctatatatgggacctactttgataggtttagggtttagggactgaattgtctaattagactcccctcttaataggatgatcatttatcctaaatctaatcatgaattctattgcatcttaatcgttgaaacaaaatgtccctactttgaacatttgccttgagcatttgcatctttctttcttctccccttttccatgttgaacacttgatcatcctttatggccctcggcatccttttcatggttctcaatctttctcgatcttggatgtgggcttaacctatctgaaatacaaaactagagtagattttagtctattacttatctcaagggaccaaaaccacaaagcttcattctccatctcacaaaatacctcatctatctcacatgtgaaatgaatctcactcaacaactgttctaatcttactcactcgagaggaactcatttagtgatgttatatggttagctaccactgcacaatcaaggcagaagagctatgctgatactcggagaagactgctagaatttaaggagggtgatcatgtgtatctcaaggtgtcaccacttcgtggaatgaggagatttaaagttaagggcaaattgtcccctcgctatattggaccattcagagtttttaggtgagttggggagatggcataccaactcgaattacctgataatctatctgatgtgcacaatgtattccatgtgtctcaacttaagaagtgtctctgtgtccctgaggaacagttaccaatggaagagctcagtgtttagggtgatttgacttacacagagtaccctatcaagattcttgatactttgacttgagttacaaaaaaataaagtgataaag

SEQ ID NO: 8726 - DNA, 198 bp, Zea mays
cgtgcgcgtcgccgcccggccgttctagacctgtagaccttggggctctggagctccattatatacagaggcaagtgggagccgtttgttcagcaccgctacttgtgctcccccaacgctactaccgccgctagctggttcaagtgcggcgagcggagccggagaccggtagaggaaattaagaggcgtcgatcgggc

SEQ ID NO: 8727 - DNA, 1033 bp, Zea mays
gggaaagtgggggcctatagatcgagcgcacggctcgacccccccccccccccccccccgcacggcactggtagagggtcgtgcctggtaggggagcccgataaaccatgccgcaacctgacatggcacgacgggaaacgagtttgtgccgggtcgacactatgtccgtgtcggggttgggccaccacccacgcacagtgtctaggccctacccggcctgtttaaaaatggccaacacatacaaggaaagcataccaccgctagcactatgtctgtgccgggtttaagccgccaggcacaacgtgcggaccctgcccgacccgtttaaaatggccggcactgtaggctcggctaccagaaaagcataccaccaccattcttgggcccgctgtcccggatgtggcatttggaatactttggacccctctcctagccctcctccacttctcatgaggtgtgagttttatctaaatagatttttaacgagacaatcattgtagtagctcaaacttattaatatttgatctatgatggcctgacgatgtgatctgatctgtgatgatgtgatctatgatgagataatatgtaatctgagtttttattgtggttttgatgtgtaatctgagatttttattgtgacgtgatatttatccgtgaactgtagtgtaatctgttattttaactgtgatctatgatcttggctgtaccgagggggctgatggccggcatggcactgacgcgccagcgggtgatcgggccggcacaacacatattgctgtagaggcgaaattttacataggagcaaattgctttaggtcccctttgcaaacctctatatctgaaggtagcaggatgcagctatagcggggcgggagatatagaacctagctcatgtctataaatacagcacaccccgtcgtcatcttcagtcctcggacacaagcaaataagagcaaatcatagctgaccgatccaaacaacacgcccccgctctctcccaggtccctaagtgaaccaccctgtctggctaggc

SEQ ID NO: 8728 - DNA, 1220 bp, Zea mays
atcctaatctcttgtaattcatggccagcccatgtgagggtataatacctagtatgtggtttctggagaggcatgcaaaacttgaacaaactcatacgcaataacatccgccgccttctgcctcctgttcactgttcttctctaatctctgattcttcttccacttctgatctctgagcataacagtaggccgttcgagttgcgaccatacaggctcgcggaaaatcgtggacagcgatacttgcggatgttgctcgcctgtcccartcctgcatgtgcacgtatgtgccagtgtcaacgaagacagcgatcaactcgatctgttgcctgtttcgtgatagcatcccccatatccctccccatcgagtactcatcccccatctctgtcgtcgtcgctggcgcatcggtgtcgatcgcagcagttcgcttcatcactcaaaaatccatcttcgtcaataaccagttcgggaagctgcgagcgaagcactgaagcagatgcttgtcttgtcttgtcccggccctctcatcctcctcccccactccactacggcactcccggccctcgctcgcttgctcattaatggcgggcactgcatggttggcgccatccatgcccattaacgcctccacccacctccgggccgcccccgcccccatctacttttattcacgccgatcgggcacttgcttccaatacagcgccggccgggccgttgcgtccgtccatcctcatccccatccgccacccaccccgcgcccctccttctcactccagtgctggctgccggccagctccgcccccggggtccttgagctggaggtgggtggcgacgtaaaggcggccgcttgctttgccaccgccggcgctcgtcatctccttacttattcatccctgcggccctgctacacatcggtgccgtgccgcgcttgattccgtcctgtcctgtgcttgaattgtaggtggcggtggatgaccagctctcggagttttctgaggcgaggatcggagggcgttgcgttaggtccgcggttggtgagcggcggtcggagcggtctcgcgcgcggcggggtcgttcgatgacgcaggaatcgcgctctgggagggtgggaatacctcgcgctcgcgctcaaggtgctcgattaatttactgcctgaggctgagggggggcgcgcctgtgagctgaaccgttcccgctgcactgactcctgagctcgggaa

SEQ ID NO: 8729 - DNA, 1500 bp, Zea mays
tgtgcgcgctaccacctagcgtgctggtgacacggattgaaactaaatacatgtgctgaatgacacgatcagaaagaaggttatggtctatattagttaaactttatagtctgcatttgaaatggccggtgtattccgactatatggtatttgggcacaagcgaaatggcccaaagtacaaagtaggcacggagtatatgggccgactgtactagtaaaactgaggcagctgggccctgtgcatccttcttgggctcggtgggcgagcaggcaatgggccatcacgttgcagggcctggactctgcgggtgcgtacgtgttccctgaagccgagacagtagtagctagtacgtactaggaggtgcgaaccgaaaagaaaaggaaggcaaaagatccctggatcacgtgtgcacgcgcacacacacagccggcgacgtgcatacaattcaacggagatctaaccaacctgctaacctgctactactactattactacctggagtgctcaacttgtccttctccaatcaatcactgcagcgcatcacgagcatcaaaccggcggccattttttaaaaaagtactactagcacattttgtccgacccatcggtccgtgtacacacacacacgctccctatatacattttgccagctgactcgccgccgccgcccgaggctttaaaattcaaaccaaattgaatagtattatttttttataaaaaaacgtttattagtcagcgaggccgtgttgcgtcgcgcctctttggactccgtagcagcgggcagagccgtgcgccggcgattcgatccacccatctaattattttattttatttatttatttcgttcacgtttcctacccaccacggaaggccgtcgccgccgtccgatgcgcagcggacggccgtggagccctcacgtagggtgacggcaacgagaaaaataaataaatatataatactagacggaaggaaaaggggtggggagccaaccaccacctctccccctgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttggtggtggtcttcagcccccctcgctcttcaggtttagggtggagcgatccgtgcaggccaacgcggggtgcgtgacccagaaagggaaaccgccggctttttctcttctgccgccccgcttttccaatccctcctcaacctcatccgcccccgcccgcaccccgcaggcaccatcaccaaaaaggtccccgccttcttcttcttcttcttcttctcctctgcccctgcttgtcgtttgctcgtgctcccccaccccctttctgattcagcaagggttccttccgcggcgcggcgcgtcgcc

SEQ ID NO: 8730 - DNA, 1500 bp, Zea mays
catggtgtgagtgatgatttgtacttttttcattgaagatcatatttgaaaggaaaaaacagtaattgtataatttgttgaagaacatgaagaagaattggtagagcatacctgttgttyggatagaagctgcaggctatgtaatttgattcctgaagattccaagcagttagtgactggcaaaaaaacagtagtggagaattcaggtttatgttatataggttgagggggttttgaataataaaaaaataaatggtgcgtgtacacagatattcatggtggaggaacatttacaattttagaggaagaatcttttttgacgctaaacatggtgtttttgtatctatgtacataaatgggtacggaggaacagaatgtagtgttctagatggaggactttattatttcacaatgtaaataaacatgatatatgtggtatgaaccttggatgcattttaagttaacttggtagcattcataacatgtatggtgaagttacggtgaagtattttgatcattaagaaatataatgatcataattgttctcgtcaaaagaaactttggaagaataatatagttatagaggcatgcacagtatgtaaattagtgtgttggtattgaaacaaatacctatgtaatcatatctattgctatttcggaataaattcctatgtaagtttaaacaatgcttctattctctgaatatgtatttgtggggattgactgattttttttctgtatgtattgagcaacgtttttagtagatgtatgcacgtgcaaactgtttatatgtaaacattctgtggatatttacataatttaaataaaagatgtctggtgaactgcaatttcttttctggcattgtggaaaaatagcagcttgtattctatttatagtagagacaacattgtatttatcggagaaaggatacttgtctcggctcggatggaagctgtaggctggccaacggatttggtgacgattggaaagataaaaaaaatatgagaatttattgtttgcagattgaggagaagcaagaataatattgtgatgcagcttgtgttaaaatgtagaagtgagcatacctgttgtagttggagtagcagtcactggttgagtggagatatgttttcgcagcgtgctggcgcgaactgcaggatcagttagaagattctaactaggttagtagttattgtcgatgtaattttatggtcatttatgcatatgcacaggatcagttagaagattctgacaacacaacatcttttattgttagaagattctgacaacaaatcatttgtagatattgtgttagggaattatacaaatcatttgttgtttcagaagttaattgcattgacaattcaatatgcagatattgtgtcagggaattatatagtagctattcactaagaagtacatttgcagtacacaatgagaagaagcaacgcagtacataatgagaagaagcaacgaatatgaactgcagcatcagttag

SEQ ID NO: 8731 - DNA, 998 bp, Zea mays
ggttcgaatccacatcggtcttaacaaagtactgccagtgttcttaatttccttccgctttcgcatcgcgccatattgcaataatttacattgaaaagatgattgctaaactcaaaattttatcatgtggcttacgaatttctatattagttgatctgattgagtttccatcgcatccagggttgagatttttaaccctattgatccctatttcagtagtcctttgtatgtgcttgttcagacaccgctggctgcagactgcagtggtgattttaactcaaagtgtcgccgttaaatttagtaaaatgttctgtccttaacatagagctccactagaaagaatgtcatttaattcacagtacttttttttacctttctaaggatgaaaggttatgatttctttgacgttgtcgaatccgtggtagaatgctcgatcaaaggttatgatttctttgaagtagtcgaatcggtgcgtgcaaggttgtcctctaacagattgtgtggatcaactatgcgtgcgtgccttaatttagcctaggaatatttggaatctcagcctttgacgaccttgccgtgccaagatatttttttaacaaaaaaaaaaacgaaaagacgatgccatagtttgttctttcctcgaaagggacagagtagttcttgcaatttgttcacctgaggtcttatctagatattctcgtattcacttcaatccacacgagagtatccaaacaaggcatgaatgttttcggttccttgtgcttgattgggtatttttggcaggcttttggtccgaaaattgacgaggaagtggtggtttctcagtatcaatgcaagtgagacgctgctctttgtttctttgtcagatgattgcaaaaaacatctcgctgccccttcgattcagttttattgtccctgtggccagactcattttttcactctttgttgttcatagcaccgaggacattgacgagttgtctgccgaggagctgcgcgatgcg

SEQ ID NO: 8732 - DNA, 263 bp, Zea mays
tgcagggtcccgcaccctgcgtagaagtcttttttcccaatgtatcctccattcgacgccgggaacatggtgccgccgcctcccgagtcccgccgaactgccaagcgcgaacgcttcccgtcctctttaaagccaggtgtcgtccagtccaagtgcttgctcccaaccatttctgcgcgtgcgcctccaccgccagaaccccgaagaagagcatccccctccttggagattttcagtaaccgttcctgctcgacgccgacggc

SEQ ID NO: 8733 - DNA, 1012 bp, Zea mays
gtagcaagagcaaacacatggttcatatagaacaaaatgctgaataaaagagacccatgtccttagttgtgtgttgccttttctcctgtgcctggaactccattactgattgtaggttctgtttttttactcgtggtataactggaacatgagatccttcaacagtcactcataagccttttgtgaatgttaccattaatttgcctagctagtagctacaatagaaatactgtgtcaccgttcactgatgatttgcttgtaccatcttctatagtacatcaatgcagattttttgatagtttttctgtagacatttatccaggaacattgataaaatctttcagtcagaaggatttattttttagttcatctgttgcatcattgtatccatcaaagaatccaacttctagttatactgaaaaagagcaaactcgtatacatcattcttgcatttttttgctagggaatagaaatgcacacctactagcaaactcgtatacatcattgataacatttttttgttcgaagaataaaccatagtcatcaaaatacattaacatatagggatcatgcagttatttgctgacctcatagtgagttgccatagaaatataggtttccattggtgtcaaaggcatttccaacaatttgttcgccgtgtaggttttaaatcctgtaggactataataatataataggacagattatctcggatggaagaattgttcaatcttatctgcagttgcttaccaaagattctagtatgctgcattctttgttgttacattttagatttttttaaagaaatatgcttttctatatagggaaggatcggcatgctctacagagaagtgttgcagagcgttaaaagcagtttgggaagactacagaaatacccaaaaagatcgccccctagcttctgaatccttcaattctctagcctgtaaaagaacaagccaggggtagctaaatacgacaaccccagcacttactcattatctttgctgacagt

SEQ ID NO: 8734 - DNA, 447 bp, Zea mays
ctgcagatgtggtaatttgaatcctggaccctagaaatgcaaccgtaggataccaatgccagcatcctccaatcctgagaaagtgggcatactactgctggttgtcgtcgtcgtcgtcgttgctattctgaacttctggtgtagttttatctggtgcttttgctgcttttaagatcagcatattttgcaggattcaggcattcgttcatggagcacttgcctttttggcttagactttagcacacattttcacgtttagtgtttacaataacgctgatttagaccttctgagccgtttgaatgagcgggagatggaagtgctatctcgaatcagaccgagacagagagtgaaagtgaaagagacactcaatttaatgagcctgtccaatttaatgcaatgtaagaagcagatctgaaatttgaacatcctgtgcgtgtgtgtgtgtg

SEQ ID NO: 8735 - DNA, 1234 bp, Zea mays
gttgcctatcgaattctcttaactgtacttrtgactgtagtttcggctaaaagaagtttatcaaaattgaagttgttgaagaactatcttagatcaactatgtcacaagaaatgttgaatggctgggctatgtgctctattgaaaagaataacttggacactattgatttcaataccgtttttaatgattttgtataaaaaatactaraaaaagtatcttttcatgagaaacaatgaatgtattgtagttttattctttgttaaggtaattatattagctctaagatacaaatatattgttattttagatctaacatgttaattaaatatatcaatatatttgtttttattgtacatgtaaaattagcgcatatattatatcatagtgtccatcgcgattagttacatgagaccttcaaactcaaaatcctatgaccgggccccctaacactactataatttggcccaaaaactttttagcagtcaacattttcaatcttttagcacgtacaggaaaataagaactgaaacaagcgcatgtcccccgtcccgagtcctagcgcgactccgtgcgacggcgaggcctctgtcccgtcctcgtctcctcgaggcccggaggctgcgagtctgtgacacttgaccgtgaggcggacggcgactcggaggacttcaccagcgagtccctcaagcaccgaggccgagccgcccaccgcccgccgccgcctcgcctggcgctagtcgccgttgccgagcctgttcggcacatccgttggggtgccggggcaccgatcaggctgcgcacagccgaagtcggcctccgggtgccccaagctgcagagcagcgcgccagcgcccgtggaccggtgaatcagtgagtgtgtttttgaagttctgagctttcacaaatccgaaatctcataccctagggtttgacagtaagcactggactataaatttggatttagagattgtgtatgtgtgaaattggtgtgtgattcattattattggctagggatttgttcttgtgaatgaaatcagagcatagaattgaatgaaatttcttgtcgtggaatcaaacttaatagaatcaatttggttaatttgtagtcatgtatagcaatattttattttttaccttattgcatatactttttttttgactaggactacccttgtttcaaatcctgggtccgccattgggggcggtgaggccaccctagtagaggctagagg

SEQ ID NO: 8736 - DNA, 691 bp, Zea mays
ctggccgtctggtcatgttggagtcctcgatggttttggttatagatgcaaatgtgtcgaaccagatagcacatgctacaaatgatcgatttgtttcctttgttcaaagcaaatatactgtggcaatatgctacttggctatgtaatgttcttcacattttaacttagttctatttggaatggttttggtttcaccacctgactttatttagtaggagagattcacttaggccatattttgccaaaagcgccttatctctttttggcagggtttgggtttctcaaagaacggtaaatactgacaaatttgttgtcgtctgaccaaaatcagttttaactttaccgttttccgttacctttcgttttgacagttttttatcactgcaaaagagggcctcggttatgtcacactaatatatgtttagttaaattcaaaagtatttgatttcccgtgaaataagatatacatttattttagatcagggacgtgtgtggtttgatatttgaattttttgcttggattggacatggctctcattggacgcctttaatcgggattgtctgatctgtcactgtgttatgtgtagtctgatctatcactgtgtagtctcgtcaaaaccgctgtcaccgagtatttccatttctacactttcgtgccctccgttcccctgcctccgccgtcgccgcagcc

SEQ ID NO: 8737 - DNA, 183 bp, Zea mays
tgccctcgcctctctccggcgcgtcgctgactccccactacccgccgagttctacaacatcatcctccaagctctctcccacctcccgtcgcacgacgatgccattcgcttctacagcgaaatgacctccgtctaccgcgtcgctccggatgtccacacctttcacatattcttcagtagctc

SEQ ID NO: 8738 - DNA, 1454 bp, Zea mays
ataatttaaaataaatatgtcaacatgacacgcatgtggatattagaaatgtggacatatgtaaaggttcaacgactacatatgataagtgcaacaatatgaattttaatgaagatagttacatacatctccaaccttttcttctatccttgtgagattgttattatgtgcccattatcattaattctagtaaggtgcgacacttgattattattttatgtggcttgtctttcctaaattgcactatcatcaactactttggtcaattcagcttctatgtaaaacatattttagtctatatccaagtcttctagagaggtatagtaaatagttagttaagtgtcatatctcataatgggatttccctacattatcaatagaatataaattaaagtattgtcaaacttggatcttacactactgtatactatattttcattcaaaatcctaatgtagggctagttgttcccattgtggtgaggtgtacaactttgtcaactccatgctcctcttgttgttttcattcaatttgaggagagctacaaaggcaaagggtcacacacccttcctcgatctcaagacaagagctctcgctcttagtatgaaaaggtttttcactatgaatgagggtgacttacagcaatccaagaggggatgtcacacgccggctaggagcaagctccaagaatcaatgagtgaatgtcggccttaagttgctccaatgctcaatgagaaactggggaaaacctagggttcttgctgttcttggggttttctctcagctttggagaagaagccacagaaatttgagccaaggtggagcaaatgagggagagggagactcaaatgggacaaaggggtactttaacctgtctgttgtatccctatgtcaggatacgcagcaggtaactgttggagaccaaggaattaaacaaatcaagaaaattcagattccaacggtcaataaatgtccgtcagtgccggagttaaggccggcagtgtcgtggcaccgcagtgccgcgcaacccacaccggttagattgatctgaaattttggcactagctaactaggtttaggtatgataggaaagtaatccttgattggtgctagtttacttattttgttttaggaaatagctaatatggtagtagttcagtcctatatggacaggtctggtcggcaggatcagggctgatagcagccggtttatttccttgtaatgattagtttgtttccatgtaatggtctataaatatatggccttagaggctaagaaaaggcagtcaatagggcgccaccaaaacctctctgtgttctgtctctgagttccagcattcgcgcgtgtgtgtgtgagactgacccggaggagggaggagctcgccggcaacctgtaaaaggttgtctctccggcgtggtttccaacaagtggtatcggagccaagttggttccaaa

SEQ ID NO: 8739 - DNA, 674 bp, Zea mays
tctgcactcatcaccagtggtccttccagatgatggcccacctggtgagcgccctcctcggccacgactgcggccacggccccgaccacgaccacgataccctccctccatggcgccctgctcctccactggaactgctgccagggtggtgctcgacctccttcttgcgtcggacattccattcctcctccgtgaggtagagtcgaccactgtgttgcagtgatcctggggcctcctcgaaggcgtcctccgctgccctcagtctccccaccatgtcagacacaaagagggtcgacaggtcgaggagagtggtgatggagaggacgatttgcttgaaccgcggcggaacgctgcgagcaatcttctccacaatcttctcttcttcaacgccagcaccaagggtggagagttccgctgccatgccgttcaggcgcagcgcgaaatcttcgacggactcaccgtcgttgaacgtcgccaagtcgaacttcctccgcagcagtacggcagcagttttcttcatgcgatcatcgccgacccgcaggtctgcaatggtcttccacgcctcctttgctgtcagcttgtcggcaatcgaagacaccaactctggtggcaccgcgctgcagagagcgtcgagtgccatcatttcttcatgaatatctgctcctccatgctcg

SEQ ID NO: 8740 - DNA, 1060 bp, Zea mays
attcaaaatttactgttagccattgttcctgaacaacccttgattttatttcttgaatgtgcacctgattcatctaatgaaatcatggaaccacatgttgtgctactattttggttaagagctacaatgatcttaaggcggttgttttgtatgttgtctcttaattttgtctattttatatattttattttgcatatgtattgttttttgctgattacaaaatgaaaaatgactaataccaaccattaataatttgggactcactaagcaaagctaaagataagtgtttgaataactatccatctacctatgtgatatataaaggccacaacaacgcggcatctatgtaatcgttgtgtactaaaatttatcgaataacttgtacgacgtagcaacgcacgggcacatacctagttataaaataattatagagagagagaaagaaagaaagaaagaaagaaagaaagatgcgttcgtggacctttcaaaggctgttcttggacgtttgtgtaggtgcaggaaaggacctgacggcgacgcgcgcgtacttgctgcatgcacgagagggggaaaagattggtctcaccaagtcagtcaacgtccgcccgtcccgtcccgtttgaacgcgatggcaagtgtggacgccatgcaratgcagtgcagcaagcaacgtggggctaacctctccgtggaaaacaaacaratcaagattcatggtgtggtggcttggacaggtgcgcatatcatttcttgctttgcttgagagtcccagcaaagctgcctgtctcggagtcggaggagagagagagaatcccgttagtcaacccagcggatacgcgcagcacacgcagagaaaaaacacatataaattccacaccggctcgctgccgtgcccgcacctgtgctgtgcataacgaacgccagcaaacaaacagcgccgcaacccaccctatagcgcaggaggagccggagcccctcctcccgttcccataaatcccattcgcacggcgaggcgagggcaactgggcctgggctgccggcagagcttggaccgctcgcc

SEQ ID NO: 8741 - DNA, 274 bp, Zea mays
gacgtgttggctcggattttttcggttcggtcggattttttttatttgagtagatttttttagattaggttaggttttaggtcaaaaatcgtaactcatatctgtaaattattgcggatcaagaatttgagttgtattggttggatgagatcggggttagtcccgaaattagcagccggcatacacgagagatacgaccagcggtcagccccctttcggcctttccctcccatatactcgccgtcggccagcggatctaatcggggcgggcgcg

SEQ ID NO: 8742 - DNA, 1500 bp, Zea mays
cagtgtttgcgctcttcatgatctctttgttatctgtgcaaatactcgtgcaagaaccaatgatatctgtcatattatcaccgaacacgtagacgtagacaccacatccaacagtgtacagataattacttccataagaaatgacacctggaggggccttccaggactgggtgtaggtgtccacgcctgcgctcatggtgacgttgaacccaacagctgaaacccaaaccacactgttgccgacatctagagaagtcacctggatcgagctgttccccgacacgaagaagagcctgggagaaggagctgtgtgatcgcaggtgacctcgaagccttgacggaagcagcccggccctatcccgaacgggtacgagatttggacatccccgcagcgagaggggcagtgcgacagggaggcgttggtagggataacaaggagcccatcccccgtgccggcggcagcatggaccttggccggcgctcgcgccaaggcggccaaacacacaagcacaacgcatgtgcgaactagcagcactgcagtggagcacatcatcgttgcaggtgtgcaagggggtcagacttcagaggatggtgcgcgctttgctgtgctgtgtctacacatactagtttaatttatgctgagagactgtaacagctagcgcgcgccagaagaaaacaaaaaacaataaaaaaaatctcacttgcgattgcgtggggcaagctagcattctgctagctagtggaaggagaaggacgacctggtcttggaatctcagggcaacagtagcatctgatgttacggtcgtcgctgcggccaacaagacttgccaaatcagacgtattctcctcctgttttttcttcgatgcatggaaacaacgagtggagagtggagactggagaatttatatcacggggagactggagagaccaccgccatgcatgctcaaaactagtggagcttgaccggtgttaagtcttctcacgagttaccatccgagatgtttgccaaagcggaatttcaagtgtgctcggtgtttttttttccttcttgaaagcgatatctgagaaaagaatagtatttgactataactgtgatctctcgatgcttcctaactcagattcatgtatcctttaattcgttgaggagatggataactctagtgatcaagagaacgtatcttgtgcgcaaggagcgttggtgctcccatgagcaaaatcttgcctgcccccaaacaaaagcccctttttaaaacacgcacaccacctcaccatacacctcttctcttctaccagtagttcattcattattagtacggtaccgggttggagtaattaaaaggccaccctccactcgcaccaccacactttagctccccactgctataggcagcccacatgcgcgcacactcctaagctagctatagcagcaaggcagccagctgagctcagagctcccagtccagcgccggcgccaccaccgcagctgctcgctggtcacc

SEQ ID NO: 8743 - DNA, 707 bp, Zea mays
ggtaacggaggaaacagaagtatatgcaaacaggagcagctgatgtacgtatagggagtgtagaatagttgattttgatctatttaatttgctccaacatccaacgacaacaatcattcttattcttccccagttttgtcaccttgagttggttgtaaacttgtaatgccacatgagtcatgtgcagtcgtgaaattgggtcccggcagatgagcttctgtgctacccgagaactggcatgtgtatgtgagaaccatacgcaaacgtggtttaggttgaaaaataatggcgatactagaaatttgacagcgtagttctgtaaaggaaggctcgcaggtccggctgttgcaaacgccaaaaagttctctctagagccagatgtttctcagagagtgatcaggggcgatatggtaggcaagatagtttgtttctcgaagaacttctttgtttcgtactggccagcagccagcagccagctatgtgctctggtatgttcgtccagtatactcgtgctccgtgcatgagaaagaggtgtcatcacgctgtgatgactagccacgtgtgcatggatactaatgcacgtggcatctattccaggagctgtctgcgcgtatatagggagcgcacttatctccacttctgtctgtgcgacaagcgactttatttcaagaagacagaagaagggagagtcgtactgaggtgtaaga

SEQ ID NO: 8744 - DNA, 353 bp, Zea mays
taaaaggtcaaacaaagctttcatcaaacgggaaatttagaaaaaaggatttgccatcgtaattatggaattcgtaagagtagcggcgtcaatggctaatgtcattgttttgcccaagcccaaatcgcacgcgactagccaggcaaaccacagaaataaagtaattaatagtagtaataataatacaaagaaaaaaaagaaactggcgtggaattagcccacggacaggacagtagcatttaatcgggatgaatcccttggtggcgtccgcagcgtccagccgtccacccaaccactcctctcctccccggtcctcctccccttcctcggcagatccgccgccgcccgttccc

SEQ ID NO: 8745 - DNA, 362 bp, Zea mays
ctctagagcacccccctgcctatcatggtcatcatggtcgagctgctgcccccacttgcctctctaatcctcagtcctctgtagagctggtcctcctacccctcactttgccttgagcaatttggtttctagcatctgtggggtggcttgtgggtggtcgccttggactgctccttcctccacctgccgcgccggcagggcgacgaggtccaaaagcctggtggggctcatcatcaagaacaccgaagcggcgagagtggcatgggatctgatccgaggcggagctcgaggagctgagggctgtacgtgctcttggatccggtagagatcacgtgccctcgtgttcgtccccggccgccgcg

SEQ ID NO: 8746 - DNA, 1500 bp, Zea mays
aaaaaatatgcattcatgcatcagtaagttcgcacgatgcaggaaatcagtaaaaagtttcccacggagtaagacgacgaccgcgtgcagccattttgagttgccgcaacaaaaagtcccatttagcttgggtaggtattgggtccacccagccagttccatgatcacatccctctcaatcatgaagctagtgccagcagtaagggatatttcctttcggaagcttcagcatggcatgaaccaggtaggcgccggttttacagataatactggcacggcatttcgcagccgtttcttgtgagccatgtggaattcatgcttggtttttatgtcctttttatgtgccgtgcagcttgatctggcgaccagaggacgcataagggactccctgtaccggttggccagcagtcttgaacaaaggcactgtggaggattgggatcctcgggttcaaataggtaatactcatattgcaactttttcttggatagatcatagatggcatgcatgttctgacgttaattcgtggaatcactgtaccctgatccacagtttcaggtgctgaatttgttgatagtgttacgcatggcaggttcgcgtcgggcggcggcggatttgccgagacgcaggcggaccccatggatcggtcagtggcacggctccttctgcagaaaccctcctaccggaagactgccccgccgcaccggagaccttagctagtcgcctcttgcatcagtgcaagggttgtatacctcattcctactgctactctgaaagccccctgaactagcatggatgtagagaaagttcccctgtataatatgctgctgcctagatgtagcttctaacgtacaacgtcagttatgagagagaaagactatcttacccctgtttcacgtgtagcaccttcaatgtattaatagtgatattttactgtacacttttttttttctacatagcaccgttttcttatattgaatatttttctatataaaactcactcgcagtaatcaagtcgagttgtaccttttcatttttaataaaatttctcagtagcctcctgatcttttaaaaaaaactcactcgcaaaaaaaaaactttagaactcggatgtcggaatggctaaccatccactgactggtagggccgcataggatggtcgacttcggctctacatgtcgcctcccccgcgcacggtgagccgctgctgccggcgttgcgtacccgctaaccgccgcggacaaggccaccacgacgtcacagaaaaagggaaggggtcgaaatatccaatcgagacccaccaccgaacgagtccaaatccgctcgtctcccctcgaagtcactccctccagccctcgccggctccgcgtcctccggctctcccacccgagccgagaccacccatccaagcgcgcgcagctccggaagcgacagggccggacgagcgcctcccaaatttagcagccgcggagcgcgtgggcgtgggtccgtaaggagggtcg

SEQ ID NO: 8747 - DNA, 1476 bp, Zea mays
tggctgttagagacgattctgacggacagaatccgatttgaagctaaaaaacaccccagagatagtcaaatagcatttttcatattataatttgatactttgttgtactataagttattccttttttatgtacttttggatacaacatatcaataaaaaagtcagccgtgagggaaaacctgttctcccagtattatattaagaagagaccaaaacatggtcccggccgagaaaatctccggaccctgacccccatcactagcgacaacgacccgaccggagggtggcgcgcatcgcgtaacacaggagcggatgtacggggcacaatgagaggaatttttaactcacccctgggaatcgaagtgttactcggaagacttaaccattacgcttacaacatatgaataaagaaatacaagagttaaaacgatctaatgtcgtgtttgaagagtccaataataagattcataaatgtccatagatcaaccgaaactactaaactgtaattattacccaaatgcataacttaattagttattgctcagattaggcctttctataccatatatatgaacagaagctgaaacattgtaggcgtcggtgcaattttcatcttcatatagtaggccaacgacgtagataaacacaccaacaacacatatataaatgtaaatggacatgcggtacagtaaaaacgtgtttcattacagactagagtctacaagaacgagtagtcagcagataacatgctacagcagttcatactttcatcaagaaattgaagtgagtgaacaaaggtaaagacattgtaattaagcgtaataacagtttcagttagaaataaccttctcagaaggtctcagcttggtgcaggagaaaccatcaagaacaagcttgcctacggcatctctcaagacctcatactcctccgtgacattgtaaacctgatgtgagattctcacgtaccctgtcacttgatcgcccttggccatctcttgtccttcctcaacacttcttgagttgttgaatattggcacctcgaccttgaattcgttcctcagcatgtccctcactctcatcgcatcatcatcgctctcaatgccaaggcaacctggcagcccgaccatagccatgcttccgcacatttccggcggcgagccaagaaacgtcccccaagcctcggcgagcatcgtgcccatctcgatcaccttctcatggttccgtttgcttatcgtctcgatgccgccctcgaaccgtctcatgaagtcaacggcatcaggcacaacgagctgggcactgtaatcccgcaccccgatccaggcgctctccatgggcagcccgttgccgtactcgctagacacgacggggtggtggagctgcgaggctacggggtcatccttgcggatgtgcaggaaggccacggcggaagggcagaagaaccacttgtggaggttgctggtgtagaagtcggcgccg

SEQ ID NO: 8748 - DNA, 340 bp, Zea mays
tctggagagagtatgcaaaattcacggaggcaaagatgacataaaaacaatcgacatatactcgtgtcataaatacccaaaataatctgatcccatcgtagccgtgagcatagttccaaaccacaggtctccagcgaagtttacaaaaggaagtcaaacatcccatttcctaagggcatagggattgtttggatgcgcgtgtatatatttcaattcaatccatataggttggagtagtttggtttggattcaaaccactcaaccatgtgcgttgaggtgaagagatgagcatccaaacaaccgtctaagagaagaagaaaaaacacgcacaaattcacca

SEQ ID NO: 8749 - DNA, 152 bp, Zea mays
tggctggccgctagcttctccgactccaccggccgggagcagctatgcaagcgcaaggtagctagctacaagtggcgagagttaggaggcgctccttgtgctgtggagtgtgctgtgtgtggagaggacgggaggtagtgggagtctgggag

SEQ ID NO: 8750 - DNA, 640 bp, Zea mays
agcccactgactaatcgatgttggagcgagactatcgtgcttcaggtattctgcaaaacctgaaaaatactcggtgaattctttgccgagtgttactctcggtaagaaagtctcgataaactgtacatcaacaacgattttttgtcaagcaacaacttttttgccgagtactttttatcatctttgctaagtgccacttggtactcggcaaagcaaatactattttgccgagtacctgatatattgcacttgtcaaaaagactgttttcgggagtgggatggatcactatccagcggctctcaggtcacgtaacatgtcggctgacggttggactcggtctaacaagtgataacaagtcactatggacatatttggaaataaggaaaatagaagtgttacaattttcttactataattaaatagtaagggaattattgccccttcaggccccttctatattcaattttaaataggggttggatttataatcatctctaatcccctccaatttgatcctccctgttttctcctagttcccaaatacccctgtcccgaatacagtgtccaagcctgccactttttaaaactcacaaccccccgacctgctcagatcaggtaaaccagtcactctactactcg

SEQ ID NO: 8751 - DNA, 647 bp, Zea mays
ttgcggcgtggacagcttctttgggtgtgtgatgtaacggacaaaagaggttggggaagtgacactgtagtggcggagaccatattcctttcctctcacactgttctagccttctagggatcttctcgttcacaaatcacagcccacgggccacggtgaccttttttattctattctagagaagggagaaaagagaaagggccggattctcctcctctttatttatcgaaagaagcgagggagcacagctttccatgatctgatcccagatcgatcatttcatttgttttccgtgctatacagaagctgacgaaagacggcctcgctcaaagcggcggcggctgcattctcgtcctttcaggcgccgatctcgttttcaagagcagcggagcgtagtcagagctactgtgccagtgctagtagggcacacgatgaagctgtgtgtggcattaaacaaaatcaaaagaaaggtaaaggcaaaacgtcggtaacgaaaagcaaatgatgctgcccaactctccctcttccaaaggaagcaacgaatcgatctgttcatagcacacccggccccaaggccctctgtaggtgttcaattcctgccactccccgcttccactttggcatcttgctcgcaccggggcaaggca

SEQ ID NO: 8752 - DNA, 731 bp, Zea mays
attaataataacacatagtataaacacgacaatagagttgttccactagatttagagtgtgtttggtttgaagaatggaatgatccatttttttctcaaccctcgcttttttatttggtttgtgaaataaaatgggttgatccatcaccacctcattcctcataagctaataattagtatatacatgagtagtgggttgatttcactttgatgaaataaacttatgatgcatcatttaatgtagtatagagtgactccacaaaccgaacacaccattaaagaataaactcaagatgcaccacttcatgagctataggatagactatagtttctcaaaccacgagcagcaaattaatcattcatttcaggcggaggaagaatttgaactttctgtccgatatctattaatgtcgcaaacacataattgacagtgaattttcaatctggacaggagccaagcttatgtagcctgatgtatatctacataaaaagtatattggattactacttttcttctccggctgctatcttcgccagcactcatgctaaacaaacctgcccctgcgagactccggaggcgcgcctcttttattataaaacgcaagcggaaccatggagttaaacacaagtgcctgctcacaattagcagtgtacgtagttgacaccacacagctgcgccattaacatatagcaggcctagcagtgccgttctggaaagggcgggagagggg

SEQ ID NO: 8753 - DNA, 1500 bp, Zea mays
acgcagctgttcgatcaggtgcatgacgcatcaaccaacagtgccatcccaatcgaacagctgcggctgcgagcgaccgcggcgggacgggacgacccggggtttcccagattccaccacgggtgacccggccccgcggcagccggcgcgctgcctacctacgcccgctcgtaccgacgcgtgcaccacccgtcttttccccgtatccccagccggtctcgtcggctccctttgcatccaggaggggcgggcaggggccagggcgctaggccatggccatgtctccgcacggctacctgctctccgttgcacgaggaggacgacgagcccggcgttttctcgggtctcgcgacggtggtgtcactgtcgcctaggcttctcgcacccgcgacgtgacggcgcgccttcgggcagtagtgttcccgaacatggccgggcgccgtcggtcacggcggcgtgcaggctgggcgtggggtgaacgaacggggccagcgcgggcgtgagacgggagactaatggcgaccggtgcctttcgggctccagcgcagcagagatggcaaatgccaaatgggcagttaagtcaacaggactagctagtatgtgtgtgtgtgtgtctgcagtgtgcactcgaccaagttgatgagggtccgcgtccgtccaaccggagctcggtagcgttaattggcagctaagcgggcatggatggtatctcatcgctcgtcccctcaaatccggggcaaaaagccttcaggaccgggattgccacgagacctgcagcctagtgtagtgagggcctcagtccctcttgcgttgcgagctttgggttacccgtcggcgatggcaggtgcgcgtacttggctttctcaatcggggaactcttgcaggggcaggagtcctggttcccatcccgactgagtggtgctgtgacgcagtgactgtgcagaacgcatgcgtcgttctcgttcagcgatcggtggggcgagggcatgccatgaggcatgagctgcccatgttcggtctcttgcgactgcaccacgcttaactgttgttggccagagtcatcctgctatgctaggatgctctggtcaagcccgactagcgcaaaacaatcaaggcagcatttgaaaaatacggatccgtataggagacacgtagtggctccagagcggatatgtgtcgtttgcctccactgaccgccccggcgccccgccctcgcgttccagggtccatgccccccgtggcagaccgggtcgttgtctccattgctcatccatgttattccacaacccctttttaaagggccacttggtcactcctgttcctcctactactgctactactcctccatgtccaccgccatcgtggcgagggcaaccaagctgagcgctactcgcagtcgcagttgttgcctgcccagcatgcagctctaactcaccccgtgcagcagacgccgagtcgtggcaggtagctaggaaggagggcaggagggaagggcaggcc

SEQ ID NO: 8754 - DNA, 1500 bp, Zea mays
gcatataaagctactacaagccagctgcatgcgcacgttttggcctaccacgtacgtacttgttgcgcacggcagcagttctttcgattctcgtgtgtctgatttccgaaacctgtcaaaagtggccgaatgttgattagggaaattcgcgcgctcttctgtcctgggtaaggaatgtcttaattattccttcctatttcctaatgacgattggagggtgacagactttccctgcagcttccccgtgctcgtgttgggaggaggagaccacggccatgacatgaccagagcctgttaatgcaccggaattcgttcattcacatgtgatgtgaagggcttaaaacaaagtgacacagttgacgacgacatggtgcaaggctgcaaggccatgcttgggttttttgtgtgtcttgtttgtgctggataagatatggttgggaggacaacactggccgggtttatggagtgctttcgtagtagtagtagtagggcaacctctctcccgagagtcccgtagtggtcatacgaattagaccaaagcgttcgtatacatgcaatgcatggttcagagtctaatgccaacaaaaaaaaagaatacgtactagctagggcaacacatttctagtaattcgattccgagacaaatttaaaacacgtggtatatatgacagttgaatatataaacctttaacccacacgactcgtcgaagcgatgacacacaacgggctgtatgcagcgtctaccgatatatttaatttgttgcttgttttatataaaggctgtcctatgttgcgacagaaagtgcatcaccattcttcagattctagaacctggatttcttaattcattctatatgcactgtcgtgaatatatatcttgagacaaagccatgctcatcatcattatgttaacactctttctatatttcaaaagataattttgtcattatttgagtatataaaaaaattgtaaactctcttatgacttatccttttcattgtactagttgcatgtgtaataagactgttgtctgttttttaaaaaacgctattggattaatttgctcaacgtaacataagaaaacaaaactttcactacaccttcagattttcatgagtctatattgctgtgctgccatcgagtagcctgcgtcgcattaaccgtgctccacgatgtcacggctcggtcacaagagagagtgacagagagagggggaaaaaacgtgtacccattgcattactcactcgaacgtccatgacaccatgatggatagcccgcccgacaaaagagctctatataaaccccgtagcctttctccgtgccatcacctcatcataactcccacaccccggaaggaaccgtgctagccaaggccaaagagaagaaagccagaagccaagaggtatagccagcgtgggcgaccggcattatctcctcccccacctccccccctgccgacacgacgcgccaagcagcagccttcgaagaggagggcaggt

SEQ ID NO: 8755 - DNA, 622 bp, Zea mays
gctgtgacaaaattacaagttatttagcacaaaaaattggttgaggaaacttagcaaaagtcgaaggacaaaagatactgaaaatctttctattttcttttctttatgtttagacaacatcttaacatcaagtagttgaaaaacttatacagatgcccgaaataataaatatacaacacacaaactatttttagacaatggaaaaagaaaacaccacgatatctgcatccaagacacagccatacagggagaatatggtaaatcatacaataataactagttaaagaattctaggaagaagtaatagccttccatgaataacatacacatgttttttcttactagaaattacaagtacctgaatatgatggcaggctttgcgggacaaacttttgaaggattagtacaatctccatatacaaattggatggatcccgcgtctgaaatattctggcttgctgtgatatcaggttccttaactgctagtgtctggtaacccaaactttcccatttggccaatctcttttcttctattttttgcttgttaacatcatgtttcaggagcttttcttcaggcgctgctctttgccttccaaatccaactgtggyatcttcactagaa

SEQ ID NO: 8756 - DNA, 1500 bp, Zea mays
gttgtcttcaatttcagggaaagaatattgcctccggtgccattgtacgcccttgtacaaaatactgtcccagggaaatagagaataaaccaataaggacttgttcggttaatcccgttacccatggattggatgagattggaaaaaaattaaaaagggtttgacttagttgagatttaaacccactcaatctcactcaatccatgtggattgggagctagccgaacaagccctaaatgagcaaatcccttttttgtcatatagtttatctagtttagacctgtttggtttatgatagaacaatttttagacatgtgttgtgtgtttggtccattgctttagagagcctatttggcagggatccaattcctccggctcaagctcctcaacaagagcggctcctccataggagccaatgtttttgtaacaaatcgtttggtaaaatggtttctcctatatttttatttgaagtataaagcaaatgtctataatgtccatgtgtaaccattttcacgatgcacgtaaatgcaatgaaaatagatgatcaaattattatgaaatatgatgttatcaaagcctagctttacgaggcgtgtgacggtgaaggctggtgcaggactacgacagtgcacactaggcgaagagacaatgtccgtgcgtgggccagtgacgtcaaacgtagggcgacggacgctgggcgggacgtaggagaagggcaggatagggagtgaagggaggagttggcgagttgctaggagccgggtttttttttttttttttgcttgggcttctctataaaaagtggttccggcttttaagcgctctttttcaagggagagctcctgtaggaggcagagccggtttaaaagctctctcaaacatgctcttaactataatatgtaaccgccatcttcttcttgttctttctctgttttttttttctaaactttgtggcacgtgtaatttcatttttgcttgtcacactttatgtgtctgtcacatcttgtcaaaagttagacgtacagtttagacatgaacccctttcacggaattgttcgtctatatccgaactcaagtaggagtatagaatttaagttgctccacaaatagacacgaggactcgacaatcgacgtggctggaaattcatcgatatgaacgattgacaaaatcagagaaaccgataggcaagcagacgagcgccaatcgttcgttgctggctgatgtgagacctgctgatgcagtcagacgagcacgagacggattcttttgatgtgagacctgacgcgactgcatcgatgckgtcgctcttgtacctgagaacaccgggcggggcgactctatctctctcttacttatcgatacccacaggagcagcagcaggcagccaacagcaacctctgagatctgacagtgctgcaacccaggtgcggtgccgccgtataccacaccagcaccagcggtccagcgcacacacgctagctgctaccagcctccgatcc

SEQ ID NO: 8757 - DNA, 783 bp, Zea mays
tgagtgcaatttgtttgatggatttcgtaaatattataggtgtgtgggttatttggttgaataggttttgtgaagtgtaaacttgtgtgttatatagtgttatagatactaaatattgggcccctaataattttgggcccccggccgtcgcctcccttgcataggctcagggccggccctgcacagttcgcatgatagtaccgactccgaccgctagtgccactagtactcattgcgccgacgcagaaatatagcaaaaacaatagaaatctcttaccaaactaccatggtcctgaggagtaacgagaaaagggggagcttggactacatcggcgccggccggaggcgcctccatttccaaggagcgtgaagcaagacctggtggcgcctccatttgcgtcgagcacgaaccaagagcagtcgagagcgcgaaccagtgtggaagacgagtctcatcggcggcgtggaagaacagtctcgtcggctgtctgaaatccgtttccaagaatgggatgaagggttgaggggagaaatgccagtaacagccgccgttagtgagctgtagacgggtttaaagcaacgacgataataaatttataaacgaatatgtattataatactataatctaattgcacactttggagtaataattttaagaagtccacttacgggagtacctgagttaaaaaaactcttgctggccaggccggatgaaattggtttagctaggttatctgttgtcagtctttttccgccttctaggctagtttgcgtaaagtacg

SEQ ID NO: 8758 - DNA, 1363 bp, Zea mays
gtccgatgaattaaatagcaaattttagatgagcgtccggtagcctttattgtgggaagtagaaactctcaatacatgaacatgttaaagagcactaatactgcttgacattgatagtctgtgtttaattggctggtatagcgcccgataggtcggtatctatttctaatatctatgaagttgcaatcaaatttctttatcctgatcgacgacgtaggcacacttttattgtgtgcatgactgcatatcatccaaacttaaactttttaagcccgtagaggtctgtttagacggttttaaaaagcttaggatggtacttgagttttatataatttacacatgagacttaggaatattaaaaagatcctattaatattaattcgttaattggacttagagagtgtttggtttctagggactaatttttagtccctctagtttattctattttagttcctaaattgttaaatacagaaaataaaatatagttttagttttcgcatttagcaatttaaagactaaaatagaataaaataggggactaaaattagtccattgaaaccaaacacctccttagatgacaatacaagaaaactttaaactttaaagttgccaaagtgattctgtgtcgattaccattgctaagattgtaagtgggtgtttggtttatatgaactaatgtttagtatctctacttatcccttttagtctttgaattgccgaacacatggactaaaagagagattatctctatttttagtctttgtgtttgccaatttagagactaagaagatgtttgaatgcactagagctaatggttcgttggctaaaaaattgttggtagaattagcgagctaacacatagctagctaactattagctaatttgctaaaaatagttaaaaactgaataattatctagactatttgatgtctttaactaattttagtagctagtaacaattagctctaatggatttaaacatagtctaaaaggtactaaaatgtatagaccaaaaaataatggctagaaaccaaatatttttaaaggctagtttggaaactccaatttttttttcaaaggacacctcgttgacactttggacgccggcacatccataaaaggcaccattaaatctttggctattagcacgcttctcccctcccaaaccccccatctcagcgagggccccgtcggctagcgccgcatccgcagccgtcgacgcagacccacttcggcagccggtgcttccccgttcgccgcattttgtactccccgtcggccgtctcttgtgctcatccatccctaacctcaccttccccactcttagcttgcagcgcgtcccttccccgctcccggcgcc

SEQ ID NO: 8759 - DNA, 658 bp, Zea mays
tatgtccatcatggaacaatccaaccaacgagctttttgtgggaccaactcatccaaaaaaacgtccacaggtgttctacatggttgggttccataccagtcaatcgaacaaaccaaacacgctgtagagttacctacatgtcgagtttccacacctgtcggttcaaaaaacctaccccacaacatctggcataagaaacatggttacttcattgttcccaatactggcaacaatcctcgaaacctgaaataagttctagtgaattgcacagcgaaaaccaaaaaaagaaaaaaaaaaccttgtggaatgaactacgcgaaagtttcgacgagttggagcctgaccccaagtccccacatatcacatcatgattgagtcataagtgcatcctgaaaaccacttgtaagaaattatytaaacaccaaaaaaaacatggttattgttgttttaagtggatgaaaaacatataaaatattaaaccatactgcttacatcttcattgtctgagacttactacagctgcagagtgtcccttgtaaaatttggcgcatcttctgtttataagcatatttaatcggtgatgacatggatacgtattttatgtttttcccctccatgttcaacaaaatcccagagtgagcgatttatgtacaggtg

SEQ ID NO: 8760 - DNA, 392 bp, Zea mays
caaaaaaaatcggtctatgaacacattttgccctgtagagtcgcggtggattccccgccacaaatccacgcacgcacctgcactgctggtcactgtcgtcccggacgggcgtccccttcccgtggtcagatcctcaaccttccctcctccattattaacgcctttactttggctgcttcattactgttttcgatgccggcctcccggatctgatttggttctcgctttcccttcgcctttctcggccggtcccagctgctgctttttcttcgtcgtaatccccgtccagcgagctgcagcgcaccacagtccacaaactgctgatcgatcctagctgctaggctggctggagcaggaattgaagcaggcagctagctagctagcattgcgtg

SEQ ID NO: 8761 - DNA, 1393 bp, Zea mays
ctagtttctccgcgaagctagttcggacacgtacccggatcttagcttccgccgctgcgtgggcgtacgagttgcacgcgatcaaaattgaaacaggtcggataaaacttgcgttgtcagagccatttcgtcgtgatggaagtacggaattcatctttcctctcctcttaaatacatactttgtcttcttgatgtgtttatatattaaatgctaataaatataactatgtaaaagctttcaagagccgtttagatctattcattttagagaaattaaaattacttaataaaatattatttagtttagaatttgatattccacaactctgtaaaccttaagtataaggttatcatgaaaaatgattatatgtattaataaaatatatttctacactgtaacttataaaataatatttgattcactcttctatattaaaaatatagcacataaatatttttcttatatattgctaataataatatacaaatttatttcacataactatattaacttaattaattttttcctaaattactgctattataaattattattattagaatgaaactccattctaagaatccaaatgagaagtgataatttgaaattaggtgagagttaaagctaagagtgcatttatattattatttatagactgatgtctctatatctatactaagaatctaatatagacacctactgctaccaatttttttgcccctatcacgttcctctgctctagaaatttagggctaatcaacagaccacacgtaccttagtgtttagaaataaacaaaaattatatttatagcctacgcactgctctatatgctccctagcatcgtggcacgcacgagaatatatctagtattgatatataaaagaagggtgaagaccaaattatattatgtaaaaaatcagagatctcttcaaagttcaaacacaactgcaggcttatttggacaagagatgctgacctaattaacggaataatgtaatccagcgtcccggccggccgccgcgcagccaaaaagccgcagtgccatctcatcctcgactcctgttttcttttacactcttggctctacagaagcatccaggcgtgagcgacgtgtcctcgccggccatacgtgccccggcgcatgcgccgacacgtccgccgcctgcccacggccccagagcccgaggaagccaaacaccatctcggcttcttctatggcagcgagtagataatcacacacactcagcagcagctgctccccgaccttcaattcccctgcctgttgccgtacgtgcctaagctagcttcgtcgtctcgttgcacgtacgtagtagctagacagccgaatcggctctctagctagctcctcccttccgatcgatatcatcgcc

SEQ ID NO: 8762 - DNA, 319 bp, Zea mays
tgttacctggcgcccagcccccgcctcctgagcccccagatcacgtcgatccaccattcttacgctctcacctccctggaccccaccccgtcctcggctcctgttctccactgaatcgcatctgccaacaaggattggcaccaccatgtcatagatcccccgccccttctgaccccccatcttacaacgtggtggacgaggaggacgagccggcggcggtggcggaagtcggtctcggggcgcgatggcatcgagcgccagtggcgcattgtcgtcgttggggaagaacttactataaattcgggatgagcttgcggcg

SEQ ID NO: 8763 - DNA, 687 bp, Zea mays
tgtgagttctatgcccccccccccccctctttctaccaggcaatctgaacaaactgttgagtaactatgtatctacaaaataaaaaccatctgcacacaattctggtatagctgatgcatagaagtaaatttactacattcaaaattgtaagttgttgtggcttttctagatttatagcttagacagtgtrtatatctagatgcatagcaaaagctatgtgcctagaaaagccaaaacaacttacaatttggaatggagtaccttttggtttagtacttttggagaacactcttttggtcatatttttccctcagcagttacaataattctgtatataggttgaaacaaaagaagtgaatgaacaagagagtagtagaggtcatgcagcattatccaagaagggccagaatcctcagccagataattcattgttgaatgaagtggaagaagatgccatatcagatgacgaaaaccacgaggattctagaaggggtcgctctaagttggagcgatggacaagccacaaagagatagaatatagtaatattgatgatgatagtacacaaacatttccgaccatcaaagctgatgttgaagccgatgaggtaggtaaatctcaagtttctgctgcagctggcaactcggacatcaatagcaatgttgatactgggcagacatctgataag

SEQ ID NO: 8764 - DNA, 1500 bp, Zea mays
cattttgaagctggagtgcccctgctgcaagttgattttgtttgaagtgcaggtggcctggaagcactgggtcttgtaacacgcttgtgctggtgggagatacttgcaagctgtggtggctgaatgcttgccatgtgatgctgttttatggagcaataggtgatagaaacaaaggactagagatttcagaactgatgatataatcactaatttgtatgcttaatactatattagccatgtacattctgataaacatataactgtcgtgcatgagttgttgatggagtaaaggtagactgtagtgtagagctgcagggtgcactggaccatttggatggatcaatacatatatatatatacctgtaggcagtgctaggtaagaagaatatgattgtttgcttgttgtagatttgcgatgtatataactggttcatgtggagttttgctaatcatacagagttctgaatgrcactatgtaaatttattgaaatttagcatttcagattacttgcgtatctgtcctgtactcctgtttgagaagttaaccctcacgcccacgagttgtgatgatacgtggcgagtcagcctgttcccgacacccagaaatgtgcacaccaggtaaacatcccaacagaagctttggcaatcggcataacatagccacagtccgctggtccaggtgttcgtacgtacgtattcgcagtccgggcggcgggcgggcgctgatctaacatggggcggagcacctctgttcaccccgctccacccaccgcgatttggcgagtgatccggcgcgtctgtcgtttccttttccttgatggcttccaacccattcgtattcatcgtcgtgtgttcaagtggcctgtgtccgtgtgggcaacgtgcctgcctaggcccgccgcgtggttgaagctagcccacggcggggggaccgcgaggatcaccccaaaaataggtgcccgtaccaaggcagcgtgtgccggcacgggattcatggcctcacgcggcaaagcaatttttttccagagaaatgacagcgtgattgctagtaacaaactgttcgccctgttgcctgcttactcaattatatatatataatcctactcctacagtcctactaagcttagactcccacatcacatggacatggtccaatacgtttccatttttcagcgatatatcctcggtgacaacagcaaaactggcgcctgcgcacccggtctcctcccacgggttggcacgcaccggacacgagctcaggctcccatttccaaaagcgtccccaagagtaatcaagacagcccactggtttcccccccaaaacctcggcacaccggtacaccacccaccgtaaccggtcgtcatccatccctcgttttggcaaccggatcaccttccaatccaacccgcgtctataaatttcctggcacacgcgagcccggaaccggcaattcgtttatagcgagcacaccagcgaaccagagattcatcagagtggcg

SEQ ID NO: 8765 - DNA, 910 bp, Zea mays
tcacagtgagataatcaacaaccaaattgaatttttttttgagacaaagggtgaacttgcttaaccctattgtagcttttgatgtaaggtttaattttgtcattaaggttagcattcatagcttagacaagcagtgctagtgcaagtagagtctatcaggatttgtaactttactaatatctttccctttgtcatggtgtttgtgaagtttgtataatttttttcagaggctattcaccctctccaatcatctaggttctttcaaatactattttttagaggctattacatcaaagaccatttaaaaaaaaactagagatgtaacatcaaagacggaggcggggtgtgtgtagatgcccatgagtttgctatgtttgcatgatgtggagaccgctatatttggcttctcaatcccccgtgtttcatagatatgcatgcgtcttctatatatggccaaaaaaaaaagacttccagctctgtctctaaaaaaagaacatgagtagttaattatcatggcgaccgcgggttaaacagaggtggctggtagcgaggcccaaacaggcggaaggagaacatcgatcggtcgtggctgtttccacagccggaccgaataggtgagcaaagtagagtgctttgaaatgaatagctatgcgatttctgttcttctcgatctactcgtcgagacgaggcgcaagagaaagcgtttgatccccataccaacacaacaacacatgcgcctttagctcgctccatccatgtcatgtgaatgctacaatgtttctaacatctttgcatgcaactctctcctagctccttcatgtgtttattatacttgtttgatcacgtttttgaacgagatccttcatgtgtctatgacccgtcgtcgataccgaagcggcgcggccgggaa

SEQ ID NO: 8766 - DNA, 53 bp, Zea mays
cgtcccgctccacgcgtccgcaccctctgcgcggcgccggtcgagaactcgtg

SEQ ID NO: 8767 - DNA, 782 bp, Zea mays
cctgtcagagaggaagtcgcaacaacatcatcgcttgcaacaacagtctgacccgtgctagatgttccagcctgcacggcggcctgctggtacgactcaagggagtgccactgctgagtgttggtgtcaaagtaccaacccagatactctgcatagaagagcatgctgggtgggtactcccggggcagccccttgggccccaactatttggcagcaccccagctgcggtagtgccctcctcggcaattgtctcaagccctgaatgcactgaattgtgcagataagaggcgtggagctgctgctgctgctgtgcataccgagtgctkttgtccagcacctgagctgcattcccagttgaatttacactgtcgtcaagctggtaccattgctgggaggcctcatcatacttccacccagggtacatggcctccaaagacatgggatctgctgaatccactgyagtgctgccgccgccctggtcgtgctgaccactgacattatgctgattggaggagttgctcccggcgaagaagtcctggtccgtcacctcggcggccaagctctgggtcccgccaaagaaggcgtgatccgaggccgtctgggtcccggccgtggtcacgaggaagccgtcgtcgtcgccggcgcctcccgagagatgagcaaatgggtcaggaccgtcgtccgcgccacctccgaaggaagcccactgcacctgcttgaccgcagtgtggacgccggcgccgcccttgcctgaaccctcgggaggcgcctgcggctctggg

SEQ ID NO: 8768 - DNA, 764 bp, Zea mays
attataaattgggatggggtgagtacgtttgcacattcaatacaccaatttgagattatataggcccttggttttgattttaaatgactacaatacgatgtatctagatcaagaatcaacaggatcaaatttatatgatgtacaacgaagatacttgaacactactagactatacaagtagcaatcaattgacaattggataggagaagaaagctagagaaagtgtttagagcacgtacaaccccatctaatatagtgtctcgaggaatctctaaggggttaattgaaaaaatacaagatgctgactcttctctacacgattctccataaatgttccatacatattgtctcttacctgcatttataattcagaagctcagagttatattacacagtctcttaactgcccttagagggcttttaaaaaaagaaagacaaaataaaacataaatgtagaggcagaatatactagttgtgcattaattaataaatgttggatttaatgggtttagtctaaattaactcattgaatcatttaatattaaaggcccatataacattaggaagtcaaaggtggttaatcctactttagacattaacatgtatcttaactaacttatatagtggactctatgtgcaacatctatgaagtttaaaaaggagagatgcgccacacacatgttcgcacgctcgctcgctcgctctctctctctcccatcccccgcacgacacttgggtagcgcgagagaaggagagatagagac

SEQ ID NO: 8769 - DNA, 209 bp, Zea mays
cagactagtaaataatgatatggtggtagtctggtagatatataaacgagtgaacaagtcacgggagactgggagaggaaaggaacgaaccacacggcgtgcgtccctaggctcmaccccccccccmcccccccactccatctccatctccatctagtcttcttccccgaaagggagaaagcacttgcctccgatccagcaccaccagt

SEQ ID NO: 8770 - DNA, 271 bp, Zea mays
gtgaaagaattattccggcccgtcgttccgaaagaagcgaacaggcccgactcgaatcctagtggatctcgtcgccgcgcaccgtcggtgttgccgacgtcaaccttgtcctcccaccccgccatttccgccaagctgtcgtcagcctgacgcggtaaccgtgtggactccgctcgggtgggggtggcggcccgaagcccaaaccgcatgggctcgcggccgagctgaccgagccggacccagacccactcgctcctccgcccccgccgca

SEQ ID NO: 8771 - DNA, 602 bp, Zea mays
cgacagaagcaacacagaattaaaaagaaaaggttaaaatcgacaactcgacatgcttaagttgtggcagcgattactagagatagatggctccataaaaggagggccacgttgttgcatggcatgccccccctgaatacgcttgttctcctcctcctctgtaattctccctgttgcaacgactctaattttcatttcaaggaagacaactggtaagatacatgccttctgttcttcattttggttggtacctacgttgctgtgtgcctgaatggtggtgctaacttgtcagtagatcattatattgaactcgcaactcacgtataataaacagctgccgaggcagagaagatgctgacatggcagatcgtcttcaaaagtagccgaaatttgatttcaacttccttgaatcttctgtggcagattgcttaagtttgttttccttatgggttgatttggtgacaagggaccacgagggattgaaggggattgagggaattaatttcttccttaattccttttaattcccgatccctggtcaccaaatcagcccgcatgtgactatattatcgcagtgtaattaagagaaggaacgggacaag

SEQ ID NO: 8772 - DNA, 821 bp, Zea mays
actaaaatgtatgggactttttttgctgatcgggatgggattttttttcatgtcgtggttgtgtccgcatgaagtcatgaagatgcttgctggcatgttgctgttggtaggcccatctctgcatgccatgcccactcttacagaactgtagtaacaacagcagctggtgtagagtagctgcagtgagccagtgaacgcaatgcttagacgacttacagaacagcgccggactgccttcaccctgcctattctttctcccgttcaccccgcgtgcacgctctttcccttcctcgtgccgacgaccgggcgaccgccgcgccccggcccgcgcccccttgtctcgggccactcgccggcaacgagcagccaccaggtatgccacccccttctccccccttcctgctgtacgaaaccgagcacccaaaccctaacttaagcttatttggctatttacattcggatctgatctagttacaggagcacacacgtattatccctactaaatccgattttagtggaaaaagctgtcgggtgtacatgtgtccacccatgtcctttacgagttcggcccttggccgaggtccgtttggaattggaaatgggaatcagaggggcgaatgccgaatgggcatgtcttgcgcaatttccatgctctgctagtaggcgtgctgcgttcatgagctcatactatccaaatgccattcgctacgcatttgcttctatttgagatcgggaaacggtgtgtcaaaaacgatttatcaatatgtttcttcttctacaggaaatgttgtgaggactgatgcaataactaagcttgctgg

SEQ ID NO: 8773 - DNA, 1032 bp, Zea mays
caatttttttccaggatggtacgactctgtgtaggaacttattgattgatctgttgatatacgaggggaacacatatcgatttaacattcctataaatatacaagagtatcttgaccatattatggaaaaaaatagattaaatagtcagttgtgcatatgtttgttttatacttattgatctgaatgtctaaactatgacgacctataaaagatcattattgaattttgccattaaattttcttgttaaattttatataatatattaggtgagtgtccgtgtcttgcaacgagaattaactaattttttatcatgaaattgttatttttctttgagtagcgtctctgttttcattcactcgtatcattttagaacaactcgcacatctcatatatgttaagagtgttcttagaatattgttttacattcttttctttctttcctttgcttgcaccatgatcccgtttgttgtccgtctttaacgattttgtctttggataagcagtatactgacctttcttcgatttcttcactctatcacttttctgtaaaaggttcttccatgcttaaaactgaatacaatgatatgtatatgtatgtattttgaagcttacatttctttcaccgtataggaattatacaccaaatatacatatctattcgtatattggctcattaatcatacgtgattcgtgatttagcatcgacacgatggttcaaagcaaaagggtctacatgcagcactcgctcgcttccctccgcctcgaatggtcacgccacccagaccctgcagcagcagttaatcgtcacgcccccatccttccccagcaaacacaacacaagcagacggggagagattcagatccactcgtcacacatccgcgttaccccctctcccttggtttcctctcccaccaccaacccccatcccggttatctccgccgccgcccgctttgggaaggcgcgacgaaggcaggcgagaggctccagccggacgaggaggaaagaggagcagcagggccggaggagag

SEQ ID NO: 8774 - DNA, 1222 bp, Zea mays
gttcttaattcatagcatttgagaacaagtccccaacaacatgaaactaagttttctctctctcttagactaataactagagaaaatacctttttcaagactgatctgcatcactgaacgtggtccaatcaaattgcccaacacatgtcatcgataatctccataaagacttgttcggttattccaattccatgtggattttaatggaaacttgacttgggtgagccttaaaattctcgatcatatgatattaagtaccaccaaatttagactaaaccaacaagctgtagcaaagggggggggatcagagatgaggtgtactagtaaatattcagtggataaacgacatagttgtaatccggcaaatgcatgttccttcaccccaaaagaagactttctcttgttttggatggttgatttttagatccatttgaaagctctatgaacatgttggtgtccaatcaattgttgtttgttacgctctagctacaactagaagagaatgatagacagaagacctccgaccacgcttgcatgcatgcacgtccaggtgtccggctagctccaccgattcaattgcaatcaaatcacggctagcattccagctgggatttgattgcaagtggctggtttgattgcatcagtggtaaaccatagtcggtcgttgtaatcctgacgaaaaacaaatctggcagtgagatgttcaattaagggtggtacacagtgcatacggccataatgataatttatataagggatttgctaagcatatagtcgtctgatttttttttctatttctagacgacaaactatatatatatatatatccatctaatctaaattcaaccatcagaatctattttattaaacttattctcatcttttcttttgttgctagttcatcttcgctttgagaggcaactgtaggatagaaaatgtcatgatatatataataatagaactagcacaacttgttagatggagatcgaagacgacgacgaagggcgctgtcagtgtttccctggcgccctctatatcttccttccctccaaaccctcctcgcctctccattttagttagtgcgctccattgcgtggttgctcctgctcgctattcttagccccagagctcgcgccacaccacaacacgtacctcccgcgcgcggggcgtgcaagcacacggctgccccggcccgcgcgcccgtgccggccggccagcagac

SEQ ID NO: 8775 - DNA, 148 bp, Zea mays
tcacacggcgcggagcacaaccgccgcgggccccagcgcgctcccataaaaaaacccgccgcaccgcgccaccgtcccacctcccacgtggcctcgccaatcgccatctaccctattccccgggcatcggagaccgggacgcccaagg

SEQ ID NO: 8776 - DNA, 431 bp, Zea mays
tgactacaacgctgtacgcctgaactacgctccatacgtaccgcgtgtctctctcggtagcgcggctgcagctttcttattttaagaaaaggaagcagcaatgtgtactactcaagtgacggcttcctttccttggcacgatcgaagaaagagaaggtaaaccaaatagcccacacattcccaagaatcctttagcatctgccaaagcaggtttgaaggcgtgcgctccgaaaggtgaagcgcggtataaacgttcaacaccacgagccaccagcccaccaccaccacggcagaaagaagcgggggagggaattacgtcccgttcacttcactccctccatccgatcccgatcgccgccttcctcctcctcctcctgccgcgacccgccacctaaccaacgaagccgcctccctccaagccaagctcccgc

SEQ ID NO: 8777 - DNA, 822 bp, Zea mays
cgtagacatgcatggaagcgtatgaccagtatacgcacatgcagagtacaacctgaattacatttttgccattggtgaaatgcatggaattttccactctttctctgtgggctcttcgaaaatcagtactactaaatttggtgggaaaatgaacggccattgaagatkramcaaacagatcaaatactaacacgcatactcctatattttttttctccaaatgggaccgtaaagtcggctcagcgcttgacccgcccatcgtagcgccggccaaccgaacgcccaccgagttcaacatgccacgaggccgtctgaggccagcccctcaactgagcccaaccgaggcccggccctcgccgaccccacaatctctctcgtggggaccgtcctatccacggcagacatggcgagtcagcacagcaacagcgcacagcagcacacggtatccgtcccgggccggagccaactccccaagccagtccagtccttccgtccacccatccatcgtccccgcctgcacctcgcgagcatccaaagctgtagttgctgcaaagctctcgcaaaatcctactcccaccgccgactcgaacagtcgaacctcggctcccctcctccccaatccgtcatcttccttctacacttgtttctgcgggagcrggagagaaggcaccagggaggccgcccccgtcacccatagccaaagtcacgcgccaccaaactcttttttccctcacccagtcgctttcgcgttcagcgcgagccgagcccagccggtgggtcggtcgctgaaggcggagccataaaggcgtcggcgacggcagg

SEQ ID NO: 8778 - DNA, 142 bp, Zea mays
ggttaaggccgtccctctcgaccccagtggcgacacctccaagcagattcggatcggatccgggctcgaccccaaataggaagcagtgctcgtcgactttctccgcgcaaacaccgacgtctttgcgtggagtccctcggac

SEQ ID NO: 8779 - DNA, 330 bp, Zea mays
ctgacagcacgcaaggaatcacggccatccatcactgtcgcgcagttatcgtccgtctccccaccaacgtcattattcatccgtcccgtcccgtcccgtgtggcctgtccttgtgtggtgccgggtgcgttgccttcttcatcctcgcacacggcaggcacgtgaccgacacccccagcgcacgaactccaaaatagcgagccgaagggggccacgaccacgagtcctccacctccctctccgccgcgtcgcacgcgcttgacgcgcgccgagagccgaatcggagccacgaggcagccgccccgggcggatcgatcctagggccagggc

SEQ ID NO: 8780 - DNA, 1500 bp, Zea mays
ctctaaaagtgtctgtgagatagaaagtacatcaaatattaaatgtacggcttgaatcatgtggtagttaaacttgctctcgctaatagtcacctaaaagttggctgcttaccgatttcaagatagattataagagaaagagatgagctaaatattaaatatacaattttgtattattgtataatcttgattataggtgacctagttacatcataaagtcgtccactgttattataaacttcctctcagcccaatcgaaaatatccaacgtattatgcggtccacgttcgtgccgtacgatcccaccgtgcagcggagaacctcatgcagtcatgcggcaccccgtgtcccggctcctggccccgaggcggttccacctggagttattcgcggccacgcgcgtccatcaccttttcctttctcttgacgcctcagttcaactcgccctgccggtgtcggcctcaccgcaccaagtcggacgccgactggcgcaggggcgtttccgtaaaccccgcgcctcgcccggtcgcttccgccgtcccgtccccgcatcgcgcctcggactgcggaccatgcctcgtcacggtcccgcgtggatggtcggttatgcccctggctcccgcgcggcgcaacgcaccccgcctgagggctatctggtgcggtgcggctcgatccggcccgacgattccgatcccttcgcgtccaccatcccgtctcgctctcggtctcgcgctccacgccggcgaccggagaaggggccgcgcatgtgacgcccacggcgaatccctcccctcctctccggtgccgccttcagccgacccgcggcgacgtgccaggtaagcctcggttccccgtcgctccgtatctcccgtggaaatggatgcgcaacgcgtgttcaatggcgtaactgtcgctgtgtgctcgcttggccgcgagccccgtatcctctcttcgagtggagaatgcgactggaactagcgctcgagtagcgcctatgccgtgccgctcgcgaagaatcgcacctgtgtatatcttgtcgtggagctcccgatccacgctgccaggagaaccctgcacgcagagcaagtgagcgcctgcactgcctgctctgtctggttgaccgtagttgcttgctgcacgcagctacatgaagtcttctcctctaggtttcctaggcggacatttgggttttcttctgatatatacgttccacccaggaagcatttcgtactgttggttcgagcttaactgtggggtggtttcctcgcgtgtacacgtgatggtgaaatgttggttttttcagatttattaatgataaaaggaacacgtgttttcctgcgcttatgccattcctatgatttttctttgattgacagcagacagcactgcaatcaatcaattataactgtcaaataatttagctttagcacttctgtacaacaggattgaaggggggatgagaaggtggacatcgttgctctagtgatttgatcaccagag

SEQ ID NO: 8781 - DNA, 980 bp, Zea mays
ttaagggggtaggatttgtaatacccaatttgtaagagataatataaaaggagagaaaaaaatatttttcctttatttatatgtgtgtgatgcatccatttaccatcatatgagaacactatattaaaaaaacaataaataataaaagatgtgtcactaaattgtgcatcatgttggactttattttatgtgcattttgtggcaatacaaaaataaaataaagagaaatatattagtacctaagtgggaatttaagatttaaagggaattctagagatgtggggaaaagaaaaggataaagggttgaataagtaaataatattgtcggcgtttcgagacaggggggtccctaagccgacgagtgagtgtgctgcgtgccccagcccagatgggtcgagcgcgtgggcgagcgcgaaggggggagaggcgaggtggccggagtcgagcgtgagagaggtggaagtcccgcggccttcgtgttcgtcccgcgcccaggtcaggtgcgcttgcagtaggggggttacaagcgtccacgcgggtgagggaagcgagcggccccaagagagcgcctgtcccatcctcggtcccgcgcggccaaccttctctaagaaggccctggtcctcccttttatagtcgtaaggagaggatccaggtgtacaatggggggtgtagcagagtgctacgtgtctagcggagagagagctagtgccctaggtacatgccaatgtggcagccggagagatcttggcaccttgctggcgtgatgtcgtggctgtcggaggtgcgacggagcctggcggagggacagctgttggagcggtcaagtccctgctgacgtcgtcctgcttccgtaagagagctgggggccgccgtcgtcacagagctggtggagcgccatcattgtccatccggcggagctggccggatgggatgccggtcttgttctccgtgacccgagtcgattcggggtaggatgatg

SEQ ID NO: 8782 - DNA, 163 bp, Zea mays
cccgttgccgtggcagaactctgttcttgcccagtctagaagatctgcaccgttccaaccaccgactccggccgccaagcatatagccagcgcggcgaagaattcccaacgcgaaagccaaaacctcttcacttcacttcacgtcgacacgtgcggggagaat

SEQ ID NO: 8783 - DNA, 178 bp, Zea mays
ccgccggccgcaaaaaaattttccacgctccgagcgccaaatccgcaccccccgcctcctattataccgcctcttctcgagagaatcttccaacgcggcacagagcctcattcatctccattggaaacacccttgcacccacactttccttttgtccccagcctaaatccccgcaacg

SEQ ID NO: 8784 - DNA, 238 bp, Zea mays
ggcggccggccggccggataggccgtggcgcagtctcttctcggaagtttgtactagtggtcgggtcgtgtggagggagtggtgtactaatcagcaatgtctcaaaccatgtcaacctctttgttgtcatcaatggaaatcgctacttatgtgtgctaatcttcgtgctgcgtttgtttcgtagtaacactattcgatggattcgtacctgtgaacagtcgatttatatcgtcaccag

SEQ ID NO: 8785 - DNA, 138 bp, Zea mays
tgcaagtgtcggtccagccagccacatagagacatataatcacatagataaggcgaattccacggtcccatccaattgcttgcttcagacttcagaggctagaggcaatagttctctctcccggtcccggggaaagcc

SEQ ID NO: 8786 - DNA, 922 bp, Zea mays
ggtaagcaagctactgccgctggctggcgccgcctgcggtgcgctttgcttggtttgattttggttgctggatggattgacttggacgggaagggtggttgctggtgtcttttataggtgtgcggtctcggcctcggagtcggaggggggaggtgttaaaaagtggtgggtgatgggtcgggggctggtgacgaggacgagagtcggatggaaggcgtccacgagggcccacacgctcagtagcgtcagggtcaaagaagctgccacggtggagccgagctgggtgggttggcggactagggtggggccttcgactcccctgctccctggctagagatggcaacgggtacaaacccgccgggtttcgctatcccaaacccgtacccgtgaaaatatttacacccgttaaaaaacccgtacccatgacaggtttgaaattttgcccaaacccgtacccatcgggtttgcgggtacccacgggtgtacccgcgggtttttatctccaatatgcttattctttttataatcaataagtatcgtaatgattaatgagatcatggtccaaaatttatgtaatgaacaacgagttcatgatttggtataaaaatattagtagagagaattaaatacaaataataagttgtataatcaagttatcttgcactaagttatacatccaccacatatataacactagtaataactataatagcaagcaagcaacactttcaccaactacttatacaatcactatttgataaaaattaggaagtaaataggtagataataagtttgttgttcgtttataaaataaaatgacaatatgcactaggtttggccgggtttaaaaaacccacgggttcacaggtttgggtactataggaacaaacctcgtacccatgaacccgtcgggtatacattt

SEQ ID NO: 8787 - DNA, 640 bp, Zea mays
gatgttttccataatcctacatctaccacttatgtttgtgcttgatatattatggtaggatgaggatgatgaagatgttggatgttagtatttcagttttggctgaatctgtttttcttaagtgattcagatctattcctaacatggttaaataattagtggatgcaccatgcatgatctctccatctaaaatttcctgccatccaaatcaagatgtgctaaaaattggactgacatagataggttgactatgttctgaccttacttacctgatgtctgatctctctaggagcggtcttgtacataaagaaggaattcaacttgtagagtgagccactaattgagggcctcatcattgccatgtccctcattggggcaacagtcatcacgacgttctccagggcagtggaaagctctattggtaggaggcccatgctgatcgcctggggtgtcctccactttgttagtgggttggtgatgctctaggcactgagtgtatgtcttgctccttgcacggctcatcgatgggttcggtatcggtttggcggtcacacttgttcctctctacatctccgagactgcaccgacagacattcgtgggctgttgaacacgttgccgcagttcagtgggtcaggaggg

SEQ ID NO: 8788 - DNA, 1205 bp, Zea mays
tgtgatatagtaaaatataatagacaatacagttagggctagttttggaactacgttttctgaggggattcttattttcccaagaaaaaatgaactaatttttcttaggaaaatgaaaatttcgtgaaaaaatatggttccaaactagcccttagggtaagaaatactgaggaaatggtcggagacagtctaaatcaaaattttaaaagtctgattgtcactaggccaaccattagctatttcactgattaacaccgctaacagttagcgtgggtcgagaaaagaacccgagcatgcatctatgccgaataaatctcgtcggatcaatactcctaaaacatctctagaaggcgtatatacaaactctgctgccaccttgtcccgatactttggctaagaacatcttgcaacgataaaaagagaggaaatcatgcaggagaatagatttcgtggcaccacaccgatgaacgtggagcgggaattctccagcgcggggcgcgtcgcgaaacgcgtacgccaagaatatttttacggccgacggtcggagcctatccgttttcacgacgaaacttggatttggtccagaaatgcacctcgccgtcgtcttaaatttcctcgcccgatgtgggctatcgcccaccaccctccctctactgtgtctgtctcccccgccgcgtcgtcccggacgtatccatccactgcgccagcgccgcgagaagagacccgcccgccgcaccagcgcctccgtccgcgagttccacctgaatccccacagcttcccgcaccaacgaatccggccagtccgcggcgcccccggcccactcgcggcggaaattcgtgacaaagccgcgattttttttcttcttcttcttcgcccttttgctttcgctcccgccggcccccttttccttttcttgttgaccccgccggtctgccccttttattgctgcgccggatcgtgttttctcgtcggaaggcgcgggctttccgagggcggcgatcgcggattcgcccccggaggcgtcgatttggttcgcaggtgcggttttgcctccccaattttgcttctggggaaggcgaagggattatggatttttcgtttcgttacctaacggtgttcgatttgttcaggtggaggaggggtcatggatccggggagatttctttagcgcgggttcgttcagggacgcttgtcagaacccgtc

SEQ ID NO: 8789 - DNA, 1500 bp, Zea mays
acgcacttgtcgcagcggaaagaagatcatgataaggcggcaatttttgcttccaccgccgacgacacacgatcatgatctatacgaccaaccgcgcgcgcggtcccgtccatgaccgacacgacgcacccgatgcccgatggcatcgaagcaatttgctttttctggttgttgctgcgtcgacctacctgacgtgacgcggtatgcattcgttgctcccgtacgaaatcatcgaagcaatttttttctggcatgaaccgtagggcgccgctgctgcccaaaaactcgccagtctacatttgttacgcctactgcctgctgtgtgagttccagaagatactcaggttgtcgaaacgcgatgcgttcaaatacaaacgctgtgcgaccggaacacgcaaaagcaatgcatccgcgtcactgcgtcagggagtagctcagcgtctcaccaccaatcgacgtgccttgacggccaccgcgcacgaacatatggcctcacacggtccttcttctcgcagcccaagggcccggccgcttccagaagctgtgcgcgtgtttcacactagttccaaccgtgaacgggctgcggggaggcggaaacatgggtagcattttcggttcgtcggcccagctagtgagcacccgcccgtctcagcctaagcccagtattcgtcccgtagtacaatcaaatttacagcaaatattctttatatttatatacttaaatcaagctactataaatatatgctttataattacttcataacatttaatttatataataaatgttattgttttttataattctaattaaactcgtttcctattttctaaaatactccatttatcattctcattttttttaaaaaaaacaacaactattttagctttaattatatacaatattaagatttaatagatgtttgaatctaattctatatagtaaattaattcgaagaaaccaatattattaatgtttattgcatacataattaaatttataaaagtttaaattacaataacaattatttttaagaagaaggggagtttatcatttggtttcgactttcgtacgagaattgcattcgtacaaccgcagccgagacggttgaccaacgctgccacgattccgtccacacgccgacgcggcgggctcctggccgacgagcactcccctccgaacgccgcgttggccggccccgccccacgaggccacgatgcagtagcagcgttcacaccatctgtctgtctcaagtgtcacggcgtccgtcattcgattcaacccccaaccccccatgggcctggccgtataaatcaaccgccggtgaagtctagtcgtctcgtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgccgttcgcctcatc

SEQ ID NO: 8790 - DNA, 63 bp, Zea mays
tgtaagctgtcgtcttctctcagtgcaagctttgtgggagagatggaacaattgtgatgattc

SEQ ID NO: 8791 - DNA, 572 bp, Zea mays
tgtaagtggctgagattgaggaggagtgttagatgatatgaatatctgttagtctaggttcattgtaactagactcatgcatgcgtgtattgtagatgggaggtgatccttgattacaggatcctccttccatcattgttgtaaccatacttgtgtacatgccaccgccgaggggcttttccttgtgcctatataacacgcaaccgtggacctgaggaggcaccacgttacaccaattctcacatgatatagtgtatttaatatcaatattattgtgttatccattgaagctgtttatgtttatgcgctgcatctataaattaaattctaaagtaaccctttgtttgtatttctatttcttgttacaatttttaatgatggttaaccaagatgcacagaaattcgtggagattttgttaatggaattcttttcttgaacattgttttttgaatgacatagttatcaatgctggacagtgtttaagaaatatgagatatgagctactatgcaggcgtattttcttaatgccgttcttatttaactgcaatttgtacagtctggttgccccttg

SEQ ID NO: 8792 - DNA, 54 bp, Zea mays
gccgtctgaggagcaaatctgattggtaagcaccattcagaattcttgaaacat

SEQ ID NO: 8793 - DNA, 1193 bp, Zea mays
cgataccatcaacgcaaccctcgtgcagataagccaggccccgtgcgattccaagcgcgatcgagtaatgcagctcccagcttagcttagaggaactcttggagaacaggtggctgctcaaagaaccattcgccatatattcatacactaggaacctcccactaccttcggcgcaaaacccaagcagacggacaatattgatgtgctgaatcatacctatggtccgcacctcggctcgaaactgcttctcgtcctgtctgtggtcttttagcttcttgacagccacaggagtgcagcctggcaacatccctttgaaaacgcagccaaatcctccttcgccaagtttttcagagaatcttttggtggagttctttatttgcgcaaacgagaataccacaagacttccatggtcacccacagttctagcactgtaaggtttgcttctgcatctcaacaaaagaatcagagaaataacaataagggttatcacaccgatcatccattcaagaggcactcttttccagaaagaaaacggaggaacggttccagaacctgactgttgtctggctgccgtacgtacgtacatacggatgccatttagaccagagtcgagcactattgtattccgcagctccgaaaaccatagcaagcaacttgcattgtaagcaaaggcagtacaggtacaatcccttaagcaagcggattcacactcactcatgtttgtaacttccaacgcgaaagcttccaggggatatctatggatgccatctattggataaaatgtcacttccacattttcacaattcagagagtcatttctcgaacaaccagcagtaatccatgcatctgtcgacactgaattaaaaccaacagggcatatacaagagccagagccagacaacgtgcaaaggctgtaaggtccacaatatggatcataatcacataaactttctggggcagaccataaaatagaatcacagtccccttgcttaccgaatctaacaaaactagtatcatctaaacgtatgtatgtatatgtgtcattgaatattagcgtatagtttccatcttcgagaatatccatccattcagggaaggcaccagcaaacctccgaccttcaggatactggataataaaacctctccttctagttgcatcgaatgacagattaaaatgtataccaagactgttg

SEQ ID NO: 8794 - DNA, 1500 bp, Zea mays
gtttttcctctccacactgtaagtgaggtcaagtgggcgagtattgtgaacctggaacagagctctcagtttgatgcaggtcgtgcttgaccatctgcctgaggatcgaaagataccagccggcagcagcagagatctgctgtgctggatgactgcgcgtgcacatgcgagtcactccagctcgaccaaggtggggaaactttttattatcttcctctcgggttatttttttttcaccagataacaacggttagttacttttcttcgcatcgaaccgttggtcaaatggctggaagtgctcagcgtatgcagcagctaggctaaactaaagctgctatcagcgccgccatcattcttaaacaaaacccgctgtcacaaggtgaagtacacatactcataccggagcaggaaaaaaaaggcaaaggttcgtgcggcacacgtgacgctgccccacattatatacatggggagtgctagcgtggaagcatctgggcgaggctggacgacgaatggacgtgatgatgcgtgtcccgggccagtcctgcctgccgcggtgccgcccccatgcaggacagctagctcggaagaacacacacacacaccaaaaaaaaaaacaagtgggcgagcgaatctggctggccaccgtcgttctcgtgcttgcaagcgtgccatgtcgtcaccgcccagagtattttagaccgcttcccctgcattttgctgggcaccagtcgcctgagactgagagacaagagatcacaggaggacgacagccgcattagcatacgctccagtgctccaccacacgtttaatctagtagcgttaaagcacttcctaataatttcgtcgccgcctcgggagagacagagagagagagagagagagagagagggacagtgtgctgtggaggttcccgacgagaggagagagagagagagagagagagtggcgtcgacgacgacgagcttgagcttgagctgtgcagcaactgggaggtatggggaggagtaaacaaagagggggcagcataggaaaagaccaccggacgccctcgtgaagcccagcttttcgtgccgcgttcagcctcctccgccagcgcgcgagattctctccatccgcccaggccccagcacagcaatgccgcgccgctggcttcttctggctccctgcgcgcggctgggctgccgtcgggatcgccgcggcaacggccgcgcccggcacgtgttacaaaaaccggccgtgcaccagccgatcatcggcagttgtcaaactccccccgcgctacatctcggagagccaccgccaaagcttcgaggcgggcggcggctacggctggtactttcgtgattatttcgctaaacacacttttaagttgtccgctgtacggcagtagattacactgttaaatagtagaatgagacataagacgagagacagtcttacagttctccagtctattttaccaattcgattttttttctgcaaataaagttagttactat

SEQ ID NO: 8795 - DNA, 200 bp, Zea mays
tcttagtgtttattaataaataataattatatttaataaatatataatattatttatatgatatataataaacgtagcaaagcacgactggctagtaacttaactggctgtaacttataagtacccaaaccttctctcctcggtatccaaagttccacactccacagtccacacccgcgcaaaaaacacagcaaggctcc

SEQ ID NO: 8796 - DNA, 929 bp, Zea mays
ttacgtcttagtgacttttggtggcggtgaattgatcgatgatacttcatttattatgagatggaattcgtctcgaggtgaattttgtcgaaatatgatccaaattttaacgtgaactttgtagagatttgtctatgtattaaggtcttatcccataatgaaaattgtcggtgtgtcttgcaggagtttttcgcaaaaaatctaggttttgctaacataagccaccaacgctgttgtaccgactgaaccataattgctgtaggatacgatccagagggacctcagcgaccgaacacttttttgagtgtttcttggcttccggaggaagtgagcgagtaacactaacatcgatctaaactagcactgagaatttaagatatggttacctccagcgtgcagggcagcggagaccctcacctcacgccgatccggccgtttcattattcccacgccgctctcctactactcccgttgcccgctgctgctgccggtgccgcccgcccgcccgcccgttccatttcatctcggcttctctcgctggaaagtaaacccgggccaacggtcactcttcccaatcgagctgccaaactttttaaagccacccgcccccgtctccccgagaccgaaacgccaagaggagcccggacaagcaacgccactccactccccccggctcgaaacgcacaccgcgcgcgcaagcccacacaccacacacagagccctcgcgcctcgtcgcgcgcgcgatcagggccggccgaggaacggagcagcgcgccgctgcaccgcatcgcaccgcactgcagcagcaggtgagcacggcacggtgcacgacgccactggcgcggcgcgtacgcacgggcacgtggtggtacttggtacctgctccgcgacaacttggagctcgatagagcgggctggcgcatcgtagg

SEQ ID NO: 8797 - DNA, 360 bp, Zea mays
ggtaggtgatttgcgctcttgttcttctcttacccttgaccatgaaaatgcttccttttctctggttgagatcttcccctccccctgccggatctgaatctcatccccgggtggggccgtgggggggactctagctggaggggcactttcttgttcaccatgtttgtcgtgcccttaatacattttttgtagtaccttcctgtcaaaactacaagaaatggagattttggatggatgcatgtgtacatgtctctcggaaggaaaagcccgcaagatcggatcgatcacttacttggctactgctgcctgctgctgcaggtgctccaggaacaagtgccgtccaccagatccaggctcggc

SEQ ID NO: 8798 - DNA, 181 bp, Zea mays
ataggtggttagccactagtctgtttaatttgtctaagatttagtttctaataataatgagaggcgtgcagtcgtgagttagatagagctacgtgttagagcatctcgaatgttagtcaaaacagatctcacttatcaacaaacagtcacgccttctttcaggggaatatgaagaaatttc

SEQ ID NO: 8799 - DNA, 1364 bp, Zea mays
agtggtcgtttgtttcgtagctttgtggtggtggatttcttgtctacgtttgtgaattgtgatcacggctgaggatttgcatgggtgaagtgtagaatgcactattgtattccgtgttctgttgagctgagttctctttgatttgtttttaatcctcattttagttcggggtacaaattattattagtggacgaatagtgatattttggtttcggtgagaggcaggcaggcagcagcgagtgcacggcacagtggtcagtggctgaccaagcgggccgccctcccagcacacgagcctcaagtcgctcgccacgaacacacacaaaacagaacaaccacatccctcgtggtctgaacacaggcgttcttcaacctcggggctgcggagccgcctcttggcctcttcttgttcctattcgttctcgcctagtaggctactaggctggagcagaacggagaaccagagacaaggaggttattcggacacagaaactcctctctcggtaagcatgaaaccctacccaagtgccgtctgattgtaattgagcgagctttctkgagcgggtgcgtgagcaatcgaaccccctttctctgttccctccatcgccgcgtggaggagggcggtgctgattgattcttctccggacctcgattgtattgatttcctgctttctccgtcgctaccgtaccacccacgcaagcaaggaagcaaatcacccaataggatccgttactacttttagtagcgatttttctacttatatactcctcctgcctctatctttccttgcatcttcgtgagaatttggaaatcaggcttcaatccctagccgcacattgcgacgccgcgtcctccttgcctccgtgccgcatccgcaggccgtagcgtcgtgcccgtgtcctcccgactctcggtcccggcctccccgccgcgtccgcgtccgcagcgccgcgctcgcgtcctctcggtcccggcctccgtgctgcatctgcagcgccgcctccactccaccggcaccgggtggtgggcgtcgtgtcgccgtccgccgccacacgcccgcgccagaagcgggagctgtccgccgcgtcttcatctaggactggaagtctgtgaaaccgccgacgacgacgccgccgctgccatctgccatcaccgccgaggacgctgtcgctgcccacagaggacggcaggacgccgctagcatcgtcaatctgtaagattttagtcgtttctaatggtgcctggggttggattggatgctggctccgccactgattggaatgagaaaaaaaatataggccttgggacatggagcagaggaaggaagcttgagaagcaggatagcagacgtaccaccacggct

SEQ ID NO: 8800 - DNA, 1051 bp, Zea mays
gcttgtatcatgtcagaataatatatctatgatcccaccaaaaaacttctctgtgaacaaacctgaatacctgtaagacccaaaattagtagaaaaataataatataataaatcaacaaatatagtattataatgctttgggaattagggaataaaaaaatatgagaaaggaatttttttaaaggaaaccatttattcctcccatgaataaataacaaggagaagaataaataataacattgtaaacaattgaagttatattcacattagtatgaatttggacacttggaaatttgaagagcaaacatggatttgaaaagagttgagaaagataattatgataatcatgtaattcgtcttgaatgaattaaatggtgaggggaggataaataataataataataaatatgaaattaggatttctatccataatagaattgtgcctaaaattcaaagttgagtcatgtttttgaaatagaaatcataaaaagaaaatagaaaagaaaaaaagagaaaaggaagaaaacctcattttgggtcgaagtccccacctgcgacccacttccttccttgctcctgcttggcccagttggggaaaccggatagcccattggcgctcctactcgttgacacacgggacctactgctcagtctcattcgccacctggtatgcgtgcttggccgaccggcaggtgggacctcctcctcagattcttccccaaccatcatccgtgacgatttctaccgcaaaacctcatccaaatccccaacagatcgcgcgtgggacctcgccaaccaaccgtccccaaactgtagcgctcttaccgtggggccgccggtcaagggcgtcgtcctcaccgggtgaatcgggcggctgggttcaccttccccgcggatggcgcgacaatctcaacaacctgcgagaaatccgagctctgttcaatcctccccaaaccgacctgtggtagtataaaatcgtgcctcccgcgtattccttgacccatcaaaccacggccagggagctcctacgacggaatttttctccgccacc

SEQ ID NO: 8801 - DNA, 854 bp, Zea mays
tgcagatacaattcatagagataaaaacaccgtaaaagtattagaagccggtaaagattaaatccaaatgaacgaacaggctaaacaaatccggcgcctcaaaagtcaagagcaggtactgggctgtcttgcacacgtcgctttttgtctccccctggcccctgggtgagagtagtagggatgctaaagtttgctttctctttttgaggcatgtgataggctcttgttagttgctagggctatgtttataatatttgcgcttttacctatgtacgtaagaaccggatggaataatgctatgcaggaaccaattatgtttggtcgaaatatatagtgacctatcataatgttatccctgttcatgtacctaagtggctaatgatatacggcatatgaatacagtaatgatccaagcacgtaaaaactcgctagacgtttatgcctgctagcctgctgggtgtgtagactggagtactggacaaacatcgcaatacagaggtacagtatttgtctagacaatgatatacatagataaaaaccactgttgtaacttgtaagccactagctcacgttctccatgagctcttctctctgctgtttcttcctctgctaactgcgttatgatatgacgtcgtataaataatctcacaatacttccttattttcagcatggcctcttttatgtttatttaacagtagcaaccaacgccgctcgatgtttccttcaagaaacggccactcactatgtggtgtgcagaagaacaaatgtaagcagctcctacaggtaccagtagtcatgtcagtgtggaagctttccaaccaacgcctccttcgaggaacctggtcgtgctgac

SEQ ID NO: 8802 - DNA, 611 bp, Zea mays
ggtaatttggtggaaatccggtaccgagatgtgtgacccgaattacccaaacaaaacaacgggttttggacttactatctgaatcagtaaggctttgttcgtttataccaatcccgctctggattagcatggattggaattaaatccatgcctcaatccatgccccaaaataatccatgactacttaattttttttattcggttaaacccatcatggaatataactcaaaggtttgggaaatttttaaactatggaagacatggattctatccatagcccattaggtatggaacaaatccatgagatattgcacaagtttacattagaatccatggattaaaagaataactagctttgaaagtcacatggatttgttgatggatttaatcccaccatgggattgggtgtgagatatggattcacccaatccatacccggattaaatccatggtgggattatatcccatgtaaccgaacaaggcctaagctgatcatttttttccatgaacttgtgtttataggagtaaaaaaaactgtgaaagctttgggaatggagttgacagcttcgactgaataacagaagaattttcactcgtcttctcctgatctc

SEQ ID NO: 8803 - DNA, 1500 bp, Zea mays
tatatagttatttatgtatatatatatatatatatagttttactacttacctatagatgtatgtgtgacgtgtagaaacatgaatgtctcacacgcactctttactcgtacacacagccgcaataatgggtgatagacgtgattggatgtatgaaggtttcaagaagggtgggtgtcacacaagtgaatggtttgctgaaagggaattaggcttacacctagttcctaaataattttggtggttgaattgcccaacacaaataattggactaactagtttgcccaagtgtatagattatacaggtgtaaaaggttcacactcagccaataaaaagaccaagttttggattcaataaaggagcaaaagggcaaccgagggcacccctggtctggcgcaccggactgtccggtgtgccaccggacagtgaacagtacctgtccggtgcaccaggggactcagactcaaactcttcgccttcgggaattctcggaagccggcgcgctataattcaccggactgtccggtgtgcaccggacatgtccggtgctccaaggaagctcggcctcctgaactcgccaacctcgggttcgcgcggcagccgctccgctaaaattcaccggactgtccggtgtgcaccggactgtccggtgtgccagcggagcaacggctccctgcggcgccaacggctccctgcgctgcatttaatgcgcgcgcagcgcgcgcagacgtcaggaacgcccatgccggtgcaccggacatcaaacagtgcatgtccggtgtgcaccggacacccaggcgggcccacaagtcagaagctccaacggtcagaatccaacggcagtgatgacatggcaggggcaccggactgtccggtgtgccatcgtgcagacgcctccagccaacggtcaagtttggtggttggggctataaatacaccaaccaccccaccattcattgcatccaagctttcccacttctcaaccacttacaagagctaggcattcaattctagacacattcaaagagatttgccgtgttcttttgagctcttgcgcttggattgcttcttttctttctcacttgttcttgagatcacaactccattgtaatcaaggcaagaggcaccaattgtgtggtggcccttgcggggaagttttgttcccggcttttgatttgagaagagaaagctcactcggtccgtggatcgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgccctctctcgcggactcgtttatatttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 8804 - DNA, 367 bp, Zea mays
tgcatataaacgacaactctaatccatgctttacaaaggttctccagataaattccactattaaagctcggtcaacacataggcactcaagaaggatcttaaccacgcttgtattgtttccaactttccatgccatggcacaagggcaaccaagatgttcaccagcagcaaagggcagcaaggtgtgccacgtcggcagaaaaccccctcactcacatctcatcctgaattcctggcactatcccctaccagccaaccatcgcaagatgtttgtttccattccatcggtggcacgagacaggagacgccaaggccatagctagagcctagagcagcagcagaggcttgacctgaagctccacccgcc

SEQ ID NO: 8805 - DNA, 1411 bp, Zea mays
ctgtcgtcgccttacacttgttattaaaccagaagaggtcacaaggcatctagttattagctggttcaagggtattttactcgtaaggcttggagttttaaagagttactagtattttaggacggtgaccattccaacgaaattttgaccggctgtcttcgccttgcacttgccaataaaccaggagaggtcgccggatgcgctgtcagcctgtgtccgtcacgagctgcgctaactctgcatccttgcaggattcggtgggatttggccgtatcgtaagcctatccgcggtgtttccgtctagtttttctctcccatatattccagggcggattcgtcctgcttcttgtcacgtagtactcggcagcaatgcctcctctgaacgtatgtagaaactgcttcaaaaaagattgaaactggaggtcacggagctttggcgtgagaaccgaggatcatcgccggtgctggcgcggtgacgccgacgggcgacggctgcaggttgacctgtagcagctaaccgtgtactgaactactgatatgtaaagccaaagactgactgcttgttattaaaccgatggcagtgacagtgaagaacattatgcaattgtattctcttgtggaaaattgatggtatcgtcgtcacaattaataattcggacccaaaaaatacgccaattgcaggttctggcaagcaaagtccatggaggcacgcatcgactctctcgtgcacccacccacccgtaccgctgtcttgcagcagcaatcggcacgggcatgaataattgttggctgcggctttaatctattggcttctatattttctatagtattttatctttataaatcataactataataatagttcgaatagctagcttaaaaaccacagccaacaagctgttggttgtcactgcactttgccggcatgcagctgcactcaaatatatatgcgatctcggctcgtctctatccggataagattcgccaggactcaagagcccgtcggcgaaccgatcacagtcggcgaggggagggttttttttttttttttgacgcggacgccagaaatcccgtcatgtcaggtcccgccgtcccggcgcagaggagagcgcgagcaccgagaagcgcggagcggaattgcaaagagcagacgagcagtgtagacaacgggacagccattgacttccccgcctaccctgccccgtcccgtccgtctccgtcccaatcggatccacccgcccgtcgtcgcctataaactctccctcccatccgcctctcgaggggcccggcttcctcccaactgccaccgatttgtttgttcgggttcggccccatctccagtcacccgttcccacttcattggtcgctgctccctccctccacggccgatcccgtgccggcgagagggacc

SEQ ID NO: 8806 - DNA, 120 bp, Zea mays
tgcagcacacgcatcagggacgcgattgtcgacggcatgtcggcggcgagcgcatcggccccgcatggtatgccggccgaccaaatctccggctaaaccccccgccttgccgctcatttt

SEQ ID NO: 8807 - DNA, 162 bp, Zea mays
ccgtgttgggttggggccagaaggggcttctgtagttcttttcttgtgcttgtggttaccaccgaccgagctcacgttctgatcgtttcccagttccccaaaccgaacaagatgatttggtacactgcagctggcactactacactcgagtaaggggaggag

SEQ ID NO: 8808 - DNA, 755 bp, Zea mays
attcatttttattccctttcaacccctactaaattcgaagtggtgttagttttatatagggtatagatatagaatatagatagattatctatgaaggtatatttaggaggtgttttgtttgggattataatatgtctagattatataatctaacaaattttaattaattcttgtattataatctctccaaattatataatccgattataatttcaaataaacaccgtcttagctattttatggtatgcataaataatatctggacacgtgtcaatataatatcctatgcggtattgctaagacaawttttagtagtatataaagaaatgagagaattattgatttattattactttctatttctaaacctctaatcattttagacccatatgttaactctttatttgttgctttattacttgtagcaaatatttgttcctctctttgccttgcagacaaatagcacacagcaatcaaccgtcgtcttcttcctcgacgcctcataggctcatagggttctccaaattctaaatcgttgcaagcgaaaccaccaaaactgtactcacaaccctcgtctgcgctgcgccaccactcccccgtggcggcttgtagttgtagaagttcccggaaccagacaacccctaggcgctgagttttctgatagcggcttcggatatctcgtcgtgggcggccatggcgggcccgtgctgagtgcggggcgggagcaggtgaaggtctccgagctcgagatctcg

SEQ ID NO: 8809 - DNA, 276 bp, Zea mays
ggtccaaatttccctttcccccttcttccctatgaaccaagcaacgggtgagctttccatccctatgtctagcccctcatatcccattatacaaacatcacctaattttggttgcaaatcctttctgtttctgtttctaatttattttatttgatcaacagtaagcacaatatcctttgtttgtctgcagtattaaagtacacaagtgcataagcgactagatttggagtggtaaagacgagaatcaaagagctggtggattagaggtgtaggaag

SEQ ID NO: 8810 - DNA, 184 bp, Zea mays
tcgctctccgggggagggggtacgggtcgccggtggcgccgcgctgggttggtgccggtggattgttggagccactcgcaactgccaactgaagcggtgggccgacggcggtgcgatcagaatcagatgcgtggtgtgaggactgactgagccgctgcgtgaagcgcacgcgaccgagaggtga

SEQ ID NO: 8811 - DNA, 86 bp, Zea mays
tcccctggtcccttaaggggggcctaggtgatctcgctcgctgcttatgttcccccacttgaatctgaaggttgtcagttttcatt

SEQ ID NO: 8812 - DNA, 1274 bp, Zea mays
tcgaacgaccgtgatatggcataaaccgtttcatattttcgtctcgttttttgcaccattttcacatttatctgaaaatttgagcgaaacaatataaaaatcaatgcaaaacggaacgagattttttccaatcatttagatccttaaccatagtaccattgctatcttgtttggacctcgaagagcttgtgtagaaaaaatatgtcgtaaacaaacacaaaatatgttatataaaaaggtgttgattttaccttttacctcttaccctctttattctaaaataaactagcaaagtgcttgtatattgctatggtttcatttataaaattaaatatgtagtataaaacacaaagacttgtgtgttctcttggttaagtaagtgtttatttggaaactgtaaaattactaatttatattggggagaagggagataaataagaaaaagtagttaaatctacataaaaatatattaatatttacatacaatatatattaagtactattagatcaagcctctaatatatttataataaatttatttgagatatagatactattaccattttttatattttaaattaaattttaaataaattttatcataaaaaccaacacattatttattttggtacggagaagtaggcgtcggagccctagccagctcgccgagagcccgaaacagtccaatcccaacacggcgacgacgccagcggaaatcgcatcgccctcttcctctttccctcgctgtgcaatctcccccaaactcccctctcgaaccctcgctctcgtcgccagagcaagcaaagcgcaggtacgaattcctccccggaactcacgatttcattggattcctcctcctcgttgatccgatcgcgagctttcccggtgcggaaccgtggattttgagcccagattttgcggtcacccgcctcgtgttatttgggggtttgaggggatccgcggatttttttgctggtcgccggccggggattagtagtacggctcgtagattgatcgtcctacgcgtctagggggattagggtttgttttgctcgggtcggggcccggatgctcttgttgcctacctgcttgcgagattggattggtactttatagcgtgatgtttacattcttttggtgactcgttggctcgtaattttactcttgttgactagctgcttgcgaatttggattggtactttgtgtgatgttcgtttgtgactcgtgggttcataatttggccgcagttgctgaaacccgtgcgctgttgatgg

SEQ ID NO: 8813 - DNA, 311 bp, Zea mays
tgcaggagccaggacggtgcgttctctgcacgggcagcacggcccaactgcttatccagacatgtccaagtgtagcgctcccataggcgcctcggcgagcggcgaatctgtttcatccgctgcaagtgatccacaccaggcgcgcccccacaacaatccgcggcgtctctctccgcgcctccgctccacagaaccagctggggctagcccgccgcgcagcgcagccacaaattaaacggagcccggcctgggcatccattattcgttgcagtagtcgcagctgacggacgactgaaccaccgacagacaac

SEQ ID NO: 8814 - DNA, 1500 bp, Zea mays
aattctttgatgatgttgatggccgaagtggcttgaaccctgttataacgacttacgcccgtccaatgcaagatgcaaacacatgtgaatgctgtccctgtttagatttatcagctactgctacgcgcgtaaggatccaaacgattctagctacaacgacaggtatatatatatatatatctaaactttacctgaagaccgaaatatatatatatatatattaatcatttggaacgtaggattgataaaacataaaaatatatacaggaaatagagttgcatgacacttgcaattgtataggaaaattttccaagaggttagatctcatgtaagaaatcctacaaaatctctctacaatagtagacccatatttcgtaattaggaattttataaaaaatatttaggaactcaatcctttattccaaaggaccacactaattcgccgtttagataaaatgatctgaaatatatttagctacgatttaaacagtcgtatagctaatcttcagctgagtaaaattataaagctaataaattaaagcttcgcacgatggccgaaggcgatcgagctagctatagctgatatatatggcgtgcacgagtaggaactcgcacgcacgtcacgatcgccgcgtacgatgtatagctatccacccggccgctagctatagctaattaacgacctcaattgcggaataatcaagttgatggcgatccctggttcccacgtcattaatgtcttgttcgattattctccttatttatagattagatgtaattgaaaaaaattaataagtttaatttaattagaatttaaatcgacctaattttattcaaactacatgaattggaagctaatcgaacaaaacctctagctaatcgaacagcccttgccttgcctccgcccggaaacatgcacgcgcacacgtaaaacgaccgcacgtcaaggccggccggatcggagagctagtagctgatcgagagaccttttacacggacaaaaagtactagggcttagttagggtgtacatcgattttggctcgcgtgtcacgcggctaataataagaacgctgccggcggttggggcgagcaatctcatggtgatctcgcgcatgcaccgtgtagcaggtggatcggatccgatcggagcacgggcggcatgaccggatgcgcgttgcttggaatctttccacctgtacgcctatagctagctaggggctagctagagccaagtagctagatcggttcgtttcacttgttgcctcagcagatagagccaagtagctagagccaagtagctagagccaagtagcctcctctatataacggagttccctcgcgaccaactccggtcacacacatacttgttgtataccgcctttgttcggagagaatcatcgagtcggatagagtccagggctccaggcgctgcgtactgatcgaagaggcgtgtctcttcgatcgacctccaggcttccagctagctagctagcgagcg

SEQ ID NO: 8815 - DNA, 508 bp, Zea mays
aagttgtgatatttttttgtcaattaagtaggtaggttcaaaatgtaataagctgtcattttatgtggagcagaaagaatgtttacatttttgtatttctccagaaggcgggaaatttcatttttctgctagacacatcccttcctgtatatgcttttgctagaacatactgggttgtccactagcgttatttcatttttctgctagacacatctcttcctgtatatgcttttgctagaacatgctgggttggccactagcgtcattgatgagaaatgggttcttatatggcatgttttacctcgagtattgactgctatgcttctgtcatctagctgtctattgcattgctttcctggtccttttctcgtgcttatgtaattggccatatactaacatttgatttaaaactgaagttctgtttctcagctttatgatcaagcaggagctctgattaacagaattttttgaattctccccaaattgaagggtgcacctgaagggagtt

SEQ ID NO: 8816 - DNA, 1500 bp, Zea mays
ccggacaccctaaacgtggaggttcttcaagcgtccgctatccgtcgctccttctctcccgcgccgaagaggaagcttctcctcgtactctcttcccctcgcgaagcactcgacgccggccgcgtactctcttcccatcgcgaagaagcactcgacaccagccgccgatgagctcgacggttgcacttgaatccaccatgaagcctagagttgctgattcgggtactatcacctggctagagcagccgcacacttgtacatcacaggaacttcaggagcgacggcaacctcaatcttcgtcgctacggtggcgatggtggacacagtcagacagacaaggcacgacgccggtgacaggaaacaaagcgagcaacacaaggagagagaagtgattgttcactgcaaagtaccgacgagtagtaaaaaaacaaagcaaatgaagaaaagaaaataggatcttatgtggagatggaggataacctatgtgaatttgtttagttttttagtttataaaatatttattaatacatgtcaatttttttgttaatatggttgttggaatgcattttacaattaccaaattccgatatttttttccggattcaatattacattccatacagaaaagcaaaattcaaaaaatgtaataatcattatctcgtgtgtgaggtattttaattatcttgtgataaaaaacaataaattaaatagagaaaagaaagtctgttaatactgtagctatagaggaccaaatttagaggacgttgctggagactaagatgatatagaggacataatcttttagagtgtgctgtaaaggacagagaatattcctttaggggacgaaatttagaggacgttgctgaatacatcctaacaagatatatgttgattatgtcaaaatagacaaggttaatattatactttactattcatattgttatactctttgttttatgttatgctttcatgtgggtgtcttagccacgtcagtgacctcgagaactgcccgcccaagtcggactcctagttcactatctagggtgatgataaggttttttcgtgtagaagaacgacatgtagaagaacgacatygagataaacacctctcctcatacacagagcctttgtcttcctccctgcatatgttatgtttattatggcatcgacatgttgtaattattgtttggcagatacaaaatcataaacacatcatcttataattatattgcattactgttttgtgtcaattttaagctgtctttgtaaggtacggacaccataataacaatataaatcacgagtttaggttaaatttaggaagagaaatcttgcctataagtataaccactgtagtttatattgtttttttttgttgtagaaagaaaccgtagtacgactaatctgtagcagcagaatgactacaagcattacggtcctcatccattcgactattcctattcgagtgaaagcggcccccaatttctactgtaagcagca

SEQ ID NO: 8817 - DNA, 88 bp, Zea mays
ggtgcgtcgttgcgaacacacatgaccgctcaactaattaactcccgttcgcctgctgcgcccttttttttccgttttcaaacgtcta

SEQ ID NO: 8818 - DNA, 642 bp, Zea mays
ctgcaaaattcaagaaagtatatgtttgcttgcttcaatgagttcaatatctgttccctgaatttaagatctatgatccacggtgttacttattgttgttatggtattgggacaacaaattctagtttgtaccaattcaatcggtcatggtgttagtgtttctttaagacttgaagtaatttatctgtcattggatcattatcactaatgatatttttactgtaaatttgcactgcttggtaggagatgcagtatatttaatctgaaggcctcttttctgatgacttgtcacttgtcgtgtcacttgaatgcatggcatgtatggttgtcagtgctaaccattgcaattatcactaattatagtagtactagaaacttggtagccttgattttgccttgctgacaaagtcataatctgcactcttatatgaatacatattacatagcttgatgacacatataagattttaacataacatatttggttatcgtcaataatattggtgagtttagttttcctggtttttctcatttattcatgcatcaaagctagattctcctttttatgttacaagttgtcagttgtctctcttgcatgccagcatgttaaatctgctgattttgattcattaagatattagg

SEQ ID NO: 8819 - DNA, 1500 bp, Zea mays
cagcatcaccgtcgggtctcgggtgcctgacgatcgcaccgtgaacctctcgcactctctcctatggcttccaggactacgtacgcctcctgtgtcctgttccagcgttcctccagcagtccagcatgcaggctttctctgcccacgggccacggcgcggcggcggtgttcgcagcgctgccggtcggcaactccgacacaatgacgaccggtgcggccgcctctcttttcgacatgcaggcggagaattctggatgctgatgttcagcgctgtggaccattttccactccacacttccacatactccacacttccacagagagtttatcacaaccgtcctgcttggcggttccaccttacgccatgtagatagaataatcttaggccttgctcagatcctaataatatttatggtgcgggtgcctaaatttgattactgttcgccacgagtactgcagatttgcctcgtgaattttcttttgacgaatgaaacatgcatcctgctgcacgcggtctcgttgctggcgcttctgtctgtgcctgcttcctcacatcacctgaactctgttccagaagatatgctagatacagtatgtcatccttaattaccagccagtttataataataataataaataatacaaattaaatccaccagccacctagcggtatatatttctactactattattgtacgtagccatccaagtatcatagcactagaagaactactgtatagcataattattaaatggcctaagagaatcgctcgcggctccattccaagaaatcacactacagtagaaggaatgatatctgtagccatatcacgcaatattacgatcaccgtccgtcaccttcgaaatgcattgcatacacaccggtcatcagatcatcaggcatccactttctctaggagtttgctcatgctgtcactgtggatgtatttcatgatcacgcatcagaagaaattttgcggtccattatattataactatatagttatcggtataaatgtagacataaaaaagagaaaaatgttaccctgcaatttgcggtccattaatttccctgttcgggcccaatctgagaattctaaggcccttcccgccggcttccaggggcgtgttcggctggctacaagccgacactgttgcagctgtttggactgctgcagctgcaatccatagagagaaaaatactgtagaagccgcagccgcagccggattgcagccgcagcaagccgcagcgaacaagctgcagcctattcaggcctatcaatcgcagccgttggatggatccgacggtaaaggtaagcatttcccggccaaccccacattgcctttctccagcctgctcagggcgaaacacaaaactctcgctccctctcgcagacgcgcctaggtctagctagggtctggtctcgctgccccgccgcgcgcgcattcacaagcttctagacgttccgaggaggaggggaggtacccgccgccgcagcc

SEQ ID NO: 8820 - DNA, 295 bp, Zea mays
tgtctcctcgccatcgctggacctgaagctcgacctccccattcgggcaagcacgtacctgaaaagcgttagcgtcgacaggaaattctgcttgcgggcgtacacgccgacgagcgctgcccaaggactcgctggagctcaccgacgccgaacaacacacacttcaaacagcgtcctgtgcgaccaccgatttgagacgttgagcaactcgtccgcccctggcgtgctcgccaccagtagtgcccccgcgcccgacgactaggtgctggtggtgtcgctagagggtatcgacgac

SEQ ID NO: 8821 - DNA, 48 bp, Zea mays
ggtgcttgcattcgagcccgtgtatggagaacctgcagcggatatgtg

SEQ ID NO: 8822 - DNA, 139 bp, Zea mays
cactcaaaaccaaaaccctccatccattctacacgcgccgccgcactcctgtacacgccccgccgccaccgcctccaccaccacagcgcgcaggaatccctcgttctctgagggtttcaggcgtcgtatgtaagagaag

SEQ ID NO: 8823 - DNA, 1484 bp, Zea mays
cactatatataagactgtttccagtagtgttccctaaatttcactctctaaaagaatattctatatttttacaacactctctaaaagatttcgttctatatatctcttctatctctagcaacttctgtaatgcatgatttcagcatttttattgtaaaacaaaattaacaccttaattcatgaaagaaaaacccttggctaaaaaaatatttagagccaaattactcatctttcaatagtaggattaacaaattactaaaaatttctattatatggaaatgtgttcgtgctaaaattcaattatttaaaataattagttttgaagacaaattacaaacagtatagagtatatacaaatatatacacgttgtattcatttttttatcttatacatggaacgtccacgaaaaaaatctaaacaaaggcaggaccaagcaacagacgacgtatagcgaactggactggtgagccatatttagaggaagcaaggcggccactaaattttagtgaatcacatagcgagtgttgctgcagtcctgcagatggatagtcctctatatttatatttagagtacaggatatgttgatggagacagtctaatgattacaaattggtgtgtcatatttgatcatctcatcatataacatttaaatgttattctcagtttaaagaggtgtttaaattcactagatctaatagtaggctaaaaattgatagtgagcaactccaaaagcttatataagaatcctaactaaatcttaagtttacatagcactttttaaaatagatagcttcctacaaagcatgggtaccaacaaactatctaaaggaaacgctaacttggcttttgtgcatgtttgaatttttctgcattgcacactttgctctgactcagctgtgggatccggtttgaatatttctgtattgcacactctgctcgctaatttggagtgatagggctttgtgcatgcgatctgatctgcatgtcaggacgttctagtgtcgctgaaaactgtgaccagcaacctaaagtatttgacttgagcaacctaaagaatcagacgccgccaacctacagaccgctctcaacgctcagcttttggatccggtttgaatagttctgcatgtgcaatatgatctgcatgacgttctggtgtgccaatccacgggccgtgacttagcgtgcgatgaagtatttgacttcaccaacctgaagaatcagacgtcggaaaccttcagattcagatgcggcaacctgtaaccttaaatagacacttgtggtgaacattggatagcactcgacacctgccaactgaactcaacatcaatggtgaatagtgggtaggacttgacgcccgcaacctgaagattgtcacactactgtgacagccaggtggtgtacggtgctgtcgagaatcagatgtttagaagctagaagctgccaccgcgacttcaacgtcttgtactggaccacttcgacggt

SEQ ID NO: 8824 - DNA, 287 bp, Zea mays
aagtcgagacccccctgtctctagggtttccctcttttaattcccccgccgccgcccctcgccacgctccgccagccgctgccactcgccacgttccaccagccggcgccccttttccttctcactccgctggcgccggcgccgccttatccatggtgagcatctggtctctcccgtcatcacgcttagctgctcctcagttactgtatatggacctaacccttatgcgcttctctgtgtgcgtgtcttttctttcgcaggcgtcggagaagaagcaatccaacccg

SEQ ID NO: 8825 - DNA, 1310 bp, Zea mays
gtgagttcatcctagtgatacactatcaattgattataaataaattaattttgttaaacaacaatagcatatgtcatgtttatctatatgaatttgtgaattaatatgtatttaaaatttgtactaaaaccaaccgtgaatcatctaattaccaattaagatttatgagcaaggtccttaagcctaacaccttacactatacagatatacaagataaaatagagataccaagtagcttgctaggaaggtgcatgcagcatgcagcggttcgttagattattatactggggagaggactggagatatatgcctgacgtggccagcgcgagaatatawtcctgcgtatgktctcgcgcgcgcacacgacggcgcggcagctaccaaccggtggccgtggacgtatacgctcagctcgaccgagatcaaagcataaggttcgttcgtttttggtcatgcgatccacagaggacggccggccgccgggcaccggcggtgatggatcgagaggcatagtacgtacgagcaagttgatccacgcgcgcgcagccggatcggagagcgatggatccatctcgctcgcgcggcggcggcggcgataggagtcaattaatcattctgctagctcatcatctgatccacgacgacgagctcgatctcaacgtagtacgtaagcatatataagatctatcgaccagctgtcgagctggaaattgcccttgccggccctgcacggtgaaaatacgccggcatttttctctctttctcgcgttagtccgctgtcaggccgtgcaacccacgtgacggagattccgccgcgcagcgacctccacatcgcgcgcctgagcattcgttcgttgcttctaggctctagctagtatagacgatgacgatgtagattgcagcgccgtcacaaacatgatgcatggacgacatgcatgacggcaaaaatcatctttggccgccgcagagctagctgtactgtatatataccacgtacggctagctagctagcgtatctgcatgcaatgcaatacctaccgtatagtatagtatcggtatgccgcccagctagcgtgtgtataaatagctgccgtgcagtagagaaccccggccaggcagcagcaggaacatctcatatccacagagacacagtgctaggtagctagcagccagtgcaggagtagcccggttatatagagagtgtagcacgactatacaatatatcacagagctagctagtagtatatacgtactatatatagtctattgctcgctatagcttgctgaatcaagctgaactactaagatta

SEQ ID NO: 8826 - DNA, 1500 bp, Zea mays
atcacaaaaaaaatcacatcccttttttgtgtcagtatgacacttaaagatgtgctccctccattctaaatcataagttcatttatactcatgactcaagttggctaatttttactgacaaacttcaaaagaaaaacccttcgaaattttttgagtcgtctctaaactcttttctttatctcatctcgaacaaattgacttcctggggaagtactatacggcacggcaccttcggcgaggactcaactcaacagagaatgatttgacaaacattgatccgccagctcaactctgaaaaagaaaagaggagaatctctctagcttgtggaatcacttccctggatgcttagatagctcgagaaagtgcgccacttctccctgagaatctaatcttttctaaatacattgttttttatatttagggtacaactatgtatcttaaaaagacaaatgccttataatttggaatggagggagtatgatcaaacatccttcttctaatgttgtttttttcttttcatgaaagaacggcacaagactgtcaatttcattgaataaaaaattgttgaaatgggccttttgagtttgaaattgtcacaaacttgaatgaatagttgtaaagggtctattaaatttagaagattgtgtattgacaaattattgactgaaacagtgtactcgtgaatgaggatactccatcttttaggcctgtttgtaagtaaagtatttttatagtttctagtcaatatcatggtttttagtaataccgtagtattttatgccataagttgtttggttgtattcctaaaaactatgttttcaaaaccatggtattctagataacatggtatttttggagtattgaaaactccactcgaacccaaagtttccatggcatggctagctttttcctaataccatggtttacactgttgtatttaaaacaatgtttttttaaaacatgatatttttggagctgataaaactacggtattgtcatgataattataaaacatagtattataaaactatgattttgagaaacatggttgctaaaggcggtgagtgagatcgttttctcgcatggaggaaaaaaaagtgcccaacatatgtcttcctacgtggcgcgtgacagagctagctcctggacgactggcccgtggggcctggggctgcgccgctgcgctacgggcacccggcgacgcccacacgaaatccacggctacccctctatttatacacacgactcttcagcccgttctccttcgcgcaccccgcgcctcgccggagctccgccgccgccgctgtccgattccgcagcagagaagccaccaacaccgccgcacgtccgtggattgtcctcagatacgcctccccgcgccgcgtcttcctgaggccgaggctccgacgcagccgaacccgtgcatcccacgggtccggaggaggaagaggaggagggaggagctgctgctcggcggccgcccaggacgagcctaaggg

SEQ ID NO: 8827 - DNA, 462 bp, Zea mays
aggcatcaccttgctgtggcgccaccggcgaattaagggaatcggacctatgcgacgactcggaaaccgctctctcctccccagatggaccgtaggttggttataaaatggagtgtatccttgcgcaattgagcgtatccttgtctgttgggcgaaccgtggcacaggtactgcggaacaggattaggtgttgtcacggtttaggcccaccaacagctgaggcttgctgaggcccgagcgtcgcttgctcaggtccgactgtccaaggctctgaccggctaaccggctgaccagtgaccgctgaggtgctgctgactgccttctctgtccctctggtaaatttgtgtttcaattggagttattgacagattgctagtaaggatttggacagataaattaaactggtttggataaatgcttacgggttttattcaactttaataggtcataatataaagattg

SEQ ID NO: 8828 - DNA, 536 bp, Zea mays
cgatctgtactgtaccttccttccctgctgctccgccgtgatcgcgatccccttttgatcaatgaccccgggaggcacggcacgggccgcccggccggatcacactcctcaaagccgagcagaaagccccgcccgcccggcgcccggacgtccgattttattatataaatatcggcgctcccccgcaacggccaccgcttcctcgtcctcctcctcctcgtttcgctcacgagaaagcacgcaaacgcggtcctcgctcgagatcccccaccgcccgccccctaaagcctcgcggcgccgaccccgaccccccgtggatccaccctgcgcgcggcctctagagctagtccagatccgcggggcgcgcgccctcaccatcatcacatcgcgcgcccagctagccgcgccttggaggcaaggcatcgtgcgtgccaccgtacgtccaccgatcggtctcgatctcgggccctcccgctgacgccttcggctggcctaataggggcgccgccgggggatcggaggggggcgccgccgtc

SEQ ID NO: 8829 - DNA, 1051 bp, Zea mays
ctgactcgccgtgctggcccagacccttgtgcgcattcctccctgttgtccctccgtctgtccgtggacgtctgcacgacgatgacgatgacggtacgacgagacagcagcttctggggaaggcgattgatgattgatggcgcgccccggctggtttgagtggcaacagcgattcgccgaggagccgtggcgtttgtacactgtctcctggggtcatgtcggcctgttgtattcttattactacacagaacgcactgtaaagtgtatgtaacagtgccgctaaaacatgtccttgtcccgttgtctctgtacagtatatacaaacgtttcacgagtttcataacactcacgacgcactgcagaaaaccgaaccccacgacgaaaccaaccaacactcgcgggaaaatagcgatgagaagatgcaggcccagtactactccgactctcctacagtttagtttcccaagccctcagcctcacagcccggcccacaaacataaatgcaggcccatcgacgcgaccagaccacccgcataataataaatggccaaatgcaggagtggcgcccacgagtcggtgatacaacgtcactggtactggtagtacgccggcgcttccagttccagcacgtgggatccgcccggtacaggctacagaggcggacccgtctgccagcgggagagcggccgcgtggtcgatccacaccgatccgtgcgggccactggacgacggggccactaaaggctttcggccccacgccgcgatttcgaattttaggggtcccgtcaccgtcggtccttcgcaccacgctacccgtccgtccgcggttcctctccccattccccaacgttcctcgctccagagcgtttcaaacggtaaggaagccacccccgctgtgaggttacttaaggcacggtgacccgacgcgagcaaagctccaagacccgcacgcgaacgccctccctgccgctccgccgtttcgcgtgggagtcgtttcgaaaaagtctgtttcgcgagcggtgaggactgaggagtgtggaggcctaaaacc

SEQ ID NO: 8830 - DNA, 139 bp, Zea mays
aacctgcaggtgcttgtcgtgcttcttcttgattagaagtttgtttgtttgatcgatgccgacggcgacaagaagaaggctgttgttaggacaaagttaaaagttagtgcatggtatgtatggcgtgtaaattgcaatc

SEQ ID NO: 8831 - DNA, 799 bp, Zea mays
agtgggcgacactctaaatgctcctcgctgaggtggctgagggatgggtggtgataggagagggaaggggtggagaggtctcgatgagggagggaaggggtgacacatagattcacatcgtgaggagggggcagagacaacgacaccgatgatgggggttgggtgcgggcgtgcggcgctgaggccaaggagcacagaggcgacgacggatgcggcgggcgcgggggaatagcgagtgggggcgggggcacatctggacaggggcaagcgtggctgtgaacgactagtagtagtgttaatacttgctccatctaaaatatatgatgtttttaacttttagatattgtttgacagttctacttatttaaaacttttacataaatgttattttttataacttatttattttactaccagagatattttaataataatttgtttatttcaatatttgtactaaaattgaataagataaatcatcaaatatgctttctaaaagtaaaaatgtcaggtgaagggaactttttcccaaaacaaaattccacacgaggctgtgagccagccaaggcgctcatcgactccagccagccgcccaaaaatccaggcgcaaatcacaacctcgcatcctcttctgtcccgtctccagctcttcgttcgttcccctctcgccgcccgtctcccccgcggtcgaggagccgccaatagcaaggagagggtttcctcctccctccacggctccaccgagctccccgatccctccgccccaaatcccacacacccggttggccaccgcctcgcc

SEQ ID NO: 8832 - DNA, 1050 bp, Zea mays
ttggctcttcaaccaaacactatagtatttagggagcgcatagcaatatggtcgtttcgctatacggagacgtgttgagcatgttttctattcgtaggctggctctccatgaataatcttatcttgtctaaaacgtatttctttcggagcgccagagatttggcttcccgtatcttcttcgtcttcatgcaccttcgatctgtccgtacgtgtgtctcgatgcaagctcttgaattagctttaatttcttctctggctttggccggtaataaccatgcatgtcatggaaaactttgaatatgcatgcggatttcatcaattttagactttcggccagagaccttcttcccagcaacgttagttccaaatgaatttgtcgaaatggagatcaatgatcttattacgtagatatatgtacatttagctcgagatttaaattttatacacaccggagactcttttatcctggttggtaagatagatcaaccgaccaaaaactaaaaaaaaaaaacttgcccgcgccctcctcctccacttcctttcattcgtacgtagccactaagatcgagaaggaagaaagctgcttgctttggccactttataaatttcgaccagctgtttctctcaaaacttacctacgtacagagacgacacacacgggaaaccaaaaccttcttgtcgatccggccggctgctgctgcgacgcaacgcaagccaccaccatcaaaattcaaaagcccctgccgaacccgaaccggccggcgcaccagcaaaagccctcgacgtcgctcatccggtccggcccccctttccacctttccttaattgttaagtcccctctgccagtgctagtggggcttcagttccgccttcaaatactcccccgacctcctcgtcccattcgttccattccgtgatttccatcccatcccatgtacaccacccacacccaacagccttagcttctctctctctctctctctaagcgcaagtgaagcaaaagcaagccacggtagtgctccgcgcgccggccgggggcggcggcagcat

SEQ ID NO: 8833 - DNA, 1500 bp, Zea mays
ttcgaagaaattgaaatagatgtactaaatctaatagatataacaaacactttgagaaatgtgccaaatttgaacatgtaggtctagagattgtatgaacacagtacaaaaaagttggaggggaaaagaaaaaaagcaaataaactttgtcgagtgtcagaaaaagacactcgacaaagacagtgcctttgtcaagtaccttcctgtggcactcgacatagttaacgcccgtcagctgttgacgacgctttaccgagtgtctagatttggcaagagttgggcacggaaaatatggttttgccgagagtgtttgtatgtcgagcattttgcactcgtcatagaggggatctttgtctgagtgtctttgttcgtcaagagtaacactcgagtgtccgagattttgcactcgtcaaacctatagcattcgacaaataacacatttccagtatagatgaatgggataaagatgttgtaaacctatttttagagaacagtagagaattaatgatgataaaccatttgtatttgatgtcaaagaatttatatcgattacggagtctttgctttagtacttcagtctagttagggcacgtttcttttagcctgtaggtttttcataaaatgcaagttgaaacaggagatccaacttgtaataatgcatatgctacctatgtttatacaatccagccattaaggtgctgtttggttcaaaaatgtaacgcaaatgataatggtaatggtttacgcttattactggcggtaacaaatttgaatagactggtatcaatttttagtgtggtatctgattacggttagactaaaacaaacatgatttaacgttatcagttactcattacgttataaatatgtcattacgttataaatatgtgaaccaaacgacactacttcctctatgtagcttgcaaaaatttgcaagacgtgattcacaaacgaggcccggcgtggaacatcggggattcgagtgatgtcagtatgtcacaggcgcatgtcgctaacagatgtcctgtgcagatgggcgtatttgcacgtgtttttcttgggtagaaatcatatagaaacagtaacagcgtggcttgcgtgatgtctgttttaaattcactccaagattaggatgctaacctgccacggcctgtcactgtccgttcggttagaatagaacccccacggccccacctcctttcgcacgagatggctatataaagcaggatccattcgccaaaacgcgagtcctctcagtctttctccccccacggcagaattccgattccggccgcctcctatacatagccagccagccttccaccctctcccctcccccaacacagagcagcgagccgcgcgcggaggcgaggcgttcgcacacctcgcccgcgccaccaccaccgctccgttgcgcccgccagccgtcacgcgtgacgtttcccggggggccgggggagagagaggcagaaggaggaggcacggagaggacgagacagg

SEQ ID NO: 8834 - DNA, 103 bp, Zea mays
gtacttgctagaaaaactctgtgcggctatcgtgctgacgcgtctcttttttttttgtctgtagcaccttttttaaccgtttatttattacgcgacaactgtt

SEQ ID NO: 8835 - DNA, 1500 bp, Zea mays
agcacataaatatctccgacatcttgttaataatagtatataaatatattttgcataaaactaaattagtttaattgatatatgtcaaaattattattattaaaatagaattcaattccaatgataaaaacgtgacgttatataaatctgtacaacctctccactctcctccaatgcataaatgcgaatgtgagggaggtagcaagtaatcagaattgtttgttgagatgatattgtttaggtgaaaaataataattgtatatgcgcacatacgcaattcacggtgcaaatagctaaatggctcgcagatgcaggtcacctggagtgaacagtggttgggttcgatcggacaggacaggccctcgacggctgttcgcctgtcccgctgcccggcgacgtgaccgatcggggacgctcaaaggtttgctaccagcaccagcagcattaaaaactactagtagtagtagtatttattaaatgcacgtccatgctctctggcctcggttctagctctacttctatgccccccacagccgccaccgtggacgcatgtcgccgtccggttcgcccacgtcgcgcagcagcgtacagcacgtacgtggcagatcccagagtcgacacgatatacacaattttttattatttcgttttcttcctctgcgtgggccccaccctcacgcctcccccctgcctagttgccgcgccacttgtgcgtcgtgggggagcaccgcgcctggtccagcacgtgccacgtcccctcacggccgcacctgtagctatagcttggccgagcccgagctgagcgcctgagcccgtgagccgttccgctggaggggagagggaagctacctgttcttggctcggctcatcgcctcgcctgacgagagtcgacgtggcggtgacccacccaacagcaacacgtgccggcgcggtccgccccccactcctccagtcctcctcgcccacccaccaaacacgctgcctgccactaatcggcaattaccgacgccataataataaccctgaagcaaagcaattgccaattgcatagcaccacgccaccacccgacccatccaggcacaccaagaaacgcaggccttcccttttgctacctgccccctcggatcgagcgggggcaattcggattagacggccacgtcccccgccgagcctcaccaatcgccctctgcaggcagggaaggacggggcggggcggggcggagatctgctgattgctctctttcttatcttctcgcctcccctcccctcccgttctcccaattccaacctgctgctcgcggtcgcggtggccattgcctcgctcgcgtctccttggccgccggcggatccggccgcatcctgctgctgttccccattcgtcggtcgttgccagtccatggattcttaaccaattcttccccaagcttcttccttgcctgggagcagctagctgcatcctgttaaataatagctctagcgtgggggggagggaggccgcg

SEQ ID NO: 8836 - DNA, 1500 bp, Zea mays
tacactaaggttttggaaatattttagagagaggagagagaaaggaagggggcagttgcagtggttaacaaccctctgccagagcgcaagaaggcacatcagtggcaggtaacaaacaccacttagcagcaggctttgcgtccgtcttgcccttttgtttccgcctcctgcccttaaaatctctaccgtcgcggtcaaatttgcgatccatacttggggagggccaagaaaccgagctctctttccaatgcccaccaacgtcaggtaattctgcaaaaaaagaaaggaaagtagaaaaacattatctagcagctattgagagttcttggattacttcatggtgttcgtctccgattgcaggtgaaatcggtggctggcctctttgaagttgaagggtttatgtgattccgcggtgggggtaattttcaggtagttattgtctcgaacatcttggcacctgttcctttcaagatctttacaccacctcattacacgacagagtagtcaaaggtcgttgctttcgtctccccctgctctcggatagcttcagcgctgccttagttatttcttgcagatcctactcctgccatcgacgcattcaaatagcctcacgctctcaccagttcagcttgccctcttgtccccttcttgcttctgtgagttttggtgatgcgaaagtatttctccaaactttcatttcacatttgctgttatttccaagattatgaagaaattataaagtgatcgacagccttctttggaggccgcttcatgctttccgtgcgctcctgaagatgctagtcccgtgattttactcgcccaagtagggccccttagttcaaaattcccggcagcgttactaggagctcttttagcttcttaggggcagctgcctagccatatcctaaaggagacaacacttcttggttagttccaaacctgtttgcgtgttcttcatctggtgaaacatgacccttgcctgattcttgaagaaatggttggcttttcctgttcccaattagctttggtgtttttactcttttccatctcattcgctttgctccaaaagactcagttcatgactgatgtttgcttaataatggggttatttctactgtctctcctcctattttatgcactgggtttaaagtttcactttctagactgtgtgcttctatggcctgttgcagattttgtttgttcccaaaggctataggtgaagcatgtcttctccagctgtaatgcagttccagcaggcctttgcctggacggtggatggttctttttgcccgtctttttatctgtagtttgggatagtgtgcttattcttgaagggacttgttgcttttcaactttgttagggttaccagttgaggtgatactattttgaattggtgtgtccttttggggcaatgtagtggtagtttcattcatagtgtttaccttctatttatcttgaataggtgattgaggaacgttggtgtttctggacaactggag

SEQ ID NO: 8837 - DNA, 494 bp, Zea mays
gattttaggtgcaacccgacacaaacgaacaagatcaatcaacggatcaggtcgaacactaggctctgccctgatcggaggtgcaaaagtttgttgtaaaggtatttttgttctagagtcgcgatggtgacctatgaagaggtaaggtcctataactaacgtgcatttagctgcgctgttgacccacaagcttgaagcctggtccgctggtcgcttcgcttggtataatagtggtggccgccgtccgttggatgtcactgctacgtctccgctctacgtctctctcacaagtcacacagcctttgctttccctgcgcgtacgcttctctgcccacaactgttccggactagcagccttgatatctcggccgggaccgggaggagggcggtggctagaaatggatcctccgccaccactggcgctattcgcctccagctcgtcctcgtcctcgccctcgccgccgacgtcgtcgtcgtccggcgcgagcatcacc

SEQ ID NO: 8838 - DNA, 137 bp, Zea mays; identical to SEQ ID NO: 1627

SEQ ID NO: 8839 - DNA, 123 bp, Zea mays
ggtaagaacggataagaatttgataacagcactagtgtgagcgccttgtgagcagtacacccctgtttttgtcgttggtttttgttttcttcttcttttggtgttttggtgtttgcgctaact

SEQ ID NO: 8840 - DNA, 1500 bp, Zea mays
tctgtgcaccaacatcgacatccaaacaaggtataaaacttatttgatttcgtgcaatgtagaagcatatttggtagtggctgtaatggatagtttagggctagtttgacaactttatttttttcatgagaatcccattttctcaagggaaaataaactaatttctatgagaaaatgaaaatctcttagaaagatgaggttaccaaactagcccttacaaactcaaaacatctctagaattaggggagattgaaaaaagtgaactcattctacactaatttcggaggaaatttgagtagcgtacagccgactaaaacccaaatcttacgtaccaaagagtaattcggacttcgtgaatagctgcgggggttaaaatgactttcgcaaaatttcgcttagccagccagcaaaccaggccgctgaaatataaaggtgttccgctgcacaaactagggacgtatatgggctaagtgggctgtacacgcgggcaaacgagatagagaaaaagcccgtgttgggatggggtgacgtacgacccactccaccaaagcacaagctctcgtcgcttcctttccttatcttctgacttctccattcccaattcccactaccgcggcaggcagctaccccctccctctcgtctcctccgccacctcttctcgcgtctagggtgcgcccgcctcgctggcgtagggtcgggacggttctgccggtgcgagctccacgacccctctgcgggagacgaaacaaaggcgtggtaatctccccgttcccaattccccgtctcaatatgtgaagggtgtctgtcggcgcgtcgtggttggggattaggagttgctggatggaattggtcccgccggctcatctcttggctgccctgcatggcgcatctgcgggtgctttcctagtgggtagcgcggatggctctggcggggtcgcttttgttgtgcgtcgcctaggctaaatgttgcccacttgagagttgagattctgctgatacgatttagagggcgtcttgttgtctcaaccagcaaccatatctcttggctctgtttcgttgaacggtggctggcgcctggctgggtgggtggggttgggtgttaattcgatgtgggattctaaagcgtgtgcgcctgggtcggcacagaaaggatgcataatcgattcgaggaaatataatatattcgagacctgcaatcgtttcagtatggtagttgctattgtatttgatagttccgtgaatccttgccaccttcagatttagttgcaaactcttttcttccatctgaattgccaccttcagatttagttgcaaactcttttcttccatttgacttgccaccttcagatttagttgcaagctcttttcttccattttaatwagtttggtttgccgcatctgcatagcattttgtgatatttacagttttacttagttccttctgcaaattttcagggcttggtagatacaggtctgggattgccttttcctagttcaac

SEQ ID NO: 8841 - DNA, 1404 bp, Zea mays
caggaaggacctgttgatcacgcacggggtgcactgactcgcgcgggtacgagatcgggaacttgggagacgcagagcaaaacttgtggctgcggataaaagaacggaagctaaggctatcttctaaatttctcaccatatattctatttttttataaaagaacggaagcaatcagtatttcaatatcttcgtcaaccattccctctatcttaacctcaccgccaccataaaatatcgtttttttctttcaaccaccataattacctcccattccccgttttttatttatttgttcatgattaaatcatgtaacatacatcaaagtaaggtggctaaattttttatacaatattactgatgcataatattgacttcactccgaatgttataatgtacgtacgattttttttctcagaattaataattgttatcatgttactaccagatcagagacaagctactaatacatgtctgagaagtaacaatattctcgccttaacaaatgactacacaagatatttaacccacggcgacgtctatctaattaaaaaaggagaaaaaaaataagaaagggacattgataagcatcagagacaagctactcaaactctccacgaaggaaatttcattggcatataatgcatgctatctgatgcttctgaatgtataaaatagattatcaattataaattccataaaagaaaaatagcctggtagggtgagagtacctgttgggcgagctcctctcctctccatccatcaggagctccatcaagccgacagaagtggagcagctggaacacggtgcctcccatgggagggggagggtacttctgagtcttgcctccgccgcggcgccggcgaccaatgtagagctctaggtgcaaatccatggcagcacttaggatacggtgtcttgctacgaggtaggtaggtggccgccgcatgaacagagacagtagctgtcgggcgagtagtgggccgaagtccgcatcagagaggaggtcctgcaggtcgagaatccgatttctcttctccatggccggcggcggccgctaccacgaacctccagctccaggtcatcatccgcggatccgccccgcctacgactgttgagagggatttgcgccgacccaaagatccccagtcgagcgggagtttgtgggccgtctgttgtcctacatgtcagacgctggctaacctatcaggctatcaccggtggtcgttactccatttaacagaccgggcccacccactccacttgcacttgcagcagccagccaagcagtgccgcaggtacaccaatcgcttcgtccccgcgtctcgccgcgtaggcgccacagaaactcgcacgccgctccccgccgtccggcccgagtcgccgtcgccgccgaatccaatcc

SEQ ID NO: 8842 - DNA, 482 bp, Zea mays
atttctcattttttgttgtattcttgtggcccatatagcggcaawaacggtaataaagtcagtgtaacaagtgaaaaaggattatctgactgagctcatcgtgtcggcgtggtgttgttgttgcgttgccccgacccagacccccgagcagtttctcacccacaccacaccacaccacacacgtccacaccgcgcgcgcgttatccattatccgtctcgtcgtcgcccgtatctatccgatccgcctgctccgtcactgacagacatcctgctctagctagctttggtccccaaatgccgcaaggataggacatgacacagcaagctggaagatcaccagtcgcaacagtattagttaacaacgagggaaaggagaaactgatgtgattagcaagcacgggcacggtaaagcagagagcctcttgctgttagtgaactaaggcgacggagaccgcgagggcggcgaactaggctgggcagcg

SEQ ID NO: 8843 - DNA, 438 bp, Zea mays
tggcgcgcggtgtgcttctgggctcaaggagagctggcaacccggatgcgaggatggtcttggcggcggagagggtgcgatggaggtgcagggtttattagggttttagcatggcgggcgcggggttttggtgtggtgcattaggaggctgacaggtgggcccaggatggtggccgttggatcggtggttctgccgggtagaggatcagtggacggtgatgtggacgcccagagtccttgccgttgatgtgtgtcctcaaagatcgcgtaatcgaccgaagcaagtgaggctgttctcttcacgtgtctatgacatctggtcctactcgtcaaagtcgatctatctcacatcgcatgtactccatgtagccaccaagtccagccctttttccccaaaatcgactttccatcccgacgaaaccctagaaatcctccggc

SEQ ID NO: 8844 - DNA, 1168 bp, Zea mays
ccgatataatcactctacatatattcatacctatatatgtcgtgtcgacaatatagtgcacatgcatgggagtggaggaggaaggtaggaaagaacgaaacccttttgttttagaggtgtcaatgggacccgatacccgttaatctatatagaattcattttattagggttagggttagggtatatatagaaagattttaataaagatttgggtgaaattcttccccacaatggatgggtatgtgagtatgggaatggaaaattcatcagtaaaattaggtgtgcaacccaaaagtcaataagcccaacatctaactctgcctcttccaataacccctttaagcacctatctaaactttgtttttgcttgttctgaatggctaaacaatgttttttcttattaaatgtcagatttattcgtgatatattattgttggttgtattatggttgttaatgtcatataaaatataacttgatcatgtatttcttgttgaggatgtggatttattgggacctgatacccgaatgaggataggtatggacaattcttatatccatgatgagtatatatatggggatggatataacttcatatagatgggtacggggtgtcccaagaattacccgttgatacctctaccttggcatgtcctctccctttctctctcttaattctaccgctatcactgctcgtaccagcaaggatgcatgcatgcagccacctttcctctttctgtctctgtcaggagtgggtggcaaaaccaaccctgccgctcgcagctctgggctagctgctgcagtgcatgcactggctgacgaccgctggaaatgaaatgatggcaatatgattcatagatggatccatggacaagcccgatccgtctgctgccaaaatgcctattgggtagcaaaaaatacccccccccccccccaacccccaccatgacgtactatatataagcgcgcgcctttcctcccctgccagtctgccaccagcaattcccttctcattcctcatcatcgtcttcctcctctggccttcccatcttcttcctctcgtcctcgatcgatcatcctgctaactagctagaggtctggcactagctgctaactagaaaaaaggaagaaagcaagcaagctaagaaggaattgaagatcgtatcatca

SEQ ID NO: 8845 - DNA, 1500 bp, Zea mays
ccacccccctcacaaaaagaagcaccatacgtacatgcttaattaatctaaaaaaagtcgtatccaataattgaccgtataatattcgttgaatcggtgacttcgcacgtaaacttcgatctcgatctaactttagtgtaggaatagtattttaaaatttaaaaaaagtattcggatgactcccatcgtgtcacgtcaggccacatagcacgcacaaagccggcaggattggtgctcatgcgggactaggacggcgacggggacgccggcctcccccagcacctgcccgcaccgaaggccgaagccgctggattcgccaaagcaataaaaacctttggcggcctctccatcgcaacatttttctcatcctcctcctcccccccgcgccgcgcgaactccgcttccaggtttccggcgtcgcctggccgccttccttaccggcgcgcagctttggatccgtaccgtcgtccctccttccgtcggccgccttttattgcacagcacacccacgttgatgcgcgttcctcccactttcgtggctgccttgcttgcctggtgcctgctcgttcgcggctggcgtcgtccgctcctcacgatcgggtaagcggcggcgacgcctctcgctcgtctatgttgatgattgtgaggaagggtcgtctttgttgaatgttgatgattgtgaggagggggcgaaggccaattcctgtttggatttgggcaccggttggttggttacgttttgcgtcgcgtcgtcagggacgacggggtgtgtgtgtgtaactgtgtatagtgggatttgaattccggctccgcgtcatgcttcccgcagattcgcgtttctcgcgtgcccgtaccgccctgccgcgccgctcgcccgcccgcccttttctttttcttgacctttctctatttccacattatgctatggtgatgcttcccgcacgtctctgtttttttccacgccgaagtccggatccggcacggttcgtcgcgcttcgatccgaaactcctctgttcgtagacgtagcttgtggcttttgaccgtttttcttttctggcgacttcaatttcaaataagaattcatctacgtttctttctttctcgttgaccaagcgtattgatctctgacgtctgctgcctctgctttcgaattggtttgtttcattcatcgaatctgcagagctatcgagcggggcagaaggttcggttcggggtccttcttcaacaaggaaagggagcagcactaccaaatgtggcgcttgtttaatgacctgtgggatgtgctaggatccggattcctctcgtccagatttctctgatccagctgtatcgggaatacgggaccatctcgttggtggcagcgaagcagacatccaccaagaccaaggcaccaatccgcctcctgcgcgcgctccatcgctcttatcgttgacgacacgagcggctgccaattcctgggctcgccattggttggtggcctcgggatctgagagaggaag

SEQ ID NO: 8846 - DNA, 189 bp, Zea mays
taacacttgtttggtcgaggcccaccagctgtcttcgccttcagccttccagctaggtctttctaaggtccactgacaaaaccctggctcgttccccgctctacgggcctaaacctcacctcgccggcggccaaaaatcgaagcaccgaaccagcggctgcggcggcggcggtgcggcaagtgttgacc

SEQ ID NO: 8847 - DNA, 913 bp, Zea mays
ccacgtatatgctgcaagtggacttgcatttctgcctttggttcccatatccatgctgattctgtactgaggcttgatagatatgtcttgcaatataatcatcttttctgaattctttattgtatcctgatggtatatcatttgcaatttgcagtagaatattatttcgtttttgctttctttgtgaaaatctgccaccaagtggttttctgtgggtctgtgggcaagtaatgtttccatcaaagattttttgcagtttaatcgaacagaaactgctagtggtgattcaaaagaaaaaagttcatgactagaaaataagttgactaatgcttattccttgcaagtttgttttgagtttgtcacatagggagttgcatggatttgttggcagaaggaagtgcgcattaatactccatacaccatgcagcagagagttgttcattggctgcagaacagagaaaaaggagaagacaacattatatatttggttatttctccaccgtcagagatgcggcctagtaacctgtgtgccaaatgcattttcatgaaatggcaaagtgccattgccaccctcaatatgtatatctgtgtgcaactctctgcgtgcacgattcttcacttagagggggaaaataatcttatatcctttcgtgccataagattttcagaatccgattatcctctacgacagcacaaggtgtgacaaaccgcactgccatgcaatgcagattcaaggaatctttcaacatatattcctctctccaggctttcattataaatagaggccaactgggttttgcacttcatacaaccccataccttcagagcttacaaggagtagcagagctcagaagagcattcgtattcagcacatagtgcgccttcttgaaagaactgtacaggagatcacaca

SEQ ID NO: 8848 - DNA, 240 bp, Zea mays
ggtgagtgaaaactaggtccagacatattctccactcctttcctctcttactacctacgcagctaaycacatttatcactcactgcagaagcaagtacaggctgggcagtttatattcactcaaaccagcccgttcctcccccacacggccacacacacttcacttcataggcgccccagcagagctcatctctgcctcctgtgtccttctccatgacagagaatctccactccaggaaa

SEQ ID NO: 8849 - DNA, 1500 bp, Zea mays
cgtacatgtcctagattcaatagtttgaatcagttttactgaattttccatacaacttgctggtctgaaagtatgtgttcattatggtgccttcagaactgaaacttgtgtatttaaaaactgaagctcactcataatgtttaccaatttgtaatacattgttcagtttgtgctcatagtacctgacatttgatatgaatactgcacgatacttcattttcaaatttcagtaaccagcattaatcttggtacctgtttgtcttacacgagcatgcaggaagcagtgtgtgcgcgcggactgaaatcttaatgagcattcgagaatactattgtaccatgctttcacattgtacatatcttgttttgtgaactcgtgagttgggggtttcatcctgtttgttcaaattaagtcagtgcgacagctctgtcttaattagttcagtgtgtgtaactgttatcagatggacctacagatgctggtttaaattactggaaggtaattattagtgatctgctgccaagagatatgattctggggaaaatattttttagtgaagccccagtgcaaagtttttgggaataaatttatgggagactttggagttgctctaagaccgtctggtcgtagggttaaaaagtatagcgggaatcataaaaatttatratacggaatagatatagtatgaaaatatatttaataaagaatttaatggtatacatttgatctcgtaaatattattacttattttataaatttgattaaatttgaatttttttgactctataaaaatcttggaatgacttagattttagaacgaagggagtatatgttagttaatataaggttaatgtatagagtaaatataactgcagtagattgttgtatagagtaaagaatattgttgaggatagaatatttttttgaagtagtatgactgtatgagttggagaaaaaattgctattctaaaacaaacaccaatttcgtctctttctcctttcagtcctcggcgaactcgactcaaaccctaagcccctctccttgccatcccgacccatggatcgcgagcgctcctcacggcgccctcgcgacgacgatgtgcaccaccggtctcgcgaacgggacgacgaccgacaccgccgccgcagtcgccacgacaccgacggtcaccacaggtatgagggcggagacgaggatcgccgccgccgccaccgccaccgcgacaaggacggtagcggaggcggcgaggatgaccgccgtcaccgcaaccatcatgacaatgacgacagccgtagccacagctaccgcgacggcggtgacgacgatcgccgccgcgggaaacggcggtccgtttccccgtccgagtccccgccaccttcggtgaagcgggatcgctcgtctagccgcccgcgggagtccgttgagcgtcgcgactccaccgaccgcgagccgcggtcgtcgtcgcggaagcggaaggaccacgagggcggtggcgacgggg

SEQ ID NO: 8850 - DNA, 313 bp, Zea mays
cgcggtagcagccagaaaggaccgaggacgcaccctgcctgttttgctctgctctcgacgcttcactctgcccctccctcctcccttcgtcttccaccattcactatagcggagcgcagggtgagctcctcgtctctctggctgctcttgacgcggtggtctagggcccgctgcgaaggcgattgctgcgctcgtttgcaagtgggggtttttcggttcatctggttctaactttgctttgttggggttttgttggtgaagctggtggacgccgaaggtgaattcggtggcgccggtgccgaacccgatattc

SEQ ID NO: 8851 - DNA, 70 bp, Zea mays
cctgaacaattaaccacacacacttctgtcaataactaaacatgtcatttccatcaaatacttgtcattc

SEQ ID NO: 8852 - DNA, 1500 bp, Zea mays
taatcgttcagttctactccttaattctcccgtgaagtgattttattagattcctaaggctaatatcatctccaagagtcttttttattttcgctttctaaataataatttagagagtaatttacataaaaaccattttctatatctttttaatctccaacaacctttctatatcttatttgtactatagagagccactcatgttttctgtatttggatagcgagaaaatcgaaatagaagatggctatatttagataaccatttagataagttgttagaagatattttttacaaaaatctctattcatataaattaggaagaatatagagagcctcttggagttgctcttataagtctattcaactttcttaaaaaaccaaatttgattaaatttatataataaaataataatatttatgataccaaattaaattatttatttagtatatttacatagtatatatatttgatgttataaatctttataattctctatataactttgatcaattttaaaatactttgattctctgcaatgccttataacagacaaagtactacgtaaatctaacaatataaggttgtctccggcggctatcctatcacttgccttattttttttttaattttactctgcaaacagtgcaatctaccgtgcaaatatatacaatgcaaatctcctattttacacgatattttacacgataagtagctaaccacagcctctaacaagaacctgtcaaatatgtccaagcagataatggaagagacacttgcctgcataacctgatgtttatgaatgcatgtagttatcgtaggacaatatgaaagcgccaagataagcatttggtcgacttgtgtttatgaatgcatatagttatcgtaggacaatatgaaagcgccaagataagcatttggtcgccttgagttttcatttgtggtattatatttcatttgaaaataattacattactgcaaaattgttttcgcgattctaaatttattctttgagtcagcgggcccgaatttccttttaaaaagctgggcccgtaattagctgactgcttcaggccacggtgaattggccccgcagatctccagggttttagcagagcccagtaaaatcggcggaggcatccaatccggcttgcgagtttgcgacttctttctattctctctatcgccgctgcctctctctccctccttccttttcctggtcgcgacagcgccgcgctaatcgatcccttttgcccacgccgccgttgcctccaactccaaccaggttggtttggtagccgccacctccttccggatccgttcaccacaatctttttgtatgtatttttgtctagatagattgttccagtccccgtccgcttgcaattgaacgtctgtatgtttgttttttttacctcctgttgttgtcgtttgatccgttccgtttcctcttgatgtcggactagggtttcgctccttccgcagccgtcgggtgtgatcc

SEQ ID NO: 8853 - DNA, 1500 bp, Zea mays
acgtaggacagatcgtctggtgtttcattccctcctttggctagctgttaggaaacttaccggttaacccctaagcatgtgggggctgggaaatgggggtagaaaggaaaagctaagctcggaaaagcgcagcttgcctcctcaacacccttgtcaacaaaagctacttagagcatgatgctgaagcttttctaactgctttgacagrataaggtgaaattgaactggaatcagaaatccatggtgaatcttttctccttccattccagtcgaagtcttctctcatgggcattcttgtaccgggctatcttcccaaaaaaatgtgcctgccgcctgccgggctagtaagagaattatagtagtagtagtagttaataatggagccaattacttgcactacttcaatgtccatgcctaggcatcggcatccttggccgtttgctagctgcgtcttgcaaagcgatgtgtttttactacgcgcgtgcagcttatgctatgcatgcccacataatcggtttcagatcaggcaaatcccggtaggacggacgctcggacaggcaacctgtagattattgcagggtatgtgtgtgtgtgtgtgggagaaagagaggaactggatgagcgagcaaagctgtactaaagctgagaatatatatgaccgcagtgcttgtactaaagctgtactttgtgggactagtaggcgtctgcaatcagttgcaattctgtatgtttttttcttcttctgataataagagcttcagctacgattaccatatgaatgcgtctgcatgattctgaggggtgttcactgtttctcgcactcgcagtctggcatcatcgactcattcgtatgcctctgacagaaggcgctcaataagaagaacatggagtcagctaggcatgcgtcgataggaagagtaaaaccagctaaatatgatgagagtggcagtgaggttgcaaggccatcaaactgatgttactgcgcgtcagggcaaatccccacaccatcccgtttgcgctcagagattacctgcaaagagacaagcaatagccgtcagggcaaatccccacaccatcgcatttgcgaacgcgtacgacgaacccaagaacggcagaactactacacaaagcaaaaggagacaaggagctatagagagaagttggagagagagatatcgagagaggaagaagaagcaagcgaggagaatggtgagagagcccgcaagacggcaagagccaaaaggcttggccccgccggggcccgtgattctttctttgcctttaactttcactttcctctccctcctcgctcttttcacccttttaccctgtccgatacgcctctctacttaaaaccgagacctggcgcaccggcagctccctcctcacgcaccagcacgagcgcaatggcgcaactgtactagctagccgcacagtgacatcagaggtgtgtgggtgtgggggggcggggtggggtggggagtgacgcccggggtggcg

SEQ ID NO: 8854 - DNA, 1500 bp, Zea mays
catcccgtgagtgacgatgacgcagcatcgtcgtcggacgacgcggtgcatacgtccagcattgcgtgtactcgatcgcgttgtatctgactagctagcagtgcgttcatgcatgcatttttaggacttgtgacggcatctgatgattgggtatatataaaaagatgcgatttctttttatatttgcgctgtgctgtgtttcctgtttcgagcttagacctcgacgtgtggagcgagcaatcaaccagcgctgggctcggacttcatcagagcctctcgatttggtccctgtctcctatcgtcacaggacaacggacctacaattccgaatccgaacctagtcggtctctgttccagcatccaaacttccaaacgccaatcaccgttgcgaaaagcttcgatgcagttcgctgcagctagctagttttcatgcgcgtgcagggcatgatgggcgcatgcatggcggacggaggcgggaggcgcggagcctcagcggctcaccgcccggagagatcggttcgagatggatgggtgattggactggagggacgaggagtggtggctggctggctgcactgcgtgggggtgggggcccggcggcgtcgtccggttgcggcagttgggttgggtttgggtcctacggccgaggtgcggacaagtaggacgcttccgcccgtgaccgttgccacatgtgacccgggaggggagagcgcacacatgcatgccgttttcagtgaaacggcgcctaaacgctcaaaataaactggagttatggctctgtcatgccatattgatgcagcagccggagtatgtatttgcctcggtcagtaagaatcgtgcacagcagtattaattggaacatggaacgtctccacatgccaatggacgccgagtcgaggcagcgtgccagttttttttttttttgacaaagtggataccagtaattgtactctttcgccccaataaatgatactggcagttgcaattcgattcgattacctccaaaatcagtaccagaaagattctcgattgtccgtaaatcaatccatatcgcctaatctttaactactatttaagaaaagatcgatgctataataacaggggggaattaccataaaaacatgcccggctaatccctcgcccggcagattctcgtgtaataaaagagcctgcccgacaaaggaaataaaacggctgaaataacactatggtggtgaagaaaaggggatcactgcaacttcactgcgcagatgtctcccttgcgcgcacgtgagttggggccacaaatcccaatcactttccatctcgttttcgcctaaaatcctgacaaacagtagcgtggccggctctggagtttgctatttaaacccgtttcctctcttccccctcctcacaatcacaggcctcccggcctcccgtgcgctattctctatcagcttacccagcacacagtacacactctaatctccacacgacccaatagatatacggggctgaagg

SEQ ID NO: 8855 - DNA, 1207 bp, Zea mays
tgcaggggtctctaagcccgcaacggctgattccaaatggctccctacgcgctgcagcgcaaggggaggccgtgtccgtcccccagatcaaggggagcagtgtagcgcccccttgcgtagtgcttccctatttaatagttgaaaaaatagtaataaaagatgaatatggttagataatgatattttatagttatagtggggtataagaggataatataggggaaccactgcgggagataaaaagataggaggtgaaatgttaatgatatgacaaaaaatgatatagaagaaaaaatttagagaaacccgcttggtagtctaagaggggcgrcgaaggaagcaacgagaggcggacgggatcacgggatggcagcgagccggcgacgtagggtgtgtttggtttaaggaatcactacatctaaattgaggtggtgcatcatgggttcattcctcaaatttggtgggatgacctcattcctcattttagtactaactaactaactatgaggaatgaggtgatgatggattaactcattctattccataaaccaaacaaaaatagtgaagagtgagaagatgatggactagctcattcctcaaaccaaacaccctagtagggatccggtcgcaacggagggagcaagtggcggcaaaggcgaacagagcggatgtgatagagcagagaaagacggggaagagagagaacatgggtggcccacccatcagtgctgacatgtgggccctacatcgccacgtcagcaaaaaaacatccagaaaacccactcgaggggtcattttgcccagttctggatagttggagccttggaggtgcaaagtatccagttttgcagttctactaggttgtaaattaggcaactgtggcaaatacaaagtttttttttgtttccagatatgctaggtcgccagatatcattttggcattcatattacgccataaagttgttggcacataatgtacctattgcgtcttaattcgacgaaacggtggtggtattaactaagaaaaaatatttcattaacaaacacatcgttaacctactctgttaccttctttgcagaggcccaaaagcaaacacaatgccagctgcctacaaatacgccgcctccattcatgtgtgcacggcactagcagcgacacaataattaatcagggctcatcatctcgcaatctctatctaggtcaacc

SEQ ID NO: 8856 - DNA, 1500 bp, Zea mays
gtataagatcgttcttcactctcatttataacctttgtgcataaaatagaatagctcacagactctttaaaaaaactaatctttccttattttttgtgcagaaaaaatgctttacgtgtctgcgacgaacatcatcacttttgaagagcaaatgcttttatgtacataaacaagctgatgaaactactttatcttagtatctgctttgcatacctatgacgaccatgtcactgttgaagcgcaagtgcttttgtgcacataaagcaaagctgatgaaaccttattagtttagcctaagctctgtgcaacctacaactctcagaacacggtaccgaaacaagatgtaatatgcatggtcatatcagtcagatgtaagctgagtgtaaccactatacttatgaactcagtacaacttatgtaatcactgctacccgtttaaatttgctcttaatcttatgttatcatgtgctacaaaacagctgctataaatgtacacatgatatatcaatatattacactactaaaactaaatatataaaaaatttcacatagctgctcccgcgcgcatgggcgcgcctgatacactagtgtggatcatcgatcgtcgtattctgcccacttgccatcgccttctacaggtaggggcatatcctgtgtatatatatctttagtgtacatctacacatattaaatctgtaccatttaccggatcaacgcttgatattttataaaaaacccttcaacacttactcatccgcgcggctgcaaatttgaaaaaaaaatggcaccttagtcgttgatccttaaacaaagagtttagattaagtatgtacatatgcatggcaccacatatatcatgtgcatttgtgttggatcttttatgggcttggcccatttattcaataaactctatgttgtgtaatggtggagaacactaatagtatcatattggaagtctaagggtcgttggcttgacttatatggtgagaattattccacttaatttgagaagtcaagaaacgtacaagggcgtgccacatgcgcgtgcgcgcgccgccgccgcgtggcgtgcgtgtggtgtggttgtgttaatttttagcactcattaaacgcgggagtttcaactcttgcccgtctcttggcgtgccgcatgcgagactcttatccttcagctgtccgtctcttggcgtgccgcatgcgacccttctccttcagcttccttccgcgaaatatacttaaattttttatatgattcatatgctttatgttctcatgatccatattgttatggatatatttgatatcatggtttctatgattaatcatcttttatatgtcatcaccataatgttaatttatggaattaaaatgatatggaaaatgcctataattctaacaatccaaaaacctaatgttaggcatttttctgtcacaggttttgctgttgtgctaaagcctgatccttttgatggtaaaaacttcttgatttggaaagctaaa

SEQ ID NO: 8857 - DNA, 74 bp, Zea mays
ttttccatatcattttaattccataaattaacattatggtgatgacatataaaagatgattaatcatagaaacc

SEQ ID NO: 8858 - DNA, 1214 bp, Zea mays
tgtctaagtgttagaaacagagaaaagaagaaaagagaaggatcgcaaaagacttgacttggtgcagccgaagtccagctcggcctggcacaccggacagtgtccggtgcgccaagctggttcgcgtggaaaaggctgctctcgggactcgacggcggcgtacgactataattcaccggactgtccggtggtgcatcggactgtccggtgagtcgtccgcggcgaactcaccgtcctcgggaaaagaaaaaaaggcgacgtggctataattcaccggactgtccggactgtccggtgagccaacggtcgtctgcgccaacggtcggccgcgcaatccgcgggcgacgcgtggcagctccaacggtcggcagtgggcaccggactgtccggtgcgccaactgacccggagctacagcggtcgtctgtgccagaaaaggaaggagatcggcaccggacaggctacagtagctgtccggtggtgcaccggactgtccggtgcaacacccgacagaaggcaagtttggccttccttgattgatctccaacggctcctagctgccttggggctataaaagggacccccaggcgcatggaggagccaaccaagcattcactaagcattctaaggcatccagactctgctcccgcgcattcgctttgttgtgttagagatttgagctccattcgagtcgagaactccctgtgtgtcacttgagctcaagtcttcacttgtgtgcattggtgtgctgcgtttttgagtcttggttgcgttgctcttcccaaccttactcttgtgcgttctttgtgatcaatcttgtaagggcgagaggctccaacttatggagattcctcgcaaacgggaaaaggatataaggaagaaaagtcgtggtattcaagttgatcattggatcacttgaaaggggttgagtgcaaccctcgtccattgggacaccacaacttggaagtaggcaagtgttacttggccgaaccacgggataaaatcgcgtgtctcttgtgattgctctctctttgattgtctgtgttcgcaagagcttgtctcattgacttgattaacccgcactaatatttttataatcaaggttgttggaatttagtgttgaattttacaggatcacctattcaccccccctctaggtgctctcaattggtatgagagccattctcttcacgtaagggactaatcacccgaagag

SEQ ID NO: 8859 - DNA, 107 bp, Zea mays
tgctcaccaccatctccactattgctagtagatagtaagtagatcacgcagcgcagtagctctggatwaattaataataawtgctcgtgcgtgtgtccagagccgcc

SEQ ID NO: 8860 - DNA, 1142 bp, Zea mays
agtgaaaaatagatgtgattcttcaaacagtgatatatgtacacagtgactgtgttttttgggcgtcctcaaactcagattcttctatttcttgcaagttgtatgtgggtctgttagtcgaactgtgatatacacacattagctaatagatcaactttttattctcttagcttctatggcctatgggttaacacctgtactttatttgtgtgttctcagatttccatgtgtaatttgtttttgtttattaactaattccgttcttagataaataggcatatatttcatctgcttagtatttgattactctttgcaaaatggttatcatctcactaagtgtattgtttagctgacaaagcattgtggccatgccttgatgcataatagtaatactaatctactgtagtgggtgactgattgatcatgtgtacatatttgttcctcacagtgattaatttgccctacattaatacatttttatagttttctattttatgtgcaattcattcaatacgttaagcacatatatttgtagtttagtatgcctttgtactttgtatcagttcattttcgaaacaattacacatgtaaaacttgcgttcttctaatttacaaattacatagttatgaaacttgatgcagctaatacgttgatgacttcaatcccattctatctgwgaaataaactgctctttggtattgacccataatgtgcttactttgtctactactattaattattggcagaaattttatacttagattatagatgtgcatagtattcccctataaatctactgatgttaactgcaggttgcaggcaattgagaggagaaggcatatgcagaatgttgcgtctcagcaacagatcctatggacaaaatatccttcccaatttgtggatccaacagctccaatacaaaacagagcttgatgtgccaacaactgaggaaggtcaggctgtcggaaaccttgcaacttgtttggaggatggcaagctaaatacatcttccaagagttaatgaaataagagttaaaaatactttgatattcatgagatggcaaaccaagccaactaggtaagacatcagcaacaagtacttgatttacctcctagagctgaattgattggcaacaaacaa

SEQ ID NO: 8861 - DNA, 161 bp, Zea mays
ggttgggtccttgctgacgtcctcttgcttccgtaagggggctgagagccgccgtcgtcacagagcatgcggggcgccatcattgcctatctggcggagctagccagatgggacgccggtcttgttccctgcggcccgagtcagctcggggtagggcgatg

SEQ ID NO: 8862 - DNA, 72 bp, Zea mays
tgtgcagagagacactataggtacgaccccctagggagcatccgcttccacgtggtgaggcgaagagggagg

SEQ ID NO: 8863 - DNA, 712 bp, Zea mays
ttatactgtcggttgaccgcccttagttatcttatcatttttttatctctcttttgaattggataaaatttgttaatcttttttgttgttcagttaaactcagtagctataggtttgctctctggacgccagagcgatacacggagcttgctgttggaccgtctttaatctcgcgtttatatgcgattcgagcgacgcgcgatgaagatcgaaagaaactggtgctagagataatccatgtccttacctatggtatggaaccttttattttatggtgcaagcacacgattattttatctaatttgattataaatttagttgtatatgtgaccaagaccaaccgtatttgtattagtgtcttgttcgtattcaaaagaaaatatgtaatataaaaaacaatgtatcgatccgattactccccctagcagctacagctagttccattctgttcatttccaccacggcacggatactgcccccgccgcctcattgggactcctcattgagcattgaataagaacagttgccgctacagcgctgcttcaggtcgatttgaggaggaagatggagatcctcgaatcgaccctgttgggcgagttcatcggcttcatcaaggggaactggtcagcgcactcgcgggttgaccagcgccggcgccgcctgcgccagctggtctcgaaggtgcgcatggtggtggacgccgccgagggca

SEQ ID NO: 8864 - DNA, 372 bp, Zea mays
tcgagtgcaaccttcatccgttgggacgccacaacatggagtaggcaaccatactacgcttgactgaaccctgggataaaaattgtcgtgtctcttgtgccatatacattattgtaatttttatctcttcttcgcttcaattcttcacttgcaatattgctctaagtctaaattaaatcttgatagagcaatcaagtgaaaggaacttctctctactctcaaacttggttttaattctctctaactcacattttataccaagtgtgtgtggtttgagttaagttttgcaggatcacctatttacctacctctaggtgctctcaattagtattgaagccattctcttcatcaagggaataactgcctggataa

SEQ ID NO: 8865 - DNA, 217 bp, Zea mays
ggtgagctcgcgccgtggaccgggcccacgcgcgctgccgtttcatcaccacttgccacgtttctggccgtgggatttatggcagtaacggggcaaactcgtaactctctcccgcgggtctcggcctcctctcctcggctcgctataagcaggctccaccgcttccgcaatggccacctaattcgctcggcgtcgggggagaagagaagcgcgcgcg

SEQ ID NO: 8866 - DNA, 193 bp, Zea mays
ctgcaggtgccagccgagccgcctaccgggtacagccgcacaggcaggcggcggcatgcgctccagcctccagcagtgagggagggaggccctctgcccgcgcgtgctgtcccgctcccgccccttctacttctacccctccccccccgcgggccgagagggagtccgcccgccggcgccgcgcgactcaccg

SEQ ID NO: 8867 - DNA, 875 bp, Zea mays
ctacctaatatatcaggacggtcttattaataattctaatgagttatcttggaattttgaatcgaatcaaaaaatctatattatgctcactcaaggaaagtagatgtagataggggcttataccctcagaaaaaaaatacaccagcttcttaaattaaaacgtaaaaaaagatttttttgttatgtcgggaaataattttccagaataaccaatgtccgttaggcacctaatccttatgtcataatagatccgaacacttgcctcggattgacttcaatatataattgctccagtgtataactaaaaaaaaaaaatagaaggtcggtagatagtaaagaaaaggactaatcataatatctatctttaaaagattcaataaaaagacagttggcgggtctctttgtatatcttgtccggaaagaggaggacttgatgattattgcctacttgcctctgcgtggagcctggtaggagaacgcgacgagtcaaccctaaaaggctaaactcttgagaaacgttgttgagcttggccgcttgggcctttgcttggtacccgttaaactattcggcgttcggttaaccgaactgagaacccggtttttagtattttattcggttctatgtaacctatgcccagaataaaaaccgaaccctgaaatatctgtttgttctgttcggatcccgggttcttcgggttcgttttcagtctcgttttttttttggcccggtcctagtgccgagcgctcgctgaaaggcctccgtgcattgcttttgctctcgcagacgtgctcgcacgcggcggcgagcccgatagattgactgaattgagccctacgaccctcaatctcccccgcacgcccgcgccgcggtttct

SEQ ID NO: 8868 - DNA, 211 bp, Zea mays
gcaaatgcaaaggtattcctaatatacaacagcacatgatgtcctcaaaatttacatgcatgtaaggtttccccccttcctgaccacacagaaatagtggggagcgaagattaaatggttttgcaccttgtgagcagctaccctaacaaacatctctaagatggctaagcttgtctcaaagatgacaattcacccagtgaaatagaagcaa

SEQ ID NO: 8869 - DNA, 1500 bp, Zea mays
agaagcgtctgctaatctcaaatagcagattaacgttcctttctccatgtaaataatcatcctaatagcatggagcatctagaaatgccggaataaatggatctttgaaaatcaagaaccaacagttcagaattgcaaaaatgagttcagaaagaaactacttatggtcattcacagagcaagagaaaaatatgacaactcaatttcagactggcttcatcagagacaaatttagttcttttagtgccttctatgttctatcccttgctcccctctagcatctgattcacttgtacctagctgcagatttcgactctccactctgctgtaattaaccattttaattcaaaatttacagtagggcttccccctcctaaactttcaaaaaaaaagacacgccggtcaattttgcaggcgacccgtccatcctttttgacttggcgttccaattccaacatacacacgggcaatgcttacgtacggtagcaaataaccgcatcataaattaaatttagagaagggaatgcccttattattttaaataaaagaagggaggcaataccaatatagctctggccgctgggctttccagccacaatggtttcaagtgctgccgtcatcgcgttgacgtcccacgaaccacgtcaggatcaggctccttggctggcacgaaacgcgtgcgattaccataccattctagcagacgccctagttgaacaggtggtcccttggatctggtagtgggaatcaacaagcggagacctggagctgacctgatcacagaagcttcctggcgctcccaattcccaatttcgcagcccggttcagcgaggaagcttgcggcgcacagcacactgcggaaaaagcagaaggctacagtttcagaaggaagcttgggtgccaaggaaatacaattaagcaaatgctactctctttttttattattattttcttattccctatgtaatcatactataaacaacacagggaaatgcagccagtgattgcatttctactgaaccctgataactttatagatgcactagtccaagtgcagtgtgtgtgaactccgaataagaatcaacagctggaatggaacgaaccagagcagcggacaaaaaggaaggtgcttaaggcacttcgccaacaaaacaaaacaaaaagaaggcatgttagttagtacaacgcccattttcccttctctgaccaagaccgcactgaagggactattattatagggattcttttctttggaggaatataaataatagtgatgaaataataatctatcccattacttttaggcgaagtcatccatcacctgaccgctcccaactatactcacgcgggcctttaaaaagccacgcatcccagccccgcccgcccccaattctcctcctactctactctccttcggcaaagaaagcaagtcagcctcaccctctcacaccaccgccactcactcagtgctccaccccaagaaccaagcagctcaccccc

SEQ ID NO: 8870 - DNA, 1443 bp, Zea mays
ggaagcagtgctcatcgactttctccgcgcaaacgccgacgtctttgcgtggagtccctcggacatgcccggcataccgagggatgtcgccgagcactcgctggatatttgggccggagcccgacccgtcaggcagcctctgcgccgattcgacgaggaaaagcgcagagtgattggcgaggagatccacaagctaatggcagcagggttcatcaaagaggtattccatcccgaatggctagccaaccctgtgcttgtgaaaaagaaaggcgggaaatggcggatgtgtgtagactacactggtctaaacaaagtatgtccgaaagttccctaccctctgcctcgcatcgatcaaatcgtggattccactgctgggtgcgaaaccctgttgttcctcgatgcctactcagggtatcaccaaatcaggatgaaagagtatgaccagctcgcgacttctttcatcacaccttttggcatgtactgctacattactatgccattcggtttgaggaatgcgagtgcgacataccaaaggtgcatgcaccacgtgttcggagagcacatcggtcgaacggtcgaggcttacgtcgatgacatcgtagtcaagacgaggaaagcctccgacctcctctctgaccttgaaacgacattcaagtgtctcaaggcgaaaggtgtaaaactcaatcccgagaagtgtgtcttcggagtcccccgaggcatgctcctggggttcatcgtctccgagcggggcatcgagaccaacccggagaaaatcgcggccatcaccaacatggggcccatcaaggacttcaaaggagtacagagggtcatgggatgccttgcggctctgagccgtttcatctcgtgcctcggcgagagaggcctacctctgtactgcctcttaaggaagaccgagcgtttcacttggacccccgaggccgaggaagccctcgagaacctaaaagcgctccttacaagcgcgcccatcttggtgccccccccgctgccggagaagccctcttgatctacgtcgccgctaccactcaggtggtcagcgccgcgatcatggtagagagacgagaagaggggcacgcattgcccgtccagaggtcggtctacttcatcagtgaggtattgtccgaaaccaaaatccgctacccgcaaattcagaagctactgtatacggtaattctgacgcggcgaaagttgcgacactacttcgagtctcatccggtgactgtggtgtcatccttccccctgggggagatcatccagtgccgagaggcctcgggtagaattgcaaagtgggcggtggaactcatgggcgagacaatttcattcgctcctcggaaggccataaaatctcaggccttggcggacttcctggctgaataggtcgacacccaattgccaacagctccgatccaacccaaactttggacc

SEQ ID NO: 8871 - DNA, 64 bp, Zea mays
ggaagcagtgctcatcgactttctccgcgcaaacgccgacgtctttgcgtggagtccctcggac

SEQ ID NO: 8872 - DNA, 1500 bp, Zea mays
ggttctcggggcggtgtaaagtcacaaaagttccctttgtgagaaaaatcgccttttgtaattcataaaagcttccgcgccacggttatccgtggaacggaccgtgtaactttcagccgtttacatttgcagtgcagttgcttttggcagtctgtctagtgtctaacaataggtctctgtccagttcgtacgcatatgaaccctgatgactttgcataattgccgttcaatgcttgccccttgtgccccacattcgttggccactctgtcaacgggcgagcggcgatcttcattcttctgagcttcaaatcatgggcatctgctacctctgtcacacttccccttcttttctccacccatgcttggacatgttctcccctggaatcgtcatttatttatatacatcctcagccaactccgtcacattctgcatactccctcaacaatctttaaaagaatagaagtcttgtttttttaacagttaactaattttaagtttgattaaacctatcgtaccgaataaacattattaattttttttatttttttttcgaaagggcggcaagagaattgtcccaatttatttaaagaagaaaaaaaataccacatgcaacagttacaaacagccatgaaggctattgagttgcgtaatgaaacatatttttataacaaccctatttagagacgtcaatggtggtgatatttttaaaattttaatcaaactcgagaaaaaaataatatggtagaaatatagaattgtattcttttgacactactactaaattaatatagagtttatcgataaacaatgtatcggtgcatgtgaagttccagcacaaaaaaacaaagagagccatggcactggcacgcatgagggtgaggtcaccgcaccctcccccgcacctacctccaggccccaacctgaaaccgtgaaacggtttgcggtccagcacgcacaggctcacggcccgcccgccgccacggcaggcggcactggcggcgtacgatcgatgatgacgccctctccctgaaccgccgcgtccctgctggccggccgacgtccgcacgggcgggcgctgtctcacggcctgcctcggcggctcggccctctcctctgccgccacgcccgcctcccccaacttctcccaccggcccctggcccctgcctcttggcccacccggccgccacgccactctgctgatcacacgcgcgcgcgtccctgtcgcgcgcattactccgcccgggctccgcttcactcctttccgttccgttcccgtccccgtcgcacgtcgctgtccgccgcccgggtctccctctcccactaccacttgccgcccgccctgcccgttgcctcctcctccgcctcttatcctctacggccctgtctctcgcacgggccggttcgctggcagttaccttacctgccgctgactcgctccagtggccaggacctgctgcagtggacgtggtgccggcggcgggccacggcggaagcagcc

SEQ ID NO: 8873 - DNA, 478 bp, Zea mays
ctaccgacgaaaatagccgccgaaatatgttagacgaaaataagcaactattttcatcggcaccgacgaaaataacatattttcgtcggtttgtccaaggccgacgaaaatacagcagctatttacgtgggcccctttggccgacgaaaatacaagctattttcgtgggcctcttggccgacgaaaatacagctgctgtattttcgtcggccaagaggcccacgaaaatagcttgtattttcgtcggccaaaggggcccacgtaaatagctgctgtattttcgtcggccttggacaaaccgacgaaaatatgttattttcgtcggtgccgatgaaaatagttgcttattttcgtctaacatattttcggcggctattttcgtcggtatgccgacgaaaataatctattttcgtcggtttaagcttattttcgtgggtttttggcccatgaaaatttaggcgtttcctgtagtgataag

SEQ ID NO: 8874 - DNA, 1500 bp, Zea mays
tttcaggtaaggaaacttgccaatacgtttcctaaatttttaaggatcgcaacgtgaaccctgaggaatcgaaggtcccaacagcaaaagacagagacccaagtcttaaaactgctccatcagagaggaaggacggagaggagcagcagcggagccaaagggtttggcggcttcgtcaagaaccacggattcaggtaacggactgtccctctcctttcatctgcggttactaatcatgctctacttagatctattgctccagttttgcatttctttttgcgattttaccagtttctacgagaggtagcgttcttgcgcaagatttatttatcatcgttttcccgtctgtttctcgattcccagacgcgacattttcgtatctcttgtttttttgtgctctggttaatcaactagaagtaatccaccgtcaagaggttgtctacgatgctgggaattacttgtttgtgccactatgaactctaggtgttataactcggcatcagcaacagagtaatctgggagagaaaaccgaaccctgcatacaaattccagatgtatgggattttattgcttctagccacttgttctatgcatcattgtgtatgtggtctatgaactgaacagcggtaactatcgatatttatttatgttctattaacaaaaagaatttctttgcatatcactatcacaccttctccactctgaccatttctgaacctatgcaagacggtcataatggtggtgtttggtttaaaaatcaactcatcctaaattaggtggtgcatcataagttcattccataaacttggtgaaacaaactcatttctcatattagtactaattattagcctataagaaatgaaatggtgatggattaattcattaaattgcacaaaccaaacaagaaagtgaggagaagatgatgtattacctcattcctcaaaccaaacccctcaaatgtgaatggacttgttctcttgactagaggctagagcgtgcgtcaggttgattttagtggtccattgctgtaattatttatccggtgcttatctgaaaatatattttttttattcttggtcttgccggggcacctgaaattgcttgtgatacatggaattagggacctttcatagacaggagtaggcggcttttrtttttaaaagcccatgtgtagctgaagtggtcaccaaaagcagtgttgctatacgaaatggagcagatacaaaacattggttaatgaagataagtgccttttcaaagcgcaaatagtaatgtatttatactttctatggggtactttcttcaatcaaatatttaatttgttatccttgcttattttgtttctggtttgtctgcaatgcttgtttcaactaaagctgctgttgtttccatataatttttcttgtaaagctcgacaattccactgacagttcttgtttgtataattttaggtcgaatggatcttttaggatgatgtaaaatacaattttgccaaggagc

SEQ ID NO: 8875 - DNA, 173 bp, Zea mays
ctttaaagccaacctgcagcgcggaccggccggccattttttattcttccggaggggttgcccggtatccacaacccaaacaaaacaagttcaacatattgggtgcaatcgaatggctcctgaaggccctgtgctgtgttagttgcatcggttttgccggccggcaggccagc

SEQ ID NO: 8876 - DNA, 105 bp, Zea mays
ggcctagtgctccaaacaaagaacttccctttattcctccttggcaaggccatgccaccgtcgagcccaggaggcggaagtcaacgtaaccaagcgaacccatcc

SEQ ID NO: 8877 - DNA, 217 bp, Zea mays
tgtcagcctggcgcaccggacactgtccggtgcaccaccggacagtccggtgtgccagaccgagctgagtcttgactgtacgcagccaagtctttgcacctttcttcttttctttttctttctgtttctaacacttagacaaatatattagtacacaaaaccaatgtactaaggcttagaaacatacctttactcatgatttgcactttgttcatcc

SEQ ID NO: 8878 - DNA, 892 bp, Zea mays
gttgtgggcttgtggcaaagaaaggttcctctctaaaaataactatggcacatacgaagacagaaattaggaaaaaacattcctgatgtgagcatatagaaggatagaaatttatgccggcttcttttttttttaaaaaaatctatactatttctattttgaatttcaagacgttttagtttttttttaaaaatatataactttggataaccgtttaaatatatattatatttagatattcacgataaaaaaataragcgtcaaaacgtgttataatttgaaattgcgagaatacggtctgagtgatcaagtatatggccaataacagtcataaactttctgaatcctcacctcaactttcacttcgaatcagttttgatttgatggctatcctgcgagtctacgactagaatggtaatagatcacaaccctaaacacttctttatagtttatttatttgagtccttaaataattttaaaaagaataaaaataaaaattaattataatattattttattcttaaattttatagtataaaatttagagacaatatcatctttactacgacttgcgtcagtgcgagctatttgtcctaggccctggcccaccccagctcacgcacagtgacgtggctgggaacacggcccggcccggtccggagccagctcagcaacgtctcgccctcccagctcctcccaccaaacaaactgaaccactgtccgctgcgtgctttccttcctctcaacgccagccttgccgagagcccgagaccaatcgccgccatctcccggaatgacggggtgacgaaaccgcgccgcaccagacaagacagaggagccgccgccgcgacccacaggccaccgggtcgccgaggaggggatccagcgagcc

SEQ ID NO: 8879 - DNA, 169 bp, Zea mays
agtaagtcatggcgcagccacagcagataaatgactaaatggtgcttgaggcatactctgtacataaaggtccttcctcacttgatatggcctctccagcaaaaggaatagatgttgaagctccttccttgagtgataatgcacaaggttcattgatgtggattgtgga

SEQ ID NO: 8880 - DNA, 308 bp, Zea mays
ttaaaaacgggatcccggtgaaacggtcgggaaaccagctctaccgtttccgtttccgtttaccgttttgtatatcccgtttccgttccgttttcgttttttaactcgggttcgaaatcgatcgggacaaaactaacaaaatcggttatacgataacggtcggtacgggattttcccatcctactttcatccctacccacgccaactatacacccacctctttttattcacactccggccgcctctcgctcttccggtcttcccccatctccgtgaaaccaacgccccccagcccagcggccgcgcga

SEQ ID NO: 8881 - DNA, 264 bp, Zea mays
gttcctgagttcccaatttccgttcccctattgttccagctgctgatctatggacgaagaattcctacccccgagctttttgcaagaatagatgctgttgatgcaagcactgtgaagcgtgttgcaaaccgcttcatctttgatcaggtactgttttggcaacctagaacctctcaccctgtagaacgttcagcatctttatgcttccttctctagtaaattctaaaggtagctctttttttcgttgggcactcattatttaag

SEQ ID NO: 8882 - DNA, 1500 bp, Zea mays
tagcgccattctctggccatggtgcggacgcctgcttacccaagcgtgtctctctccctggcctcaatctccagccgccactcactaggagatcttctccttcacgccacctaacgtgccatcgtcttcacccggccgtcgtccaccctgccttctccagcttgcgccaaacgtgcgctctttgtgccgccttcgtgacctcccctagctcggccatggatgtcgcgccgcccttctcctatctctctgctcgaccgtgcctcttcttccttgagccacgcccggtgctcctccaccaagcctcgtcggcatgctctcctggcagcggtcggatctggcctcctgcttcccctctagtacgctctcgcttccagctcgttgtgcctctgtactggagttcgccggacagtgcccttgctcggcttctccaatgcgccctaccgccagcacccctctcttggtcatcccttcccctgcgcatgcgctgggcgtgtctcccagccgccagctcggctcctcgcttcaaccgtagacctggtactcctcccgtcgtgcctgtcctctgtgcgcacgcgccatcgccttctctagccattgtgctcggccgatgactcacttcgtgccactcaggggtggatctacgaccggggctgcctgggctgcagccccggtcgcggccagtaaagcgaataggctcatcacgcgtgacagcccagctctgcatccagccgcctagctctagccgtgtccagtccgtgctgtgattctgtgagcatttttcctaccctaaaccagctgccgccgccgcccgccagccgtggaggagccacccagacacccaccgcctacggcccgccgccgcagcacgcagcgctgctagcttggaggccgcagccagcccaccgccgcagcacgcagcgctgctcgcttggaggccggagccagaccgccggacggccggagcctcggagcaccgccgccggcccgccgccgcagcacgcagcgctgctcgcttggaggccggagccagaccgtcggacgcccggaggcccagaggccggagctagaccgccggacggccggagcccggaggcccagagcactgccgcagcaatggctgaactaccaaagtgtacagtttagtaatcgttaattgatctttgtatgagaatttaccatgtgagttaatcatatagtcgttgattaaggtttattgtcttgctagctgctagtatttgctaatgatcggattcggagctgcacgtttcagaagggaatatagtagctcaagttgataggccatatatggctgaggacaatctggaagcatcgacatgacgccacctcatcgctcgcggaacgcgtggttagttgatgggtacgtactgtttttgtttggtttaattttttttgttatagtcttaagtttgtagccccttttagattaatcctgtatccgccactggtgccactgcttcggtgattgcactcagtcctgcg

SEQ ID NO: 8883 - DNA, 1500 bp, Zea mays
gcattacagtctaacatactctttatttaacgatgattgttttaatggaaagtttagttcacatcatgatgtgatagagacaagtagcgacacaatcaattatcgtcgtgcaagggtaccattgtgaaatggtcaaaatatttgatacatgagtgagttaggctttcttgcacaaattaaattctaaacacaaggccaaactccactcaagtgattaatgacgtgataaagagttttgcactctagctaattttcaattccaaatgaaaaggcttcaattgaaccgcttcaatgtaaatatgtatagtaaacaaaggattatcggactcctctggagacttggcactctctgctaatccttgtttgatcgatccctcttggtccacgcaagaaccaaatattttctacgagctgctacttcaccgctccgacacgatgaaccgctcacaaccatatacaataccgagttgggtcacctacaaactcttcatgtgatcatcacacttttgatcgccatctagccaccattttaggtattaatgactaccaaagagtaacaagcattaaattctcatatgacctaactaattccaatgagggtggtggatgcaaatagttcactctatgtctaatgagatcgctagcggtgaaactaaatgttacaccccacttaacacagtccaggcaacaactcactgcaccggacacaccagtaccttcctaatggctatggtattcaattttcactatagacatgtttgatgagtacaaacttgaatatgcacaaaaaaatatatgttcgtctatgaaaattgaaaatgtctaaaattctagaggactagcatagtatactattcccttcgttcataaatatatgatactattgatttttttaaaaactttgaccactcatattattcaagaaataatgagttatcatttacttttttttratttgttttatcatttaaggtgtttgtgcttgatttaatttcttacatttttaaataaaatgartgattaaagttttcgaaaaaagtcaatagtatcatattgtgaatataaatattttgaataagacgaatgaacagagttagtacttaatagaattgatactcgtaccagcaagtttctgtactttgtttttcctaagtttgtacttctttatcggaagtataaagtataggtgaccgaccagtgtttctttacctttcattttccgtgctcgatttttttagatcgaacaccaggccaggaggaggagcaggcgcggctaaacgcgcgagtgcacgtagcaaaccgcatcgtcgaaagaggagagagaaataataaatatacgacgagggggcatggcccccctctcccttattctattcctccacaccgatcactcgctgctcccctctctcgccggagctccgggccggatggcggcggcagcagcagctcctcccgcctccgtgatcgcgtgatggacgcacacaccgccgcgctccgccg

SEQ ID NO: 8884 - DNA, 641 bp, Zea mays
ttgaatcatatcgaccctaaccgtctgtttagttggcttcttctggtagcctgactgctgtatacgcacggacaactaactagagtattatatagcatctaacggcttgtaaaagaagcacactacttcggtttcaccacgttccgaaattaaaaatgccgaatcgtcgcttgtgtcatcaacttcaaatcatgccggcatcgtcactactcagtcccagatgcacaatcccagtccccagaaccccaccccaccccacccacgtcttccgctccccaaccggctggggggctctatataaaccgccatgcgctcctgatcagttgcacgcatgcaaacaaacacgagctggctcgagcaggagagaaagaaagagacgagagcgcccgaaccccacttggggcgcccgtgccgatatataatccaatcgaaaccgccacactgttggccgccggcgccagcccgctagtaacctgcttaatttaggcatacgtgagactctgagagaaggtactgaccacacaagggaggccactcccgcccggttcgtccgcgtcgtcgccgatccgtacgcaactcccgtgatccgatccggacgtacggccgctctctctccgggctagctggcgatcgccgactgc

SEQ ID NO: 8885 - DNA, 1487 bp, Zea mays
acatcgtcgacacactgtatatttgctcgatcgtcgtgcaatatcgtactacatgcggatctatatatgtacgtcgtatctccctctgaactttgtaagctttgcgtactgtacacacacaaacatatacgtgcattcctttcagaacagttggaaagtgtgcagagcagggtcgactgaggcttttccctcccttttctgtttctgcttttgttggcgaccaaaacttcctaacagtagggcctagctctcatatgtctttcacacagcgtcaatgcgtgtaaagtcaaaaagtcaaatgtaaacatatcctatccgcatgacgtcttataactaggttgacaatagactctaaattttacactctaaaatttgatgatcagatgagattatagtgtcaggctctatttctattcaattttaaactaaataccgtttgaaaaccggagctttttttctaaaaaaacagtggagttgctataaggagctctcaaacggtgtcctggactcgtcaggtcctcgtatgttcctaagatggaccccctcggcgcccccctgggcatctccctgacaggatgaagggcgggcacaccccagccgcatccaacgaggcaacgacgctccctctcgcgggggaggggggaggagagaagaatttccccttctacactaatcaatgataataattgcgaaattaactatttttagtttaattagcagataacaatatgtattacggtactataaatatgatagtatttttaaaactttaaaaactaacatataaaagacaaataacctagttcaagagtcaagggggagttgaataagggaacggttggagaggagaataaacagagaaaaatggttgagggtgaaaatgattaagagtgagatatttaaatatgaatagaaagtacgaatacgaggaatttaggaaggtaatggttggagatagcctaaggttatttctagctaagcgtgtaatatatgtgtaatatatgcatgtataatactgttttgtactgcacagtaaattatttatagagtgaaatttaaaataaaaaccgagatacgttgtgtgacagagagctggagatacgacggaccaaatttcaaagatgcaactcaacacagcatttcgtagtgttctgtcggcacatcgcctggcagtgttctgcagcttcatggcgagaaagcacgtcgcctggccgaccatgcgtttcagttttgagaaacaaatacgttcaaatgctgcgtagcgtagcgtaggcttaagaaggtcatgttctgttgagtttcagctttgagatttggattgtcacgtaattcgtttccctgtcctccccctctcgctgagctgagcccacctactccctcccaccacttgcattcacacactcgattccgctgctctctccctcttcctctcccccgcggcggagccataaaccctaggcctcgccgtcgtcggaggcgccgccgtg

SEQ ID NO: 8886 - DNA, 635 bp, Zea mays
agtagcagcactcttcaccggtccagctagtaaatgcggtatctgtcgtctgtcgagctaacctatcatatcagcgccatgcgccccggccggtcgtaacctagctaggagtagctagctaggactagctagctaggagcctaagcgcccagcccagtgggtggtagcctaccaagggtgaggaagaggagctgagctaggaccgcgaggcgagcgagatccaatctgcaccccacgaacgaaaagattcttccccgccggcgtcgctctctcatccgtcgacgtctcgctccttccttcctctctctctctctctctctctctctctctctctctctctttctctctctcagccagcagcaagcatatagcccagcaccaccacatgcccaagggccctccctctccctcgtcgtcgggccaattgagtgtgagagctcgaaaaaacccaggggatcggccggaccagcagcgagcgagcgcgagctctgcgtgcgtgtgtgtgtctgcgcgctagattagatcacctccatcgtcaataattgcaggcagatccatatagtctgctggtggcgagacaaagcaacggatcgtcgtcgatccggagagcggaaagcgcgcagatcgcggcggcc

SEQ ID NO: 8887 - DNA, 566 bp, Zea mays
ctctctctctctctccttcgactcaattctttgatttctttctccccaccggaattggattatttccggcgcctccgagaaaatcgcagccacgagaaggaaaggaggtgggcagaaaaagaacggggaaagtggaaaaatcccgtccgacgtggcgagcccgcccatgctctttttctccccgtcctcgacacctcgtcgcctctctccctcctcttgtctattcttcttctccagtgcaaaccggcgcttctcgcgccgtccttccccttctccttgcgcaggttcaggcctgaccgcctgagaaactggaaggtggcggcgacctcgggggttgatcggcgacttgggtcggattagtttccggaagagcactggaggagaaggcctgtttggaggtaatacctgcgaccttcattccttgtcttggctttcctggcccggctgggagagatcgtttcggccgggtttgaaattcactcgacccgattggtttggacggtgtaatcgcaccttcttggggcctaaattgtgggtgtttcctccgctgcccgcagcaaattccg

SEQ ID NO: 8888 - DNA, 101 bp, Zea mays
agtgggtcccctgtccacaagcactgaagtgatgaaaattgttaacaatctaatgaaagctctagagttggctaccacgatgcaagaattctagcaaagaa

SEQ ID NO: 8889 - DNA, 1500 bp, Zea mays
ggggctgctgctggggcggtttaccggtcgcggtcaactggatgaggcgtccccgtccccctcgctcgcctgcgatcagggcccgactgggggtttaatggcgattgtggcatcccgtcccgtgcgttgcttcacgtgatgctgctggtatagtagacctcgacgtgcacgtcggcatcggcgcagatgcctgtaggctgtagccctcggaagggcgcgcgtcagatagagattgccaaagacatgtacaccctccatattccttctaatggttatatagtaataacaaatatttctttgaacaattttttatttgattatctaaatatagccatcttttgttttgaattcctggctagttaaaatagaaaacagaaataactacctagaccgcaaataaaaatatagaaacaaaccatgcattgaaagagtaaaaagtaaagcacacataaaatatagaaaaaatattgaaatcttaaaaatatagaacacaactttttttacatacaaatagacctctaaataataatgatttatataataaattttataaagactcatgaagatacttaaacctgactgagccttctcaacaagctgatagattaccatgacataagccttgtcatgtcacaacttgttacatacaccacaatattttaggcgagcatttgatttaacgtcataacctactatttctttattctcgacaccccgtcccgtgtgtccagtgtcctaaaccctccttttttgaggaaaaaatatagccatcaagaaacatccaagcaggtgacgtttggttcatatattggtaacataatgagtaaccgataacgttaaatcatgtttgtttaaatctaaccataattaataccacattagaaatagatactgtcttattcaaatttgttaccgctaatattcgagcgtgaatcgttaacattaccattttygttacatttcgtaaaccaaatgtaccatagcgatgtgactgtggattcaaagcccgatgtcytttcgaaaccacataaaatttataacgttgtcgtgtcaaagattgagcaacagaggcgtggcaagttttcaaaccccctaacgcagagccatgtctctaggaattattgggtaagcttagattaacctgggattcatatctgcgaaatgattacaacaacaaccaaaacatttttaatttataaaaattaaaaaaaggaattctgaaagcccttcagttgtgtggtcgccttcgtgccgcctcctttccctgtcttccgccccaccagaccagaccagaccaccaccctccggctgctacttttgcgcctccaccgcccatccccaaagccccaaccgactgcgcgtcccctctcctcccaaacgcattccatcctctctcctccagtgacagcctccggcgcctcctcgggctgccatccagcccgtgccactgccactgccactgcacttgctgtgccgacccgagctgcggtcgagtgagca

SEQ ID NO: 8890 - DNA, 234 bp, Zea mays
gcagccaaccgcccgcagccagccgtcccgccccgcaatccccggccccgccccgcaatccccgcccgcaatccgctggtaggtgctcgccgatggaaggttatcaggtccgctgccgctggaaggtgcccgccccgcagcagagaatggaaggtcctcacgcccgcacgctcgctggaaggtccttgattgagctgataatggaaggtcaccatacacggatggaggacgcgg

SEQ ID NO: 8891 - DNA, 217 bp, Zea mays
ctcggccccgggagaagcgctagcaaacaaggttcacctaaaaatccatccagattcattgaatccaaccagcacaaacgtcccatttattaatcacctcatcacaggtccccccagcctcactctcgcgccggctcaaggtacattgcgtgtcctagccaagacacgcagctcatctcagcctcacacgcacagcaagagcgaggcgtgattcgcc

SEQ ID NO: 8892 - DNA, 594 bp, Zea mays
aggaagcacggatggatcgcccggatggtggattgttctacgaatgagcttttgactaaccagcgatcgaatctagatcagtattcttgggacgattactccagtccatccatccatccatccatccatccatgcggttagctaagcatttgtttgatggacggtgactggtgggtctgtaatagctgttattttccaaataaattggggctcaactgactgagggagtaattatggagcaatgtgtgtcgtgtgcctgagggagcaatggagcaatgcgtgtcgtgttaaccgctatgcctatactaggtcattgaaattgcttagttatgcctgaatttgattgaccttgaccccttctattacttgtttcttttggtcatcatagttaggtgtattcagtatgttcttcctgggttaccacttcagttgctgatatgcattgcctctgcttattgctatgcattcctatgctgacactaatttccccatcacaatctttctgcagtggctagaggcacctggtttgtttcttgccgaagcccgtggtacatgtgaacagcagggcctgtcttctgcttttgcttcttagca

SEQ ID NO: 8893 - DNA, 965 bp, Zea mays
cgagagggagaattgtggtggtgctgaagccaccgtacaatctaatgtgattggtgaagttgttattaaaaatgttaattgtggaagagatgtttcgacaggctacaagcagaggcatgtactcgtgtaacgacacttccattcattatttaaattcgatgtcaactgttctcctctcctgtcaaagacacatgatgcgcaggcaatttcggctagtttcagataaacgtgtacagaatatgatgaactatgatcatacttccatacgggacgtgctcggggaatcggtccatttccttttctcaacaaccaaagaagctgaagggaaaagaaaacaaacagaagcagtagcattaatgcattattgcggtctagatggacgtacacgtacgtttctgccactcgatagcaagtgatcacccatcgacaggagcagcagtgctcgccgtcgcaggaacagacatgcgcacgaccagctccagcaccatatacacctcggacaccacctcagccgtcctccacagcaagtgaccggcggcgcgccggagcccgcccgttccgctgacgacagcgagctccgtcgtgtcgtcgaagatcttgacgcggccggccacggcgaaggtgctgccgttgtagggcccgtcggcgagcacgacggtgacggcgaccacgagcacctgctcgcgctgggaggacagcatgtaggtgcccagcgcccggccgacggccctggagtcggcggcgggtccctcggtcacgaggtcgtcgatggccaccgtgtcgccgaagtaggcgcccttcagcgacgtgtgcggcggcccgacgttccggatgaggtggatggccgtctgccccggcccgccgatgatgtcgtgcatgtacaaccgcaggtgcaccgggcgctggctggcgtccgccgcggcgacgagcaggagaacgacggccacggtggcggcaagcagcag

SEQ ID NO: 8894 - DNA, 477 bp, Zea mays
gtcagtttttgtacttcaccgactatatttggctttcctctgatccttactgatatctcatttttgtcttgaggtattcattgcatgccttgcacggatgtgacagttttgaaaaatatactaataattcctgggcgtcccccccaatgagtgtggacaagggacggcttggtacgctgagtgttttagccggctgcttctgagtagtaatgtgatgagacggcgggtgtaatcatatcatctgcgttattgactggagtcccaatgggtgttgcgttgcgtgaaacggcgtcagcctctgacgtgtcttcagacgggttgaagtgtgtattgaatgcttcacgactgttcagtgaccgtggttggaggtgagcggttgccttcttcttctataaatagtggctttgcctctctggttttttcacatctcttgctgttctccgctgcttgctttcttctccttctcgcgcttccacc

SEQ ID NO: 8895 - DNA, 563 bp, Zea mays
actcggacatggttccaccttatgttcagaacgttcttgatcaatttgagggggtgtttaaagttccaaactcattccctccctccagggagtatgatcataccattgctttgctccctaatacatcacttgtgaattcaaggccatacagataatctcccttacagaaagttgagattgagagacaagtgcaagaaatgctacaatctggaattatttctagaagtctcagtccytttgcttccccagtgttattggtgaaaaaggaggatgggagttagagattttgtgtcgattaaagaaagttgaatgacatcatagtgaaaaactagtttgcaatgccattaatagatgagtttattgatgaattggcaggagctaagattttttctaagttggatatggcctcgtggtttgatcagataacaatggttgatggagataagatgaaaacaacttttaaaacccaccatgaatgtttccaatttaaggtcatgccttttggtctcctaaatgcactaactacatttcaatgtttgatgaatgcagtgttccaagaataa

SEQ ID NO: 8896 - DNA, 973 bp, Zea mays
tgtaaacattgtccttggtggcggtcgaagccatttttgcagcgatgggcagggggccttcggtcagcgggggagaggacgcgtgacgacgaggagtgggaccagctgaggcataggaggagcggcagcgacgacggataggattgggagaacaagggcgtgcggaaagttgcgcacggaaggatagttttttcgcacgcgggaagatggggtcaataaataggatctattggagggttgttttattttatttttcctaaattaaatattcaggaatattgggatcagttagagcatctctaaacgactagctaaatggtctgtcaagccaaattttggctattgatttactaaacaacgaaataactatccaacaaactagttatcagactcaccaatctatctgacttttcaaattggcttcttcactggtacttggctagccactttgactagccaaactagatatatattgtgttggactgagagatgctacatatagaatgtaatatttatgataagttaaataaatagttaaataaagagttaaaaatgaagagtcatttgagatgctcttatacctattttagcctcgcagaagccttgtagttatagagtagagaaacagggaaaaggaaaaagaaaaaaaccctaaaaaagatatggagaaaaaggaaaaaaaaccacaagcccaatcagcccaacacgttaaacctaactgcctctcctgtctcccagtctctcgccgctcgcctctcagccgccgcgtgcctcccagtctcccgccctcgcctctctcttcctctcctctctccctgcgcgccgccgccgtgcctcgccttgcccagagactaaggcgccaggatagtataaatttagttcacgtgattgtggacttctcgccttttggattcaacattttctgcttctcagctctggaatacagaagtgccattgtgggctcaagaggata

SEQ ID NO: 8897 - DNA, 618 bp, Zea mays
gcgagcgacaaatatttaagactggtgctagtattatttatctatcacaagtgtgctttagtgaaattatatcactataacattttagtttaggccttctaaatttttttgggctccgtctatatgggcaacaacctgaagcgacaatacacctagaggtggtaataaactataaattttacaccataaaacttgaagatcgaatcgaatcaagctcttttttcattcatttttgaactacattaattaagtagactatttgtctcggattaaagccaactgttcgaactgctgcagctgcaattcgtagaaactaacactgtagaagcaataaaagatgatacaaattaaaaccaagcgaacggactaaagagctcaaataaatagtgaagaaatacttggataataatatattgcaacctctatatgcaccccggagctcgcctataaaaaagcagctcagacatccgccagcaagcaggcaaggcaacatattgtaagcgcgaccacccacgcccaactctcctgctagtataaggtgctcgagctcgagcctccccgtggcagcaactaccagtaccagcagcagctgcccggcgagagaaggaacattcagtc

SEQ ID NO: 8898 - DNA, 198 bp, Zea mays
cgtaagtcgctactgaccgaccatgaattcttgtgcgctgggatgacgaccattgttgctgttgtgtgagtgtcctcgaacaagatgtatgtagaggagtagcacatccggtggtgcaatgaccaggtgtactacctcgctgatgagcccggggtgcacttcatttggcagctcagccaagagtcatcggtactcacc

SEQ ID NO: 8899 - DNA, 81 bp, Zea mays
gttggattttgtaacattcacagttagctaacatgtaatcgtttttttttgtgaaattgctgcaggaagcgcctttttgtc

SEQ ID NO: 8900 - DNA, 1500 bp, Zea mays
atattaactgtaattatttatattttaatgcatatattacttttatgcgctttctttgtcagcatacacatattcatacttcaataactacatgcagaacaacttttgctttaaaaactatggataaaaaaaagatatatactcctcaaacgaaatggcgtagttaccaaaatgcgagtttgaatcagtgctgtccattttgtattcgtatttgaaaaatattaaaatctatatttgtatccagaaaaacagtcgatttccgactaacaaatatctgagttccagcggtaccgcctgtttcatttccgcccaataactagggcctctattgttatcttggaaaaaatctagccgtccggtacaccgtacaccaagcaaatatctagctaggcttgccacgtatcccgtgtcgtgattacgaccaagtgccttttatttcttgtgggcgctaatgtacgttcaaagtacgtgttcggagtttagcacagatggcacaatggcactgtcatccgacaaggacctgtttttgtggagccacggccgatgcgatttcacataataatcacatatgattcgcgtgcagtagaatacagtaccgagtagcagcgctccacttggttccgacttgtgatccttttcgtgaacgtgtacctgagaggcatgactgtgtattccattgccaagtcataaagagatagtagcgcggtacaggcgtacagcaatccagctgccaaactacagagacctaggcaataacttgctgccaaaacttaaagctagaaaacaccttgaaaataaaaccaaaacccggtgtgtgtacagcgcaagggcgcagagatccatttacgtacatgccaaaccaacaacgagaaggcagaatccggggaaaagcgagctgtagcccgtacaccaccccttggcgcttcggcctccacgtgtcgaccgcccgcgcctcccctgccggcctcacgcttatctctccacggaaggatacgtcaaccacgtagaccgggcccgtccgcctccccatcccccacacaacaaacgtgccacgcccaccccaccctcgagccagccagcgagtcacagcgcccgcggagggccggtcgtttactcgtggcacgcggccgcgcgccccagatcgcttccgcctggtggacgcgcccaggcgtcgacacgcgtcccgggggcacgtaccggccatgggcgcgcgtcacgtgggccgtatcggacgccttcgccgctgtcacacaactgtacgggggccggcccggcggccgcgtggcgcgtggcatccctgctcctgccttttatacccccgcggcaccacttggaacgcaaacgcaacccctctcgctctcaagcttcaaaatcccactagcgaaaggaaaacgggagaagctaggaagcagcagccgcggcatttcttccttgagcgttcgccttcggctgctcaacgcgtgcttcgtttcaggagagccttggtggcatctctgtttc

SEQ ID NO: 8901 - DNA, 1500 bp, Zea mays
gtgatccataacaatccaggaaggctaaatgcgggtacctgagagtgaggacgacgtgacaggctgcttcggggggcggagcagatcgggcggacgccgcgcctcaccctctctcggtctctccccttctctcctgtcccccggacaggaaaacgagcggtkgtgcctgcaggatttgcagggaggaggaaggaggagggagcctgaccgcctcggttccgccggcagcccgggagagaggcgctatttagaggcgggcacggcgtcactggcgcctgggcccggaggagccagatgtgatcatgtgacgccgtaaccacgtcggcggacgtgaaatctggccctgtgcacatgtagagccctatttggctggaccccgggaggccgggaggcgtgacacagctcgtgcagcgccggacgcgggcccgtggctcgcgagtttggttcaacttttttgtgaggattttttttagaatctgactgccagaaaaatatggttgtagggaatacagtttcatgtagataaagtgtgaagaaagataaaatagtttatatgatttaggatatagaaaatgacggttttcataaggactcggttgattctgtcctcatattgattttagataattttgactaaaatgattcttatagaaacaggttaaaaagttagatgtttaacagttttgcgacatcttctggtgatcagaaattgaaaaaaaagcttaaacaaaaagctatatactcctatccaacaaacgggctctctaaggctctgttcggttttcacggattggagccctggaatagttcttagccggattacttttctaatttatattaattttaatgagctggaatgaatcccggttcattcctggacaagcgaacgggcccttagttagatgaaaccaaataccctctatttctctaaacttgtctatcaagagcagagacgtagccaaaaaaattatatggagagaccataaacaacatttaatagattatatgtaatatataagtgtctgatttcagtttaaatttaacttaattgactacatatttttattaacacataaacaaagaaataaccaatatttatcaaatcaatcactatttttatatacttaactatttaagcagtaattagtatgtatttatatgtttgtacaaattttaggaggtcaggctcctgccagccctcttgtctactccactgctcaagagttatgtttgtaattatactagctgatcgtataagactcgtctaaaaatccataaactcatgaacgtgaaatataacgacttctctttcacgttggcataggatatgaggctgtaagagggggaaaagagcacgaaaaagcgcgagaacgaaaggaatgaggcgaggaagaaagtatcgtcatctatcctaaggccataggatgtgaggctgcagtgaacgccgctccgcgtctccagagggctctgctcctcctcttcaatcccactcccgccccg

SEQ ID NO: 8902 - DNA, 87 bp, Zea mays
agctaaaaaacgctatttgcgcctcctcctccatgtgacgtacgtcgtcgcgcgccctcggagtatctacctagctaggctaggacg

SEQ ID NO: 8903 - DNA, 538 bp, Zea mays
tggcgccgccgagccgtcagcttagtcgtggaggtggattcttggaggtgcggtggaggagaggaaccgagccaccgcccgccaccaacgtgaatgctcctaggcggcgagcgcgtgagaattgggccggccggttagtgtttgttttgggggaataatatatcctagattttaggtgacagtttagggtgaatggatggaaaaaatgtacgtacaagcgtgggggattacggttgggttgtccggttgtggtttgggctgaaccgaaatcgacttttcggatcaaggctctccacagttatatagagctcagggctcttaatataaatatatatatatatatatatatactaggtggttgcccgtgcgttgcaacggaaacataaaatactacgataacttatgtagaaatatgtggtgtttgcatacggtatgtacataatttttttcatataaggaccgcgtgccgcgtcacgttcaacaacgcatcagcagagagtgtgctaaaaaggagtcagtctcgtaggtcgagtgagat

SEQ ID NO: 8904 - DNA, 567 bp, Zea mays
gtttttttaaagtttaccaacaagagagctgattgttatattaaaaagggaagccatgacatgcactatatagagataaataaaaaaaatagccgccacaactaaaagattctacgagcaaaaaaaaacactgtagtagtcgtttaaggtgctttcagtcatatttatgaaacgttcgcacgtatcaaccggaggtatcagtgatttcggtcatatgcctaacaaatgtttctttgtccttcatatgcctaacaaaatatttacaaaatgcatccttccttgtccttgagccgaatactcaccgtctcctttgacctcggccccaaccggccctagcagtagcagcctagccttttccccccttccctttttaattcctccttgacgccctaaccggctacgcacaaacaacgcctccaacgcgagctgcgaaagaagagcaggggcaggccaaaaccaagcgaaacaccagctgcgtctgcgtgcaccaccccctctacggacccacccacccggagcgaaggggagacagcagcagcagcagaagccgcgcgcgtgcaaactgca

SEQ ID NO: 8905 - DNA, 592 bp, Zea mays
cacactcgagagcacagagaattcctatctacggagtactactcctatactcgatgcgggctgcatgatttacgcgagcgccgctgccctaatgcttgcaccgttcaagaaacaagagactggatccaaatgattgagaaaacgggtgccaaataaaacaaagagaatgaaatgtacgccttacaattaccaagagaataaaaaacaaagagaaaacgggtgccaaatagaatcttttggaataataacacctggagggttcaacaagacgagaagcgaccagagagacaggattcacaaatgatttgttgagtatcctgagcagcagaacattggaaacgatcgtggtgcgaactggctgagaattatttctggaccacgcaaaatgtagcttagcagatgcataacgggatacagcttccagagagcgctgaagaaaacggtccaggtctcggtccaccccacatcttctccgttataaatacagcgctcggattcctcacgcccccacctatctctctctctctctctccagcgcactcttcctcccctcactatccacctcagcctcagcgaaggcatcgatcgaccc

SEQ ID NO: 8906 - DNA, 444 bp, Zea mays
agctcggtacccttgtttcgaataaatatacatatacatgcatgcatatatagtagtatatattgagttcccagccagactaatctctcactccatgcatgtataaatatcagcactttgaggcaagaaatacgccatctccttcacttccatctatcctttgaattggacccctaagctaagtagtactagctagagcaactctttttcatggctacattaatagctgctagctccgccaccatgctatttctaatgctcttatgctctcgctgctagacatggcaagttcccagccagactaatctctcactccatgcatgcatgcatgcatgtataaatagcagcactttgaggcaagaaatacgccatctccttcacttccatctatcctttgaattggacggacccctaagctaagtactagctagagcaactcttttc

SEQ ID NO: 8907 - DNA, 268 bp, Zea mays
ctaggtcactaaggaaaaaacgccgcaaaacttttcgtcatgtctctgctgtgttcttcagtactaccgctaccacatttgcgatcctgagttgtgattaccggtcctttaggtgatgcacaaatggtactcgtgaatattctttttattagcagttttctgcagggcctgtacattctctttctgctcgatccgattgcattgcagattgatttgtaaatgagtacatggtcacgttgaaccttgaaagcagtcaatcatttcaaaa

SEQ ID NO: 8908 - DNA, 1068 bp, Zea mays
gacggcgacgacaagggtagcggtggcagcagcaaggccagtggcaaagcgccactgttttaaatatagcgaaagtggcagtgaagttttctagtccctgttgcttagtgagcggctcctatgttgtaacgtcctgctgctaccaggctaggttagggcgcggctaggcccacgtgttagccggcggctacgtcggccgaagttacgacagaggatcgagttgcccgttgattatccgcccagtacgagtatttgttttgcacctacgccattcgattgtgcagccacgagaagggacacatggcgcccaaacaagtgcgacaacgatacaggacgcttcgggattccatgtatatgctcggctagactcttgctggtacccgatatttgataggcacccatagggcacgcctacggatataatgtcttgttagctcggtgagtatggatatttgtagaaggctcgagtactatatcgggtcgggtattattctacccgaacacaatccgacacactgccattcctaatagggttagcacaagatatatgctagtattgtaaatattctatttcttttatataccatttagatacaatcatcagtgacacagaaatttaaggaaatcacatggcctaatttttctatgccagtagctatawtataaaatatataaatatacatatttgtgtaatataaaaaagattatgacttctttggaacgtaggaattttagagaaatcatatagtaattttataaaaatcagtaatttcacaagaatcagtttattttcaaaaaaacatagaaaatggaaaaatttccacaatccaaaagcgcctaggacattactggataaaaagtacagtgccgaattgtccgaatatctttccaaattttactcgcctcctgtacctctctcccgtgtgaccatcacaacaaaaataaaatcaataatagagagagaagaggtagcaacaccggctgcttaatctcttcttttccctcctctttatctccagcgcatcgtaaagggaggagcggagcggcgaattcttgtggtttcccaag

SEQ ID NO: 8909 - DNA, 269 bp, Zea mays
cccaaaatttatgactcaaaacacgataggcatgtgtcacaaaatttatgactcaacacgataggcctgtgtcactgtgtgccagcccggcccggccccgctttcattggccatttcgttaaccatttcaaaattcgaattctcccctcatttactgtgctgaaattgcttctccggtctgccgcctgcccgccactctcacacatagcttcccttctcgctcgaaatcaccactcaattcgatcgcaagctgccgaatcctgaaccct

SEQ ID NO: 8910 - DNA, 78 bp, Zea mays
ctgcctgccttgcctccctccctcagcacgtcgtgctggtaatcgatcagaggggggcgtgacgtacgtacagcagcc

SEQ ID NO: 8911 - DNA, 1500 bp, Zea mays
gaagaatcattttaccagaactcaacttgtttcccaagttcttatttcttcttcaatacttcctgctgttcttcctcatctgtactcctggaattctcctggaattcttgtatcagctcatctgttaggaaggttgttaacactgctcctctcctagtctccttccccactacagcacgccttctcctctccccactcagcagcttcatcttgtccgttgcaaactctcggccgaagcatcattaatggagccgacgcgctttctcttgcccttccgatgcccgtttcttctccctctccctataaatcacatgctcgtgacctcgtcgaaccgttcctagccttttctccctccttctgtgcctgccgaagcttctgcgcgcgttcgaagatttgctacgcttcgccgtctgccatcgtcaccaatctactatgccccgagcacccttctctccctgctctctactcatgagatcgtcgtgccaccgtgcctctgcttgccagctgctgttgtgccgcttgtcgctccgtgtagctcgccgtcagttcacgattgaacgcctttccccacgccggagtaccacaccaatgcctgctgctcgtctgcgccagtgactcgccactacgtcaccgttagctgtacatgctcatcctcgcacatcccgcgtcatcctcgcaatgctgcacgttgtcatctgcagtaccccgtcgtcatcgccatcatttgttgcgccatccgccatcggagcaccctcggacgtccctcgcctctaccgctctatgttgtcgatgatggaaatccggagcgctcaaacactcacactcttcgaagaacaaacacacacgtaaccagtagtttgcgcacgaacgctccgacgcacgaacgtcggtctttttctattatcctttttctgctgtgattttacagagtgctgcctttatagccggtgcttagagcaactccaatagttatgtaaattttagctctctaaatcatagatttaagaagttgctaaatgtcttttgaagtaaaaaatataagttctccaatagttctctaaatataggttgtaattttgttttgtatttatccacataaaaaacaagtcacaaaaactatataatgcagtcaatatttttgtttagggatttgttaaatggttgctaaatgtagagagaaaatgaggttagatgacaagttgttaaatttaaaaagttcgtttagagaactgttggagaatagttttcatgtaactacctaaattattgatttagaaagtcttttagagaactactrgagttgctctaacggtctaacctgtcccttttcatctagtcaccctctccattcttcgttcggatccacgtattgccggacccgctgtcagagtctgacatcgcttgggcgtctggacggtcaacgttaaccccacgcacgcttcttctcccccagttcaagtgccacaccggccgctcgtcgccttcccatctcgccgcgcc

SEQ ID NO: 8912 - DNA, 266 bp, Zea mays
ctgcagcaaggacgctttcctctgctccctgctcttcctcccatggccccccatggtaagctcgccatgcctttctgctcgtccatggtctctccccatcgctgcatctctcctgctcacttcccatggtgtggacgtcgccctctccctcaccttctagttgtggtgctcaccttggtcgtgcagtagcagtaaccatggaaacccctctgggacgcgccctcagcatgctcaatgatatgctgcagcgagctccaccttgatct

SEQ ID NO: 8913 - DNA, 1107 bp, Zea mays
gataaatctagacacatatataaaacacatgcaccactatttttctaaatcgaattttattttaagaaagagggagtactattttgccatggagtgagtataaatcttagacaatctctctattattggcttcctatagttgcgaaggactgagagccaaaccaatcaaatttcttttagatgcaacattttgttatcgaatgtttttgtgttctcattctttgtacctcgccaactcacctcattcttgtacaccctcgccaatggtgcccctgggccctggcttttctctgttagaggagaatgtcgtgggctggaattactgaaatgaaaaaaaaggtccagtccatcttgttgggccaacacgggcttcacgagccacgctcggtggaaggttctagtaaccaccagtgtcactactcaggaccgtccgattggaaactagcagtcggatgaagcttcgttcgtagcccttatatgcgctgcgcttctagacgcgattcgaagcatccaggcatccagcaaatccagcgggtccgtactcatctgcttcacctccgggctccggctacggcggcactcttctctggcaaccggtaaacctcctctccctttcttttctatggtgcggtgcattcaagatgtccggatgtacgtgcgcatcgggtttgggatcggattgcgcctgctgcgacatagggagtataccgtgctcttttgtttccccatggattgatactttctctgtcgattcttatcaggtcggaagatgttggatcttccgcttcaaatcgacgcataaaggatgcagattagttttgttcgcgtcaaatttattttgctcggtgtagttctgtccattaattaattatttgtactggatttaaggtgctgctattttgaaggttttttctcccggaaattttcacatcccgaaacgactggaaattgaagtagccatttgatgctgttacctgggttcataagttgttagacttgttgttatttgtttgttaatcctatagctattgcatattgtgtgcctgatcaggaccacagaaacctctaggcgacgaatcgagcaggtagaggagtaatcaggcatcc

SEQ ID NO: 8914 - DNA, 153 bp, Zea mays
ggtcaccagcctgctgcagaacgctggacgctcgccgggatctagcgggaccagtcccccgccgcggcccgcgtctacagcgccctctcgccgtccttctacgcgctctacacgctcgtcaggggcgtcgccgscccgctcttcctcctcaag

SEQ ID NO: 8915 - DNA, 69 bp, Zea mays
ggtgggcgctaccgtacctacgaccgcgtgaagctccacctgtccaaggagttcagctgcctgccgtac

SEQ ID NO: 8916 - DNA, 790 bp, Zea mays
tcggttttcgttcctggccatttcttttattttttttgcctaaaattcaaaaacttgataaaaaactactccctttgtccaaattccaaaatatagttttttctaactttttttatgtccacattcaaataataatgaatatagatatacatataaactacaattatatgttaattaataaatatatatttagtctaaaataaattatattttaggatagagggagtgtattttttatgagtagtatgatatattccatatttaattttttaaattaatcagaattttctgtaaaaagcaacgaatttcgtccggaaaaagacggtcatttcgaatttctggaccggcttgcaaatttaacatttatttttctcgagaaaaaaaataaatttaccgaaaaaaaacgagaacggacctggaaacacggcttgtcagccgagattatcagtttcaccatttttttgaatttgaaatttaaaacaagtccgaaaattcggatttcggtaaaaaccggtcaattcctcttttttcgctggtgaccgaaaaatcaaaccaaaacggtttgttctgatcggaccccagatccagattactgctaaataaaaagcatgtgaaggccttcctccccctcccagtcgcccttcaacttgccagccgatcccttcgcgtttgtctccgcggttccgacgctccgcactccgctcccctctcccaagcaaacacagccgagtccacgcacgcctcccatcattcctcaaccgcctcgccggagcaaggggagtagcggagg

SEQ ID NO: 8917 - DNA, 63 bp, Zea mays
tgtaagcagggtcctcttgctgcacctactctgcagttgctgacgaaagaagatttgagcaaa

SEQ ID NO: 8918 - DNA, 96 bp, Zea mays
ggtacgtatatatatagcacgcacgtgcagtgcatggctgcatgcgttgccggccggattagtaaaatgcatgcatgaacggcagatggcggcggg

SEQ ID NO: 8919 - DNA, 220 bp, Zea mays
tgcatgcctgcagcatatatggaaagttggaaacaaaaagcgtctcaattctgctcggtgcactcgaagctactgctattgccaattccgtctctattattatctgataatactcgtctctctgctcacaagtcacaaggaggggagcgaggcggcggggggagcgaggcggcggccaacacctagcagctccgaaccctagctccggccactggcggcg

SEQ ID NO: 8920 - DNA, 899 bp, Zea mays
ttgtgctcaaagatttctgcataaattaggccatgcatgcatgcaatgagttaaaagtggcaagaaaaaagcgaggagaggatcggaggtttggtataaataaaatatatcaagagttagggtccgtatagttgggctgtgacttgtccaaaaacagctttagctctagctttttctaaaaagcagcttttctaatagagtaaaagtcatttcgtaaatcgtttgccagaaaaggcttatcttaaagtcatagttattttcctgtattaaagtgatagagccgccaaagactatgaagctactatttgtagcttcttctgcgtagaacaaaaataactctggcctttagatgttttttgtattaagccgttttaaaaaaaatagtgtttggtagagctctgacttttctctgttttttttttataaaaaagtcagagccaaagtcctaccaaacaagctcttaattctgcgtgagggagagatgagatgagcttggctggctggctggctcaagtcaagtcatatgcaaattccatccaaaatattctcttgggaagacaagattatttttaagaagtgatctacatacatataggagagaaggatctccgaattaaaaagattactcaaaagctcactacccttcccatacttgcatgcaatccaagctacccaactctactcgatcgacaagattctcaaaacactaaaaagatatataaaaggaaaaataatggtgaaacaaaataatatatataatatggtggaccaaaccaaagtcttctcctctagctgtgtgcctgtgtgtctgtgtccactataaaaggacctcaccaacccaggccgccttctccagaggccagagcaagcatctagctaccattcacaacacaagtaat

SEQ ID NO: 8921 - DNA, 583 bp, Zea mays
ctagcggaacagcttcttkgtcgagtgtctgaagcactcgacaaagcctgaaagacactcgacgaatgctttgtcaagtgtgacactcgacaaagaaagcttcgcgaactgtacatcggcaacggcttctttgtcgagtactttttatcgggcactcgacaaagactttgccgagtgtcacctgctactcagcaaagaaaagtcgccatcacggcgccaggtaacagcgacggagtctatgccgagtgcccacaaagtgacactcggcaaaatagaacatataggtctacatactgtagaaacaaaccacaaaaagtttggttgcaaaagaataaaataaaaatattctttaccgtgtgtctagtttaagcactcggcaacgcttgttttgctgagtttatgctgggtgacactcggcaaagataacggtcgtcagttatagacgactgctagyggccctttgccgaacgtcgctcttcgccgagcgtttgccactcggcaaagagcactaaggcaccacttcctgcactcactgctagctgctcacaccgtagtagtaacagtccatcactaggcatcacca

SEQ ID NO: 8922 - DNA, 1500 bp, Zea mays
caaacacacgacaggctagggcactgacaaggtgaccccacagaacagcgagagggagagaggaagagacgcgcgggccggcgccgacaggcggggcccgcctgtccggggctgaaggcgcgcgggcaagggcatgcgcgcgcggctgggcttagtgggccgactgggccgaattggctttttctatttcccagggattttccaattgcttttttatttattttctctagggttttcaattcaaattcaaaccaagtttcaaattcaaactaattcaaacatgtgcaacaatttaaaggacatttaagctcaacatgatgcaacatttcatgacttataaagttttggcaaaaataaataattaattccctcgctaattaaaccaaatctattcaaaaggaaaagagagagagagagactagagagagagaagagtaacacctgaatttggttgataattagaaagaaattttatacccccaaattcagggtgttacatggaacaatacatacatgaatatacgggctacaatgacaatggtagaaacaacaaggatgacctttagttctagcataggtttgattagaagcaacataatcaaagaatctttggcactttattatctctttcgtggggaacaaatgcacaggagattgcaggacctgacttttgcagaaacaatgcaaatggaatacaggatggagggagatagagggccgctgaccagaatatggatgcgcggaggtggtccaaggcgaggagatctgtggtgccctgtgctggggaggttgacggcgccgtgggatgtatcgtgtgtgcaggcgtctggaataagaagaaacctaggcgcgtgacgcgagcgggaaacagagtaacgcgtgagcgggaacagcgaaaatcagagttagttgctaaacactgggtttagggtctgtttgttggaaagcaacaatttattcagatcctaaacatatcaaattcgtctttaaaacagaattaggcctcagtttaggattccttcttggagttgctcttatcttctatcgcacgtaatcactggtcatgggcgcatcggagccgttcaggcggccacccgcaggccgcaacgcagcacaacggctttctctccctgcttccctctccctgcttccctcctgctacaaataaaaattcgtggggcggccaaaccctaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctgcggttgcggttagtattgctgtttcttgctccttgtttcttgttcttttgcttctaacc

SEQ ID NO: 8923 - DNA, 55 bp, Zea mays
ggccgccacctccaagccgagtgccgagaagtagaaggacaagatctacatcctc

SEQ ID NO: 8924 - DNA, 741 bp, Zea mays
cactgatacccggtgcacagcttaagaaaataaatagattagcaaataaatgtaggcccgtttggatctttagaattgaattccattataataatagtaatttagacacatatatatatcaattaagccaatacaattttatgcaaaatatatttgtatgctattattagtaagatgtcggagatatttatatgctatatttgtactatagaggactagagaagtgagccgaagagcgtcctataagttgcagagtataaacatattctaccgatacatgaaatcatttttcattcttcacctcataaatttgagatggacgtatatatttgaacattgaaaagtggtggaatatcaaattccaagccaaaaatgttattttattaagtaaatttcaatttctaaaaatgagtagtgaatttgagtctagctagtaccatttcttgtttttaccatgctgcactggcacccgggcacgataatgtggtgtggcctctgccggaacgtgctcgtacgcgggctcaaacgccgtgccccgtaccggtgtatcctcgtgctttctgccaactatagttacacatactgccatattatatatgattcatccccataaataaagctccaactcatcattgtcatcgtccaaatttcagttcgagaagactccatcaagcagctcatacgtatatcacttgccatgccagcctagcttcttccgtgtctttctttctcaataaatac

SEQ ID NO: 8925 - DNA, 870 bp, Zea mays
ttagaaagcaacgccgagcgattggaggttgacatcagcgttttagaagtaacaccgagcaatcgaacgcgagaccagcgttttagaagcaacgccgagtcagtgaaggctgacatcggcattttagaagcgacaccgagcgattgaacactcgatcggcgttttagaggccacgccgagtgactgaaggtcggcgtcggcattttagaaataatgccgagcgatagaatacaagttcagcgtttgggaggcaacgccgagtgattgaaggtcggcgtcggcgttttagaagtaacgtcgagcgattgaacacgaggtcggcgtgttagaggccacgccgagtgactgaaggtcggcttcggcatttttagaagtaatgccgagcgattgaatacgaggtcagtgttttggaggcaacgccgagtgattgaaggtcggcgtcggcattttggaagtagtgccgagcgatagagtacgagttcagcgttttagaggcaacgccgagtgatagaaggtcggcgtcggcattttagaagtaatgccgatcgattgaatacggggtcagcgttttagaggcaacgctgagtaatagccggccgcgcgagttattttgaggataataaccgagtgatgaagtggcacgtcggctttttcggaaataactgccagatgtccacgtggcatgctgaggtttcagaaataactgccgggtgatgactgggcactttttgaagcggtatctggctcaagaatatcccataagagtttcgcttttagccgcctttgctttccgtgccctagttcttgcatttccgcatctgaatcttctctgccactcgcctcctactctgttcgccagtgagaagcaag

SEQ ID NO: 8926 - DNA, 1500 bp, Zea mays
ctttgatgaataatcagatactgtatctgaaaaaacgatgctgcagctgcagctatatggttgtggctgcaacagttcaaccgacaataaaacttgcagctcaaaaactgcagcgaacagggcccacgggatcggaataatttgtgttgcaggccactgtgttgcgtacgtgcattgaatggtctatcactctatcgtacatacatctggtaattttgttacgcgcttaatataatgggaggatgcaaaactatatgttttttttttcacaggtgaaccaagttcattttggttggaaggatgtatggattaactcattatgatctattttggaagactggtgtttagttcaaaattcttataccctatgtcattggattttatactcttgtgtgccattgaattgaatggtatttatgagatatctagtaatttcagtggcattgttgtgcacaaaaaagacggcggccagaaaatacatctgaaacttattcacggctacaataatatttaccaagataccaaacagacccttaatcataaactacttttatttccttccttttagaccaagcttattaatttgattattgatgctgtataacaagtgtgaacaactatagctcaaaagtacttgtagctcacgataattgtcatactgccttgcacggtatggaaagtataatctactcaagaaaaaaaaaacagttaatttgttcagtaaaactgtgtaacaattaacatactcacaaacatcacacgtgttcagtaaaacaaaataacaattaacatactcccatcgaacctaggacaatttaacgaaagctgattagtgcgagtagaaatcgtatggatcaaagccatgcaagcatacagttcagatcattctgagtactcaaatgctacaaaactgtatgaatatacccctagaacaagatgaaacaactgcccgtcaaacctagaaacgctaatacgtataggagaatatatctaatatatatagaagtttagtgcacatgatgtatatattaaattaccatcacttatcttagatctaacatctctaattgtttaatatattttggtaaagacatcttacgatagatatagtaataaaatgtgttatttgtaaattggaatgatcaagcagcagaaaccacagcagcctacctctgcggttgcattcttcgcgtccacagaccgcagggaccgcggtaaacaaatcagcaacgaaaccactgcaggatttcgaaaaggtgagataaaacgctaggagccgaggagaacaactgaatgatccaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccatctcgtcgtcgcctcacgaggcgaccagcggcggaccctccgcggcgcaacc

SEQ ID NO: 8927 - DNA, 826 bp, Zea mays
ggactaaacattagtcctatggaaccaaacagggccttagcggggaggaaaccaaacaagcatgcctgaaaaatgtagtattctctttgtggccgaagacaaaaacgatatttatcatcacgccttgtttggatccttagaattaagttctattctaataataacaatttaggcaaagattatttaatctaatgttattttatacaaaatatatttttatactattattagcattagtgagagatatttatgtgatatatttttatagaggagtgagactaaaagcatattataaattgcaagtacatataaattctgttgatacataaaattattttctatactcgtcctcctaaatttaagataggtttatatctaagcttyggaaagtggtgcatataaagataagacttatcttaatacaacaaacagtaaatacagtatccaatgaaaaatatgactgttagctgagcattagggcatgtacaactctgagacgttggtttggtttttcatgtttaaaagactctgtgatacaactctaagtctttagaccataaatacagttaaaagacaatatgtataaagagtcgtatagagacggatccttcacaagttaagacgaaaaaccgtattttttaatctaactttttagagactcctcaaaaaactttatattaaatagggatgtacatgacgaaaagtagagtggaaatggttaagtcacacgtctacggtcgctagagatgaccataaataaggagaaacgaattacagccacttcggcgttccggcccttgttcaatccaaccaccggcgttcgcaa

SEQ ID NO: 8928 - DNA, 1500 bp, Zea mays
tccatgattcctagtggtggttttcttaaggaaccgtctgtaaaaatcgatttctagtagcggttttcttaaggaaccgccactagaaattatttttatccttaattttttgagtttttcaaacgacctcgtatgatgaaaccatcaaaataaaagttgtagatctctgaaagttataaaactttgtagttgacaacttttttatttaaaatcatttcggctctcaaaaattgtatctaaatttgtcaaatttaaaattcaaatgttgcaaacgacctcggacgaaaaaagtgtcaaaatgaaagttgtagaacttaaaaaattattcaaytttgtagttaacaacttttttattcgaatttgtttacgatctcaaacaagtaatttacactcatttgattgtaatatgtgggtaacaaaactataaacyagacacaaagcatgtcataggcggagtgatagagaagggtacgtgtgagggtgaggtcagcggttcaatttctagcaaccacgtagtgcacgaaaaatgccgcgacttgcgacttcgayggagacgagcatgtgggatgtgtgggccgaggcctcccctaataaaaataattttttgctatttttaaaatctgttttatgtttcctgaaaacgattttcactggcggttttattacaccgaccgccagtaaaaaacgattttcactggcggtctttagttacccgtctgtaaaaatgataatttatattggcccctatcactggcggttatgaaaaacgctaatgtaaatagatttacaaccgccactatagaagttctttgtactaatgtgtccgcccttctggccagccgctagctccacgcgtaccaccatccgcggtactgtctttggacccgcgcttggtacgactaggacctcaaagcaaaccaacatagcagcctccgcccagctaaggccatgttcggtttcaccggaatagaccaggatttatttcagctcatcaaaatctatataaattaaagaaataatccggctaggaatcaatccgaggctccaatccctaacaaccgaacacggcctaagtcgttctgaggttcaggacggaaaattaacggacgagcactacgtccatggatggaccggtccgcgtagccaccaccccttgcgctaccaccatagcggtgccagaggtcgcaggttgcaacgtaatacttttccactagcaggccccatttctttccaatttgttagcagccggcagtcaccttgcctattacttagctgtataattaaaaaatcatatagcctgatatgatgggtaattgacaacgtactcgtaaactaaatattagctggctacttcccttgcaacgattggttgtgttgtgtggctacaaatacgaatacacagcagccctctgctctctgcacctgcgcattttgtaaaggtacgaggagcaaggtgaggcaccaccagtaccaaccgggctccgagttcatcacgcacgc

SEQ ID NO: 8929 - DNA, 915 bp, Zea mays
tgggtatttcatacgtgtacacctgtcgtgtttgtatgaatgagttaaggccgagccggccaccaagcctagcacgacagcgcaccaggccccaggtcctagcccaacaaggcaacatgacaaggcaactagcagactagcaaaaaacaaaacctaaaataaccagccatatgttacgccctgcccagacgacggtgacgactatagattctcaggcgccaatgaactcagatggtgaccaagcaaggtgagaaaacttcatttctccatttcttctatcagtcccgaagtacttatgtcttttctgatggatggatgaatggatcatggttcatggatgagtgcttgtcgatgtagtgatgtctgaaatctagattgtttgtgctacatgttagtacctagttatcccttaattggggatggggacccattgggacccgaaacccgaatggggatgggtatgggataagttttgtacccatgatgggtatgaggatgggtatgcgatgctataactcggtggggaattccccattgacatctctaaaagaaacagagaattggaagtctctcgttcaatgggagctgatggatttcttgttatttcatgcagggatcgtgacattaagttgcctactctcggcggacggtgatttgatgctttgcatgtcacagcaactaaagattgagttaataaattctatcaccctgcatgggactcatgttgtttgcaactggtttagcacgaactggtcttgttactattgtgctaatgtatttgtttcgaagtttcagttaatatgctgtggaaaagaatctggtgcacgttgatgttctttatgatctgttgttcagtacattgctctgcttcgttgctacgttaagaatatatatatactaacatcagaaaaatgt

SEQ ID NO: 8930 - DNA, 576 bp, Zea mays
tttcttgaaccaaacatcatcctagagttattagggatagtttggtcctttgtaatatcctaggaagataaaaaggattaaattaattaaaaaacttgaaatcttctatctatcctaagaaattaagaatggaataaaatctacgtcatttatgcggaagcaaggaatgtgagcccgtttcgtcggagttgtatgtacacgagtcctaaataatcaattttctccgtcctgcctatacgccccgctaggccgttaccgtgtactacgactatatgggagtgcggacgcgtgcacaggctgtcttcccctgaaactcaactagccgttggagtcagggcagcggcggcggacgcggctgaaagctgtcgaccgtgccgcgccgcccccaacggtcactggagaggaagaagaaactcgcatttccatccccagccaattgtcgctcgcctttaaatcctgcgccccaccgccgcctccactcccaccgctctctatcctcccactcaaatactcctcaatagccatcgaggagaagggagatagaaacgggagggaacacccactcgatcgtcagcc

SEQ ID NO: 8931 - DNA, 124 bp, Zea mays
acagtgcctagcacggttcatttcccccgtgtggcagactggcaacgacgcgacgcgttgcgttgcgaattgtagattaatttcggttatgggggtatcacatattcacatttaaaggcggtta

SEQ ID NO: 8932 - DNA, 1461 bp, Zea mays
aattgaatatccggagacaatagatagatgcatgcactgccacttgaaacgcctgaaataagcttgctatgtttctaccagatagttttgataaataacatggtcgtcgcctcgtctttcttgtagtactagtttgtaaactaattagcatgcatcagaatcggttgaaattaaataagcttgtaaactgtaaccgtgcatggctccttccttcttccgaattatatattgggatagcaatctatttctcccacaaactaaaaaaaaaatccctagcaaatattgatctatatctagcagtgtcatttgtgatattcttagctcaaatatcaaattatttacaatcgcttgcgtgtaggctgtgggcggcaaagctggtcgctagtttgagccctaagagtgagggttactatatgcaccgaggagataaggcccctgagaagtgggggttcagggcagtccaccctcctcagacacggtcccgaacattagtgtcgtggtatggtagtgtcgagcgccctgcgcggtagtgctactcgataaaaaccactcggaatgaggtaaaactttgtgagcgtaaagatagagataatccaagagtgttctagaagtttgagcactctaagatcaaagacgaagaatcggagtagaaaactcgaactcgaaaaggagttttctcaagaatgtacaattatgttagagacttgtgcacaagattgaattagcccataccagaggtggcatataggttattctaattttcttttgaagaaacaaaacaacctcaagtttgaccaaaactactgaggagtgaggacaccgcaaatatttacggcgttaaacaattagtgaaaatctaataatatttatttggtatcataaataattgtttttagtatataaatttagtcaaacttgatgtgctttaactctctaagaagttttactttccatattaaagtgtggtttttttttaatttaaatctaataatattaatctaacatgcctattagtatctgaaaagtaccttaccaaattttcgaagataaagaagcgatttagactaagttatacaaagttaaaggacgtaatttgggacctaatttaggttacctgctgcggctaattgctcccttgcgagttgcgacaaatgaaggtattattcgtacccaacggcatggtgtgtttcatttaatactagtgagcatgagtatatatacgtaactatctactatcgttcatggacgctatcatattatatatttggcctgatgacgtgatctgacacaagacttctatgtatgcctccctccggtcagtgcgaagtgcgaacttctcctctgcatagactgcgtagtagtgcgtactataccggctatgcgagctggtgcgtaccggctagttttgtcagctaacgggggtggccagagcctaggacgatagcccgatactcgtcgacg

SEQ ID NO: 8933 - DNA, 1500 bp, Zea mays
taaagaaaaagatcaggcgtgtgtsatttagcaaataccctattttttctctatagcgagtgacatggttgatggttttctacaactcaataaaactcgaatttggtggaacacctcgtgaatggcagatctatttttatgtagagaagattcatggggggagttgttggatcaaaaacgtttgactataaaaaataaacgtagattctttttttacctataattaatggacttctaccaaacacgcccacatgcacattttgtggcaatatctctttgattcatggatcgtaccattttttgactctggcttgttcatggcagcttgctacgactttaattcggctacagctacgacttttatattattttatctctatagattgcagttgctgtagctgtggctgcagagcagttgtgtgttatagctcatctcgtagctaaataattccatacaatgaaagcaggagctggcatgttgaggctttattttctacaacaaactactttaacatatgaattgagattaatatgtaaatatccaagcatgttctgagtaattaattaaaggtcatcgcgtaaggatggctcaacgctcaagaattccatattggaatgagtggccccaggtccctaacatactttcatgtcagagttgaaatttccgtcctgggatgcactcatcagtttaacctaaaagttaaccatttcaacacaaaagtttaaactactaaaaaagatatacaatccatgcatttatacactttaacagccctaccacgtgggctagagagaaagacgtaaatttggaataaagggtagtctctgacaagattcgaacttgagtctttgactttaataccatattagagtggacacactaatcagttcaatctaaaagattaaactattgagagaaggtagacaatccacttatacacttcaacgctatctcaatatcactgtggttgatcttcataagtaaatttatttccaaacacttaagataaatttagaagaaaaaaaaacaataacttatagtgaagctaaaataaactactgtctctattccacgtagatatctagcaaaagctatacatatatacacactaaaatggaatgatttattgaatttagaacagagaataactgagggagctgacacactatcaagcatctgatatttattggttgaatcgtcctaacaaggagagcttacctggtaaggatttgattagataagcagcgctgcagcggcatttacattaattaacaaaaacttgcgttggacaaggtatctcttgcatgcgtagctatcagcacaaatctgtacaatgcatcagcccgcacgcattgtgacgtatgctgtcgcttatgttctctctctatataagaggacatgmatggctatctcactatagtcgcagctcgcagcagtcgcgcgcctcctcctacagttactactttcctcaggtgagaccgtgagagggcggaactagc

SEQ ID NO: 8934 - DNA, 234 bp, Zea mays
ggccgccacctccaagccgagtgccgagaagtagaaggacaagatctacatcctcatgccggtcatggccagttgcccaccccggcgcctacgctcgagaagccacccatcttggccgcttcggtgcgaggaggcgctaccgtcctcttcctccgatccacctctcctgccaacccgccaggttgccgctgccgagagcgagcggaggcctccctccgccgacgggggaggaag

SEQ ID NO: 8935 - DNA, 357 bp, Zea mays
agtccgggccgcccccaccttgccgggcggttgcccacccccggacgggacacggggtcccaccgctgccgcgccgtggaccgacagcccagacgtcaccccgtgtccttctccccgtaccactgcgccatgcccccccgccactagctcgcccgagctgtgcaagctcctcgaccactataaatacccccccgccatgccccaaccactccaacccaggcaacacagcaatcagcagaaaaacatctccttggccttccatccatatgatccatccctccaggctccagctaactccaaactaccctctggttcgactcgcgttcgcatcgcaagcagcagcgtaccatcgaggca

SEQ ID NO: 8936 - DNA, 785 bp, Zea mays
tcggtacccctgctatcccataaaggacttgttcagttgcgtctggatcaaagagtaatagaggggattaaatctctctctagtcaaaattaaatataaattgatttaatccctgtaatcccttacaatctagacgcaaccgaacaagccgaaacaggagaagaatcagatcgtataaactctcaaaataaaacactgcttgacagtttgttgctgtccacttatttacattttgttgctgtccaagaaacagattgtattttgttgctgtccacttatttgcatttccctgcaaaacaccaggctaccacagcattggacagagactgctgacgatgctttccccttctgtccagggaaatgtctagcaaaaagggttataaatagttattattattttaattgttaggtgcaatcagagaaacgtactcttctggtttctttatgccattcctgctgccaacgatataagtcccagcaaatgcagtcttctcatggaatttgctaggaggcaggatgggaggtgatggaactgttgcataatccagataattccattgaggcatccaagaagggtatcaacacttctaccttgaggtatgtgcattacccaaccataaatttgactacaaatcttctttcagttgattacatcactgtctttagagagaaaaaataaccttttgaaacaaaaggccagttttgaaactagagctctttgcttgatatttgctgccttcttcatgtttcaaaaaccaaattaaagaacttgttcacatctacca

SEQ ID NO: 8937 - DNA, 848 bp, Zea mays
tgtcttacatgcaaatttcatgagtcatgggctcataaccaatgccactggtacactgttataaggaatattcgtcctagcgtaaagaacttaagtatattaatataatttaccttacacatctaaagaagcacaaatccattgaaaatgataaatttcagttcttaccttgtcctcgatctcatctgttttgattgctggtaaatacattcgatcctttttttaaaaaaaaactgaagatatttttgccacttcaatctattttgacgtgatcatacggaccgccaggcattttttttcgcctttctttaacctcatctcatcggcaattaaagaccagggaaatagtaattgcgacaggcttctctggtcctattggcgatcaggacaacccacctaaaacacatgccaaaaagggctttctctccctgctgaacaccaactaccctgcgccgggtccagggtgcgccgggttctccctctcgctcccacgcggcaaaccccacgacgtgctataaatattccacgaacggcccggatacctccagccccgcatcgcaccctccctggccgccttctcttctccagcgtccgatctctcccactcgccttcctcaccgcagctctcccggctcggtcgcttcgccacctccgtcctccccccgcgctcggtcgctcgccacctgctctcccctccctccacgttgctcgcgcccgcgcttatataaggtacgccgcctcgactctccaaacccctccgcgtggacctaaggtccggcgcgccgagatggagctgatggatctagggtttcggttgcggcggcggtcctgtagtgcaggaggagctc

SEQ ID NO: 8938 - DNA, 432 bp, Zea mays
tgcaggggcacaccgtgtgtccgtgccctctccggtgtcagtgcggtcaacactcaacacacagacagcatgtccatttcatcgcacggctcaccgcatacgccggtcacgtcgacatccacggaaagccgggacccgcccgggtgcggcggggcggggcggggcggggcggggcgcgtgacccaagtgcccacggcccgccctggcacccaccgcaccgccacatccgcgcctctcgataccaaacagaacaagccgcacagtgcggtcctgtcctgcgtagtttgaccacgacgcgaccagcccccgctcctctcctcctcccttgccgaagcaccccacagcagaagcgaaaacggcaaagccagccggcgggctaggcaggcatgcttgcccgctgacgcagctgaagcgaggcgacccgcagccgcc

SEQ ID NO: 8939 - DNA, 236 bp, Zea mays
tacatgaatttatcttagttctatcagtactggctaactcatataggcctggctcgacttctacaccaaccaaacatatagtatgtgatcctaggaacttggcaaaatcaccgccttttgctcgaaataacaagtcaaatgggcccggcgatcgtccacctccctgaacctcgcatcgtcaccggtcataccctgccctctcctaagcctgggcggctggaccaaggacgacgacg

SEQ ID NO: 8940 - DNA, 104 bp, Zea mays
tgtcgcattgaattgcttctcgcggtaccggtcaccggtggaaccaactccccaccacccgcccccgcgcccgcgggctccaggccgagccgaagctaggcgcg

SEQ ID NO: 8941 - DNA, 968 bp, Zea mays
aaccagtaggacttgacttgcagtgtgcatacttggagctccgtcgagcaccccgccctggccctgtagcaggcagcgtaatcaatggcgcacaatttgccgctggggcagggcagggcagggcagggcaaggaagacagacgcaggaacgtggctgaactgaacaatcagcaatcaccttggcgattcggtggtggctcgggcgtgcccaccacgagcctggctctcaacggcacggcacgagcagctgggcaggccgtccttcccaggaaaaaactgccgacgccatccgcgaaatgccgctcgccgccctgtgcaagtgcaaggtgcaacgaatgatgggtagccatgctcagctccgagcaccgtcgtcgcccccatcttgcctcgcattcaaatcgcaggcgggcttggacttgaagcttcgcccccgctgtgtcagcggtcagcgccgcagacgcgacgggcccgccgccaccgccgcccaagacagccagccagaagcaagcagcgccaacgcgattcgcatgagcaacgggcgatgcaacaaccagagcaggagcagcagggcggcagatgtcgatggggaggcagggacacgtcgtcactgggctctggtaggcgcagtacgtacacttgtaccgcccgtcactgcggatgacacctatacgtggtgcgtgcgacggcgacacgtaccgggaacgaattactctcccccctcctcaattcaatgccgtcatccaactctcaccggccccggcttcaatgcgcgcccgccgccccgcccagcctataaacgccgcccgccccatttccctgctcctcctcctctatcttcgcatctggcacgagcagccaagcaaataaaagtagagcggcgagcgacgaccggcctgggccactctttcggccgagcgtagccagcaggtcgtcgtcgtcgtcgtcgtcgcagcacccggccggctagc

SEQ ID NO: 8942 - DNA, 1500 bp, Zea mays
atgtcatagtcctttttatcttccagttatcacaccattgttactatagctctctcgtttctatcctcatgacttccacttgatgcttctaccaaatgatgttgggctccactatgtgttttggcacttatgtgctcgaagattatgccaaggcaaccgtttgtttcatgatgccttaggcatgcgaaattggcatagttttttatggcaatgaccgacgtccattttctcgattaaatgttttctattggctttgtttgtaaaatatgaggcgtcatcaaaattatgtttgttagttttgtgaccaaatattaattagagagaatggtgatgtaccccttcacatgaagacacaactctggcacatatttaatagttctatttgcatatatacaacatatggagcacatgttttttcattgtatggggttataattatgctatactatatattaagaaatattgtgtatgatgtttttcctaaaatccyaatagtccaaaattgacataggagctttatatggcaaagtattaatgtctaatcacctaaactgtgagtagatttaaggtgtgcctttgtaaaactccaatctagtgaggggcaatattaaaatgtcctagtcctttctatcttccggctatcgcaccgttgttactatagcttttccgtttctaaccatgtgatctccacttgacgtttctaccaaacaatgttgggccccaccatatgttatggcacttatgtgcccgcaaattatgccaagacaaccatttattttatgaccttaccttagacatgtgaaagtgacgtagttttatcgacaacactcgacgtccgtttccacaattaaatgtctgttgctggttttgtttgcaaaacatgaggcgtatgtttgctagtcatgtgactaattagagagaatgatgatgtagcccttgatatgaaggcacaactttggcacatatttattagttatattcgcatcaacacaatatatggaacacctatttttcgtcgcatggggtatagttatgctacattatgttaataaatattttagaggttgtttttttataaaatctcaatactctaaagttgacatcggagcattggatatcaaagtattaatgtctaatcatctagattgagagtagattttgagatgtacctctgcagacctctacatccacgaaggagcaatttcgcaaatatactagtcctagctatcttctgcctactttgtaccattattgctgtagctttccgtttcgcctccgtcgactgacgtgtggaccccatcgcacctccctccctctccctctccccccccccacccccacgcgcctggccgcctgcagactgtgccagtggcggccagccaatatatagggcccacgccccgtccgcgctctccaaagtttcgtccaccatttcgctctcgcaagtcgcaagccaccgatttgtttacaggcgccggagctcccgacgacgactgagcc

SEQ ID NO: 8943 - DNA, 1500 bp, Zea mays
tcataataattttatatgcattcactccattctaaaatgtaaagtgcactatgatttctgaaaacttactgaaaaaggtatccattatgttgcacatacttaattttagatatgttttaaaaagaaaaccatgatttaaggagaaacattttacttgggtttaatacatgggtacataaagtatttggatattttcttaagttatctctaaaattttagaatgcattatattacaagaccaagagagtaaaatatagattataataataattcaattgtgatccaagcatgactttactctaaagagacctgtgtcatacacaatagtttattatttgtataaatgctaagatgatctacctattgtggacaaagagactaaaggtgtttggtttccctgactaaagtttagtctatatcacattggatatatttaaataccaaattttaatattaaatatagtataattataaaattaattatatagataaaggctaaactttagtacaatttattaagcctaatcaatctatgattactaaatgtttattgtagcattatatgtgtaaaccatggactaataaactttcatatgtttgtctcgtcgtttagttttcatctttcatctgtaattagttttataataaaactatttaatacttctaactagcatttaaacattcgatgtgatatagaactaaagtcttggtttttggatgcgaacatccctagcaagtacgtaaaataaaaaaagaaggatacattcatatcattgggttcctttttactcattaatgcatatatatcttctaactttataattcatcaattagcagcaaaacaaaatctttaggcatttactcaccccgtataaatttgtatactactactaggcatacagcctcatatccatacagtatttattaaataaattaaattactaatatagcccattcccattgcgtgcccattgtttttgtccgaaagatactgctcctccatcaccggcatcccgcattctcgacaattaaaacctccgccccacccctcctcccctctaatccgcccgccattactttcgcagacgccgctcttcgctcgctcaccgccgcttccttccacgggccatttcgtctccgtcgcccatgctcacctccttcaactctgtgaacccgcgatccgacgtgtagtgccgccgtactgcgcggcgacggcccaccggcgaggagccgccgacctatgcccctcggccagtccggcattggctaacccccaaatgcctcccgccgctaactagccgcagcctgtacatacacagacagacagacatacacaccgtaccggaggttgaagcggagaatcgatcccgacgcttcgccgccgctgtctcgtcgccggagaggagttttagcctcaaaggcgtgattttttgccttgttattttctagcttttttctttcgtgatttttggaccgtgttctcgcgatcgcgccggagag

SEQ ID NO: 8944 - DNA, 851 bp, Zea mays
tgcagtcaattgctctaccactgagctatggaccctttgatgtgagcaaacataaataagaatattagtagcaaatgtacgcagaacagtttcgcaaacccgcggatcctgtatagtggcatactggcatgtatcggacggcggcccacaacacaataatttgccccagtaggagtatagcatagtagtgctccgccaatcaccgacgacgtagtaccttggtcacatgagcctcacagggcggcgaaataaacgcgggccccgcacctcatgtgtggaacccgtgcgcacgcctctcaattttggcaaactgcctgcattagcatgactagataaggcgagcccagcattggccagccccacctgtcattggttcaaggggaggcgggggagccacggcggcggagggaattgtttaatcccccgtcaccgtctcctatcgccatcaccccacccgtcccccttggtccaggcgcaggcgcgagcgcgacgtccggcgtccggcttcggcggcggagtggagcgatcccgatccccacaaggaattccatcgctgtcgtggcgtttggtggcgctcctcccggccggcaagcaggatcaggtaccctcccgtcccggatcctcccaaccgttccgtttcccgcggccgggctggcttagttctgcggcgctggttgccatttcgggccaaatttgttgcgtgaagcggaaggatttggattgaatggcacgcgttgtttccagtcgacgccctcttggcttgcctttggctgtaggaaatcgcacggaggtgaggatacacgggtgcggaacgagagctaggcgaacctgtctggtacctcgcggcggag

SEQ ID NO: 8945 - DNA, 1386 bp, Zea mays
cgaggcatggaggggggagggggctggaagcctagaatcacgaggatggaaggagcatcgacgttggggcgaggttgggcgcgtcggcgtgcaatcgatgttggaaaataacgtgtgtggcgaggaaggaaagagcgcacaatgttgttagagacgatggcttgggagggggcatggaaggaaggcgcgcacatggttagagtcagacggggttcgagtggggcatggaaggacctgtgtggaccaaccgtgtggacgcgaccgatagggggcgcgcggggggagggagggtatgaacgctaacgctaaacttttaatatagtagtatagatatagatggggttacagttaggtatcagtagctcaaaatggataggtacattcttaagaggcgtycgggtatgaatctctagattgaccctgttttcgtcacttcttttccctccacgtgtcccatatctattttaaatacagggttataagaaaaacaagtcacttcatcaaataccataatctaaacatttaatataaacaaataacataaactagaaaacaacaaaataaaatttatggataacaaccaggtttaatctacatttgaatctaaacataaaacctatcattataacttaatcataaaacatatgcatcgacatgtcgcatacaaatcaagagcagaaactaaatatgcgtttgtaaatgtaaataacctatatagataacttactagggatgcaaaatacaactaacatagactaaatcaatgcatataaattgagaaggagagggagatacctgctctcgaatatctaaaaaaatgttcaaacttccaatatggaatcaatagaccaataaatgttggaaggattggggatagtaagatagaaagagagagaaaaaaatggaggatgggcgtggacaggcgtaggacagggaaaagaagtatctagataggtgttggacctcagtactaagatttgtggcaacgatcttaccaccataggttatggcatcaaagttggagtagaagctataggtcatgccgccaccgactctagggtcaaaaaatgattttaattactataaatctaaacgtgaaattttaataaaaatggaactacaatttaaaagggcgcgcgtgtatgtgtggctcgacatgggccggcctacgccgtatcatattttgaatgtgaaaatcaggcccacaaaacggcactcgagcacactaattcaccgagtggcttcgacaaaatagcctaccagtgtcgtcccagccgccgtcccgtcccgtccgccgtcaaacgtcatccgaatccgcgccgcgaccagcgaagaaggtaggaagcatccggaacggagacgcgcctcctgcctcgccttcctccc

SEQ ID NO: 8946 - DNA, 507 bp, Zea mays
ggtaagacgagaacgcaccctgttgcgagccatggcgaacgtagcggagggggacttgccgcgaggcagagctaggggaagaaccgaagaggcttttatgctgcccccatgaaaacccgcccaacgccaggtgcaggaattgactgacggttgagtagctcaactcaacccaaggggcggggtgggacgaggtggcggggtggggagccgagaaggagcaagacgagcacggaggcggcgagggggacaagacgactggccggcgcggcggagtgcggaggaaggaaagagattaaaaaaatgtaaaaacgaaaagtaaagggagagagtgggctgggccgttgcggcgattagttgatagcccagcaaggaagcccaaactcgtcaccgtcgcctccttctattcatttcgccgagaggcgaaagaactgcttcgcacctacgttactgctgaagatccagccggcacacacagacaccatcggcgaagaagaggccggagagagg

SEQ ID NO: 8947 - DNA, 184 bp, Zea mays
ggtgctcccaataacaggtggttcatgctcagaaccagccaacaagaagcagaagaaggaggcttagagaagagtacaacatgttggggtgcagggacccttcatcaagacaaaatggtcccacatcccaatcaccttctcccaagaggaccttcagctcaaggattatcctcataatgatgct

SEQ ID NO: 8948 - DNA, 104 bp, Zea mays
gtaggctaacacgggtgggggagggaaacgagacgaaggggagggagggcgactcgcacttagggacggcaatggacaacgcgacagcggagccctgaaagccc

SEQ ID NO: 8949 - DNA, 1038 bp, Zea mays
ggtagattaccattttattacttaacttataaagacgagtagggagggcaaagggggtgcggcgagcagcgaggacctacctagtatgagtcccgggaggggacgtagtcgacggccgaacaagctgcggacggtgaggagattcgcgtccgatgctcaacggaggcgttggcaggggaggggggacaaatcttgtcgcttggcggagctccgccgcggaggcattgaggaggggggcataggaggagggcagagagggatggatgagagagacggtagaggaaggcagcgccggcgacgggctgggagttagagaggctcgttgcttcagtgggcatggcagtgcgcgcatggcattagcataaggtctctggctcaatccatgtggattgagtgagatttgatgggtttaaatcccaaataagtaaaagttcttttaaatttttttcagtcccatcaaatctatgtataataggaataaccgaacaaggccttataaggaggacatatcctgtgcaatcactcattttggtgcaagcgtgaaatcaaactatccagagcatctaatctagatccaacggtttcatatggaaggagttaaaaataaaataggtattaggtttcaagtgcaagatgttaaatgtaaagtaacagccataattgaatctagattaaaatgtaccagatcgcttgattgaatgtttgcatcaggataagtgattgcataggatatttctccctttaagaaactgttgaagatgctcttaattgcaacgcattttcagtgcggaccggcggcctgacccactaacccgccgcaccgtcgtccccgctaggcgctggcctctggccccttgcggcgcgcggtgcgttacaacttacaagtagcgtcagtgagttacagccagccaaaagttacctacagctcactcccaacggaagcaagaaccacygctcactcactcgccattcggcagaggcgtgactgactgaaactgagcactagggctttgagagtgcagcagaggagggcgaacc

SEQ ID NO: 8950 - DNA, 354 bp, Zea mays
tttagtaggtgaaaagacgtacatatatttgagaaggtaataaaaaaggccagccgaccaataaaagagtgacgtacgtggacctctacttgagcgtttatagctgcgggataaataaacgccggccgaccaataaaaatctaaccgctcctattaaaaagggtgatggcgcttttaccgtagaaaatactctcacgtggccggggggacggactcggactctcggagaatataatccaaccggctcctcccttgcttctcatctcacatgtaatttcgtcctagccaggcttcccttgccctaggattgcgccgccgccgatccaaccggcttctccccgcccgacggccgcg

SEQ ID NO: 8951 - DNA, 1500 bp, Zea mays
gaaaattgttggcggtgtttggaactcagattctaggaaaccagtttatatctttttatacacaactaattacacatatatggactaaaggcgtgtttggaagtactccaatttttaagaacaatttttatcatcattgcagaaactgttttatgggaaaaaaggttgagtgtagatgtttggaacccagttcttaagaaactagttgtcagacacctagaagcgggcgaccaagtacctcaccgagcaagtctaagcgttgaaccaaagccacaaacatacattgaccacaacaatgtgtgacgccagaagcctaggtgataagatacaaacacaattctcatgtcagggacgaccttagcactggagcctctacaatatccagtatggcggaaacgacacgacgccatattgaatggacgaatccatagacgcggaatgacaacatggggcccacgatagcggaagggaatcgtgccctgttagtcgagctccgaggctgaaccatgggacccaccacacatcagcacagggacatcagccacgaacccatcacacggatggggcgacgccatatccaggagcactacttcgtacgatcaggagaaagaacccgccacaacgaatgaaggacccttaagatataaaaagggaaggaccctcttcctctcaacagatatgcacataagttgtaacacgctccattgcaatatcatgatcagtactacattggactagggctctgacccgaaccaatataacccatgtgtcccaagtgattcgtttgagtctcaacaattcaccgtccggagtaaatccatgctagcatttccactgaacacaaatcttattgtttaccggttaccgaaaccacgacactagtttctattatttgatacacaattactagcatactcttcatatatttttctttaaaaaatagtggcaatagatgtaaattctatgaaaccaacaaggacataatataattaaacaaacaaaaacttattttagctagtggagagtagcttcctgtttttttgaaaaaaaactggaaatccaatttctataaacataagctggtatgtccgaatcactctagtttgtatgaatcagttttttaaaattaaaattttccaaataagctctaaagataacaagaactactaaatctaattagtccatgatttagtcctaaaaaattgttaatcattaattgtttagacttaataaatgtatcttgcagttttattttcaactaaataattaattttataattatacatatttaatacgcgtaataattattcaaacattattgaagccccctgcaaccaacaccgcaaacagagctgccaggagtccaggacatcaggccccagaaaaaagtccgaacgcatctcttctttctactttcttgtaacccaagacgaactcggtgaactctttctcctcgcgcagcaccggagcacaatcaaggattccagtccagtcctgcca

SEQ ID NO: 8952 - DNA, 764 bp, Zea mays
caccttaagatctctggtttttttcaaggcgtacaatttcagagggtatcattttaaaatacatttagttattcataggaggttttctcttcctaggcttggttcctctaactcctaaactagccctaaatgtattagtagtatcttagagaactctaataaaagaaggaaaaactaaactaytactagtaatggaagatgatctgttcagagattctttagctactctcttttaaacgtgtcagtaagggtgtctctaatggctagctattttattagttagattcactctctttcctacgtggataaaaaatatgggaaaaacaagaatagctagtgacaagcaaatagatagaagatatcacgtatttcaaaaactatatattaaatgtaagatcaagtactagtggtgatataaatttttatttttatttttattttagcttcatatcaggagtcctcgcacaacttctcctcttcttagcctatccttcgttgacaggtggctccggaccccgcacggcctgtcgtcacctcttcggcgcctgctccggtccccgcacctccatcgcccccgcccggccccccagtgtcggtcttgttttgaactaggatggttaatggctttgccgctttgggcaacgcgcgggcagtgggcactgctgtaccaggctataccagcatcagcgaagagccggcgttcttgagacttgagagaggagagcgaccgacgacctcgaagcttggcctgcgcggtggtgacg

SEQ ID NO: 8953 - DNA, 730 bp, Zea mays
ccctggtgcgctatccaaaaagagtccgccggcttctctggtgcgggctgcggggtgcggtgtttctgaggtccgccgcgccgcgatgaggcgaatgcagcagtgagatgagatggtagtgatcctctactcccagaggtgaggtgcggctgttgctgactcgcacatcaggctacatcattttacttatttatttattatgcgctctcttattcagcctccagttccagggaaagtcttcaccgtacttttctgcattgtgttttatcaaaagcaagcacgatcggatgtagatggtgctctctctttttaggtgggtgcgtgtgttttatgacgtcatgatccatgtatcatgtaccctcgatgctgtcaatatgtgccttttggacaaagcatcgagcggatacaagttctgcagatacttcatcgaatactttctaatgcatataccagtaggagtattttacaacaaacatatatgcctctgctacatgcctacacgcaaggaaaaggaattacataatgtgccatatatagagatcattcatacttccttgcacttggcacttcgagtcatgtgctatcttgctttcccggttcttctacgcgcaggcaaactataaattattatatttatataatatgcggaggactctttatattatatgattttctgaaggcccgttatcgacattcaggtgcaggtgtaaatgcagtcagaaaattcggc

SEQ ID NO: 8954 - DNA, 1171 bp, Zea mays
cctctgagaaaaaaaaagacaaaaaaactttaaggctgtttagtttcctccaatccatatggtttggaaaggattacgtgaaatccgtagcaagtgcaaatacttcatttttttcaatcccttctaatctattattagttttgatattggacccccaaccgtgacggttcggggagccagtgttgttgcaggcacgtacacgccgcaagatggactggtggagagtgcggatatgtgtttcttcgctttgtttagatgatactacgagttgaattttgttatatacrtaaactcgttccagtcataatatatgctgtgattattcctacagttcaacagttgtgtggtcaaagttctctatcgtccaaaggatgtgatcagatatatctccattatcttaaaaaaaaggcacgtatatatatatatatattgaaaacccaaatagaattacggatctcgctatgagcaatccggcttctttcggtatcgaccactgaattggcacccaatgatgctcacaaagaataagtacacacacctaaggagcgttcaaagtgtatgggtgtccattaacagagcgaccaaagcccgcatcgcctgagaagggaatgttacctcacctcttacattccctctcccacagcatatatccctgtcgaaaatgtcattgtctgtgcctgcgtggagaggtggagaagagagaggcctgtacgtgctgggatggggtcgtcgtggtcgtgggagggagaaaaagaaagcggaaagcaaaggaaaaggagatgcatggtgtgggagaaaagaccaatctaggagtatatatcttcctccctgctagtgctaggccacctccctcccaacaacaagccaacaagctagcctcgcctcgcccccgctctctccgcctcagcccctcccttccctcaactcctgctagctctctctctctcacacacacactagctggagtagcaagctagctaggctcctcgcttccaagcgagaattgcggcggccctcctcgatttccatactcgttcccccaaccgaaccacaggcacacacctacgacgcggccacaccctcctccgccgatcccttctatatacgacgacgacgacgacgagaagatagacaccaagcagccggctttctcgtcatacagaccgagaga

SEQ ID NO: 8955 - DNA, 799 bp, Zea mays
tatagatttgtagcaaaacacgaacaaatggctagtccatatttatattcgtataggctaatttaactcatagacacagtttattaatcattagtttaactcataggtcatatatatcatatatatatatataacatgtttatcgattattatgtaaataatatatataaagttttattttgttgtaatgtgatagcttgtttaggtggcgagctgtcttgttaactaaccgtgtaaaaatttaaacgagcagataaatgtcgagctgccacgtactcacggggaagtatgcgtatcgcgttttgcaaggcaagaaagaaaggggaaaaaaaagcctcgaaccgaggagctttccggacgggggcggttcctgctcaatcttccccttcgtttattgctcttctccggtccttctccgcaacccctggccctgtcaagcagacgcagggtgacaccaggcagcagcccacctccacgcgaacacgccgcaccacaccatcaccggcaccgcagcacggcagccagtcaccaggactccaggagtgatctttgatccccaccaggccgccacgctactgtcggtaaggccagggaccctgctgcatctgccggctgctcctctccccgcccccggttccatgagaggtcggcggtttcgataacacacaccaactgctccctccactccttccccctgccttcagtccttcccgcacgggccgcaccactcccaactcgtaaacgctgtgcgccaacgccgtcgcccttccggatccgtcgtccttccgccggcgccgtg

SEQ ID NO: 8956 - DNA, 1500 bp, Zea mays
cattgaaccgtgaggtatgatctaacgagtgagcatctagtagactgatagtcatgaattttgcctagagctattgtagcgactacttggtcgattggagattataaataccttttgcccattttaataactgaagtaacacataaagagtaaaaaaaaaaatacttgattagcagcatcattagctcataagatagtgattagtgtgcatccatgcatatcattaaacctggtatccgcacagcttcagaagtctaacctgtactacgagtttatttgggcacatgattattggtgttattagcacataagagtttggataaatgtgttaactgccactttactttgatggaaacttgattcgaccagaacaggaactgaaaattcgcgacaacgaacctgaagcttgggcaggctcgttcgactgtctgaactgccccataaagggttgtttggttgcattcggattggaaggtagtgaggaagattgaatctcttttctatctaattttaactagcaataatggatttaatctgtttgaatcctctttatttaactcgttctaatatggctatctggcttcctagcccaagctagagaatgccgtgcagtagcagctctctaataatgaataatgcgatcacggccggccagtttcccctccgatctctatgttcatacttcataccgataccaaaaaacaaaacctatctatcagtaatcagtcaccgcctccgtttggatgattacacgatggcgttgacgctaagtcatggtttttaatttggatccaataacggtaggttgttttcagcatcaccgtggctcaaatattaatccgagagatgaaacctggtgggctttaataattgaagcatattctgccggatcggccaaaccggtgtaccccgcctcgtccctcgatccgccttcaatcgttcacaactgaaaactaccgccggtcgcgacgacaagtttaatgcgtcctctccgggtcgtttcgcctggggttggcgcgcaccgccccgtgcacgtgtccgtcctatcgacgacccgcctccgcctgcgcgttcggttgagacgttgtggcgcgtcctaaagcgatacacacacagatggtggtcccccatatatgcacacggctcaccgtgtactaaaaaaaccacacaactagcgctgcctgtgcaccacatcaaacccatctccttccttgtgtcgtataaaaagcccgggctctctggtgatcgatcgattgatcgcgacgcacggacaaggagagggatcgccagctccgcccgtttccgtggacgcagcaaggaagcgcggatggacggatcggtctcagtacctccgctcccgctgcgcgatgcgtccgtcgcctaattgccgtccacagcaaacggaggagacgtgccggtgccgccgccgcgccggtgcggcccgcccggcatataacaaccacctgcttctcagcagccgctagctccagcctactcacc

SEQ ID NO: 8957 - DNA, 1488 bp, Zea mays
tgcgtagatactaattggaatgccttgctataaggtgctttatttgtcggaatcccaatttaattatgatggtatagttatgctagagagtataaattaggtacattctagttgtattgacgtgataaagcttagattgaagtgtagtgtatgtatcgggtgttctagtggatgtataagtctagcgttagtaaattggtttgtgttatgtgaatgaaattattttcatgagtgtcttagaatcgacatatgttggggttagttctacgctttagtggtcatagtacttgatatttactaatcgagtttaggttgaatggatgtatatgcgtagtgtcattagagtagttcttcatttgcaatatgaaccttaagatgaatatgcaactcatacgaagtaattgtgtgcatggttatgaagtatactaatctatctatgtgattaactaggtggttttagctctaatttaggacgatgtgtcagaatagttgaagtaccaagcacatggtgattgtagaagccaaataggagctaaattgaatatattactgtttagagctataggtatagtgtttattgcgcagctaatttaacaaagtaaaccatgttttctatggacatgttatataggagagttgtagctcacttccttatcttgcttgtgtaaaaatttcatgaccataggcttagcagtttagaagttatgattttcccaagtccagtttcagaatctgtccagattctgtactgatttcgaaaattgcttatctgatcctcacgctctctctcctctaatgtcggtgtttctctctctagggttgtacgcttgtgccgcctgtagatattgtgtctgccgtgtgagggaatcgcgccagcttcctttgggtttgggactgtgagctccatcgctctatggtatgaaccacctgtgtctatgacaccaatgtgtaggatccatgtactatgtcctagattaattagcagtgtgtaagatccatgtacttgtcatctatggtgccaaagctatgcatgcrcgcaacatgtgccaagctactctgctatctttaaccctacaatttagagtgtttggtacttgtcactgtactctcagctacctttaaccatttagtgttctgattttgattgatattaggttgaggactagattagttctccataaattagatttgctctattttttatattgacatggagaattgcataaagttgctgtcagtttggaacttatggtgttttaatcagcaataggaagtaggtatggtcagtcttagtctgacttgagatcaacaaaattatgtactggtttcatccaacctaagtttcctctacaaaacaccgtagagcatcgttctatttttactgcttccttcggtatgtggtcaaattcagcgagattatattccctgtcaatttcattgtttgcagattcagggcgctaacagttcctaagggaagcttctagggac

SEQ ID NO: 8958 - DNA, 1500 bp, Zea mays
aacctagtgtaggtcaagtgaatgatctagattaggcaaatgctagattcaggctagaagattcaggtaataacctaacttgtgaagtaaaacttggcttaaggatccattattagtaagcctgcttttctgcaaaaaggagtccttgataattgatgagattttccttgagtaccaaatccagcatacccttgagagtctttactttagtcgggtaagtcttgtcgagtaattgcgtactcagggttttatcccttgttgtttttgtaggagaggtttattcccttatcttttgatcagttacttcatgtggaggacttgaagcttagaatgtttttatatatctcttatggaaaggcttcacccttccaattattgtaataagttatgcacttcgagtactatcagaacttgtaataaatacatctctttctaccatgtaaaacttgagatctggaatgtaaagtgtactttgtaaaaagtcttccgctctatctccaatgtgtgtgtgtcaagtgtgattactgtaatatactgttatgtgggagatccttgggatgatgagttccagttggcgaactcgatagccttgttaagttacccggtacacatgcacaaccatctgaggccagtaaggcaaggattggtgcatgtgggcctgataacttgggaggctgtcacaacttagtcctttataacttgtattacgatcatgtgtaaacattaaggacataaatgtaattttgctcgggctgcgtctcgtgcctataaatagatgaacagtagcaccgtattattcaggctgaattgtatttactctctcgcatcctcaccttcgagcaagcaggaggtattaatgtaatattaacattgttggtattcatacatgttttatggaatgcaagaataaatgaattgttaaaatatgatcatcatatttaccccttcacgttctctatcatatactaatatgatgaagatatgtccttctcgaccttcgtctgatgagcattatatcattaaaaaaataatgctttgaaagacgaaggtctttaatacttaacaattgtgttgtcttgttctttattaacagtatttgaaaacaagtgaccaacaataataatataaaataagtatattttacccacgggtacacaggtataggtagtgcccacctgtagtcgtacccgtytaaccaacagataaatattattgcttattaacgtactcgcaggtataaaaattatattataccgtctttatatcgaataaaaccgagtattcgcgtttccgtacctatcaccatctcggactgcgtggcacacagctgcgttctttaattacccacctaccacaggtcccagcatttgctgcttacagttacagtcgtcactggtagctagcgactagcgagtccacacggagacaagatgtctgggaatgtgaatgtcgtcactcgggtgagtccacttccactcaacactccacagagtcaagaag

SEQ ID NO: 8959 - DNA, 1500 bp, Zea mays
cttttttttttctttctttcactgtttactgattttggagattactaacgcacggttggcttcaatgcaccggagatggccggcctgagccgcctcgcatccccatcccgccgacgtgcgcgtcccttcgggtgggcgcgccgtcgtcggatgggtgctgcgcggtggtcgaggcccagtccgacgagttaagaactgcggcactgttagccgtcgcctgcgaacctctctctccccaggatctatcctcaactcgatccctcaagtgattttgtaacgggatcgagttttggaggtaaagaatcatagatctgggtcccgcgatatttctgttattttctgtgatgattttagtgcatctgtacacttttgattcacgtggtttttgaaaaaaattagggttctaaccctagcttcgttctgtacgacttttttctgatctgttcttgaccgtttattaaaaaaaatcacgagtacctgtttacaggtgtaccgattagggttaggtcataaatcctaaccctagacagttatgtgacctctctctggtttgaggctgagacacactgtgtctcttacagtggtcaaacctaaatctctagggttagggaaaaccctaacctgagagcatcgacttctttctgttctattatctctctgatctcggtgatgaacaataataaaaaaaaataagctcaatcacattaatcgagacctttctgtgatctcataaaactgatgtggattaggagttctagggttcttaggatgcctctgataccattgttagaatctatgctgtctaggatcgattcctaagtccctagaatacaaatccgtaactgaaagtaaaaccttgatgacgtgtagatctgatctactgatctactgagaggaacggggaaacataccttgttgttgctgttgctatcttcatattgttgccctgcagagaagcagcaggcatcgtgatccgagccactgtctggttgtcgcgtttccaaacacttcgacgcctaggcgatgggggcctctcggactagggtttttttttggggcgaggtactagcgttaatctttcctgcgaccccttagtcctatatatagcgtcgtgtgtctgggggctccaaccgaggttagcgtgggccctcccaatcaagggcccatttaaagagatagatagttgggtttagcccaatccggtcactgatgaccagctgtagaggacacacccaacaataataataaaaatgcggcctaggcgccgtgtactatgtatgtatcgccgtctcctggctgacatggcactacactataaaaacgcagccccggcgcctaaacccggcctccttcccatcccaccaccaccagctagcccaacaagagaaagactgagagagagagagagagagagctccactgcaccctgcagcaccctgacctaaactggtccctctctgctgcctccgccccaccactcgtctcccaccgagcaatagc

SEQ ID NO: 8960 - DNA, 1183 bp, Zea mays
agtttacgtgcgtattgttgtgagccgtcgcaacgtacgagcaactgactattgagtctttatacatatgttaaagagttaggattgtactctctccgttccggtatataagacatgactaaatttagattaaagaccaataaatgtatttgattctctctatatcactatatcgatatacgtgtgcatagagacaaaaacaaaaattaattatgccttatattttagaaagaatggagtattattcagtttttagttgtttcttaatactttgaaatgtgagtaagagtctcagggttgtaatgccttgaccccctcgttcattgaacaaagcatctccatacccccctgctacctaaacccgtctagattcattgcacctgctggtcgtttgaactttgaaccgagcggcaagcaaccctttctccgagccgcccaaatccgtacagcgcccatgcccttctcacgtgcatgcccccctccccaaaaccgcacacacgagaggaaaaaaaggggggctcattttcctacgagatcccgtggaaaacggccgggtgcggcaggagaggccggggtgccatcacgtgccggtgaccaccgtcctgatcctcatcccctcgctcgctgcgcctgacctgacgtgtccccccggtccgtgtgtgtacgctggcgtccggcgggatataaaggcggtcccgcacccacctcttcttcctcctttttttctctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccaggtaggtgaatggtgattgctgcaaccgaccgtcttcgatggacggggattcttcggtggggttggattggtacgcggtgtggcggtcggattcggagactgctctgcatactcccgcgcgcgcattgggttttggtgtttgggatttcattttctcgagggttccgtcttcgcggtggcaaccatggttcggattgggacggtggatttttgaccctcgcctctgcatctgtttccgcagggggatcggatacgccacaggctgcgcg

SEQ ID NO: 8961 - DNA, 819 bp, Zea mays
tgcagcttctgtcttctgacaatcgtaaggcctgccaataaagtcaggaaagtcactctttgtatcatttaggagtagaatagataaactatgagtattattttccttttgctttcaatctaagccgggctctggtcttctctctgaaaaaaaagaccaatgcaacaaggtgtttgtgtttaattatgcagccatatcgctcccaggagaatttgtagttctggacagttaggttgcataatctatgaataaattggaataaaattcagttttctgaacatgtgctcatcaggggggagaataaaacaacatgaaggatgcatatttgaagtgggcaatgcaacaaaaaaaagtaaacattactgtagcacgtagtctttcgcccatataatactttcgccggctgccatcccagattattaaaaaaaatctcttctggtgtatttggtgaaggttccactatggattgatgtaacgcctttcgtccaactgctacatcggccattcgttccgcaatactctatgaccaaagcacgttcatccgccgcaccaatgcaatattctgaggggaaaaaaatttatataaccattttgcagtttgcagtcctcatccatcaccatacaaatagttgtggttttacgtcccgaatgaatagaatttttaacaacttgcttgcgtagtgtaccagcgcatttaacaagtgcagagcaggagtggcaaagctcgtagtacatcacgagtgctccaaacaaatagagttttccttcaccgagccagacccagaagaaggggagccggaggtagaaagaccagagaag

SEQ ID NO: 8962 - DNA, 378 bp, Zea mays
gtttcatcagcgaaagaaaaaaaaagaaagagataactctgaatagtccagctagcggtatgcgattgcgacttgaaattacaaattagtgcttgctatctgcacgggaaaactaaaatatcgttttcagccagtcggccatgcaagtgaagccgtttgtataggatggaaaagaaacaccagtggagcgcaccatgtttcttgtttccagccacgagaagagaaccaccgcgcgcgagctctgtcgtccgtccctatataaacgccgcaccaccacctccccagcttccaagaccagatgccactctgagcttccgattaacctccagctctggtcatcacaattaaaacaaaccgttcccgcagctcgtgccgaca

SEQ ID NO: 8963 - DNA, 175 bp, Zea mays
ggttagcgtctcgccgggttcttcattgattctgtcacgcgtctctgcagattcctacgcgtcgttgtttttggctgcaggcgtcaacatacacagcggcgaggaggtggctatcaagttgttattagataatctgatactgttcgtgcaccatttttctctgtcgtggagttat

SEQ ID NO: 8964 - DNA, 124 bp, Zea mays
accacgtacagtacagtaaggatgcatgcgtgttttgccatcgtggagcttctttccggacagatttgtttctaattcatcaatcgaccagttcattattcttttcttcgttttataaaaaaag

SEQ ID NO: 8965 - DNA, 429 bp, Zea mays
cgacgtccatcatcgtcacctaattaaatcacaactagtgttcactcgcaggcggccggggatggtgagagatccgatcgatcgatcccagtgcagtgcaaccctcggcggcagaaaccccacaacgccagtggagttgctgctccgtgaagcaaaccaccgcgacgcgacgccacctgctaatcaacgtgccatcttccagctcgacgtctagctaagctagccccgcctccatggcagcatggcaccccaccattcctctcttcatcccctcgctctcgctcctcattatataaataataacccacactcttatacctccattgcaatatatatgcatgcgcatcaagatcaagaataatccagcgccacacgggatcgacctagtacatagatacaacaagtcaacaacgtactaactagcccacc

SEQ ID NO: 8966 - DNA, 77 bp, Zea mays
tgcaggatggcgatcgcccgactgcggctgagccggagagcaacgaaccctgacaggcaaccgaaaggcgcagagag

SEQ ID NO: 8967 - DNA, 359 bp, Zea mays
agcactatactttttttttataatttttttatgaaatgtaacagcactgtactctgactgaaccccgaacctctgccgaccgacccccgtgattaattcggtctctcgaaacccgtttacgccagcccaacaaccaatgtcggttcgccaatgtttcggcctggcccgcgatatattcgccgaacccctcaaagcccacgcgggagttcggcacgctgcatcaaagccgacgcaccgcagactgcttcgctgaatcgtattctcaacagttctcaccgcgacaccgcccatcctctctccgacatcgattcgcgccgagccgccgaccacctgccgccgtctcctccttggtcccagcc

SEQ ID NO: 8968 - DNA, 925 bp, Zea mays
cgtaagtgaaacgtggctttcggtcgaagacaagcgtggcttcctgtgtacgactgaacgagtatgattcaagcataagcgtggttaaatcatattgcgtacaaatatttgtgaaattgttataacggagtactatggagaagtaaagtttgccattacgaaattaattttaaactgaaatcttgtattacatcttttccgtaattgaaaacaaacaaataaaaatatttttttttcattttttttaaaacgagcgcataatgccgaacgtatgaaaacatataaaataaatagaaattgaagttggttatgttagttatatggaaatgtatatttaatgagtagagggatatataggggaaaatttaggggaacggttgtgagacgagtgaatataggagagagaattttgctgacgtggctatataataacatttatggggaaaatttagggagaacagttgcagatagtgtctcggcccaggcctaactgtagcgggagcggagagccggtccacgacccgagatgatcagctgggcccaccactccgggagagccagacgcgcgctgcccacggcaactgctggcctgctgctgcgcgcagacgggacgagacgggagccgacaagggcgcaagtcccaaagccaaactccccagagcaaggaggtggagaacggacggaaggaggagaggagagagcccaccacccgcgaccgagaccgcgaccgcgacctaacccggagacctccctaggctagctcccctcccagaccccaggctctcccacccacctttcccctctccctccctcctccccgtcccacgccgccgcacccccgcctggctgcttgggtggcaatcggccgtagaggaggagggtgtaggagcttgatccgggccacctgcccccctgcgccgtcggg

SEQ ID NO: 8969 - DNA, 320 bp, Zea mays
ggctcgaagactgcaggcatcggacgcgccccccgccgagaagctactcgaatcccctccaaaattcggaggcgagagccactgatctatcgcaaaacccatcaaattacacaattcaaatcagccaaccccacctacagccaccaattcgtgcgcatcaagtctagccccctaccccttcgcaatcagtgaacccccaatccacacacagcctgcgaatcgctggatcaaaatttggtctcggactctcgatccaccattccccgaggaaggagatctcagtcaaccgaataagtctcgggaagctctgtgttggaaac

SEQ ID NO: 8970 - DNA, 574 bp, Zea mays
cactctggactacgaggagaggagtttccatggcacgccacagaacagcttccacaaggcggtcaacctgcctgatgtcgtcgtgttcccgaggtgatgatgcttactaagaactccagtggtcatcactctgttgaaatcaagggcttgtaggagacgttatatgtttcaagcgttttgcctagaatggtctctgacttgtctgacccatcttacaatgtcatgtatcggcacttgatgttgggatccgctgaatgtaaagcctaaatcctccaacaggtcacacgaatacaggatcacacacggacacaagtgrtttggtgattggaatgacaaaggcaggctgtgatagcctcctaataaatgcagaaattcactcacccaattagcctattaatccatgctgaagtttagctaaagtaaatgctatgaacctagacacacatgattatttacgacactgaacctgctccatatctcaagcatgtattgattgaatgatctatttcttgtaatgaagtgatgccttcatcgtctattttgyagctcgcaagatgaggtacaaaggattgtg

SEQ ID NO: 8971 - DNA, 513 bp, Zea mays
agcctttctgacggcagaaagaagagagagaaaaaactgctatagacagtagtacgtatataaaaatagacgttgcactgcgaaaatgcgaagtgattgttaaagtaaaaagtgacaatcttctgaaataaaatagtgtgcgtacgaccattattgttaattatcgcatcttgccgatcatcgcaggcctaaaatatactagctagtacttcaaactgacgtcagcacgtcaaacaacaatatattttgaagtacttactgtatgtatatggagatgaggagcgcagcagccaacgtcgatcgatttgatttgcccataatttaattagcgccgctgcctctatttactgcagcaacctcccctgccacccactgagacacatatcctgatatcccttctcaccaataaatacatggtaggatcccaatgctatatgctactcgactacatactgctgagtacatcagtactcagatagcccaagtcggaccacactgcttgcacagtagaag

SEQ ID NO: 8972 - DNA, 1500 bp, Zea mays
ctaagcaaaaagaagaagatgaggatttttttattttaaagagggggacgaaatgtctccaccttgtagaaccttaaattaataagaggggagggggtccagcttacaaaagcagcagtatcaggtgcctaagccatgagaggcaccagcttacacaaaactagaaaaggaattacaccagtcagcaatgtggtcaggttggccagctacacaatagcactgtacaacatttttggcggccgccgttattttcggcggccaggacccggccgccgaaaataagcgtttatttcggcggcacgaggtggccgccgaaaataatactatttttggtggtctggtaacagggctagccctagccgccgaaaattagatgttttaaaccacgcggccgaccttcttcttcattcttctcatgttctcttctcgccgagccgctgcgtcctccgctccgtcgcgcccctgcctcggcccaccgcactgccgagcccgaccacgtcgaccgcccaccgtgtcgccgctatagatggccaataagcacgaggcccacgagctcggtacgaagcccgctgtttgggcccgatccgagcctggcacgaataagcgagccgggctcgaacaagaaactaggcacggtaggctagcccggtatggcccgtttacgtctaagcccgttaaacccattttttgcactaaaatgtgcttaccggcctgcttagcccgcttttcggcccgctttttccgttctaaacgggtcgacccgtttaggcccgctgcggaccgggcttggacaaaaaattgagcccgcgggcttagacggctcggcccggttttctaactgtgcctgcgggccgggcccaaaacgggatgggcttcaccgggcccaggcctggccgggccgggcgacccgtttggccatctctagccgccgtcgaccggcccccgcgacctgccccaccgcacagccgcgccgcccccactcctcccccaccaagaggttaaattttttttttgcgtattttatttcagattttcggcgaccgttatttaattgccgccgaaattagtatatatttgtaattgtgtttgtttgattagcgtatacgattagtattattatttagttcgatttcattaatatattagtggtatatgtggtttagagattaggggcatattgtatttgtggcattaatttcatattaatatgtggtactattatattattagttttataagtacattatattggtatggcgtacagttgccatattagtggtatgtggtatttagtctgatttgattaatagcatatcattctttgttttatatataagtaatatattgtttagtggcagcgaggttatgctgccgaaattttcttcgggtcctgctagcttgtgggtttagaacctatccttgcctatagatgtaggactgatacccttaacgaagttgaataatgtttttacgatatggtccggtttaaccgtcttaggc

SEQ ID NO: 8973 - DNA, 251 bp, Zea mays
gccattcgaggaacggaaaaaaccgttttcatttcgaattttaaattcacgaggggctcgagcgaagttttgggtggatttttgcctgagcctttatatacctgggagagggaccgacagcggttctttaccctgccatttgtgcttccgtccttaccttctgcctttgctttcgcagcctgagagagtagacagagagaagagaaaaccgcgcacctcgtcccctccgccttcactgcttccgctcagca

SEQ ID NO: 8974 - DNA, 119 bp, Zea mays
aaacggctccggctctggtttctctgaaagagcgctcctccgcaggagccggtgttttttttaattgtttggcaaaacagattcttttgtgttttttatttggtgtacgagacaagatt

SEQ ID NO: 8975 - DNA, 1500 bp, Zea mays
atggcagcagcgtagtggtactgtgggagtatagatgtccaataagcacgaagcccgcgagcccggcacgaagcccgttttttgggcccggtccgagcccgacacggcccggttatatgcgggcccgggccggcccggcacgaataagcgggccgggctcgggcaggaaattaggcacggtgggctagcccggcacggcccgtttagctctaagcctgttaagcccgctttttttacactaaaacatgcttttcggaccgcatagcccgcttttttcgtgccgtttaggcccgttgcgggtcgggctcggacaaggaattgagcccgcgtgcttagccggtccggcccggttttttaatcgtgcctggcgggccgggcccaaaacggcccgggcttcaccgggctcgggccgggcggcccgtttggacatctatatgtgggagtgacaagtgggcagagaaccacagtctctcaccctcaggcgatcgctggtgtcgtctggtgtcagtgtcaacagcagctcacgtacgcataacatcactgcagcaggtgcatccatctatctcttggctctgaaccgagctggcagctggaaaccagacacgtcaagcggcaacggacggcactgtcatcatgcagcgcgcatgcatgggcatggctagcccagagactgagctcaaactcacacggacacggcagcagagcacctctctctctctctctctctctctctccacctgcaacggccgaggccacaggccacgcacgcaattgcatagctttccagatacaaacgctggcccaaaataaaccgaaagcatcggcactgctgctagtgcaagtctaccaggagcactgggatacatttcagcttcatctcaccgattaggagaacacaccatcagttttcttgcatctttctttttttgacacaagtaaacccagcttttgtagaaagcaaacagctagcgtctggattctgtaaccatctcctcctacaatcgtatagcgatttgcccggcacatccaagccgacgcagacaccacagcagcgacaagttccctgctgctgcttgttcaggaagccaagggaggagaagaggagagcagagcagagattcggaaatgctatgtcgccgtctggctgttgctgtgcgcgcgttcaggccgccgtagctatcacctgtcaggctatcgcgtactacgtccacggtgacagcaccatgcatgcatcgggtatttttattcaggcagtagtggcctgcgtgactgggtgggagcggatcgagcagaggggtagacgaagacttctcttcaccatcccacggcacggcacgtcaacacaacaaggcacagcacaggctgcctacctgcctatatataccagcaccagcacgctcctaccacgagcgatccagctttgctttgtagttgtagcgctagcagcttaactggtctgagctgaggctagctagtcgtgcaggaagaggaaggaatata

SEQ ID NO: 8976 - DNA, 147 bp, Zea mays
tacacgcaggtcccacaaagtcataacgagttctggaccggaacttctaaagaacagatacgaaagcctaaaggccccatacagcccagaaggcccaactctgaatcgctcacagtcacatctgatccgctccggctccgacgacga

SEQ ID NO: 8977 - DNA, 621 bp, Zea mays
  unsure (1)..(621): unsure at all n locations
ctgacgtcggtgcgcgagatgctgacgagacacgcggggctcgtcaaagttttacatgatggaatacacgatacaatacgcggctcgcgctttcgtccgcgtccctgtcatcacaagttcagcgccaacccggcgcggacgcgtgaaaattccttctagaacagcacgacctgtgccgatagcaacggtggtcaatggtcgccggggagggggagcacccncccctttcctctagccttgcttggaggggagccgcgggatctagctggctttccccggccggttccttgctcacgtctgataggataggataggagatcgaaacctgccgccgctttcagctagtaacttgagtcgattgtttttcagctccatgaaacggcccacgacagcccatgagtgttgcctgttttcagttccaaaaacaaaaatcgcaaaaaacaaaaaaataaccgctatgggccgagccgactgctgcctcgcatcgctccacccgtcgcgccatcccggcgtgccgcggcagacgtgtcgacagagctggcacgtgccgtcgcggggcgcatccttataactcacttccttcctcgccagccactctctcaggctctgcaagcgagcagg

SEQ ID NO: 8978 - DNA, 254 bp, Zea mays
ggataatatattaatttcattggtaaacaaaataaaagaacacgaagctagttccaaagttcaagctgaggcccaaaagagtgaaattgaagaccttcggagacaattagcggaggccaaagaaaaatgcgctgttgctgaagctaatcgagatgccagcgaatattggaaaagttatttagaaaagacagttgcagagcttcgcgcctccaaggaaagatgttttaaaaaaatctgtggagtgcgtgaaaaag

SEQ ID NO: 8979 - DNA, 841 bp, Zea mays
caaatacctatatcaaaaataaagctcaacatagttcagcatagtactacgaaaaccaaaaaaccatttttaccatctacagaaagaaaaataatcgtccttgatggaagcaaaggtaaccattctttttttagcgatcagtttgcactatgcattttgcattgtatataagagtaatagacaattgactactacaactgcatccatataaaagagatccaaagatgacaaaataatagtgaaatcagtaccggtttagaagttgacgttttggtgggtcagaaaatacgatttgtcccaatagagctctgttaatttctccactttccagcaaaatatcattcccaaaggcttttacaatcttcttccaacctcaacattctgtttcctagattttctcctcaacattctgtttcctagattttctcctcaacattcatttttttattgtgttgatttactcaacaacattcataatctttttgttgttttaaatgtataattctttgagacaaacgttcttgtgatttttaatagttttgttcttatttctagacaatttcatgaagtattgtccagaaccagagtctagggattcattgaatctattaacaggaaaccatttctattgtttgggttgaaactgctgatgcttgcaattggtttggttttgaaatctagactggtgggttggattggtttggtctttgtgcatgaatagaacagtgcggtgtggatttggcctattttttagactattagcaggcttaaaagtgragatatgctactgtggcctaaggtttactgtgcttttgtacagaaataaggggcaagcgagaag

SEQ ID NO: 8980 - DNA, 659 bp, Zea mays
gcaggatgtgcatatcctccataacatggaccggagcagccacatggcaagtaggcaccaaacgtaacaaaagtcgtcaagtccttccgtcaagtggaggaaggtgatgcaaaaaaagttgtcctgtgttttttagttggtcaagtttttattttagtgttttgttagaaaaactgttggagtatacaggtaatatacatctaaaaagttttagtccgccaccattgatcagcttttgggaaaaaattaggctaatttgagaatccaaattttccaaatgatttctattttcctaaaaaaaattaattttttcacttttaaaaaatacgaattatttagaaaatagtgtttccaaactagtccttaatatctttttagatttgctctaatccccaatcccagttcccgttctattcccgggaggagacggcgtcgtctctcgctgtctccgcgttcgtgccaatccaagcgaaacaaacggcgtgacgggagccaagagcccgagagcgccctccgcggccgccgcaccgcgtcgtcgttgtccccagccaacccaacccagcgcaatcccaaacgaatccagccccacctcagccgctgcgcggacctccgaatcccggcgccggtgcgcgcagggcaccgcagggcgcggcgcggcc

SEQ ID NO: 8981 - DNA, 1500 bp, Zea mays
atttatttcatgatttaaataaatatgttttcaaataatagattatctaaaagattattatgtgaactatcctttttactaaagaactattctttaaaaaaagaattaagttaaactatcacttaatatagattttacataagaaattatattcttttaaataaatacgtgaatcatacaataattaaggaccctatacctattaaaaggataatgtctttataataaaacacataagcaaataccctgatattatttgaaatctgaaattgacaccgacaaaatgaagggagtaattgaatcagctacttttaaaataaagtaacggtaaacttgtctttgtgtattttaaaagctaaaaattagtccacacatctagttttttctaattaaaccaatttttaaaaactagggtagaaacgagtttcttgtccatttagttgggaaacgaggcagaatggagccgctttattttacgtttggttgaagagcgaacagaatggtcgaagagaagcgactctaaatcgagaatatttacattagttctatgacgagcttgccccaaaaattcgttggaatctcaccattccacttgtccctttctcttttagggcttgttcgttttgatgtgtatccatgtgtattggatggtatcgagtcgatttaaatccataataggtcaaaatacatctcaatcctacccaatccactctaatccacatgaaacaaaaataaccgaacaaaccgttccgctgttcttagagtatggaatcatctagctctcgaaatctgcaatgaaaccgttccgctgttattgctctctaaccaaacaaacttacaaacctcagaaattgtggtgctttcaaacaagccacaaggttataacttttttcttaaataacacccaaagcagcaattaaccattaacaacattatttttaaaaaatcgtgctgaatgcagccaagccgcggaatttagaaatcgcgagttgcctgaagtcaaaaggagaaacacggccggctccttccatagatccaagagatttctccattcccaagctgcttgaccagacaaaccataaaaactattgaactttcaatacatctcctcccgtgtccggttcttcctcccaaaatctgcccgagcttctttgcccagcagatccccggcagttgcatccccaagcgcccctccccagtcgacggttctcacccaattccgccgccccatcgacgggttcgcaccaaatcagccgcccccgcagcggtgcgggagcggcgccgtttggacgctttcccgctgaaatctcccgacagtgtctcgtcattttgacgcctgagctttatccgggtggaaagtttggatcttggtaaggatcttaggggctggtgggctcgagtctgcgcaaggatctcgcctttgcgcgttacatgtgcaggctgttctctggtgcgggatctctctaacttgtcggtgctcttgaacaggtgcttgcggag

SEQ ID NO: 8982 - DNA, 342 bp, Zea mays
tgaaatatgataggatcttaaatggggtaagaaaaaatttagtaacttggttaaatagagttgcgaaactagacatatacgtgttttttttataaaaagggtaaaatgcaaaaaaaaaaaaaaaacggccgccacgcttcgtttgcttcccgctcccaccgccaccacccaccaatcgcactcgcagttggcgcgcgctcccgtcctaaccaagcaaaacccacaaccctagcctccgccggcgccgccatctgccgggcctccctccggtcccggccgaccgtagcctcgcagcaccctaaccctatccctcccccgctgccgcgggagcagggtaaaaaa

SEQ ID NO: 8983 - DNA, 193 bp, Zea mays
cagttgaattacctccaaaatgtctgccatccacagtgtgttccatgtatctcagctaaagaagtgtgttcgattgtcgaccgagatcatagcagaaccagaattgaagatagagccagatctatcataccaagagtagccttcaaagattctagattgcaaagaaagatcaactcgggctaaatcgatcaag

SEQ ID NO: 8984 - DNA, 1500 bp, Zea mays
tggtccggaggttccggtctagatgtctgatcgtgacgatgttcacatgtaaatcatttgcggcacggggaagcgagcttctaggcatccagttagacctgtttggttcagcttttggtctgattctagtggctagaagccgcttttagatgtcaaatggactaggctagcttctactggccacgctttcctggaatcatcccttcaacgacaccctggaatcagacgtctggccgtgtctattggaagtcgcctcgaattctcggccttatgttgtgtttagtttagctgtgagctgtaaaaaggctgttgtgagttatatgctgtgaaaagctattgtgaaaaataagttgaaagttgtttggttcaaattattgtgagttgtccggtgtaaacaaattatatattgtttatatgcactctgtttaactgtcttttaatcaatatatctcgttaaaaatgatttcacatttgtgttcctaatattttttacaaataaataattgtttaattccatttgtaataaaaatatttttattccatttactatttaatcctattttagtatcagtttattgtatacgtttattaatataacgaacttcgataaacaacagaagcaggatccaaactgttttcaaatttgtactaaagaaaagttgttttccaaagaaacggcccaaaagctraactccttttgtcagcttctacttttccaaagcaraagtaggtttcaaaaacataaccaaacacacccttaggctatcttcaacagatcccctatcccatcccctatcttatcccctatttcaaactttactctacaaacagtgtcatctacagttctgtattccctattttacactacttgctggagacagtgttatacaaatagaaaacttcaacagacctaaaactttaatttttctctatactaacactaaatgaatattagatatataagagagagagaaaattgagaggggggctatggtccactttgcccccccccccctctcggtccgcccctggtcatagacaacgattctctaggatgctctgctcgtttgtgcgagtccaataacgttgttatcttcgtgcgcgtccatgcatatcgggagggccatcctgcctctgccggtgagctaaagctaaattagagacgacgccggaggaaatggatggcccagatatatagaagatgggagccagccatgagacgacagtgtctgcgcatgcatgcgcgtagtcgtccgctccccgcgcttgtcgtccagcctcttgctctgcagcagactcttcttgcctccccaaggagatctcccggcctagctccgtccagttggccaagccggagcaaaaagcttgtgcgtctggctgtctccggccggccgggcttgtcgtacgtcctccaatccgttgacggtcaggccctctagcttttgctcggtgttctggagacagagcgagagagagagagagagagagaggtagacggag

SEQ ID NO: 8985 - DNA, 858 bp, Zea mays
agtgggtcgaactcccttcggatctgagttttagtcctactaggtctgagttatcgatttcgagtctgaatccacaacagatccgatgtagtagcttttctcttgagacacctcagttattgatgtattatatatatatatacaacctttaaatatagtatcttagatttttcatgtttttcacatgtccttagattttttatgtttttcacatgcgcgacgttgcaatgctctgctggagacaaccttgccaccactgaatgaaaggttcatgcaagggaaagaggatttaacatgttcgtgtgctatttttacacggtttatctaatactaacataaacaaaaatgcactgcccctatttttactaacattccacggagggaaatcacccaatttctacaagtccaagttgattgagcgatgccaaagggatgactcatagagtcaaaagtcattgcagacttgcaagcttccctcccctactatcaggcgaatcatatccatccacttactacgctgctaggctgctacgaacaaaatcctcctaattaagacgggcgtcgttggcttcaaatactggtctctcccctgtccaaaagtctctcgaatctccaccctggttctgcaccggttccagaattttctcccatttacagggtctccccgtttctgtccggcggttctgccgttccactgcttttgatttcggagtgtgaacttacatcttgctggataataaagattggattttaagcgatttgggggtgcttgcctgatctccccctgcgaggtactgccgggggattggatttcggggaagttttggtggtttgagattcggcttggccggagcagga

SEQ ID NO: 8986 - DNA, 161 bp, Zea mays
ggtctgctcggtgaaggtggcggcgccagtctacctagactggtccgacaagcccatcaccttcgaccaagctgaccaccccgaccacgtgccgagcccggggaagatacccgctcgtcgtcgaccccatcgtcggcaacgtcaggctctccaaggtcttc

SEQ ID NO: 8987 - DNA, 1150 bp, Zea mays
ggcccgaagccaccaccttcgcgaacacctccttggcgtcgccgagggcggacacgtccgtcgcgcaccgccggaacaggccccgaaccagcgtgtccagcgcgcgcccgtccacctcgaacccagcgcgctccatccgcttgtacgtctgccacgccgctgaggtctcgccggcgcggagcagcgccgtcagcacgatcccgaagctgatcttgtctggcgggcaggcggcgtcgttgttgccgcacatctccatgagcagcgcgaacgctttgagcgggtttccctccttgcagtggccgttcaggagcgcgttgtacgtgaatgtcgtcggcgagaggcccatcccgatcgcatcgtggaagatggccgtggcctcctccgtccgcccgaccttacagaacccgtcgagcacgatggtgaaggtgtagatgtcgggcgtcatgggcgagtccttgagcttgttgaggaggtcgagcgcctcctccagccgcccgacgtagcagagcccgccgacgaggctgttgtagctgcggatggtcggctcgcacccgagcgcgcgcatggcgtcgaacacctccatggccttggtgacgcgtccgcgcttgcagaggcaccccacgacggccgagaacgtggcgacgctggggcggaacccgcgcgccaccatctcgtcgattgcgagcttggcctcgtcgggcgcgccctggcggcagaggcactgcacggcggtggcgaaggactgggcgtcgggggcgacgggcatggcgcggaacagcgcgacggccgtggcgtggtcccccgcgcgagccagcgccgagaggatgtcgttgtagtcggagacggtgagcgcgtcgtcgtcgcgcggcaggaggtcgagcaccttcacccgctcctccacgggcagctccatgatccgcttcgcgcaatcccgggcgcagaaacgcgacctcttgctcctgccgtcgccgcccggtccgtcggagcgggaaccgaggacttgcgacggtgctgcgtctccgtggagggtgccgttgccgttggactgtagagcgcggaggagctcggcgtcgtggtcccggaccggcgctttgcagtggcgcgcgaaggcggaggaagccgccgccgcgggtcgagggagggcgctgac

SEQ ID NO: 8988 - DNA, 441 bp, Zea mays
accaccgacttcttcccttccatgttcagctacgcgctcaacaagctcgccgcgctcgacgtcttcaccggcaccgacggcgagatcaggaagagctgccggaggaccaactgatctgacggatcggatcgatctgccgcagttgttagttgattgatacacagagatactaggttaatcaatcattaccaccagcagctacctaatagctggctagacgagcagctgctgtgagacgctaagggggaaaaagggacaagagaaagcatatcgagaccaatggatcgaggactgagggagcattgcccgtggtagcatttggttttaccgtagtaaatttgagtaaagattcaatttactggtgtagtacaaggatgcattttgtgtgtgtgtctgtacgctgattcttttgtacgtggccgctataaaaatatacgttcc

SEQ ID NO: 8989 - DNA, 356 bp, Zea mays
ggtggacgggcgaggcgagccctgcccctgcccgcctcggaatcttggcatttctagggattctgtcattcatcctggtgtgtggtgaggtgcgcgcgggcgggtggctggcgctttttactggccgagagcgtgtccgtgacgagaccgccgaccccccacccctggaagaagcttccacgctgcttcctctgctttcatgcgccccgtgctatttatagccgccgtggtcactgccagagctaacggtgcaagccgtcgtttcaggtgaattcgagtgagccaagtggtctcgactctcgactctctcgagtgagtgagtgatcgccgcctcggcttgcacgtggccactctca

SEQ ID NO: 8990 - DNA, 540 bp, Zea mays
tcgttttcatgtacacttcaaccattctagtttcaataggtaaagttgtggatcctaaaatttacagctargcatagccttatatgtgcactacagaagtaatgtctatttttatttttttgcataattatagaataagttgtcatgtgcttgtcaaaacagggtgtgatgcagttaggggcaccaaagaaattgaaccatcagttcgataagagtacataaaaggtagagacaatattttacttttgtcctacatatacaattatatatatgtattctataagggtccacctaatgctaattaaaaggaacctgacatctgattatcttatgagtagggtatgttcatgtacactaacagatcctaggcatgctgttataaactttgctctttcagcttgtccgtcagaggaaaaataatttctttcatttttcgagtctctggtaaatcattgtgttggctgcgcatccaccttaacattttgttttttcccttttaggatcaatgcatttcaacactgagaagaagccaacagttca

SEQ ID NO: 8991 - DNA, 224 bp, Zea mays
aaatctcgcgaataaataagcaagcaggagaaagtggtttagagagagtgagagagagagggggagagaaaggttaaggaatccgagctaaggcgccgtttcttctcctcctgcttttttcttctcggcaccgtcactggagggagaggattcacgggacgaggcgacgcggaagggatttcgtcgcttgtgtgggcggcgcgtccgctggttgctttgcttcc

SEQ ID NO: 8992 - DNA, 994 bp, Zea mays
ggtcatctttattcaccagaaccggcctaatggtgtacatgcggcagatctaacaacagagatgacggtgggcttaagtccattcattttaaccagatgcattttttatctttttactacttgaagttctctccgatgttaaaatttttattttaattaatacagcgtgtatggtacccaaaatcaactagtggaacataaaataatcgcttgctgatgtcatagagagacatatttctgttatccttggctaccatatatcttgctagcttgctatatattaggtctagctaggcggttgggtgctgtcagcaattacttactagtcagacgaacttctttagtatattaattgttgaaaggtttttattacgtactaattcctttcttattagttgtttgtaatttgtgatattcttggtaattcatgagtagttgattgcccaacagtccaagttcgtctcttgttgttttgttgaattgaatactttgaagtttggttcaagtgtaaacgctatgtactcatatattgcttgcttctgtaacagtaatcagatttattatgtcttgttttttgttctaccttgtcatttgtcaaccttatgttttatttgtgtgaagtgtaattatacccgcgggtatccgatacccgcccgatacccgatggatacgagcacgggtacaaattcctacccacgcgtatagtcgcggacgaatatgagtaatacccacgagtattgtcgcgagcagatatttactatacccgatctaaacgcgacccattgccatccctacaccttcctgtcccattggcaacttgcgcgctactctgactcggagtggccgctactctaccccacccacacccttccgcccgccgccactaaaccctagcgggacacccgccttgctcgcgccgcctcatcctctcactcctctcggacccccggtggccggtgcagagctgcgcgaccgagaaccgaatctgtgagcc

SEQ ID NO: 8993 - DNA, 127 bp, Zea mays
ggtacgggtatcagcaatcggccaagaaagaagaacatcttcggaaatatgctaggggccaggctgctgggaggcgcttttgggggcctcctgatcggggacatgatctcggacttgtaggcgtacg

SEQ ID NO: 8994 - DNA, 820 bp, Zea mays
tgtatatggaccttccaaatacactaggcttttgcaagcaaccaaagatattctcagaaaggaaggtttaccaggatccgccttgccttgaatacttcttggcttatgtcatattgaccatttgggcgattgagaaacagactaatacagccactgttgctcttgcacttgcatgcctctatataataggctaaactaaacaacattgtacatgatatggtacttttgcacttgcactgtgtcttcttgatgggtagaaccgtagaatcctgccctatagtccagaactagaagaattctaatttttccttttagtaatccatgtagatttgagctttgtttggtaagaaatgcatttggattttccacaaattccagtctttcacatacccatctacttgctatcctgctactggacgaggtggcatcgcacgggcacgaatagtttcatatatgcctatgcattttttacagactttgtgtgagaatattattctcactttctttgctttctgtttttactcatatataggcaaactgaagtggaatatttgatgcacacctcttttgcctcagatttaaaaatccctatttttaatcattttgcgaggaaaactctagatttaaaatgctccaattcttgagagtttgctatgtggttaacatagatactcgcatatattttatagcttgaaagaattgtgctctagatttcatggctcttcttcataactgttacctgatttttatgattcctggcaaatctatgtatgattgctgactctacctcacgatgggttgaggcattgtgtgagatttc

SEQ ID NO: 8995 - DNA, 1377 bp, Zea mays
ctgcagactgcggacaagtgcaaatccagattctctcctttctttccttgcgaagttttttttttactgagagccgatcctgacgctataaattgctctcctataacactggttttgtacagagagaacaacacgaactaacaatgacacgtgatccaaataagatggatctaaatttttttccacgctgatagcagagtggggtctcgaaacttaaattgatgtggttccaaatatactggtttataactcagtttataggaattagattttcagtttttaaaaaaaaccaagaaggtgatccctcctagcttaaaaataaaaatggtttcttataaattaggttgcttctaaacagaatattaatgggacataggtaaggatgaaagaaaattcatccaccggaacctggtagatagttaggagtcatattctcgcttagggcttgttcgctttctcctcaatccatgtggattgggtgagattgaatgagttaaaatccagaaacaaatcaaaatctttaatatttttgggattgaaaacgtgactagcaggaatgcaggatgatgaaaatgaacagaacaaatcaataacgggtcgccgaaacatcgctgcacagagtataaaaataataggattgcaatcaattttgaaacatcccatttagacatcgaagcaatatattataatatacaaatggttaccaaagaaaacaatcaattatggattagtttgttaagacgtgttctatgatttatttattggattatctataacgatatactatataaagataaaaacagtaaaaacaaaaacgattaggaaaacacacatatcatttcgtcttatttcatatttgtcaaaacaagaaaaatacctataaattcgaattcgaacggatcaatatatatttcagagaagaaaacagaatatatacagacggttttcacccctacccgcaataccctccctggtcgaattcaccaaacaaagaaaatgttagtctaaaatactgaaaacccggtgcaagttcatgcatagcagtcaaagtgcaagatatgcgcattcactacccaccgattatctgccgaacacgcagcgacagatggaggaattctttttgtctcgcgaaacaggggcggaaggatccaatccaatccaaccaaacctctccccccaccacctgctgcaatcgctagcgtgcgcataaattaacaaatcccacctccactaatcgcaccacccggtaattgcaaacatcgcaagtccacggcccgcccccaatcggccaatcctcaccccgcatcttaaggttcctgtcgcctcagcggctgcctccagtcctccgccctcccgctccagcggggctcgccattg

SEQ ID NO: 8996 - DNA, 1500 bp, Zea mays
gtactgatacgataggatagattcggggctaaatttgtgggcgccgtctctaaggatgatttggtgatttgggcattgggttccgtctgcgctccttcctcccaattttgggttccctctgaactctgaattctccatacatggccgcatcgatctattacgcagttggtagaatcggcctttccagttctcagtactcatatttgggctcatcccatctggggagcgtcgcgccaccatttcgtgctacatctccgtgtaccatgtacaatgatgagcctgtttggatcccgtggcactaagtactagtttttatttatgctgcgtccaacgggactacgggaggaaataagcttgctagagccgcgtcatttctttctgcgtgcctttccaggagctgtcccggtgtaaattttgctcatggttaatgcttactcgttgtgctattagaagcttatgcaatcatattccgctgtatcttggagctgcctaccgatttggctctgaatgggttgcacattgttgcttagaatccggttaattagcctcgttttttttcctcagatgtctcacatatgcagtagattagtagacaatagtagtctaacagattgccgagcatacatctgataccagcacacatttgtttcgtttcgtatatatgaaagtattgctgtgtccttctgtttaaggaaactcacccgggttttccaatttccattcgtgcaggtaactctggtgggggacaatcaagaactgaacactcgacactggcacagagctctggcagcatgcggtggctcggtctatctgtcgatgtgttccgcagggggatctccttgaacctttactgccgtgtgattctgtaaatcgtctccgtggctaccggcttttccttcgcacgcctcctgattcatgagaggcttgtgaaggcactttacatcttccccacccagtcattaattggcgtcgctgttaggctgttgtggttgtttggccaaggcttttgaggagaacgggctggagtactgatggtgtggaaagcagccgctcagacgagattccgcgtgtttaagcatgagaacggaatcacagtgagggctattgcttgcttccagccgctgcaaaattgccaggtagtgaggcaaaagggcaaacatttgttaaggattttcctttcttcacttgatggttctgacatttgcttcggtatatctgctgtaggccgagtacttccgccatctcctcaagcccgtgacgtagctcccctctgctctccacctgctgctgaataaacttacagccttagttttttctccatagcaactgaagtgggagaacatcccagtcgttcatcgggactttctgctggtaagaacatcatcctttcattcatgttgctgctacctgtctctatttgatattgatatatactgacgctcagttccttcttggtaatctcaggtagttctgtccggtggttgttttaatttattcatc

SEQ ID NO: 8997 - DNA, 682 bp, Zea mays
aaaatagaattaaacacctccatattattatgcctactctgcatttttaaattaagttcacaacatggtttaaatttaaatttgaattttaaataaagagagaagaaatcagaaaaaataaaataaaaagaaaaagagaaaaaccacacttggcccattcattggttctcgacccactaaccatctcgcgtgaccgggtcagcctactgcgctgctggtgccgacaactagggtccaccagaccgcctcacacaaccgcgccgcgttcgcgttttccctgccactggcgtgtgggcccgggttcgcagctctccccttccaacgaacgccgtatatggcgggatcgcggcgaagacgcgtgatcatgcaactcgtgggaggaatgcaccagctcaccgaatttcgtgggtgcgcgtgcctataagacttaggggttacgcctttatcgctagagctcgaccgtggaaaccaacagagggagaaaaacgagagaccactgccgccgccatcgaaccgcaagatcaccgctgctctgctcctgtaacctggtcccgggcgttcggacgagtacgcggatccctgcggagactggattggcgcctgcggagccatagtgcgacgagaattgttcaccggatccgggagatcgcgccgtgaagctacccaccgtggtccgacctcc

SEQ ID NO: 8998 - DNA, 1154 bp, Zea mays
cctttgagatggcagtggtagaagagatgtctgtgcatgtcagcagtggaccatcaagaaaaattcccatgggtgtgcacattccacagacgcaaacaagtatggttttatagtataactgcatcataaattcagcatagttaagtcaaactgtcaaagattaggctaattgtgctaggccagtaattgtttaaagcaaaagtatcaaacagtcttcctaggcctgttcggcagagctcctagagcaacttccaggctgaagccacaagaagctctgccaaacacttttttttgccagagaagtaattctatgctgattctgtaaagtgattctctagaatgaaattgagggctaggagctgaaaaaggtagtttctccacggcaaacacatgaagatctgagatctgactattagcaattgactactattagcaattaaacacatgaaggtagtttctcaacgaccatttagacatggtagctgcacaaaatcctaccgtggtttccaagtctcaacaatcactaaacgagcatccaataaaaaaactaattaacactacggcctaaagtcctaaacaacacgtgatcaattcgcaactcgcatcgagcacagaagttcagatcgcacgatcaaagacccacagattgcccagtagttgaggagggaaggtcagggggggctcacgcaagcactcgaagtggtcctcgatgtcctctagcgcggcgcggatggcgtgcaggcggctgccctcctccgccagggtcgccgcgacctcgtcgccgccgcgcgcgccgagacccaagaccccagcccttgacgtgcacgaggccggcgggcttgtccgcggcggaggcagaagcacacatcagtctaaaccacaatgcgaaagcccagctaaggatgggctgggccgggccgtctctggcgcatttggtaacgagaggagcggagaaggagcttcttggagaaagacggctcgagagagagctttccgattgcgatcccatcaacggccgccgaccgccgctggttttctttcttctcgcccaagccgcgccgccggcgcggtcctttgtaaaggcctcgcggcacgggagcggcctgcgctccctctctctggattaggcaaagcatcctcctgtttggatcggc

SEQ ID NO: 8999 - DNA, 843 bp, Zea mays
cgtagacgaagcacgtgtccgagctcgaagcgatcggcacgcatgaaaacgaagagaaagggtttatatattgacgcgctcgccaagacttcggaataatactcttacagttggtttggatgtcgatatcgaagggcattgaatcaaatttggttcaataccaaatcagccatggtattgaaacgggatgtaattccaattctattgtttcgacgtcgctaaactggagttcggaattatgcggtctaattccacgcaatacagaatggtgcgttcggtatccagagagggagtttctagctatagtccaattccagagaattgagtatccaattctaaatctcaattccgtgtgcaaccaaacgacggaattgaggaaagctgattccaattcctaattccgtgctccaatatcgacattcacacggggtacaacaatatattacttgcaaattcgaaccatttcttagatttttttaccaaaggaaactatatttaagtctggttttagaacttcaaatccaaacacgctcaatgcactgctaaaacggaacatttttttcacaatacatgcagaaatttaacggtaacataattattttcttcgttctaaacaggtcctgaaatggctgtgaactcgtgtaaacgccacccgcatgagagatgcatgggcctcaacgtttaggcccactactacacgcagatgagcccaacgatctagggtttccagctctacacgccgcacacataaatcccgagaccaaaccttcgcctccattcgtcccccgccgccgccgctcccagtctccacgcggaagcagcgcctcgcaacgctcctaccca

SEQ ID NO: 9000 - DNA, 103 bp, Zea mays
gttccaatccccgtttgctgtacagggtatattaaagaggcaacggagtcatgaccctttgagggagtattagtaaccgcatgatcttttcgagggaggcacg

SEQ ID NO: 9001 - DNA, 1500 bp, Zea mays
tacttctctgtgtttcggattcatgcaatttttaggccgggtgagtggaggtttaagctgtaaattgtatatgcacgttattggcgctcctcggtaaacaaaagttaagctttgagtatgttagaactcaagttgtgtaatatttctagtaactggcaaggttcgcgagttcaagtttttatgatctgaagaactgacaacaaaggataggtgttaaatttcagaatgtgttcattgtccactttcagcatgtgttcaggttcaggttaactgcagcttctgtttgtttgtcgtgcatccatctgcatagttcttgttctctgttattgtgcttttggcaataactcaaatacttgaatttggatcaaatttctttaaagcctcgttggtttccttttattttaaaggaattaaaatcttactattggaataggatattttttttagaatgtgacattccaacaatttccaaagttatcatataagtctatctcaaattcatggagtgagagatgaaaacttattctatagagttatatgttatttttccgatgtacaacttatagcacactcttctacttacttcgttataacatgaatgtagtatataactatctctctcatatgatttaagataatatacaaatatattacatatataaatatatgaacttaattagttttgtctaaattataattattaaaatggaattcaattccaacgaaacaacagggcctaagagcatctccaagagctctccataaaacgactcctcaaaatcagttttaagggacatctaaataataagtgggggtaaattttaatcctttctccaacagatcccttaaagcggcagtttgtttctggggagcccaaaaaacccctcatttgtagctacaaatgaggaagttttaagggctatgaaaaagttgggggcgctttaggggaactgttggagacatgtttttgtgttttttcccaaaaaatagatttaggggagacttctggggagcttttggagatgctcttatataccaatagctaaaaattataattaaactgtaaaaaaatagaaacagttttgaaactaaaaatttagctttgagcgaggtccccgtgtcggaacgagatcctctgacgtggggagagggcactgccgcgtggcccccgcgtgcgatagggcccgcgcgcagtgaccctactgcccctgcagtacgtcagaggaaccggctccccccgtgtccgttcacctctccggctctccctcccagcctcgccctcccaccgtcccacgttgttcctcccgaccctcgccgtccctcccgccgcgacccgccctcctcctcccgaccacgccgcccagcccgtgtaccactccctcccagcctcgccctcccacgccgtccctcccgtcgtgacccttcctcctcctcccgacctcgccgcctagcccgtgtcgccgccgtcgcccgtgccactctgctgctgcgaccacgaca

SEQ ID NO: 9002 - DNA, 72 bp, Zea mays
cacacgagccagcgcgccaagcaccggycaccgtctccggccttacctgacctgacctgaccggctgcatcg

SEQ ID NO: 9003 - DNA, 1500 bp, Zea mays
caccgcccacggcgggaccgaccttcatagggaagtgactggaaggtcaggagcgtccccctgagtgtccaggcgacgacgccatggatttcaacgatgtgagagtgaaaggggtactcgaatccagatccaccgagggaagaggaggaggagtggatcggggcgggctcacctgtgcttgcgctgaatgcgaaacctaaaggagggattggggatcagagatggagcacgctgacggagcgaatggtcgctgccgatgacgagggccaccagcagctctccctcgttctcggcttcgcgcgcgggcttcggatggcagcagagggagtcgagatgggccgacggcgagcaggaaggcgcagacctcgtgcgatgggggagacggagagaaatgggagcagatctcgcaggggttggttgtggagagggtagggtgcgtgcgcactggagcgtggagatcagacgacgcacccgagcgaagggacaatcgtacggtcgaggtgagagggcagaacatggtgcacggatggtctacattagagtcttatagagtagtagagattttttctccacctattaaaaaactaaaatacacataaatagagatagaggagtcaacgcttcacgctacctgtggcggtcttctgttcacttccgtcgaacagagggaccgacagagggctgcgttgcgggcttgaaggcgctccatgcaaagggaggggtggccgtgcggcgagcgctgcggacaaccttaaacgtcaagtgagagcatctctaacgatgtgtcttataaaaatgtcttataatttaaaaacgagtatattttatagaatttaggacaccaaaaaaattccgctccaacattaaaacctcaaatctagattatagggtagcccactacggtgtagtatatttgagacatttgagagtgtctactataattttttgaccaagatttatgaaatgtggtattgttggagtaatttttcctgcgtagagccctatattttaatttgaggcaccaatttaaggtcttgttgagcatctccaagagtctttctaaatttctctctaaattatcatttgaagaatcatttacataaaaactgctttctatatcttttcaatctccgaccgctttcctatatctagtttgcactctatatttggctagcgagaaacctgaaatagaatatatctatatttggatagtcatttagataaactgctggagggttttttttttaaaaaaaaactttatttatatagattaaaaagaatatagagagtctcttagaattgctcttggctacagaaaatggctcgagagagccacaatggttccttaccttattttctgaatcctggttcttgtaggtgtcgaaaaaggttcaaaagagccacaacggcagaaggtgggaaaggtaacagtggatcaagtgcgtgcaatagctcaagaagaagttgccggacttgaactgcaagagcatcgactctgct

SEQ ID NO: 9004 - DNA, 147 bp, Zea mays
aggcatgttcgatcgatcggcaaccccgctccaattgtaagttggctagtttgttatatgcgggccgggtactgtataacagcagctgcttggaaataaaaagcgtgtaatgaccttactcaacatcatggcaagtacaatttctga

SEQ ID NO: 9005 - DNA, 885 bp, Zea mays
gcgacgagcgcgagtcggccgccaaatccacgggcgacacgtggcccactccaacggtcagcagggggcaccggacagtgtccgatgcgccaaccaacccgaagttgcaacggtcggctgcgcgaggaatggaaggaaatcgtgcactggacatgaacagtggctgtccggtggtgcgccggactgtccgatgtgccacccgatagaaggcaagatttgccttccaagaatgcctccaacggctcctagctgccttggggctataaaagggacccctgggtgcatggaggagtcacccaagcatactttgagcattataagtcttccacactctgtctccgcgcacttgattgaccgtgttagtgatttgagctccgttcttgtagtgaactagttgtgcttcattttgagctcaagtcttggcttgtgtgcgtgtgtattgctgtggatttgtgtgtgttgcttcccatccttactcttgtgctttcaccgtgatctttattgtaagggcgagagactccaacgtgtggagattcctcgtgaacgagaaaagtgataaacaaagaaaagtcgtggtattcaagttgatcattggatcacttgaaaggggtcgagtgcaaccctcgtccatttggacaccacaacgtggaggtaggcaagtgttatacttgctgaaccacgggataaactcgcgtgtcttttgtgattgtttttctgtgatacttgtgtttgcaagagctcgctacttagccatactaacacttaaccaagttttgtggctattagttgttgaattttacaggatcacctattcacccccctctaggttctctcaattggtatcagagtcgttctcttcatgaaagagactaatcgcccgaagag

SEQ ID NO: 9006 - DNA, 157 bp, Zea mays
gacatgcaagacccacatgtcagtcagcgagggcgccttgttattacttttcgtgggcgaggcgaagagccgaagacagaagactgcagcaaaaccatcagatctagcagaactctctcgacctcatcggcgttggcggagcgcgtgttgaccggag

SEQ ID NO: 9007 - DNA, 274 bp, Zea mays
cgagcacgttccacacatgccggaaaaattccctcgtacatcgttagtcatcagacacgcaccatcatatgctcttgcttaaacaaaaaggtaattggtgtatgtgtttgcgaagagaattaaaggcaggccggcacaaaagctaccctgacggtggcgaggatgacgaactggtcactgttgtcgatcctcctctgtgtcacctccggcgccaagatgacgccacaatcctcgatatagtagtcgtcgaacacgcgcgacatgacgagtaccg

SEQ ID NO: 9008 - DNA, 1353 bp, Zea mays
taggggcttcttttcactcattttttcggtcttttggctgagatcaagtgtaatatttgtttcaccagttcaatatctggtatataaacaatatgttcactttgacattaaattcatttattatgggtatttttatgtggatggtccattaaactctcaagtgccgcttgctcgtccaatcaatatctggttgggtaccgtcgcaatgtattagactagtgagagttaattagtgggttacagtcttaagtgtttgtctaatgcctacacacattttaaactggaaccagttgagaatttccatcggatatatataaagtatctcgtcgatggagcttgcactgggctgcgatatacatactacagtaccaagggccaagaggctataaatacatatcaatccatgtgcagattggaaagcatcgagtgtgtgtttaaatccctaattaacaaatcaaaatctttctcagttttttaatctcatatccaatctatgatgagaataaccgaacatggccgtacgagggtggtgggtgaaaggatatgaattctgcaaaaacaatctatcaagaagctcttacaccatatgcaaagtaggggggaaattacatccggggtatgaatttttgtcaccgcgcgtgcagtacgtcacgcgcttttgtattagtcaagctaaggtccatctgccatgcacattattagcacatttagtcatcgtgttgccaacaagtggatgtttcatattttttgtacgaccatatcaaaggcttcatccgaacaaaatgtgtgtatgcatgtgtcatctcatttactacttatatatgtgggttagtggttagtacagttttaattgtttgtctaatgcctacacgcacattttgaattggatgaggttgagaattttcatagcatatatcttctactgtataaagcaccaattatttttacggttacacggcttctaccatcgttgtgctcccacacatttaaatgataaaataattaaaattatactacataaatagagatttaaaccattgttcattggctctaaactcacgttcacacccacctaactaacagaatacatgtctttgtactttatactctataattaaacataaatgaaaattgtagcaacatacggccatttttacgagtatataatataatgaatctcaaccatgtagctagtcatgggctgtgtcgctgcgacaatatacatacagttgcaagggccaagcggctataaatacgtgtttaggtgtatcatggtgataacgcgccaatagaacaagaggaagttgttgccctagctagctagtgtagagtgtgtagacgaagccacacacc

SEQ ID NO: 9009 - DNA, 94 bp, Zea mays
cagagcttgatctacctgaagggcaatagatgaccattgtggcaaatagatatacattcccagttgtcctcttcctaccatccatgatgcggta

SEQ ID NO: 9010 - DNA, 481 bp, Zea mays
ccttcgttgtcatccacattggctttgcaccaatgcaataaacatgagatgaagtaggcatacatttcactttccattataccgctttaaagctcccattgtcttgaatccattcctaccaatatcctacgttgctacctatgctcatgattactttattcaatggatcaagaaaccaacatcggtgtgcatgttcctcaaacacatttaggctaaaaactttgatgcacaaaactttggttttttgatttgagctattggtgttcaatttggataagtaagtcacacatttgtgtacaccttaggtcttctatctttgatgtctgaggaagtcacatggaacatggtggctatgaccacctttaaagagacatgggacattttgaagaacatcctgatctcttttgccacacccatacttgtgtagtgcagatatgggtcgacctcgccgtcactgcttacttcagtaagatcaaaggtt

SEQ ID NO: 9011 - DNA, 1283 bp, Zea mays
gttaactgggacaaagccaaccatgcaaaagtagaagctgaacctggtgaccttgaatttcaagaagaagtgctagttgaagatgaagtagtcgatgaagaagtcaacgagcaacaagagtagaacacatataggaataaacataaatatagatacatatatattactatttgtaagacctaaatattattttagctagtagttagtattttactattttaggaataacaataaggtctgattgaccctatgttttgctaatgagatatgcatcatgctgagattcttatttgtgcatatgttttgagacaatatgggtatacatcctttttattacaaatctcgaggacgagatttctgttaagggggtaggatttgtaagacccaaaattagtagaaaaaaagaaatataattataaaataaataaacaaatatagttattatagtactttgggaattggggaatgagaaaagaaatttgtaaccatgtcaacttttgttagagtcaagcatgagaaggagaaaaaatagtaatatttaaaataatatggtttatattcatatttggatatcaattgatacatttggaaaatatgaaaaattaaaataagggtgttgggggtctgcttcgtcaccgaaggtcctttaagaagaaacaccttcgaaagattagcacataagcaaatacagcgcgatggtacgcgccgaagctgccatctagggagcttcggcatagcgtcatgtcttgagacgaagggccgcaccgacttaaagaggaaaagaccaatcggtccatgataatttgtgtcatgattgtaactagttgctgaggacataaatgtaattttaaccgggctgcgtctcgtgcctataaataggtgaatagtacccctgtactgttcaccctgacttgtattcgctcgtgcgtcacgtttggacttttaccttctgtcaagccgaaggtacaaatgtaattcaatattgtttctgtttatccatgataatataaaggagtgatattaataatgtcatatgattattcatgttgtcttctatatttcatatgcttctcctttcattaatatatactgcgatgatgaaggtatatccttcaagaccttcatctaaagatcattatatcctaagggaaataatacttcgaaagacgaagggtattaacctttaacattttgtgttgccttgttcttaactcatagcatttgagaacaagtccacaacattggcgcccacctctgatgaactcacttccacttttgagctg

SEQ ID NO: 9012 - DNA, 108 bp, Zea mays
gtgcgagagtgcgacgcgagagaggcagatatcagtgggggcaatataaaataaaacaaaaagaaataaaaactgcatcggcatttattccgttgggcctcgcttccg

SEQ ID NO: 9013 - DNA, 750 bp, Zea mays
gttgaccaggtagaacaaaatctgggagcaataaactgccatcccagaacaaaattcgcagctcacatttcagttcacaagctagttcacaatttagttcccaggtaccacaatttagttcacaagctagttcacaagctcacatttcaatggagcaatacacaggtagcagtttgacaagctattacacaagctcacatttctgggagcaatacacaggtagcagtttcacaagctatcacacaagctcacatttctgggagcaaaaaacaggtagcagtttcacaagctcacatttcagatctatggtttttcagtttctttctaggggtaattttcttaactacccatttgacacttctaggtggcgtagtagcagtcgtgtgttcatcttcatttgcagcaacgacaagttcacggcttggtgcttcatcttcatttccagctacaagtattggtgcttcatcttcatttgcagcttcgactattggtgcttctacttcatttgcagcttcgactattggtgcttctacttcatttgcagcaacgacaagccacctgctttggcgcggactagggttgtggtcgcagcgccgccgccacctgctttggcgcggggccgcgagcagcaagggagaagacgcggagtttggagagaaggaggtgcagcgccgccgccacctgctttggcgcgggaccacgggcagcagatctccgggcagcaggggaggagactagcaggggagggaa

SEQ ID NO: 9014 - DNA, 1500 bp, Zea mays
aggagggaaggagcgacggcgggcttggccgcttgcgaatgcagactggcggagtggcggactggcggtggcgttcctagtcgcggaagagaagccaaggagtcgccgccacaggaaacgatgcgctgagaacctaaccctaaaggcctaaaccgagaccgccaccacaggaacgaacggctggggctggaaatatatcgcgcgacacgagaccgtcgttccctaaccctaactcgtgccgggctagcccgagcacggcccatgatgccgtgccgggctatttggaccatcgggccaccaaccggagcacggcccagcccgtctaacgtgtcgtgctggctcggttttttctatttcgtgctgggccggactgcgtgccatctatttcgtgtcgggctcgtgttggcctagcaagcacggcccaaacttacaggactatataggtagcgtgcttttgtcataagtcgactaagagctttagctaatcctgattccagcagtgtacataattgtattctttgaggcttctcatgagtgcgcggcttaattaattggcatactgtgaggttgtactacgataacacaattagtaaccattttctctccttcgttcatctgtgttgtgtcattgcctcctctgcaccgagaatgcaacgtgtctcctctaaactttctagtttctactctcaacaatctctccttcgacggtcaccatgctatggcgcgcggggtgccactgtccagagaaaaggaaaaaacgttgcgtcctggttcgcgtgccctgcagtgcacggcacctcgcacggttcagcacgcggttaacgccggccatgcggccacatgcatggcccgcatgaacggagaacgacagttgcgcaggcgccggcccgtgcgctccgacgatggccaaccgtcgataggccggccaaggagttccctgcccacacgtggaccgcacgaagccggccgcggcccgccacgtcgagccgcggccggcgcgcgtcgccgtcactcgttaaacgaaaaaaaaaggcgccattattagcccggccccggcggcagcgacggacgccgacgcgccccgcgctgcggcacgttgaaaccctgcgcagtcaccgccgtccgccgcgctcgcgcatggaggcatgctttgcttgcttttccggccgtatggcgttcgcttgggattgtttgcaggcaggccagcagagatgcagcgtgcgccttgacgtgcaactgtgcaagcaaactgggttcgcacagctgtgcgaccggcctccgagaggcgacggcgctgtccacgtctcgctaacgtatggcccatatgggctgcgtcgcactataaatacaagctcattccatcgccaactctaactgcaagtctgcaacaacaactcaacaaagacgtgcacacacagtcatacacaagtagagcgacagtagagatacctaccgtctcctatattgtgtgtgtttgtcgtgtcatctcctatctcgatc

SEQ ID NO: 9015 - DNA, 403 bp, Zea mays
gatcaactcaattgtaaccaaggcaagaggcaccaattgtgtggtggcccttgcggggaaattttgttcccgtttgattgagaagaagaagctcactcggtccgagggaccgtttgagagagggaaagggttgaaagagacccgacctttgtggcctcctcaactgggagtaggtttgcgagaaccgaacctcggtaaaacaaatctgcgtgtcacacttcttatttgcttgggatttgttttccaccctctctcgcggactcgattatatttctaacgctaacccggcttgtagttgtgattaactttgtaaatttcagtttcgccctattcacccccctctaggtgactttcaattggtatcagagcccggtgcttcattagagcctaaccgctcaaagtg

SEQ ID NO: 9016 - DNA, 1307 bp, Zea mays
aacgtaatagcaggagctctgcctttcaattaaaaagaacggaattgatctagtttaaagaaaatcgggtctaaaacctacacagagtgcacaaacaactcacacaacggtagccctccacacaaaactcgttcagattcatcgttgtcgagctcaacgtaaaggatgagcagctctgacttcactagacaggccgcacatggctaaaggaacttaacgactcctacacccaaacatcgacgcaaaaggatgccaagcctcaatacactccacgcaaggcagctccggttcttcaccaacaagtttgcttctccgcctcgctcccggcaattgcccaacctacgaaacaatccaatccttgataagagggtttagtctcatatcattgttgtcgagccacatcctctgatgcagcagtttcagctttatgttgcaaaaccctacctccatccgcataccagatgtcgagaagtgaaagcaacaatccaagacgacattgtggccaagacaaactttaacagcggcgtctttaaaaagggagtgacgtgtagaacgtcaccgtcgtcccttgttcgggatagatcggatttttatctatagaagacaatgttaagaatgcgacactcccgacgggggaagtggcatccacaaccacaagcgtcaccattgctgcgatggcttttggccaagaagtctctcagcccatcgccaggycaaacgagaggagagccccgccgcaagcatctcgaccatagtgcagccctgccaacgcacctcatcgggccactggacgtctctctctcaaactttgtggcctcgcaacgcccacgtaggcaccacccctcctctccgcaggaaccaccatcaccaaggcgtagatccagcgagagggcccaaaaccaggctgacggccccaaaaccgccggaccccggtgaggccagggaggagacgcggttgtgggcgggaggggagaacagagcaactccctaccgacgccaaccacgcgcccctagcgctgtcggccacagagctgagtagggccgcctcgccctcacacccgctcgcgcccactaggatacggtgcccgaaatgccggtggaatgccacaggcaccggctccaacacggtcgccggcacagccagcagcgcccggccggcagcgggcctgagcgcctccgtcaccgttccggggcccgcgcgcaccctccggcagcggcgagacggagggaagaagggagagagaggcggcggcgacggctagggttacgcccgccgaagttgcccacgcgggaggctcttcaagctt

SEQ ID NO: 9017 - DNA, 1500 bp, Zea mays
ggattttgttatgcaggcagaagtaattgatataaatgcatcaagccctcgttaaatcaaagtcaaacacatggataacgagaaacgatgcatgctcatcctcctcattaatccaacatgcaaaagctaaacgaggtgtggacagagagacgcagaggatactccactctacttgcgcccccctaatcaaacgccgccgcgtttgcgctttgctcgccgttttaccgccgccagcgccagagtagaaaccagtcccgaaataacggtgcaccgcatgcaatgggaccgattgtccaacgaaatacacgcggcgagaaaccgaccggtgggmgrmgaggcggctcgcgacacaccgacctccaccgactcgcatgggcgtcgtttctttctttctttccctttttttttgttatgcgtggcgctccaatctccgccggtcaagccgccgggccacgtcccacgcccaccagaccaccacccgccccaacggctagtttccagacacgtgagatcgtgccacgtacctccacccccagctcccctcgccgtccgatcccacgagttccttgctgcgcacgagctgggtgcttccatttcaaaaaactaactcccttaaacccggctgcacaccacgatctcctcacagacccgcggacaccgacagctgggttcaagcactcgcggtcccgcatctcagccaaccgtcgcagcgtcaaagccgcgtggggcacgggaggtgaaacatatcccgtgcacgaacccgccttggattctggcggttcccgtaactttctggaaaggccctcctccgcgcaggggaggaggaggaggggtctactaggcaggttccgcgcagcagagaagcaaaaaatacagggagctttactataaaaacggagaatgggaggtcagctctttccaatttttttttacctcgaaagtttgggtcttcttcctcccgcattagccgcaagtttggttgcttagcatcagggggaaacatcgcaggttgttgttttgtttgaacactatcgagaggaagaggaggaggaggagtagcaggagccgtagttttgggttgagatcggcagaataggtaggttctcctctcccgatctccaaaccctggttcgatttggcgttcgtttcttcgtatgcccgtccaactttgttcagggtgctgttccgctctccgtttcctgtctgggttttcttttttttttgctggatgggaatgctttgctgacaggcgggtgtgggttggattacagctgaatgattcgtcatcttgctgctgattctcggttgcggtttctgcatcggcatgtttcgctttcgccgctggctctgtttgcctccgcctatcctttcgcttttcgttttgattttccgggtgctgactcttatctccaatcccatgcaggtaatccgacttccggctggataagtgatccttttttttgaatcgccagacgcggagagcggagagcaacaggtgaa

SEQ ID NO: 9018 - DNA, 1500 bp, Zea mays
cagctcgtgcggctgaagaataaaaaataactagtacaatgcgtgtgcgctgcgacgacacacaatcatatttgatacctataaaaattttaatatcaaagtaaatatatggtccatacatcagatatttaccctgataaaacaaatactacaatttatcttagccgaaagaaaaaaaaagtatgagttaaaaagagcccaaatccattttttatagctccctcgtagaatgaaatttaaaataagagatgagactagagatatgatgaataccgatgcaaataaaatgaaggagcgataggaagggctaatcccacgcacacataatgagacaataactccatggacattactttgcatgaactaaatttgttgttacaaaactaatgtgattgagcagtaaccgttcgtgatcacggattcacggtggtcatcatggcccccatcatcgtcagtaccgtattttcagaaggaggaaaaactagccggggacctcctgggcgggggggcgagtatataaccaccacctgcctgcccacacttgtcacgcgaagcgaaggcacgtactactgacgcgcacaaagatacacacacgcacgcaggcaggcacaagaaacaaaaccgcgcctctccccctcgtccgttccgatccccagcggaaagcggagccaggaccgggagctgaagcggttgtcttccccccctcgtctccgtcaactggtgagctccctcctccacctcctctccctgctctttgatctcgccctcgcttcttcctccccagccggccatcagttccggcgactgcttccttcgttcgtccccgccgccgccgccgccgctggactctttccgaattgctctgtctatcctgtgccgtggatcgagttgcttccggaggcgacgcggtgatgttctgctcgtgcgcgcgatgcagctgggagcactgctttctcgactctgtttctccttgcactgattcagtgagtgattccgtcgtccatcttcactgtcttgttgacggctccttgaattccgtcattttctttacgcagcagtactttgttcagatcatcggtttgagttattacaaagcttagtagagagtagtggtggggatctcagagatttttctcaggggaggggaggggaagggcgaccagaccatccagttctaaatgcggttgtcagtcggatcagggaaaaccagcagagttttcagcttttctttagtcccttccgatgtgctggttgaccatatcaggccacatgttccgcagcgcttgcattttacagacacctgatctatccgttgtagaagtggctgccgcctgcatgactggccatttggccttctgcctccctctcctcactcacaggagccaccgttgtgttatctcgctgacacgagccatctgaattcctgaaccttcaaagtctgttccacgaccacaatttcttcttcttctttttttacaggcacccccacaagccagcaag

SEQ ID NO: 9019 - DNA, 1202 bp, Zea mays
accttcgaatgtcgcaattctgactacaaaattatatgtcactggcttcatttacctgttcaacactgcgagtatatgcttgatctgagaatgtggccttctctttgactcccacaccttgatacatgattctagaagtttgatgtatatgataatgaaatagaatgaacactcacaaagtcctacttaatgaataatatataaaaagataacaaatacaaaaagcagggctgagaacccgtacttgtagttgtagggacaagtatggtcaatttatctctaattttagagaagattatcgtcaatcagttagttagatctttcacatctacaccctcagcactgttgcatgcttcttaccaaccttaaatcaagaagttcatgcccatccatgaaatttaatctaacaccaaaacaccaaaacactaggaaacatgagtaaatatatggaaacaaggccatgttctcacaccgccacattaatatcttatcgccacattaataccaccagaacctctagaaaaaagatgtgtcctgcaaactatctaaaaatcataaacattgaggtatcaactcgatacactctaaccattactggtaatcatagtcattgaatcttttatgctttctgaaaaattgcacatattttccattatgaaaaataatacaaaaactatgcagcatggcattatgaaaggtgatctaaataaagtaacatcacctttacatataattaacttacttaatacttatgctattataaagtaaagtgtcacctatatctacatctaattatgtagccacgtcatttttatgaaaagggtatttttctcaatagagaattggatgtttgcgattacaccaaaaggagtccacaaaattgtcatcagattcacattttatatacttggatagactcacaattcatagacactgacaagtataacaaggcaacatttagactgacaaaataccaatcattccattttccatggtcagacaattcaggttttctttatttcagtgtcatttgtggtattcatccttcttgctgcacctcactggcgaagagctagctaataaatcaaaagccaagcacgttctttccatctaaggcctggccaaagtttcaaataccctcgcaagttaggatcaggagtaagcttgtttaggtaaaaaaaacgccaaatcaccgcgcgata

SEQ ID NO: 9020 - DNA, 169 bp, Zea mays
ggctcccttcttcttcgctgtcgacgaacgcggactccccgccgcgctccctctytcaggcctcgcggggtgatcagaggcggctgggagactcgtgcgctccgacgagtccggttacggcgcggtaattaagcaggggaggagccggccctgagcggcggagtccaaa

SEQ ID NO: 9021 - DNA, 1500 bp, Zea mays
tcattcattcgtggctaggaatttcgaagccaatgtatagtttacaaaatatatcgtttttcttttctgttgtgactgtttgtcgagcttggacttgaaattatgatacatctacagatgatgttttgcgactagatctatctgacggctgcattattgagcattgcttaggtgcatgtactgtgatgtcggtctttagatgattgataggttttcagctgtgtgaaactatggtttgaacatctgcgtaaattgacttccattaaaaacagagttgaattttatggcttctttgtgagatggatgtggttttagcttgaaaggaatttgatttgacaacgtgaatgtccttcgttctattgagcatttttatagtgaaaatgtacctgtcattgatgcatgaaaacttgataagtacacccacaatttaattagagccgccgagagtgcctatactctcttgaggatattgtttttttaacgaaagtggtagaagttctgcctatcaattaagaagggagctagaacatgaaaacaccaaagggcggccctcaagggggagaaaaaagcctaggggggtgtcacacacatgaactgctccggccaagggcgtcccaacacaacccaagaattaagacactagagaactctccaacttaattgccaacagaagtcactagcacaatattgatggcctaaacattacaactttgaaaagtctagttcctttcccatgaatattcaccgagtatgtatcactggcacctgaggaaactgctgtattttggatagcgtaactgccttgctgaaacttgaaaaagattatatagtcccaagttgtcagggttgactctgcatgcttcttacaccaaatgcagactcgtcagttgtcaattttaattcctatccctaaatcgcacctcatgttctttcaaccgccgctgtaattcctatcctctacgttgaatgtggtacgttttcccataaagattcatatagcttgctccccatcttggcatggcagttggcccctattgaaaatagaggtttgaccttcatctctggctggagagccttcttgcatatgcataaatgggcagtccctggccagcttcatcacgacgcagcgaagcaggcctccttcttcacaagcgcttctgctaacaggcatcgtcgcatctctgtataggttttgttatttgctgatatcagagagtgcttgttttagtgtcgtgcatccgtgcatgtgttccttcatctctgatggttcttgaaacgaacaaattttcggatctttctttcgttaggtgtgccatgcatgcagctgacaactatgtgttatgtgtgttgtttcgagaaaatattgaatcttttcatccgaaacttgtattaccatgctaccaacgtgtttcctagctatcttgtgatttcctactactcctcataggtatttctgaaaccagccgtcgtacgtccatcccaccgggagcaccggcgacg

SEQ ID NO: 9022 - DNA, 1500 bp, Zea mays
caagatatatgatcatgcatgacaggtagctcgatagatcacgtgaaggtcgggcgcgtatgggatttattctaacgattttttttttttgctactatatatatgcagagaacttttaccatctatggtcgaagaaaactagatcgctggtgaagaacggagaaaacaaatgacgtttcgacgacgaccagcagctagcatgcatgtttttgcctagctagttcatgtacgttattgcatcgtccgtcgtctgctctggttgacgattaaaagcttgcagcactagaaaccacacacgcgccatcgaacatctacatcgaacaccgacatcgaatcgcgcgcgcagcattgtcggatgatggagcagtacgtactcatgtgtgtttgtgtgtgtgatggaattcattactgttatcgtgcggcgctttgatttgttttctgttgccggtacaytccaaaagaatcgatactggtaaccggaagaaaacccaaaagctggctggctatcagcacgtacggtctattaaaattcgcataaaaaagggggaagtgtgctgaacatgtaaataaattaaatacacatcaaagcaggagtacttaatttattagctgctgtgtatgcatgtgtgcattgatatgaaaattagcatgcatccgtaccttgcgttaggatcctaaagcaaagcctgataatatagtatccatgtagtaattgttagctccctttctctattaatacatggctcgtcttctttggcgggtttattttggttcgtggctaactgtatcatatatattttgtctaagtttaatcgtgcgaattgagaaactaattttaaatagaaaagaatagatagacgtaacaagttaggcagcaagccaaaaacaagtttctcggtttaattttatgcgtaagccggctgtacacgcttctgttgtctttttttttacacctcagcgttgagtcctcttacgataaacaaacctcagaatggtgacacgcctacacaatcgccaaatatcaaatcaataatctaaaggtaaaaaagaaggggggaaggcgctttatagctagcttttctcctttacccaccgagtgtatttggacatatataataatatgaaaaaaaaagaaagggaggcgctttattttaatttctggctcgctctcgcccagctttcctcgtctttagctaattgcgacccatggaggagaagcactcacataaaatactctccagctgcaggattattgctgcatatgccggccgtgcctcatgttatatttgcagcagctacacatacagcagcacatatatataaataaacatagatgatgcatatgtgtacactctatagctagctagtgttattcgatctctctctctatatatatacatatgtgtcactcacgactccacagatagatagctacacgtacgtacgtgtgtgtgcaaacaatccgatcagctgggaagcaaacaacaacgaacgaacgcc

SEQ ID NO: 9023 - DNA, 215 bp, Zea mays
ggtgcgtttatttccctgtccggggcgctttcccttctcttcccgttgcttatccacgtggggttgccgtgaatccaccgtcttctccgcctacaatctctcagcaaaaccaccaaagccagctgctcatttgggggaagaccttctttgagtgaggtccaacccttgggggccatttcaaccttcgtcctccgcaataaaagttgggcaatcct

SEQ ID NO: 9024 - DNA, 330 bp, Zea mays
tgtcggattatatccgaaattgttccagctaattaaagattatataaattagagaagcaattcagttaaccaattcggcacaaacgaacaaggcctaaagtttatctcgtgacattgaaacatgctcttaagctagagctagttaaataggtggaggaggcttcggttgccatctcactctcgccgtcactccggcctcttccacggccgcctccgccgccgccgccgaccaccatagcaacagatatttcggagctcgcgccttacgcgcatggtttgctcgacgtgcaccgtaactaatcgactataagcgtggtgcctattgacgag

SEQ ID NO: 9025 - DNA, 354 bp, Zea mays
gcggcactcggtctttgccgagtgctcgacaaaaggcactcggcaaagcctacgattccggtagtgtcaggcctaacaagaaaggaagttagaagtacctaaatcactaataattaaaaaccagaagactaaccaactatgagtgatttattgtgtcttgtactagtctacacgtcaacgcgaacgactaggaggtggacgaagcgctgcacaacttgtttgcactcggaacacatagtcaccaaacaatccaaaactgctctttcaaaatgaactatcacggcacaggaacttatataaaccctgccaagcgacatgtaaatcacgcagacacacacacttcatcgtggagat

SEQ ID NO: 9026 - DNA, 368 bp, Zea mays
gacctgttgtcctctcggacgacgacgagttctcgtgctcacgttccggtgttcgccaccggtggccacacacccatgtccgatttccgaaacatcgcggcgccgcaatccaatcaggatgcgatcaccctccacagccatcacgtgttggtcgtggcagaaaggacacaaaaccacggtttcacacggcacgcaccgcgcgaatccgtcgttcccactcgcacccgcgtcatgcgtcgccgcccccgcgcccccgcctatataaaaaatctcgtcccgagtccattcatcacggggaactcctgcaaaactagacacttttacacagcgtggcagggcagcggcaagcagatcgcgagctaaagaca

SEQ ID NO: 9027 - DNA, 70 bp, Zea mays
atacagcttgttactactattactagctaggtgtgtgtagctgtagcagcataagaacagacgattgtac

SEQ ID NO: 9028 - DNA, 391 bp, Zea mays
tgcatgcctgcagcgccatcgtggtggcctccttgagcgagcacagctagctatggcgcctacgaacgtcatgacctcgtcgttgttgcacgcgatgccgtcgctgccgatgaggactctagcggtctagcctgaattaatctgatcgtggattgtttgggctattatgttggaccgtctgaggtctgggccgtcagaaccacaaaatcggattgtctggtcatctagctgtcagatttggcgctcaacactgataataaaaataactcagggaagaaatagaataaagaaataggtacttatattttattgcattccccttccacacgttatccgacgtcgtacgcatccttcctcccacacgttattttacccgtttccaacattattg

SEQ ID NO: 9029 - DNA, 188 bp, Zea mays
gcttagcctgagtttgtccctttttacttggtcccttggttatatttaccccaaatctgtgaatatatgggtttaggttgtataaaacaaaacactgacactcttttatattttgaatataaggcaaaaattctgggccggccactgcccagatcccgccgacattctccaaaccaaccgtggcggcg

SEQ ID NO: 9030 - DNA, 187 bp, Zea mays
ggcagtgaacatcggggaaatgacacggaattcatccatcagccgaagaaggcgaagcaatacagtgctagtgcgattccggcagactcgcagcaatcagcttgtgttatctcactctagaatttctgctgcaacgtgcgtatgcgtgcaacaatgtaagcaaatggaacttaggctactctaacag

SEQ ID NO: 9031 - DNA, 749 bp, Zea mays
gttgcggtaggacagaatatgtgctctgttacggtgttggtattgatggattcgagatatactagggcatgcaatttcgtgagtagcaatgcaacaggtgttgcgtttttttaatgtttacggtttgtggagcaactggggtgcatttggttgtgaccaagagagactgcacatactcttccatttggggtttgctcacatgtctgctgctatgtttagctttggtggcacatattataaatagagctgtgctaattttctgcttgtaccactggggttggggtgaaagcaagttcgagttttttagggcaatcggctttatgcccagttttgttagttgggcaatatgtcaactaggaaaattcagagacagaataatggtccaaattgtgaattatatctgcctactccctccgtcccaaattataagtcgttttaggtgcatagaaagctatgcacctagaaaagacaaaaccacttatagtttgggacgggcggagtacttctcaaatgagatgattaattccatcatcctgcagaatactgtcaatcctgttgtttatccttgtgtatgcttgttagtcaaaccatatttcagtaactaattccttgattgtgagttactgctgatctcataatggaatgggttttcatgtagttcagatgtgttttttactcaactatttctctattagtttctaggttacttacgtggatgctatttatctgtctggactttggatagtgca

SEQ ID NO: 9032 - DNA, 1464 bp, Zea mays
atctatattagactccataaactctattttaacaatcatattaatacaatttgaacttatgtatgtaacacaaaaaatatgtatatttaatttttgaaatgtaatattttctaaaatcacattgtcttgcaattgaaaaactattttccgcaatttaaaatccgttatttcaatcgtatacttagaagaacaatgcacttcgacaatgttgtatatatttgtccgtgccaaaaaaggttcgttttgacgatgtcgtacatatgcttaggggtggatacgagtcgatctagctcggcttgttgcggctcgatcaaagtaacgaatcgagctcgccgcggctcgcttctctagcgagcttgaaaagtaggattgacccgatcgcgagtcaacttgtcgagccaacgaacttgaccataaacgttaactcgccttccaaattataatataaaattttagaaataattaaataaacaaattttaaattagtaaaataaatgtattactaatctaatataatgtattactaatctaatatagaaaatatattgtgtaccgtaatctcaaataatataatataatcgtctatttggtactaacactattttaactaggattttatgtaacaaatcgttgttaggttgagycacaagccagcttgcgagccacagcgagccctcgcccttttctcgagccataaaacatgctcatctcgtgttcgttctaagagttgagctactctgattaatgcaaaagttggaccgtacattaacaatcggttaaataatatgtccatacgttaacgtgggagagagatccgttcgtgtatacatttatgtgtgtttggttggagagtcaactagaatggaacgactccatttgtgtttttgagaatagagccattttattctgcgtttggcaagcagaatagaactgatccattttttgtttggtcgaagagtaaaatagagcggaaccgttccgttctttgtttggttagagagctctatgagtgtagatgagaggagagcaatgagagcgctcgcgtccggtcgttttggtagagcgggagcactacaactatttatggtattttttcatatgaagactcgagaagttgttccgctcttcttctattgaaaccaaacatccagaaaatagaatcggagtcgctccattcttctacactattcaaccaaatgcaccctaagaggcatttcttcctattaaaccgatgcagctcgctcgccaggcgtagcatccacgtcgtccaaaaaatcttggtcgcatgcgtctgctgctacttcacatcttgtccgcacacgtggctagtgctgtttcatttgcctaccaaccggttcctgacttgccgctctgccttccagttcccacgaaaaaggaaaaaagaaaactcaagagcccaggcttatctagaaacctcgctaaccctcgaggcctcgagtagct

SEQ ID NO: 9033 - DNA, 386 bp, Zea mays
caaaataaaatacttccattcaacaacgtagaaagagtgtcacaacgatcatgccatcgtggatcgttgcacgggagtatgaaatacgtgccatcgccggtgcttcgaaactgacggtcggatgcccggtacggtgtggtgctacagagaaaccagccgcgcacaagaacccctgcgacgggcagcaaagcattccttgccggagtgagctggcagaacccgcctctcctattggccaggccacggcaccacccactaaactgccactctgccaggaacgaggaagcttccttcctgtccttcctcgcgaagcaagacacagataagagagtccactataaagcaacacagctgcgatcatagcgacaaaatatctcgccgttccc

SEQ ID NO: 9034 - DNA, 76 bp, Zea mays
agaatgcagtactcagtcaaatcagagaacatctagtatgaactcttaaggactaaaggttttatttaagactaac

SEQ ID NO: 9035 - DNA, 793 bp, Zea mays
ttttaagtacttcatttgtttatctatctcttcatctttgccttgccatcaagcttctccctgaagatgatagaacaacatggtgaaaatgaagctcaatttcactatgttgccttgatttgtaatactttcaggggattaaaatcaaatgtcaacaatacatgtatgtatagtgtatatatcttataatttggaaaacgggaataaggaggagcgttcgtgaattgaataaaaatgaagcaaaggtatatgcatgtagaatacttttgtacgcgttggcaaaatctagaaaatgtgcatttcgctacaattttattccttacgaacaatagtactgctccaagtcaattgtttgagaaaacaaaacacattaaagcttgagctttaaatggtcagagttcatggacctaaatgcaaatctgaaggaaaaaatagagtgaaaaaggaaaggagagggcaccagttccacgctgctccacctccggtcaaatccccgggcgcaaacgtgcaagatgtgctttgttctctcgctttccaattagccaacacgtctcgcgagaaaacggatacacacacacacacccgttgtcggtcccctcctctcccatataaaggctcgggagcctccttcacctccagctctaactgccaaactccgacctcgctctctgactgacgtcgtcgtctctccttatttggatctctctcccagagctcacaacaaatcaaccgtgtgcagctgctgcagaaccagagaagctgcaccctatcgatcgatcagcagcagctagca

SEQ ID NO: 9036 - DNA, 920 bp, Zea mays
tgcatcgggagtcgggacaggtgaattccggtggtccgaccggacctgaacctacagcagccagccgtgcgcggcttggcctcctgcttcaccttctctgtggacgcaaagagtacccgtgaggccgtgagccggccatctaggcccaaggacgccatggcgcatgcaacatggtgatgcagagcacgaccgaactagttccgtccatatccaccagactacttgggtctgaaagtacaagagtttttttgttgaaatagttgtctgttcatgttgtttgaaaaaaaattatctaaaatttattttgaaaaacaatataaagccatgttgctaaacggtttttttgataagggctttggctccccagaaaagctacacgcgcgaagaagccagagccaaaaactatttttataaaagctaaagtcctgccgaatccttaaactagttcatttttcaccatcttcttcaacgtaggtggggatttaaatttccaaacttgctttaaggcctctttgacattgttttttggggggtttcagctctaactcaccgtgaagccctgccgaacgctaaaaaaatgattcatgggagcactttaaaagccaaaactgttttcttgttaggagataaagcataaaaaaatatggtttctaggggctctttccacatttttctcatacatcactagaaaataaaagagaagttattttgtcaaatgaaatgtaaaacaactctctcttctctatataagtcatttgcacagaacgcagagccataccaaaagggccgagttgtaaacatgaaattttgaaaaagaaaaaaactaaaatacacaatgaaagaaaaatcggccgccgccctttgcgtcaccttttctccagctcatcctccctgcctccgatctcgggagcaactgaagc

SEQ ID NO: 9037 - DNA, 497 bp, Zea mays
ctgttcagctactcgtaacaagcagcagcaacaacccgctgttgtctgctcggctcggctcagccaagccccagccgagcgccccataatacagtgtcacagatctgatggtacaatacaatcaattataattttggaacccactgcattcattctacgcttttccaaatctatataaaaaaacatgtgatctgaatgaagatctttccttgcactagttcatactccactagtcttcttggttataatacgcctcaaattcctaagatgcgagcaattcttccctcttgtcccattaggccattacaccttctagtgggccttgcagcccaacaatgatagcagacccaaacaaaatcgccgattagtccccttcgctccgacaaagtccagatatacccttcccatttctcgtggcgcccacgggccacggccacgccgtagatctcctcctcgtcgcagggctccggcggtctcgccggcggtgagctgaagcg

SEQ ID NO: 9038 - DNA, 1500 bp, Zea mays
tgtggacaccgaacgctgtgagtcccaggagcaacagtacctgcgcagcaaagaacgagcacacaagtacacagtgcgtgtgcgtgtgcgtcatccatggaacctcaattctgcagtcgctaatactctggtcatggccgcggtgccgtctccgcggcctatgcgcagcggttgtagccactacgcctattccaacagcaccatggcctcttccgcttagaccaactccagcagactccctctctgtatccgtatttagcacggccaacagtttctctctcctctctgtatccgtccccgtttctagcagactccgtatttgcactccgcatgcagtctatgacaactggggcccgcgagcaggagggggcgcatgcagtcttgtgcggagaggagagagaaaccgtggaaaaggggagtgcaggtacacggcgtgtgttttgcggagacggatgcggaggctgctggagagcgaaatagtgacttagagcgtgtataatagggatacggagtgggatgtggagtgttgctggagttggtctaaggtaaaactgctccggatagccttagcagggtagacgttcctgtcagctccttgacctattcctgacgttcttcttctgtagtcctccgaagctccagtttctttaaaatgagctctcactgtcgatgatagagaaacgttacattaytgtttagtgacgatcacgagcatgccatgatgagcccatgcccagcacgcacaacacaagtggcaggagacgacaatcccaagttcccaacggcagcggaaacttgcttcgcacgtcggacggccgacgatcagtcgtgcaaggatccgttccatgcggacgattggttgccgtgggccacgcccagcagacggcccagatctatctcccccaagctgggctcgcaatctgggtcgtcggcgtcctaggccccctcttcttcgttgtcacgcagttctctggctccgactctccctcttccccacacctaaagatccgaatctagggagcgggttccaccaccccaagattctcgtggcgacctcgcaacaacctttttcagctcttcccatctcttcggttgccgaatctctctcgccttctctccttgaggcttttataatcagcctgttcttggttcatctcgtttctgtggagtggagacaattttttcgggtgatagatttcgtctcagaaactcttaaactaccgttgctttctacttgctcctctgatttgcgccgagaaacaaccactatataattatcagcgatttctttcgttccactcgatccaaccttgttgatttcctttaaaggcagcgcctttgccaatctacttttgttgagacagatgtctagttagttcttgaagaagataaggcttcctcgcagattattctgttgctttactttgattttgtcagttttgccctcaatttccacccggataggacccgagcattcttttatttctttctttccccata

SEQ ID NO: 9039 - DNA, 1456 bp, Zea mays
cttccaggacaaagtatgtggagtagggatagatccaaatatttatttagatgttaaatttttggtcttctttcttcgattataagtaaataggatataaaattataaattttatttttatttttagcattgagtttattgagatttataaaaagcaaatctcaaattcgttctatatatttttaaataattgatgtaaaacacagacacatatatggatttggatttagatgtttttcgcctttttcgttgtagggagaaaattttattcttgtctttaataataagctttaatatgactagagattagcactaaattttatgtacatattaaaatattaaatctgtcatataactcaaatgttcggatgtttagaatccatctctaatgtggagcacaaagatgtttgacccacacgtcacaccacgaaggtttggcgtgccaagcttgttaatttcgatgttccacacttaggtcttattcgggcatgagatcgaaagggattgagatgtattaaatctattaatagctctgattttattcattcatttttaaccaaacatgcccttgatacaggagtaaaaaaatgatggtgattacatgatttacatcacttcgcaagtattactgaattctagagtaccgagagataacgtgagtgagattgagagaaataaataagataatatctgtccgttttaatttataatttatttaactttttacaccgagtttgaccattcaaaaaaataattattatttatttttattgtgatatcatttaacatatatactttaagtattactttgcaaattttttaaataaggtaaaccggttataaattggagtggaatttggaacgttcacaactttggtttatttgtctgctctcgttgtgcggcagctgttccggtcaggtggtccgcagtggtttgttatagacgttatgcaggtttgacttgtactggcctctaccaacagtccaaccagctaccttggttacgggccacggctcggccgggacgttggatttacagcgacgccaccgcgggacgttggatttacagcgaccggcctggctcgccgaattctccctcccatcggcgtccaaagaacctccgtgtcgttcttccacaccttcctctcgcgttgccatttcagagcaagacggcgtgctcaaacgttctcctcgtcacgcgcagaccagcccgccacggcgccacggcgtcacatcagacatcacatggtgatggaatgatggatgcctcccccaaatcagacgcccggccgattagtccaaactccgcgtatgtcgtcttccccttcgcttcgcatgactgaccctcccactatttcatttcatctcccgaaccaagaaaccggccaccagagcgaaccccaagaaacgaccttgattagccaaagacagagcagcggcgcaagcgatccaggcg

SEQ ID NO: 9040 - DNA, 1471 bp, Zea mays
cttccaggacaaagtatgtggagtagggatagatccaaatatttatttagatgttaaatttttggtcttctttcttcgattataagtaaataggatataaaattataaattttatttttatttttagcattgagtttattgagatttataaaaagcaaatctcaaattcgttctatatatttttaaataattgatgtaaaacacagacacatatatggatttggatttagatgtttttcgcctttttcgttgtagggagaaaattttattcttgtctttaataataagctttaatatgactagagattagcactaaattttatgtacatattaaaatattaaatctgtcatataactcaaatgttcggatgtttagaatccatctctaatgtggagcacaaagatgtttgacccacacgtcacaccacgaaggtttggcgtgccaagcttgttaatttcgatgttccacacttaggtcttattcgggcatgagatcgaaagggattgagatgtattaaatctattaatagctctgattttattcattcatttttaaccaaacatgcccttgatacaggagtaaaaaaatgatggtgattacatgatttacatcacttcgcaagtattactgaattctagagtaccgagagataacgtgagtgagattgagagaaataaataagataatatctgtccgttttaatttataatttatttaactttttacaccgagtttgaccattcaaaaaaataattattatttatttttattgtgatatcatttaacatatatactttaagtattactttgcaaattttttaaataaggtaaaccggttataaattggagtggaatttggaacgttcacaactttggtttatttgtctgctctcgttgtgcggcagctgttccggtcaggtggtccgcagtggtttgttatagacgttatgcaggtttgacttgtactggcctctaccaacagtccaaccagctaccttggttacgggccacggctcggccgggacgttggatttacagcgacgccaccgcgggacgttggatttacagcgaccggcctggctcgccgaattctccctcccatcggcgtccaaagaacctccgtgtcgttcttccacaccttcctctcgcgttgccatttcagagcaagacggcgtgctcaaacgttctcctcgtcacgcgcagaccagcccgccacggcgccacggcgtcacatcagacatcacatggtgatggaatgatggatgcctcccccaaatcagacgcccggccgattagtccaaactccgcgtatgtcgtcttccccttcgcttcgcatgactgaccctcccactatttcatttcatctcccgaaccaagaaaccggccaccagagcgaaccccaagaaacgaccttgattagccaaagacagagcagcggcgcaagcgatccaggcgatgcagccagccgcc

SEQ ID NO: 9041 - DNA, 1456 bp, Zea mays; identical to SEQ ID NO: 9039

SEQ ID NO: 9042 - DNA, 641 bp, Zea mays
ctgcaggctacagaaacagaatttacagcgagccagagccatttcgtttgcttctgccgcgacgatcgagccaagctctggctctggaaatcagctcgtcggctgaccggaatcgaatcatgtggcgacgaagcggggcttgcagttcagatcgtcctcctcctcctccgggtactggacctcaccgacgacggtgacaatgtatgccctcgcggtcgcgatgcggactgcccgccgctaccggtattctgtttggcgtatttatatattgggtttttttatatattcccccctgcttgcttcatgcggtggttcccgcatccgcatccacctcgcccgcccgccccgcagccactgccttcctgcctgccattatttcttcctcctcctcgctgtccatccgtccgtcggtctcctctgcccgcccgcctgccatcattttcgccccgcccaagctgggagcaggcaggcagggagcgcggtaagcagcatgctgggagcgagcgccagcaggggcaggaaggcggcgccgccatcagtgaagctgggggcggcgaaggaggcgccggcgaccggtggccgcagccagcggcggcggcaaggtgtcggcggaggaggtgtgggaggtgcggcccggcggg

SEQ ID NO: 9043 - DNA, 1471 bp, Zea mays; identical to SEQ ID NO: 9040

SEQ ID NO: 9044 - DNA, 379 bp, Zea mays
atgagttgtcataggcggtgatactactccgttgtacggtgtaattggattggaatactggaggatactactccgttccgttttgacctgacttgaagagttcatgtgggccatggccatgagtagcaagtgttgttgggctgtttaccgatgtgggccatgagtagcagcaacacctgaccgcatcgctcctatgggccgtcccacactcccaccgcccctcgtgaccagcttcctcaatcccgcctctggaatctggattctggaacagaaaagcaccacccggactatatgctgtgtttattacccactgtgccacgcgcaggcgcgttcggcgttcgggactcccttctgcacaacctgacaattgcatccgaag

SEQ ID NO: 9045 - DNA, 121 bp, Zea mays
acagttcccgtcatcagataccgatcaggtcgacgcagctagctagggcctaggtgttgctccgtgcgtgcagtttcgtgtaaatttcgtttctagttcgtaaataggtgctggttcgtgc

SEQ ID NO: 9046 - DNA, 1500 bp, Zea mays
agattcccagcaatagttgtaatgcatgcatcttcagatggccaaataattgtgcgtacgagatcgagtcgggaccaatcgccgctgcaggagcgtacgtcgtccgtgcatgctatttgctttcatggatcgacgatgtagcagcggcggtggcggcttccggtgtgtgtcgctggctaaatgagagtttgttcgtgctgatagaccttgatcgtctgatgctgatggacggacggtcgaattggatcgctcaccggccrgcctcgcctgttgaatgccatcatgaaaatttgtcacttggcattgatcgcgacgcgactagcggcaggctcatcaccatgctgttccaggggctactgcttcggcttcgrttggtgttgtgctatactctgagtctgaggtgcgttgcatgcatcatatatcgccgctagctacagtgctgccatgcaacccgtacccgctacgctgaatgaatatatgatgaatatttcaataaatgtttgcttgtgaagttaactggcatgtgctcgatctgctccgtcctccattcatataataatataataaaaatgtagtcgtcttttttagaaactaaacagtctaaacaactaaatttatataaaaatataaatatttataaacaaataacgttatatttgggactgttccaactccataaaatttggtagagttagaggagcatgtcaccagaaaattgtggagttagagttgtaaacctctagagcatcttcaacaagatgatttcagatagtgcccaaaaaaatcaaaatactacatagtttaaagattttagagcactacaaacaaattgagctctaccaattaagctctaaattatgcattttagaaagtaaattacattattaggaaataaaatgttcagaatatgatgtagaaaacaagtataaggcactaatatggagtgtagtatatttaggtcattttgtggtgtgctttttatttttttataaatataaaataagtcactgttaaaactgtttttatgagttaagtcctatattttaagatatgacatagattatactctcaaccatagtgtctaggggcagacccagcgggtaaggttgggtagacgtccgattatcttaaaatttagtctaaaaataaactactttccagcgtttaaaccaaaagaaataaatctatacatcttccaacctaatttaataaattatatgtagtataagacaacttgattattttctgcttgtacagaattgacaaaaactatatatatgaaccaaattctaaatggtatgacatgtcaaagatttttatccttgactacccgccactgctagtctcacatgttaaatgattatcagagcgcgcaatcactagacggcgagtctatatatggaggcattttgtgcctaagaggctcacaatcggagtggatcaacaatagctctccttgtttttttaaaaaaaaaaataagaaagcacgagctcagcgcc

SEQ ID NO: 9047 - DNA, 628 bp, Zea mays
gtgtgatttgcttcaaattgtcccttgcatgatgtaggatgttcagtgacacaaaaaagtgatgatcatgttcagtttcttgttattaacagtatatcataaataaaagcaaaggaaatgagtgatgatctgtgcatgacaaaatttcaaggagaaaacagaaattttaagcttatcttagctttgcatattatctcgatctcactggtgctctatgtactctgtagcgaaagggcatctagcctaatggttaaaggcttccgagtaacacctctaagtctcgggtttgattaccctcgggggcgaatttttcattaaaaaatgctctcggtgcaccatttgctatcgggttacgatgtcctatacatcaccctccggttgaatcgttgcagagtggacgtttgacgccagtccgttagtgttgggaggccagggttcgagaattttctcgactgtgaccattgtttcggtctctttttaatataatatcgggagggcggtctttccctccccggccgagtttttagaattccaaagaatgtgtaataaatgcacaaggtagatattttcccgtacaataattatagaattctccagcagctcttatgagatgtttttataacattca

SEQ ID NO: 9048 - DNA, 455 bp, Zea mays
atcagaaatctattccaattcaaatgctgaaaaaatcgaactagactacgacaatgaacaggtaagcrccagacttgtcgatcgggcagtcgcagtgctacttcccttgtgacagtctagctgtactttagtttgatgttttttttttgttttagaaaaatgattttttgggacgttttacctttgttgtgttgctagggttgtgatgtaaagcaggaaatatttaaacttatcagttactgtgtatgttatttcatccatattcatattttccctctctctacagagcacttacgtgtgcattattcatcaagtatttagttcaaccttatttctgcaaatatttgttttcaagttcaagttcaaactattgtgcatattgtgtttatcaaggctctgtagaggtttggaacatgatcctatcttaggccaatctcagggccggccctgagggt

SEQ ID NO: 9049 - DNA, 1130 bp, Zea mays
ctgcagtatctcgtcggagggcatccacggctgctgcgggtcgcggtgcgtgcatgtaaaacccggggtgcccgtccggccgcatgaccaccagctccatgtcgaggtggcgcgcgcggctccttctccccgtcccttgtaaggctccttcctggccggagctcagccggtgcaaccccatccggtacgccaccttcatcggccaggcgtagccgatgtcgtcgtctgacgggttgagcacatatggtggccgatccgcgcgctgctgctgtagtagatggcgcgttcagcggccagtgagcaatgtctgagcaccacaccaccacgcacgtccatggtgtcgtcggcggcggccactgcacccaccggtcgtcgaggtgcgcgtacgcggctcatgttctccggcaggctgtgtcgttgagcgcctagcttgccatcgtggccttggcgatgaacggtgcccagaagaatgacaccgtcacgtcgtacgagtacgacgtcgggaacgcccagactcacacacactagcgcagccaattgggcccaaacactctgcttcgtgggcctcttgctgtcttggcgcagcccgccttggactgtgccgcgtccgacgtcaagcgtatgtcacgctggcacgggcgcacggccaacacacaaatccacagccacggcaaaaccgatgctttgacgccgagcgtccaaagaggcgcagatttcaatgcacgacctcagcgctggatccctccgatccgatcggtgagctgccatttcagggacgtacggagcactcgagctcagcttgtagccccagccatagatgcaccaccgctcgtgcacgctacccgccacgctccatggttttagggcagagggaacggtgagccaaaaaaaaaactgatgcgcgcaagggctcggtcgggccaatcgacaccgctggacctcgcgatccatccgtgcagcgccgtctcggtcagtggctagtgccgcaccccacccacgcccaccgccgcttcataaatcataacccgctcgcggccgccgccacctgcctccttctcctccctgggctgggctggactgcacacccacaggcggcagaggaccaaaggagggccgccggtcgatcgagg

SEQ ID NO: 9050 - DNA, 238 bp, Zea mays
aactcgactcagtttttttatttgcttttttttgcagacaaatacaaaccacacacatatatatatttgtaaagattcgttcgtattttcattttcaccgggaagatttgtaactgtcctcctccctccttgtaagttgctcctgtaaactcttcctgaattcatggcgtgtcgttgtagcaatcaccacttcctccctgtgaatgcccacagcgtgtcttggtgaaagcatgtatgt

SEQ ID NO: 9051 - DNA, 1145 bp, Zea mays
tcgtgtacccccggccggcccttttcgtccgtttgtttcctatactgtgcggcgatctggcgggctaccaaagcaatcgccgatcgaacatccccagtcaacacctgtcgacgagctatagaaaaaatctccctcgtatctaggatcaacgagtgattaattaatgtattaaactatgcatgggttgcacggctgcacgttttctggtgttgaatggtagtagtggctaatttaaattcgtgcattgggcaagacgacagttgacagtggtgagtgagatctcgttgctatagaggtgatattgtttacaggaagaggttttgattttatgaaatcgaatgtaaaatgctgggaatattcgtattgccgaggttatatgctttcaatcccacacaagggacgagtttatgagaatacgctccatcagtctctttaagatctttttacctgtcctgcggacaagaacagccaagcattcggctcgacagcggacgccagggcagggacgcacggtccacggagcacgagcaagcgccgccaccacgcaccagagacacatgaatgggagcgagtagccgcgtgactcctctccctttcttcttcttctcagaaaaaaacggagaggcagtagcttacgggacttctactgctacgggacacactactgtggtaggcggtaggcgacagcggcagaccgcgagggcgcctgccacggatggccaggaacgcgctctcagccgttggttcgcgatctggtggttgccccaccccaacgccacgtctccgtccgctgccacctccggccgtccggcgcgggcgcacggggaagacgacgcccacgcttttccacggggcccccaccctggcgcctttttccctttcacatccccatgcagatgcagcgccagtgcctccttccaccaccgccgcacacgttgctcccccattccttccctccccactccccagcccagccctgctcactcccgcgggctaataatatctcacgccgctcgtcctcctcggcctcagctgccgccactccccacactcgcttcccgtgggctgcgcgggtgaaggagcgcgcgcgtgcgtacgtacgtgcgggtggttggactcggatctgctgctgggtggggcgcggg

SEQ ID NO: 9052 - DNA, 82 bp, Zea mays
agttatggtagttcaataacaagattctgaatgataaaaatggagaacagagcctaccatcagtgaatatatagctgatctg

SEQ ID NO: 9053 - DNA, 1500 bp, Zea mays
ttactctaaatacctacgtgttggagaaagaaaggaaaaggatagctgcctgatccaaatagctcatactctgaatatcgacaccgaagaagtttgcaccgagtagggactttttatagagataaattgagttagatcataatgatgtagattgattaggcttctatggtttttatgcccctattgataaaaaaaaccaattcttgatttttaaatgttaagcaataaggttaaagatcagctaattctaagtatcaagaagttattggacctatagattagcgtcatgatctttattttttctttggtagggtggcatgaatgatcggcttcactagataaggccatgtttatttcatttttgttcagtttctggccaccaaaaactactgcagatcgctaaacacctaactttttatctcgcttctatgagaatcgttttagtttaaactgtccaaaatcaacgtgaatatagaatcaacaaagtcattgcaatagtaggaaactgtcattttctacgtactaaaccctatggattcttttatcttcctctacatgtaatttacacgatactcagattcttcctacccaaattctcagaaaagttcctcagaaaaaaactaaatcaaacagggcctaagtttagtgatgcatttgaatctaagatgctaaacttttagatgtaaggtacaaagatacttctaggtacaatggataaagtagcttattgataggtttaaatcccatcgcacaagtttagatacatgctaacgcattccaccaaacaggcacataccaaatgtgaaatggttcccccggtaaagaatgattccatgcaaaacgcaaatcgacttcctctctttctcaaactttctgtggaagtaagatatcaatcaacaggcaggtagctcaagttccctgtatgtggggccccctcccgccagctccaagagaagagggagatgccaagcaacccatcagagactcgagcagacaatcctccgtagagccaagtgcctgttttgataattctgccatacctgaggtagcagcgctaatttgagaacccttccatctgtcagagcatgtaaaaggtaagggtcatcacccagagcatgtaaacagatcggagttgcattcatctaccattacaaatgttctaggtttcattgcaacatgacatctatcattacatgcaattcttgagggacttccagagcagaatccgctacgactgaactttgcaggagcacttgtgaagttggtattctgtgtgcgtggtgcagaagctcagagaaacaaggttagtgtttccctcaaggtcttctttcagaagtttttcaattatgatgttgcctatcacaggttagacagagaaactaaaatcaattaagaacctaaacagctcattttgtttgtccttcggaacaatgggcttatttagaatcatgtggacattaccttccagattatcggcggtgtgcatatatagcaagggag

SEQ ID NO: 9054 - DNA, 788 bp, Zea mays
gatgaaaagtccggtcgaccctcgataggtggaaatgaactgtatgcgggtattgggcttctgcgtttgtctgcttttatgttggactttggacctgcaacagaattttgattgcttttgaaaatttgttggcgaaaaccattgttaatcgatgggcactctttgtctcatgaaaggtgtggttaagttatttccttatcttatccgtcaaatagtatttctctatctcttctcttatgtttctctgaatatatagttatgacacacttaaataatttatgtgctattacaacgcacgacattgtattagtagaattttaaagttcacataaagctatatcctccgtcttaaaatagttgacactctcattttttaaaaccaattatttttaactttaattaaatatctaaaaataattaatatttatagtatataattagtattaatctttggatattttttagaacaactttttattttagaatttaattattgcttttttaataaattttgtaaaatataagaaagtctccaccacataatactatagccataattcgacggaacgagcttcatgtactggaaaacctgatctcatctcgaacgacgtgtatacgcagcaggcagcagccgagccgtcaccacttcaaatgagcgccagctgtgcgccacagtaccccaaccgaccctgccggcgacggcgttcataaattgggctagggcaaaaactgattcgcgccgccacctctagagagaactgtagatccctgtcatccaatcacccacc

SEQ ID NO: 9055 - DNA, 122 bp, Zea mays
cctttagagtcgacctgcagggtaaagctctcccccgctcgccggtctctgtgcccaggccagcaggacgaagaagaagccggctgggaagacccaggcctgagctaggggagacgacgacg

SEQ ID NO: 9056 - DNA, 126 bp, Zea mays
ggtaattgatgatccacatccagtaaggttttctgtgtccggtctgttgcaaagcgtgcttcttctgtaagctccaatatctatattgatatacgaatgaattggccataactcttatgatctttg

SEQ ID NO: 9057 - DNA, 861 bp, Zea mays
tctgttgaataagcagcgaaattattctcaaaatataataaacaattaaaaataattcaaatttgtctattatgaacttcagataccaactgtggacagcatttaaatctttttattttctgacataagtaaaactatggtggttttgaccaaaatgacacttaagatcattcctgtagtcaaatttgctaaaatttccaagtgcctgaattttagttttttactttcgattctagagtcacaatcatctgcttcggcatgagcgccatacactttcaccactaaaacaagggttttgctaaaattcaagtgcctgaattttttttcgggcgacagttattgcatatattttatactaaaattgcagattcagttcgttttgcaattttcagtttcgggaacaaaaaaacacattagaatttatagatccaagaaaatcttatccatgttgggaattaacaattatttctatagcagacaaagacaaaaaaatgatttattaacaacaatttacttacactaattagttactacaagagtgttgcctgaaatcattaaaaactctggcacctgacatataggagaagtgctaaaaccaaggttggtgggattctcactttcttttcaagtcatgtaaatgttgcagcatctgaatagtcacaggtagtgggttttacaaaaaagaggctcaaactgaagttcattggaaaacgggggataaacctcaccctgcggtggcagcaacacgatcctcctccttggcatcagaaggaagatccgcatgatagacaggaaaagtcaatacgacacccaggtgattcgacatgagccggaatggtcgagtgagaactgccttccccg

SEQ ID NO: 9058 - DNA, 1500 bp, Zea mays
gttctgtttacgctggtgtaggtttagttttcaggatttgtgggggtgcggctgaaaccctgttcgtcacgttgagtccgccaactggttgcgtgtcttagcgtgctttcggttgacggcacggtatttggctcggagtcacggaaggacgggatcatccttgtgacagaagatgctaccgtatctggatctccgtggcggcgccctccctggcggccgtgaccctccctctgttggttttccattccggcgacgctcactctcatccttggtgctgatcctcagcatcctgctataccagcggatctcgtgtttccttgacgagttaaggagaccctaacacctgaaacctgtttcgtgttgcacggcactataaacatgatttattttttcctgaagaaacataagtctctgaagagaaaaatataaaacccatccgctctcaattatagtaatttgcacatcaaaacatttacagtcccgaattgtgggcataaagcaatttgggggaaaagaggaacgatgaagcacgtagggaaaaaaatcgatttgtcagtagtagccgttgtgtttcgatagaatatccaattcactgcttgagtgcttgtgtctaacataagccgttgtgtctaacacaagcagttgtgtttcgatagaacatccaattcactgcttgtgcctactaacataagctaatctgtctaacacaagcagtaccaaactaagcagtgtttctgtctaacacaagcagtgtcgctgcaatctagcggggtattaaacaaaaataggaaagtgtgttgttttgatgtagttgcagttgtgaaaggtagctacttctgtcacccaacctatccaattgttttatgttcattgtgttgtcctaaacatgcttagcatttgatattttgatgttcaactgtgcaagatctcttagtccaattttagctcatcatgtcaccacttcttgatcccatgctatctctacatagatgttcaactgtgcgaggactcttagtcctatttttgctcatcagggcactacttcttgatcccatgctacctctacatattctrtatgaggctagcttatagtagattacttattccaaaaaagctgctcatttgtattgccaagagcagtttcaaaatctcttttttcatgttaattgcttttcacaggatcttcctaggcactatctgctaattgttctttatttcactcaaggtttatgttattaggtcatggttcacaaacatttttttcctcatgcagtatttgctggttttcagagttgatgctaaacatgcttatttaactaaactagaaatttgttaccgaggttagcgccaagctgcctatccttcatgcaattgagatttaatttgtccaattgtcagtttaacgggcaatggttttgaatttatgctgatgatgtaatttaattgcatatttgcatgcagacttgtgaacgaggcagcatcatagttcagtttggaaac

SEQ ID NO: 9059 - DNA, 265 bp, Zea mays
cgggtccgttgccgtgccgtgccagtagccagtgccggggtacagtccgtactccgtaacgaccccgccacctctttcccctagttttgttagccatcatcatcaaagaatttcaagtcgcaaagcgcgacgtccgacgagagagagcggcctcagaacaggagcgaagggatccgccagagtccccctgagtccaaccaagctcggtccggcccagtcccaggcccaggcccaggcccgagcggtagcctgtaggtcgccggcg

SEQ ID NO: 9060 - DNA, 652 bp, Zea mays
ggtaataactttgtgttattctgcttgcacagattcatgctcatatgttattaattttaagattgtaatcattcattcaagtgcactttgcctgcaatgcataccatacttttaaccagtggcacaaccattctagcgataccttatgtagaattataactccctgcccgtgctatatcaaaaccattctattgaattctctcatgatttgcggttaggttatgtttaaccattattggacattttatgcatcctcagtagtgtggacatgggcttcatgtctccctaggagcacaaactccatgttcttatgttattgttttgacgttcatgtcatcctgaatgccacttgtagcatcattccatatatgcaagcaacaatttattaaactcttattgcacgggacctgattaatgatttcagtttatttttatgatattttaattgactaataattatacaaaggccttgaagcttaactgtaaggtgtcatagttccatgtgattaggaaggctccactatgcccatgtaccttcatctcttgagctgatatcgttttcacatacttaaattcgttttaatgttgcaggcacattgcagctgaatgttcttccaaaggtacctgctggaactgcaaagagcctggccac

SEQ ID NO: 9061 - DNA, 525 bp, Zea mays
taggaagcaaatagggagataacaagtttgttgttcatttataaaataaaacgacaatatgcattaggtttggtcaggtttaaaaacccacaggttcacaggttttgatactgtagaaacaaaatcatatatattaacccgtcgaatatagatttatgcaggttaacaaacatataaatataaatattgatccaaacctgtaccctaatgagataaaaacccatcgaattttggttatcgactgtccgtgcagtaacgagcgtatctgaaacatttacgtcgactgtcgaagtgccgagacttctcttcccagtccggacttccggttgcttcaagttccaggcttccagcgttccaatttccaaggccatgtctgccgctgcacacccctgctgcgtttttaccacaaaaatgtcgaaacatacaacccagtagcaaaaaagcacgaaaaaaaaacggttttacaagaccatttgcgggatatactttcttcaagaaatcttccccacttgttccctcgcgtcc

SEQ ID NO: 9062 - DNA, 697 bp, Zea mays
ggtacggcccagttggcggcccccgctgcccccggctccacgaccgctgaaagagaagtcaaagcgcacgggtcggcaggcagcttccgcgttcccactgcgcagtccgcgctcctcttccctcactggtgctcgccttggctgctccactcccagctccaaaaccctaaccccgcgagacatccagcagctaggagcgggtccaggagctcaccgtcgagcgaccgctacactcgacctcaccggtttctagtaaggcatcccttcagctcgccgcgcacgcttcttacttccttcggtggtttctttagctattgtcgtagttgattggttgcttaggtagccgttctagttgttaattagcttgagctttgaggtggctcgttaattcttcagtgagaatatcgacgccctttgacgttttagaggtcaagggttttgttcggtgagttttaagcttgggttgggggatagcgcgtgcggcatgcctttctttaatctctagctcactgcttgcgttctagttttatactgtgcagtattcttctatttagttttcttagcacatgggcaataggtcataagaggtcatggttaattagggtcttacagttgttgcaggttttgttgctctgattaattctaactagtatgtgtaaatatttggatccaatcacctgcagatgctgatcaaagc

SEQ ID NO: 9063 - DNA, 73 bp, Zea mays
gatcacgaacagggatgtgttattcgtcgatctcgtgctgttgctattaacatgccgtagatcacgaataggg

SEQ ID NO: 9064 - DNA, 1500 bp, Zea mays
tattaatcttaatataactgaaagggaaatggtcttgaccatttcttatattgattttggtgcttgatgaccatcacaaccattcagactaactagtttgcctagtctttgattcacatgttcataagttcaacaatgtaagtttctaagttacaatcagctcaaaataatcaacatctacctcttttggagcttgtttgagcaaaataagcaatatgagttagagaattaaaatgtccgagatccatgacttagactagttggaaagacactagagatatttgtctaactcgcttgtgaatctctgtcgtattctagcgtccacacaatattaagtcattttagagttcaagcaaagacattcatgcattcagacaacattaagtcattccaatgaacattaattcattctagtaaacatctaggcaacaataagtcattttagttttcagacatttttcatgttttctcagacattcctttgttttttattcaattattcttgtttttagggaaacatgaagtcattcttttcgtttttagtcattcctcatgtttccttagacatttctaggtttttcagtcattccagaatctagataacattgagtcattatttgtttttcagacatttttcatgtcgatcggctcgggcagttggctcggtcggccgggcgtgggygtggaggggggggctctggacgggaaaccacgagctagaagaggtgaatagcctatacaaaatattctagaaaagtcaatatcaatactaaagccaagtttgatgggtgtgaaagcgcatacttgatctagttctagataactctgcgctggttttaaatcaatctagtaacttggtaagaaatttgtattggataaaacaagctactcacttgcattgcaagagataaaactcaatgataatctacgcaaagtctaaaaaacattaaaatacaacaagtaaatatactctagtatttaacattgttgattcagtggtagctaggttgtggcttttaattaatagcatggctcctgtgattattttgtgaatctcgagatctctgtcagtattgtccttttaatggtagacctcatatgcccttggataacaaggtgacatgttgatttcgtacgtcaacccttagagatatgccgacattgttcttccaattaatagtaggatgtgaagctgggagctagcgagcatgcatataagtatgctggtcggtctttcgaaatgaaatggtgccatgattgttagaatatgtaaaccaaaaatagaaaaggccaggagatatggtagttaggaattgtaaaagaaagaaatagtttgtttctattttatctcctcaatcatctcctggcatcctctatgtaagccacggctggggcttttccagccactcagaaaatcaacacgcaacacgcctgtctccggcgtttccaccttccaagcacctctgaaattctcacatggtaatcagagcctagtgttcc

SEQ ID NO: 9065 - DNA, 265 bp, Zea mays
cctcataggcgcgccgcgcgcgcggaagagttaatggaggccgtttccgtaagtgcgctgtttatataggacatcaagtaattaaccaattagttaatctcaactgctcgattatattgctggttaattatccttgtacgcggttgtatcggaggtcgttacgttctaacaaggatatccaaccttaattatatatacatacatgatcatgatatccaacctatagctctcgacgacctacaatctaatctaatagtcaaccagc

SEQ ID NO: 9066 - DNA, 584 bp, Zea mays
acgtgaacaaaccaagaagagagagagttcatgccagtggcaggttctgcaatatgatgagtggaggaccggacgtgagtacgtgacacgtcctgcaggattgttagctgtttttcttggcaagaaaacatgcacatgttcatgttgcattcttgtttgtgcgtgtgttctttttgccgtgacatgtagagacacccgtagactgcatctgcatcgatctccggcgtttcaggggtttagttttgagtagtggcagcccacaaattccggcagatctccgagagtggaggaggaggtggcggtcgctccgtcgacgggcttccctccatcactctcctgctgcccgtcttgtgcggatcctgaacaagccaccacgcctcgtcttgtgctcttctcctctcgatcgcgcatgtcctgtcctgacctgaccggcccatcgccatcgccatagcatcgggggtcgagcagctcggcgaaatgacgcagctgggctgaggagagcggtcgatcgagagatcatccatcggggtcagggactcagggtgtgagcgagggtgtaggtagggtgggtaaagatggacaag

SEQ ID NO: 9067 - DNA, 1500 bp, Zea mays
tagttgttactgatcacattagaaccaaccttcctcgtgtctcctggtaggccgtatctttaacttgccattggcaacttgatgccacgctgttaagtgtatatagagttccaattttttgaagcaactttttcgcttttctaatgcaaccggtgtatatatatagttcttttgactattcttgttacttttgcatatggtaagtgaagttttttctaaatttttgaagcatttgacagtaaaattatagagacgattgaatataaaaataccgttaaatatttttattttgaagagcactagaggatagtgttttacaaataaaggtcatgcgaccgatataatatttagtcatcatcattatattacgtgtatatcaaacatattattaccgggacgcctctgctttagcttgtcgtttgcattgttacaaaatattgtcatgtgatcaaccctctcctctgacagttttctcccaagggacacaccccttgggagacactgtatccacatgtatataaatcagattctctgcaataaagatctacaactgtcatttctagattctctcgaatctcgtttttcactgcactctaacatgcatcttgatggttgatgccacgctgatctggcacgcgcggcggggcctcctctgtgggtgcctccgtggggacaccgatggttactcacaagcaaccctcaaaatcttgaacgatctgatgctctgatccctttcatacaaaagaagacgaccggcgatatcacgtcacatgcaagcctttttatttcgtctccatatggtacaacgtttaaaacaaaataaaaaggcagcatggcccgggcattcgcagctggcacggactttttattttattttatttagcaagcaagagatctgatggccaacacattgccaaggccagctgcggcagcgtgcaggagtgcagaggcggcgacccgctggggctggtcgtggtcggcacgccagggcccagagggagaccgaggaaacccacccgtgcgggcacagcagcagcagagccgcgcatctccttcctcgcgaaaccgagtaggtggaggccttatcctcttcgttgccacgacccacgacgcagaccccaacccactcccactccgacaggaaaagaaaagggaggacgacggagtcgctcggccgtagatcggatgagaacagagatggactgctgtagataatgctacacttttccggggttttctctctctctctctcccgcgagctgactgacggctcctttatctcctcccgcgtgcatcccccagctactcgtcattcttatccgcctgcctccgccctccgccaccgctacctttatagctctagcttccttcctccattccctcctcatgccttcgtcttcgtcgtcctgcagccccgcaatagagcatcgtacttcatcgttccacttacatcgtttgttcgttcgttcttccgcgtgatctgcttgggagttgggggca

SEQ ID NO: 9068 - DNA, 1491 bp, Zea mays
gtggtctcgtaaaaacgtaatttttacctttattttataaataagtttgcaacacaattcaaagttgttttcaaacgatcatacaagttccagaacagaacattttttatggaaaagtgtctcttatttgtgactgtagggattatctagatgtcttcgttgattaatactaccagtttacattaagatcatctatgggcaatcaaagctaaagaaagttgattagctaggacaacatatagattgacttatacttgtgacgagatgaccggaggaagtatttatacatgtgatttattatttatgatgaatttgaaacctgaagtcacgactcacgagaaaccctggcgcaaaaaaaaaatccaaaaggatataaaaggagtggggtggggttttgaatgtagattactgtccttgtaggctgcaaatgggctgatgtccacactttgggcccattgttaacaacagccagattgcatgtgaaaactgaagccacctacaatactggcatgccgcagtgttggagcatgatttttagttagtaacgcccaaaatttattttagacgcctttttagcgaacaagtggagatgctctaaatcacttaaccctgagtgaactgaacacggcagtttactcattcgttcccccacaaagttcggttggccgctacatccacaagctcatgcacagccctctcgagaggaatggaccagaggctctgcattcgccgcacgactctctctctctctctcagatgtgcggccatggtattggccgcagcgcatgagagagagagctgggagaggccaaaattggtctggtcgctccgtccgatctatatgtacaccacggagggcgctcgggtgtaaaaatagacagttgttgctgctgctcctccgatcttcttccctcttctcctttccttcctcccagccgcgcgtgcggagggaagaggaagaagagattagaagggcgcggaaaggagaagctacattcattagctaataactaggaaaaaaaacaaatttagcgtcggctgggcagacggtggcggcgcgcggggggagcgagcttccacgcgcccttctccctgccttcatctgctccatctgttcaagaacacgccagagaattcaagtgtcgcattgcacttgcactccgtcgagcggtcgagccccgatccatgcctgcgcctgcccctgccatcgccgtcgtcgtgccgccgccgccgtcgccatcgcttacaggttgcgacggctgctactgactgatcgctctggatgtagctataggtacctctcgattggcgtgctgttctgataacttctaacgagcctcgaacacaaaacaaaggtacgcgcgtcagtttaggatcgcattgctgctgtgaattgcgaatttctaatcgagtgactcggatgcatgttaagaagccgctctgccaccggctgccactggcgctggaggcaacgaccgctcgttagccagg

SEQ ID NO: 9069 - DNA, 595 bp, Zea mays
ctctaacgatgtcttattttataaaatttgattaaaacagtataaagcattttctcaagtgcctcaaatatattacaccatagtgacttccctataatatagatttatggttttaatgttgaagcagaatgttttttatgccataaattctataaattatatttatttttaaattataaagtatttttatgttatgctgttggagaaccactctcctagtgaacaccaactacccaaagagagtagttctccctctcgcacccacgcggcagcccccacggcgtgctataaatacttcacgaacggcccggatatctccatccctgcatcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataaggtatgcctcttgccctctccaaacccctccgcgagggcctagggtctggcgtgctgagctggagctgatggatctagggtttgggttgcggtgatggtcctgcagtgcaggaggagctc

SEQ ID NO: 9070 - DNA, 785 bp, Zea mays
tgtgtagctttgactacttatgctattgaattattgatgcagtcgaaataaatcatctagagtatagtaacatgtatatcattcatatatatgatacgtcataatgaggtgagatgttttccaactctataggtatacttgatcttgcgacgctagaagattattttataaatttacttggaaggaaaggcatttgttgtcatcataaattcataatatatgatatctacctgaactgcaatgttgcagcagaaagattgtttgggatagcaatcacatgcatttgcgagctccttcatggttaacagtgatttcttgttattccagtcttgctttgtgaatgattaattttactgtcatttttggcagttttctatgtgttgttatgacattatctatactagaatctagaaacattgaacattaatcctgttctaaatgttcttctatttgtagttagatccaacgcttctttagtaatgtatagatttgcttattccatagtttccctgtttctcctttgagcaattatagggttaacctactaattcatagcttgagaagtgatgattatgttagtctgcatattgagccataatttttctagcagcttgcatttgataacccagatggtttgtcaggtgccactgctaccccctaatattcaaacggataataatgtggggtggtaatccaggtggtttgtcaactgaaattataaacttacaattgggacgtcgtcaactgccgctggattgcccgattcacttaacgctgttcaactc

SEQ ID NO: 9071 - DNA, 410 bp, Zea mays
gtttattttgtctattcgggtttgaaaggttagaaaccgaacccgaatccatatcttcaaatttagcatatatataggaatcgaattcgaacccgaaaactcgaatagaccgacaatattcggatttagatttgagttttaaaatacccatccctagcctagatctgtttgggcccctgccgcgctctccgacgcagttcccagtccacccagcccacagcccaggccactcgcaaatcgcaacccacagcacgtctcctccttttcctcgtccacccggccatctccgcatccactacctacaggccgcagcccagcaccggccgctctacgcctccacgccggcacgtcctcgtttctgtccgaggtcatcgcctccgcaacttcgtggccggtgaggtcgcaccacc

SEQ ID NO: 9072 - DNA, 370 bp, Zea mays
cccgtcggctcggatcgcgtgcaagctgccggcctgccgcccacagaaacaagtataggcacgtcgacccgattgtctgcagtttgcacacgcaagaacgcccgcccaaacagaattatccccagcatattccgcgggatatcgcatccaccgcctgcgcccatccccgcgcgatggcccagtggccaggccccgccgcgcctgccaaccctactcccgtcagcccacgccgagccgctcggaccggatcggccgtatttaaacgcacccccgtgtgacctcctcaaaacacgcgaatcgtaccggtacgaacactgagcacgcacgcacgcacgcaaactcaaaggagtgtgaccacggaactgaagcc

SEQ ID NO: 9073 - DNA, 1082 bp, Zea mays
ccccgtggtgtagttgtaatcataatacacctgtgcatagtttgaagaaagggacatagatctacggcagagaaatacatatctagactaagccatatgtaaatagacacatagaactaccaggtgccatagtttagtcatgcctgccattcaccaacagcgctcatactgtactaatcaaggggcctacaactagcctacaaatagagaagatacaagcacttaggcacacatgggttgaatataattctttgtaatgctacaagcatttagtttatattatgagtgctaccttcaccgatgtttgtaagtgggaggtaattctttgtaatgctacaagcaatttgtttattatatgttttttctttttctaaattcccatggcgtatatttttagcttttctaaattctctagaaaaactgtttgcaactgagggagccaaattccagcaaaagtatggctccaagccacacgagcgtcaatcggtcaatccgtttctatcgtttgttcaatctccgtttcgattttttttacctcatcttcacaacccagcttattagtgatccatttacatcctctctctctctctctctcctctcacacacgcatgcttcagtgaatgttgatgcggcgaaacagcgtcagcagcaaatctctaggccccgctaataaactatctcgccattagcagtaggcggcggcgcggcagcagcagcccgcaggcatgcaacagctgcagcggcacggggagaaaaaggtgggcaaaagcgggcacgaaaccgaagcgctcgccgacccacccaccgcaccgctctcccatcccacccaaatcgccgaccgataggagagaactcgagctgaggagagagagagcagcaggcggcggcgcggagtaacacgcggaggggaatgcgcagcccgtgtgagcctctcgcccccgcgaaaccccaccgattctgattccgccggcgaaatcgggcgcctcgcggctcggccggctaagcggtggacggcggcgccgaggggttcgttcgatacggtgagggtgaggccgtgaggagcagcagccacggcgacgggg

SEQ ID NO: 9074 - DNA, 140 bp, Zea mays
ggttgtcactctgaatctgaactttacaccatagtttgtgttacatctcttgaattacagtgttcagttgtggagaagtagattttaatctttacatttacagaatatatttcacagtctagcttatcaccattttgatt

SEQ ID NO: 9075 - DNA, 202 bp, Zea mays
ctgactccatgtccagtgtctgctgtcatctgtcaaactcttggagagagtcagctaaagcgagctacaaactcctgtaacgacctctaaacatactactatcatgtactggtgtgtagcatgcctttctatcttttgttagttcgatccgtgaaactgccgatgaaactgttctgtgaaccgtggtgcacagtaatacatt

SEQ ID NO: 9076 - DNA, 91 bp, Zea mays
ctcgtccgctcttcatactcccgaggccccgatccccctttcatttcaactcgcatctcccgcgccgcgccgccccagcccggcagcccaa

SEQ ID NO: 9077 - DNA, 88 bp, Zea mays
tgcagcgcagggttgctacttcgtcaacggcggtccgacagcgcagggagtcctgttcggtgccagtggcagcggcatggtgatgccc

SEQ ID NO: 9078 - DNA, 1052 bp, Zea mays
tcggatatatgacatgttctaacattatattgcactcttttctttatatgagttttccttataaggttttctcatgtaaagtttttaatgaggcaatattaacatacgcacatgctatatcatctatctttgtgttatttcctactggcttttttttggaagatgtttacatgatggatttattggatatgattctaatacttcaacgatgatcatgccaaaacatggacgggatcaaggaggagtgttgtggatcggtgatatggattaatctcatccattaatcaagattaagcagttagctagtggaaggatgtatttttccaaagggacagtttcgcgtccgtacagatgtttatatacgtgtacacagtgattaatgaaagataacagctctccattttgtcatttcgtcgaacacctgttactaatggctgctgacgcttgcgcagatcgctcgggtggcacaccaggccggcagagctagcttccttgcctccgtgggttacttttgagccgggggtggggcctccggcaactttttcgccggatgccgggcgaacaaaggatgcacgagacaggagcggagcgccactgttcctccgagccccgtggcccgaggagcgcctggcagccacgtcgcgggcgcggcacacaaaggacggcaccgaatcctgttgacttcccacaccacacggccccccgtcgccctcgcgccctttataagccttccaccccgcccccacccctactcgatctgcttcctgtcttgttcttgttccttccttctttgctcgagctcagtttcacacccctgtagctggagcctgctgtcctgcagcagcgtgacaaaccagaccttttcaatctcttgctcgcttgctcgcccgcccttcttcttcatcatcttccacacgggctgcgtcgccgtcgtcccaagcctgcctgcagctatccttctacctgccggttcgtttgtagttcttggagggagctagcagttctctgcgcgcctgagctagccaccggttaatccaagtcattcattaccg

SEQ ID NO: 9079 - DNA, 1199 bp, Zea mays
tcgacaaatcggtccctcctcccggccgcctctcgctcgttctagcccctaaccatcttcagtttctcctcggcaggccgagtgtgggagtgtgacggctaataaacgctgccactactagtattccactactagtattcgggtgggtgttgacgtgtgcactcgccgactccgcccgcttcgagtactccactcgggcaggtgccggcggcccgacgtctttgacgtgtgttggctactggctagtttcatggttcgtgatcgggataaataccgaaaagaatacgtaagctatttttgagagtggggaacttcacatgtttggtgtttggttagagggactaaagattagtctctagtttttagtctcatttagtcccttttttgccaaacactaggactaaaatatggactaaaatgatttagtctttagtccttcaaatatgtgctaaaagagactaaaagaccataattatcatgttgcccttaccttttttatagataattaatattatgagtatattgtaagggcatttgagtctttggacaatgtatttaatgactttagaatatgtttagtccctagaaccaaacatgtagggactaaagtttagtcctaggactaaagtttagtcctaggactaattgaaaccaaacatggcctaagtgttagtaaacatgagtgacgacatattcaagtacagtaaacacgagtgatgacttatttcactcttagattatttctaatgatgattttatcttcaataaatatcccggcacataaacaaatatggtgatatatatagcaacgatttaataagaaaagagatacaaagggtttcatggaatacgagagggttttatgaaagatgtgaatatttcatttataagaaattcaggatgatgcaacattctaaaagcaatgtagtaatggaatagcctaagtatcagcttatcgtacgaaatcaaaatggatggtccattttatcccggagtactcagaccaattatactatctcaagcagttttatttattttatctcatactctcagtaaatagtgcgggtcaaaataaagaagttcgaagccacgagcctactcttccagaatccagataagtagacatggcctgaaacaatcgcagacaaattggagctagcaactagcaatagcccgttccataagcaccagcgttcgca

SEQ ID NO: 9080 - DNA, 709 bp, Zea mays
tgtagacagtagtagcggtgcaacaggtcctagaaccctgatccgtgttctaccaaattttcctgtctcacacgaccgtctttctaatgctgggaacgtaaactgtacccctagagtgaacaattttcagtcgggcagtcggctaaggaacaggaaccgtgtaaaatgtccctgctctagctcggtcttcactcaccggccggtgtcagctcagtttcactcgaaacaaggatcggaggagcacgcacgcaaccgatctcaagctgcagtagtgtgaaagtgtgcagctagagctaaccactgctactgtccaaaacgttccatgcgcgcgcgcgcgcgaaacaagttttttttggttctccttgcgtaacagatgagacgagacgagacgacgtgtccaccattacgctacgctcaccgttgcggctctggtccatctctcacctgcaccagaccatgccaacctctgacacgataaggattgaaagctggaggcagcacgttacgtacaagttgcatgcatgattttgctcgatatctatagctagagcagcatgttggggtgtgctgtgtgcaccgctgactataaatacgagagcgacgacgcaaccaaggcacgcttcgtacttgccatagttcgtcatctccaagtgcgtgccctggccgccccctatcccgccggccctgtgtgtgttccccgctaccagcc

SEQ ID NO: 9081 - DNA, 178 bp, Zea mays
tatctcgtgacctcgcgtttctcgctctctcggcggccacgctttattatcccctcggtatcttcgcttaacctcggcgggcctcctcgtacggccggcccaacatttcatttcatttcattaggcccaactaaacgagcacctgggcagcgcgtctcggtctcgctggcgctttccc

SEQ ID NO: 9082 - DNA, 895 bp, Zea mays
ctcggtaccctggtgagctcaacagtcgacctgcagctgctagagcggtttgcaggacccagcagaccagcaggaaatcggcaacaacatacatactgcaagctcaaagtccatgcacgaagccaacaggccggcctctccctatagctttttggccttttgtttcccttgcttcttgtccgttctcttctctctctctctctctctctctctctctctctctctctctccccatgcatcttctcttctccatctctccccctacctccggccggtcggactgtgacatgtaacggactgctcaatgatttccccgcgatcgagctgcatgtgcccgcggcagagcagtacacgcagacgggatcatctccatcggccagtactacgccagtggctacactagtctcgctttctctctcatgcatgcatgtatatgccctcctcttcctctctctctcctgcacgctgtgcagcaagtgcaaagcagccaagcacagggcacagcatctgtacatgcatgcattgtttgactcgatcctatccgcttatctttcggtttcagtacaggcacgccttagctgtggccgctgtgcgaatccctgctgtcccgtatctcccagctttctcgtgctactgactgttgtactagtcctactacactgcacagagcccagctagtatcgccatgattgaatactgcaactcctgctgcgtgctgcatgccacaccagagagcagcgtttcaagctcttccccatagttcagtacttcagtatatatgtgtgtgttgtctgatgagaacgtacatggccctctagctagctccggctccgcccactctctatccagtagctagccacaggctctcatccgcctcttgttccttgtcttgttc

SEQ ID NO: 9083 - DNA, 541 bp, Zea mays
agcatctcattccacagactctccaacatgcaagttagcttggctagcgagagttgctagccaaatttggctagcgagaaggttaatttagagagccagatagtttagcaagctaaatgactagtctattggagagttattatgctaataagtagctaaaatttagcttgacaagctatttagctagtctcttggaaatgctcttatactggttgccatgttatatttatgataaaccaaattatgttatatttgaagttgcaaaatgcaaagatttaccacatctaatagattgtgcatgcattaattagatctagaaaaaagatttgatacataaaactttcctattttacaaaacagaaaactaaataaatataaatttcacctcttacctcatactcataggaagtaataattattctaaccacttaaatgaatgactcatagtcatttgcaaatataaacgttaattagttgcagcttaacttcatgcatgtcatgtaataattgccattcagggattctcactcgacgatgacac

SEQ ID NO: 9084 - DNA, 1315 bp, Zea mays
gccagaacttcttccgtaacatttgaggcggtctgggtctggctccgcacatcagtagccggacgttacggcatagaattggcttcttggtaaggttaaggagacgcctgctgctccgtgctcctgtgccagcagtcctgtgatcaagaacgttttttctttttaccatttcatttccagggtatctagggtaatcttcctgcatccgttcgtatcgtaattcctgattatttatcctttatccttcgtattatacaatccagattaaataaattaaaagacacaccaacaacacatattatattattaggtggataatataatctaaatatctaaattttcataatctataawtaggtcaataaatttttatatagtctataagctatattatacttttccgttttttatttgttgtggtttagttcaaaaattactagcaaacgacaaatatttgagaatgcaggtagtagatatgtttgattcgctgtctaacttgctatattttatctaacttttgtgtctaaggttagttcgtaaattcgaacgactaaccttacgcaaagtgtgacatagttagtcacgaaccaaacagaccctggccttagacatagctttaattccacataactacaaatacgagaataaaatagtcttaaaacccactcggcacatccatgtacaaaactttcccccagagcaatccatcagtggattgtggtttgtatttgttgactatttattttgaaatgaaaaacaagctggacctgtaacagtacaaccaaagaagagacaaaggggggagagagagatgttccacaacagcagtacagaacagtgaagaagacgtcgacgagaccaccgagggcagtcaaagtgcccgagatagaagccgccatcgcccgtcgccgacgtcgaaccccggtcggcatagaattccccgctccgcctcggcctcgccaatcgctttcacgctccatcaacaccatggctcgatgccaaaaccacaattaaaaatttgtgcttgggcgtatccgtcaatacacgcaccgagaggaggaagcccactaccccgtctctctctctctctcctccctggctctcgtcttcctctcctcccccaccgagttgccgccccctcgctttcaccccacgcggaagcaagaattcgtcgtcaaattcccaccttgcgcgtgtttctgtggatttccttttttttggccgcttccttgctcctatgggcctttgatccggggcttggatcttgggaaggggaggtgtggtgggccgccgccggcgatctggcggggaggat

SEQ ID NO: 9085 - DNA, 464 bp, Zea mays
aatgtcaaccacagcgcagtcaaatactccaatttagcacaagaccctacccttcctttcgtccaacccgatggttgcctgctcaagcacatcaactccatggccggagcggcacccgccgtcctcgtgcccaggcgaatttattttggcttttgagaagatgaaaagtgtatagagcgatgtcaaccgactatttgtgacatacaacattctgctaagggcctttgcgcaggctggtgacacaaagcaggtggacatcttgttcaaggatctggatggaagtgtagtctcccttccctgatgtatatacttgccatggagtgtttgatgcatacgggaagaatggcatgatcagagagatggaatctgtgctgctgcggatgaaaatcaagcaatgccgtccagatgtgatcacactcaacatactcgtagattcatacgggtgaaagcaaacatttgataag

SEQ ID NO: 9086 - DNA, 282 bp, Zea mays
tgcagatgttgggtgcgctttatggcattgcatacttatcagtttttgttgtatacataaactactgatattctaagtccttgtataaaattgtgtgacagagttatcgcccattgacacaccagcagtttcagataaccaagatacagtatcgaaggaatcattgctgctactttgcactgaaaatgcgatccgtttgttttccttgggccacgcaattcaggtatttgtatccctaattatataccacctttttctttaacatgagttgctgttgttctt

SEQ ID NO: 9087 - DNA, 486 bp, Zea mays
caaatataactattttttataattaaattatatttaatatttgtaattgatatctaaacattagatacggtacatactaaaatttaatcgagaaaaccaaagaccaccggtaacatccgtgttcacatcatgcaaaactgctccacacagcagatcttccggcaaaacggttgcgaggctaaactggacatttctagacttctctaccaagtcatatctcatatcccccgaaacagtcaggggctgagggaggcgccgcctgggtggagtggagagctggaggcagatcgaaataaagagcaccttccgaaccgacgtcctcgccaacgtcgtctcaaacgtgcccctcacgagaccgtcctccaaaatcctgaaacctatataattcccgctccatcaccggccggacgcctgatccgagcccctgagtcctgatagtacacgacaggcaccgcagcagaccggccggactcggcgccaagcgcg

SEQ ID NO: 9088 - DNA, 219 bp, Zea mays
agtatcttttttctcatttatatgcagcactattttcatattcagtttccatttaacacgtacctatgtgtactgtgtcttaagaatcaacagatccgaaggatttgcgattgaagcttcagaggcgaagttttcaacaagattttaccagcacaagaagttctggtgtgcgtgatctacgtgagaagctatctggtataatgaacccacagccatcaa

SEQ ID NO: 9089 - DNA, 99 bp, Zea mays
tgtaagtttttctacggagggtatccatatccatttgtgcatctgctggctttctgattcgcgtgtggttctctttatttcgatgcagcaaccaaggcc

SEQ ID NO: 9090 - DNA, 1193 bp, Zea mays
cggatgaggagggaattctacaccgcatcgcggacccgccagaaaagaaatctcctccaacgaactccgaaaatgctggaaagacgcaacctccggctcttcggaaaaagatcgtctccggaaaggctggagctgaaagctcgccgacccggaagactccgctatctacttccccgacgaaagaatggacgcggatcacgagaaagaaggagaccagggaaaagcaagtcgttctttccgttcctccagcctcaaaggagaacggaaagaaagtcgccacgacagcagcaccattctaccccgacgtcctcttcatcgggagagtggagtcgcccgccgtctctaacgacgaaccgaccgtgcctggagaagaaccgcctcaacgagagtcccgccgacggaggaatcggcgcaggaacgttcgagacatcacactgccggtgagcgggatccagaagcagcctgtctcgcgagacgaggtctcggagataggagaaactccggaggaacgcgtcctcagagaacgaaggaactcccgacggcgtgatcgccgacgagctcaggaacaagccgagcaggatgcgaggcaacgccgggaaaatccactcttcgggcgcaacctgaatcccgacttcgcccaagccatgaacacgccgagtgaagtcggaggggtactagctcggatagctgatggactccctcggactcccgacgccgagggctatcgacgaatgttcacctaggcagccaaccatcttctacctctcgctcacccgccgaacgacctacgacacgccatcaacagccgccgggatgcgcgaagctccatcaatgcttcgcgtgaacgatggcatgagaacgagatccgccgccgggaggagtacgacagggatcatggcatcccagcttggagtcaggccaccagaactgagtcggcaacggcctcgactggcggtactacccggggacggtcgaggaaccacaactactcccctccctgggtcagacatcatcctcggtgacaagaagacacgtgtggagtgtccgcccttactccacgccttagggccattcaatggccccctaacttcaaggtgtccaacgtcgacaaatatgaacctaagcaggatccgggaggctggctggccatctacaccaccgctgcccgagctgccggggcaaccgaggacgtg

SEQ ID NO: 9091 - DNA, 1500 bp, Zea mays
ttcgatcgggaaccctagatttggtacgaggaggaggagccggggggagcaagcaaaggtgggatttgaaacaagcgacactcaagattgaacttttcacaagcaggtgtgcgctatgtggatatatagtactgcactgggttcggctagtggagccggctattaaaagacgacctggagatatttcaaaggtgccacgtctacgagaatgacttgtggggcagtgctagtaggtggaccgcttgtcaacgactggttctctacgacggcgggcggcggtagtgcggctaccgttaatttcacatggccatggcccatggtggtacggttttttttttcctttttcaggggtctcttacaattttgtttctatagttttttttattcgtcatcatgatatatgtgctagtcatttttttttctaaatttaactgtaattataaaaaaatcaacgcgatcgaccatgtctttttgtgtccatcaacgaaatcaatctgcaatttgtccgatcgacaattttaggccatgtttggtttcaattagtcttaggactaaattttagtccctacttgtttggttataaggactaaatagattctaaagtcattaaatatattgtccaaagactcaaatgctcttggaatacactcatgtgggcttttagtctcttttagcacctatgtgaaggactaaagactaaatcattttaatctatattttagtcctagtgtttggcaaaaaaaagggactaaatgggactaaaaactagagactaatctttagtccctctaaccaaacacccccttaagataaggaaaagaaaataaaatttgacatccaattcgcaaaacgtttaatatttaacatcctgactcacatattaatgactcatattgactctacatattattatgataaaggtttcaaatctttaatggcttgtaaatttgatgtcaaatttcaaaacttctccaaaataagcaagtgagataaacacgaggagcaagcaaccatatcaaatggcccgagatcagaaagttgccaaatcagcacagaccgaacaaaacctggccgaaaagcatgtttatatctttacaccagcgccacgccaaggcaaccatatcaaatgattgcttgggattaaagctaattgtttaaactattgcagatacaatctataacgataaaaatattgtaaagaaaaagtagaattcgattaaaaccaaacagctaaattaaacaggagagagaatattctatttcagctcccgaccgttcccctcctctcttggtagttgggctcttggcctagaaaagcaaagtgagggacgagaaagggagggaagtgtgaaggtaggagagagagagagggagccaagggaagctctcttctttcttcctcctcctcgtcctctcgaattccgtctcttgtctctgtcctcctcgctcggcttccccggttcttgagaggggaaataggaggcggagccgaggagaggg

SEQ ID NO: 9092 - DNA, 707 bp, Zea mays
tctctaatgtggacgtggggcaggacaggtccaaagtgtcacagtatcaacaggcgcctacattaatatctcaccttttgtacgcacctcgtccgtccgatgactccatttgttcccgcggaacaccgatctgccgtccacttgttaaatcgcctgggttaagttgaaacaccatctttaaatatagcaattccattttttattcgctcctcacacgtcgccgtcgcttctcgttattaatatcgccgtcgcctcgcacctccctttgttccgtcgccccgcattgctcgcccagagttcttgtttaggcaaaggcaaaagcaggagcaaaaaggtaagaacacttccagattcctcccccattcgcatgtctttccatttctcgatgctttgcttgcgccctcgttcgttcgtcagatcgactaccaccatctttcgcgcctgatttgcttgtgtcctcgtattaactgaaccagatttggtctggaccagattttaaacgactgtgctgttcgttgaatctcaatccgccgtgcgaattaactgaatagggtattttacatcacgtgttcagatctaattgattatagcgacacagtatggcggattctgaaaccaggcgcagatctgcttggttatgatgcggatttgctgcttgtctaacatgttgctgactgctgtgtgatatttggtaggtttcgttggcg

SEQ ID NO: 9093 - DNA, 142 bp, Zea mays
aggcccggtgcgggcgtttggttgcgccattttggcaaacaccttgtacgcgggcccttgcttcgactgttttggtagtatgggccaccctgtgtgagatcttcttccctgctgctttgaagtttgaactggtttctgtgtg

SEQ ID NO: 9094 - DNA, 882 bp, Zea mays
agaagggggggtcaattagtacttctaaaaactatgtctaaactaggccacaaataaatccctataacaaaacctatgcaaataagcaatctagaatgtgcaaactaggtctaagtgtttctatctgtaccgcaaaaaggagttttgcaacctaagttccatggagagattgaaacttaagtacttaatgtaaatgaagaaggtaaagagaaatggtagagaaagcaaactcttgtggatgacgctagtatttttaccgagttacccttacctacttaccttttactctgattctttccatactttccttgatcctgtctcatcttttgctgctttactctgattattcttacattttctactctaaaagacaaaaaggatttcataccttagaatcctatatctacgaattcccaaagagataggagacctaaaaatattttatctatattwagtgtctkgaatgcttgttctcatgataactgcttgattcgcttctttgtttgattgaaatagttgtggggctatatatagaccataaaacytagtatagtgggtacattcttgcatgtactaacatagaggtagtatagtaatgataggtaggtggcactctaatctactgagctattgtgacccaaaagatcgtaacctagaagtcaagtgttccatatttggtcatttgtcttatctacaaatctatcttgccatatgtctctaactgagatggtcaataccaggaagggaggaggtgtcgatctacctgcacgtgttcattgaaggaggacaatagctaatcaagaaccagagatgaatcccctaaatcctccgtctgctgggtcggacgcctttttcgccgcccaaatccagccactacaacag

SEQ ID NO: 9095 - DNA, 857 bp, Zea mays
ggcgtgggctgcgacgcagctgggcagggcgtgtcgcgaggatggaagcggcccacagccgcgacggcgcccgaggaggagtggagccggcgtggctcgaagacagccgacgcgggcacgccgagtcgcggcggtgcctggggacgggtggagcggcgtgtggtggcatggcgacggagagggccagcgagcgcaggagcgtcagagaggagaaggcaaagagacgaatggagaaaagccaggaagaactgatccggttcggtttaaaggggtaggcgccacagatcttggtgcttacctccaaacacgttgttgtatagtttaaagggggtaggcgccaaaatctgtggcgccgcctacccctaccacgtgggcgccatatgtcgtcaccatgttgtcggacgtgtgctagacttagatgtcaatgctattgacgtcggcccgtgttagttaggcgtcaatagtgttggcgtcgacctatatgtcatttttgaaatgaaactgaaaagagtatatttctgaaaataaaaccgaaaatggctaaattgtaaaaaaaaaaaatttggccggtatgtgtatgtctaggctctgccgctctggggtctagacgacaacgcacgcaaaggctgatgcgtatcaacgtatgcggatgcaggggcagcaccgtccacctccaccatctttcctcttcctcctcgcctccaccccttcccttccatctcctcccacccggcgactcctcttcctctctgccgcgccgatcgattggcccacccatcgatcgagcacggggaagaagattccagtccggagtggtttcaattcggtcgggttcgttgcccgtgtgggtgggcgct

SEQ ID NO: 9096 - DNA, 1168 bp, Zea mays
tggatatagttttcatatatatataatcatttaaataaatgtggatgaaaaaataggctagaaaaaatatattttttggacggaagaagtagttattttacttgttaatccagcagctacagctgcagtacccgtttatagcgagcagacccatatatgacgcatgaaacagtagaaaacctggagcgaaagttggcactcaacctatttccgtcagatgttttatgctacctggattgattacggaaagaagggcattttggacagtcgcacgtgcaggacaccatgacttgctgtcagctctggaaatcctaagagctaagatgatccaccgatctacatctgcaaatatttatttgccatagaaggtgaaatataatgtaaaatgcaagcatgaattaggtatttaagtctcttaggcccatgttttaaaatcctaaagaaaatggaaacatggcgaattctttttggagaaatgtgtaaatgttatcattgctaattattatgtttacaaaattggcgaggtagattttggcaggaatagtttactcaatgacttagatattataatttttttatttttaaaattataaattattttagcttttctagatatatattttactatatatacgatgtatatctgagtatacaaatatatatttctgaaagaatatttcttaaaaaagagatacagacagattttctatttatatggagcagtggagccgctgcctacagtaatcacgcggtacgatgtcaagcgatccacctttaaatatttccataaaacaaagaaaagacaagtcaaaggcccacaataaaacctaacgtaaatcaagcccctaaatcgctctttttcttgtttaaaaagcgagaagaaactaatattccctaccgaacatgcgaacacgcaacgattctccacgtggccaccgcgcccagtccacgctcccccaaccagcccacctaaacccccgacccatcccgacctcttcctcaaatcctcagatccgccccctcctccacccttgcgccgcgctttcacagctctcccggcttccggatccagatccgccgccaccaacgcctgctcctcccccttccggtgcaccaccaccatcaataggtccagcagggcggcagcggcaccggcggcggcggcgac

SEQ ID NO: 9097 - DNA, 1459 bp, Zea mays
tgatggtggtgatggcaacgacatattttaccagtcgaaccgataaacatgtactttgtccaagttagggcatgtataactctgagacattggttggggtttccaagtacaagagacacttaaaaggctatgtgatacaacccaaaacccttagaccataaatacaattaagagacaatattcatgaatagtcatgaagagtctcttgtatattttcatctaacctcctagagaacgctcaagagaccccatattaaatggggttgtacatgcctttatagatgtgcctgcaagcccatatatacttaggggcatgaaaacctatgatataatcataattattatgatataatcataatttgcttctaaaaaatacatgttagtcataacaattctatatatttttgattaatcactaaaacacttgagggcctatgcgttaacattagtcagttgcctatgtattgccatgatttctctatatatatatatatatatatatgagtagaatttgttgtaacaagacataaaaatatatgtgttctattttttaggtagatgtaaatgtggaaccaacaatcaaggtttgtgggttgatcgctgaaactggtgattgatatagtagagatgtataagtcttgctattatagttagagttatatttttcttttgacaaacggaacaacgttccaatttctaccatccatcacagctcacatggtttcaaaaaaaaactgatcttgtagatccagtgtggtgtttggttcgattttgatagctataggactttacgttcagggttaagacaaacaaaaattcgtgagtaggcagaaggttaaaacatgaacggtgtccatgctttgcaactaaaagtgatacggttgtatctgataaataatatacttgttttgtttataacaaaaaggggatgtagctcagatggtagagcgctcgcttagcatgcgagaggtacggggatcgataccccgcatctccagtttcgtttttttgcgctaggcgatggaaggttcacatctgtcgaataccaagtgtggagagtagggtgctgtggaagaggcgagctgaggaagggaagggaaccctcttgaccgccggcggcgaggggagatgccgccggagaggacgaggaagtcgaggacggaggagccggcatctccagtttcgttttttttgctcattttgcatgccggtcaaattgttccgcgtagtgtatttgtcgggcagaatttcagagagcgcaacaactggtgggcttcaaggtcgacacattccggtccggcccagttaggccagacgcgagcgggtgaggaaaggagccgttcgctaggcgatggacggttcacatctgtcgaataccaagtgtggagagtagggtgctgtggacgaggcgagctgaggaagggaagggaaccctcttgaccgccggcggcgaggggag

SEQ ID NO: 9098 - DNA, 108 bp, Zea mays
tctgctaagtgccaagagccaacgccctctttcgcaccgttccacggaatcatccaccaccgggcaccggcagtcacagcgcacctcactgaaattggaacagagaac

SEQ ID NO: 9099 - DNA, 1282 bp, Zea mays
cccaaacacccaactaaaagtatgttggttttaggttgcaaagtccctctcaaccttctgctgtcccctagcttgagttgattcccttcattcatttaataatttattacgtaacctcatcatctttgcctaaatatataagtacttttcttcttcttccgaggaaaagacgttaatgtccctcgtccatctgcgcagcgtccatatattttgtcacaaaatactttgttccccccatgaatttagtggcatccacgttcgctcttcaacttcctgcacaggaacagaggaatggtaccgatgaaccacgcactaatgaaatttattagcaattcgtttgcacactgccgggtactctggggtcagctaagatgattcatggcgtcttggtcacggccacgttagcgctgcgtcagcggtgtaagcatctcggcgttaagaactgtaccatcgagccgtgttatctcgtcgccacggtctgtggctgtgacgttgagtaaagggtccaaaaacgattaagtcgtgaacaatttttttaaaaaaagtttaaatacaaaaacttcgggatcttcaactgcactaataatcacgccgcaaagtctttactgctacgaatggactctctctacggactatggtagagtagagtcgtcattgaacaggctggtttaggtgcacagtagttgcytcggccatgccagcatcagacaattgtacagtcgtcctacctaataagcttgcactagaaggaaaatccacaaagacaacaacgcctgctcttactttagttaagcaattaatcacaacaccttcccttcttccgtgctatgtaatgtatagaacctcgaaacgacctttgcgttgtgtccagctgcgatatacacactacactaacaatttccatgattgctgtctgtctgtcagtctgtcatgctcatatcgcaaccattccatttaaaaaaacaaaagaacgggagaggatcgtccgaggccagtttagtcaattcgctcaacactaacgctgaaaagcgtccaggcaacgaccacattcatgatgaaaaaaccaggaggagaattttgattgctggattgtcgccgtcagcggcaaccaccgcgcgcgcgcgcgtaccagttccggaaaaagaaacagcagcctctgcccttcgtttttatacgctcacccgacgacaggcgatggggggaacagctatagccctgcagttagtagcatctcgtttcagagctcagaggagggaggaggaagaagaagcagcagcaaggc

SEQ ID NO: 9100 - DNA, 1500 bp, Zea mays
aggtaaaggtatagaagaaccaagggtatgagtacaacagagaatggtgttaaggcaagatttgcacgtggaaaagatgatatactagatgttattgttgatttttaaccgctaaagttaattaattatacgaatttcctgcggccaaacaagcaaggacggacgtccatatatatgtttccaaaatcacaatcacgcagcagcagctagagactagtagtagtatacttactagtttggtgaacaatgctacaaaaacagataaggcgcatgtgtatgcatgcaccgaaatgtgccaaattaacagcaccaccatcactcagttattgacattgctctccgtgcttcgccgctgctggtactggtacccggcccgttctcagctctacgtcgcacgtgggcagaaatgcacaatgaagtcggccgcttgagatcgacacgggtgaagaagccaggatccaagggttttaccggcttttgctacggccggtactgatacagtacgtagtagtaaagtcgaagcrcaccttttgccaaagagacccggccggagtgaaacatgtcgaccacgttgcatggggcatcaccagcaacccaagttgttgtagtggcgtacgtacgtgcccttttcggaggcgcgcgagttaattggggcatcaccagcaacccaataagttaattggagcatgcatgtagggcgtacaacaataggttttctaacgtcctgtttagaagcaatctagtttttaacaaactaatttttatctttttagttaggagataccagctttttaggatctgtttggttaggctgtgcctgtgaaaaaagctgttatggacttttggcttttaggggcaagaaccaaaccaaacacacccttagtttctaataagaaactagtaatctaatttctataaactcaagtataaaccgatatgtttggaatcattttaatttttcataaaccggtttcgtataaattaggtgcttccaaataggtcttaagtgcaagagacggttaagagacatcttaatacaattttaagtcattgaataaaaaaaatatagtcaagatacactatgtatgtatggagtaagtgggctagcatatatataactcacgtccgagtagagtagataccgtttacatttgttgtagatgatcgacgtggttggtggtggtcagtcggtcagccgggctcaccatacaacttcacgtgcgcatccacgtctgtgcagtacgattgattttgacacaaaaaagaaaaagagaatacgaggtcaaatccaggggcgaggcgagtcgcgtagaggcggctgcccgccaatgccatgacccatgagccatgagctagctagctaacccacgaggaaacctcggccgagaagaacgcgcgcagcagacttgtccgcgctctccctctttctgtggacctcgctcgcctagaaagcgccgtgcccgcctgcccagcgacaccgggcagcgggctgtgtagcta

SEQ ID NO: 9101 - DNA, 572 bp, Zea mays
cccctgtgtgtcaggaacaaacattgcattgacaacggtctgttaagactcagaaaggttcaataatcatttagattccatcacttgaaatgttgatctattcgccattacctcaccagatctgaaacaataaaattttcttacttgcatggaaatttaaagaagcacaggggcaatgttacaatactttcatgcatatttattagggtttgtttaggagagctccacaataattgcagctttggttttctagttttaccataaaacaacttcaacaattgttgagctggttttaggagtgtttagcttaaacatggactctaacttttataatataattgacttatgtttctttgactacccttaataattagtgaactgtggtggattggtggttcggtgggttgattgcaggttgctagctaatgattaaggccttgttcgtttacgtcggattggtgggtcggaacgattcctacccggattgtttctctaatttatacaaactttgattagctggaacggtttcgggtgcaatccgacgtaaacgaacaaggcctcaatcggtccta

SEQ ID NO: 9102 - DNA, 89 bp, Zea mays
ggtaataacttgagyatagtatgattttttttgctaacaacattttgcatgtttcattgatgttataatgtgtaattatcttaagggag

SEQ ID NO: 9103 - DNA, 101 bp, Zea mays
tcgattcggcctagctagctagctagcgagcaagctatagcttagctcggctagccgggtgtgtcgccggtcggctaggcaacgccgctagcgatcgcaaa

SEQ ID NO: 9104 - DNA, 861 bp, Zea mays
gtatatatagtgtctcctactagtctgatatcattactccagttattatacattgtatagtggtatcatcataaaaaaaatcactgagttgcctgctaacatatagagggagagttgttggtgataacaaataaagccccagctatcatctcaaccacgaatgggtgcttttcttgagacatcaagagaatccaagaccacatatatatactaccctttcagttcactcactggccaacagaagcatttagcttagctagcacagctacgaatcgttactgaaaagggtcagcagacaacttttaaaatccggtattttaaagtggtgcccttatttctactgctttccatatttttacccgtttttttcgcagttttgtccttccgctagcaaaagtgacgaacgaactgagcaaaaatcgcgagacgcaccttcagtttctgtttactcctccaggaagacgtgaattctcatcagcagtggtgcattttaatttgctgacaacaaggacgatgtcccaagatcgtctgcgactgcacatggtactggctgtctctctatctatgctactatatatatgcgtgtgagcccacatttgccactacaaaggattaaactaacaaatccgataaaaaaatcgatgagatcagctgtctcttttttaattaattaaggcattaattaatgggtgtattgcgcgtgtagggggatctctccctttcactctaagaggcttctttacaccatccatcgtatcctccttagcttcctttctgtagctagcttgctcccatttcttggtcgacttcttctaggtctagctaggtctagagagacgtctgcgtgtgtgtgtgggatcc

SEQ ID NO: 9105 - DNA, 67 bp, Zea mays
aactggctcctcttgtgaacatggatgcatcacatcaagtatctgctaaaacgtcaacggagattgg

SEQ ID NO: 9106 - DNA, 94 bp, Zea mays
agcgacgagagacagggagagtagctattgctagattgcattagcaatttagcatatttgctgcattactaactgcagctagttactattaatt

SEQ ID NO: 9107 - DNA, 200 bp, Zea mays
tacagcaacattgagaagttgctcttgctcgattatgtaaaggagattatgcgactgctgtgtacgacttctgaaacgggtaatgctagtgctgagctgctgaagacggttgtgctctcaggcaccaaaacattcggatctgaaatcctaaacggaagtgagacgcccaatcggtgatccaccgcttccccgtcggtacc

SEQ ID NO: 9108 - DNA, 454 bp, Zea mays
ctgagcctgtttcgtgtcaccccttcttcgctgtgaatgatctagtctaaatatttctgcaacactgctccggcgccctctgctaggtactgcagaacatcgcagctcgcagtaagatccgtatctatttgttcctagttccgtgtcttatacttttatgaatgacattgccattatgccagtgtgtagtaacaattgaatgccaatcacagacatatataaaattttggctcttccttttctatttctctatctacaatgttatgcgattaattgagcacttcgaaattgatattgttaattatggtcttcgttatatctattgtgtctactacactactgctagtgtatgtctagcaagatttctagccctgttttatttagcccccttgcctggtttttggatcctggctgagtctgtacgttggtttcagcatcccagtcaggagaagca

SEQ ID NO: 9109 - DNA, 1500 bp, Zea mays
ttccattccaaaattaccgccaacatctgcctcagacagagaagggtaagacagacagacagagagagagagagagatggttttgtttgaataaagtcaaatgcagtctaaaatccctgaaatcctcagactaaaatcaagtcaaatgcagtacgcacaacacaagtctacaacgacacatcctttttttatagaacgtgtgaacacatctccaaggaaaagagagatggtattgactggacggacacctgggggcggggctggggctgggccgggctggggccggttcatgatgtaaacatgcatggttttagatctgtctatactcgcactcaagaaccaatcgaaatggcgatgctccatagcctgacacgagagaaattaaaaaaaaaacatcaaaaagtacagtacagagatggttttgtttgacacagtccagcacctgtactacttgccatgccaatattgtcaaaacctctgaagatctcatgcgtgactcggtgcgtgccctcagagtctgtctgcttttggatgggattgccaaaacatctactacaatttcgtgaaaggttagagacttagggcatgtttggatcctcaaacaatttaccggctatttttaacaccttggcctttaagtatgctggctaataaactgactaattgttagccagagacccgacaaattgttccttcattagccatttgaccttagtaatagatctataaagaaaaaaaagattgttgctagttgattatttgtcggctaattgttagctactagcaaataattaatcaagaggatacacacaggatcttagcgtggctggtcaaacacaccattggctggctctggctctttgttgggtgggttggacccggtctaagctacgtgctacatgcatcccaacgaagtcatggcatttgctttctctgtcagaaagaaggaagtaacatacagttgacagcataacctgaacttacggcaccactctttacttgttaaaaagcgcattttttctactgctaaactgaaaccaaattggcattcaagaggtaaatgcagcagataaagtgcccagattgagaaaaagggatatttgaggcatgcttttacacgctgccgcagctggaggggaagattgacgaagaatccatggaaagcaaaccgagtagtttgcagtttgtgtgagtctgactctttgtgagggaggaggaggaggagagaaaaaggacagctgaaactgggctccgtcccgcggtcccgccggtctagggtaggccagccacatgcaggcaggcaggcaggcaaggcaactgaaacggggcgctccgtttcttctctcctttctcggtcagctgcactcccttcgtcagtcagtctccgcgcatacttatatccccctctccttgacttcgccatctccctctcctacgctttgttctgggctcttcccgacttcctcctcctgtagagagagaacctagagagaacccggg

SEQ ID NO: 9110 - DNA, 1095 bp, Zea mays
tcttgcgcatgtgcaaaaatcagaaatgagccatcgtggctttgtcagacaatgtttgttgggtttatcatcattggatgcaagactatgttaatatatgattgtaataattagttgaaaataggtgttgcaatttaaacctttgaaattagagatgttgaagaataaaattctttgcaaataataagtgttaccatagccattacaaataatttgaataccaatagaatgtgaattaagggatggaggactgagatttggctggtttgctggggggacgttgctggggggacgagtaatatggtttgtatctttggaatggatagccaaatgaagatatggagggtagaatttgcagggtcttctgaagatgctctaataacagatagggtgattctagtaggcacccatgaggttcgaaatgctccgtcattttatcagctaatcttacattcagtcagtttcagaaggaatgagatacagccatactggccataaatcccaaaatccctgaaacttggtaacaagcaatcccatgtgtggatataattccaaccatagcagtagaaactaaactagacaccttatccttgagccacaactatgtaatagtgcacttgttgtgtctgtgaatgatgcagatgtgtccagctattgtttatctcatctgtactctgaaatgatctctgcctgtctaggacctttgattcaccatgtgttgtccataccggtgaaccaaagcacatgatagcagtgcattagctaaatcatgtaattaacaccccatcatgtgtccatgcctgatttgtagcgtctcaaatcagaatgaaccctcatttattttagattcatgcttgccaaggcacatgtgttgtgctgaagggagcaccgttggccttcagatatgtatgctatgcacaatcattatgaatctgccaaaacatgcaaatcatctctcattctcccagctaaaatagagtatgatccagtagctgcccccatgtgatgcgactgatttcaccatatcgattaaccgccgcaaaacattctttcaggataaggacttaaggaggcgtcgctcggtgcaaagaatcc

SEQ ID NO: 9111 - DNA, 1500 bp, Zea mays
gtagttatctaacaaattattagaaaacatgggtctttccgatacttatcaaaaatatgtataacgagatttttaaatcgtttttaaagtaccgttgaagacgcccttaacacggattatataattataaaatttattagattatataatctagacatattataatcccaaacaaacaatccttgatcttttttttataaaacatatttatctattttttttctcgaacaatgcaaaataaactcgtgtggcatttcattaaaaagaagaaaaaaaaatagtacagggagttattgagaggcctctctgaaccccgtacaaaggtacaaagtctaaacataaatacaacctcgacccacgaaaacatctccttgagatagaaagcccgaggagagcaacctagagaggagtttgttgagagccgaggctccagcagagcacaaaggacatattcttcctccagtttgtgtaccaccgtccgagcacagaagctagctccttcaaaaaaaaaatcaataatacgtttccattggtaacgacccagaacctagacatggaataggacgatcctttaataatattatttagttaaaagtcaaagattgggacagtactatctcagtgttgttcctaattgtaccttaaaattggtcagagcactacatcatacattttagaccctgtacagaagcagaaacaataaaacctaatataaaaaaaagacggtgtacactagttccattgtcatagctaacacaaacctcatctcgtccacccacctacacaatgaactctattgccttcaacaaactaggtccaaacctcgtcacgttgagcacgacgtcctgctcggtcatgtagacctccccgaccttctcccatccgccgctccttacggcctccgggtctctcaccaccgcatggttcctgccgtacttctccagcagcgtgctctcgtctggaccgacgctgtaccgcacatgcctgaggcccatgtccctcgcaggcgcgccgtagaacccgtcagccatgaactcgaccccgtagggcacgacgtgcaccagcgccgcgcccgacctcaggaacaccatgttggtcaaaccggcaccgtggacgcccatcatcgcgtcacacgagtcgactaggcgggcaaactcctcgaggtcagagtgggtccttggatccgccctgaccacctcgaagccgaaccagccaagcccgagtagaacgtcaggcgtgttcacgagcctccgcgtcttgccccgctcgatgagcatcatccggggcttcttcttctcgggctcgtctttgtcagccctgtacggtatgtccactccaggcgcgggcagtccgtaggcttcgcggacaaacagacggaaatccaccatcgtgtagttcttctgcggcgtggagtccggatcgatgccgaggtcccggtggctcctcagcccgacgatgacatgcggatagcacctcacctcgtcgtctgcatcgaaatcg

SEQ ID NO: 9112 - DNA, 206 bp, Zea mays
ctgttctgtgtcaagcctccagcaaaatcgtctgaactctggagccttccagcgagaatcgtaaagcggctaaacaatgttgcttctcgcctgctagtcgccctattctactccactctgttttctggaggctgctaaactaaacccttcttctccccactccgccctcggacccgccgccgccgccgcttgccgggtctatagcc

SEQ ID NO: 9113 - DNA, 163 bp, Zea mays
gtatataaccaaaataaaaaggaagacaagtgagagaagagagagaatgggaggagaccaaggaatgacgaccgctgaccccactgtccagcgtcactgactattgggagaccaagccctactacagcagccgcaacaaccgcgaccccgacctcgacccgcc

SEQ ID NO: 9114 - DNA, 270 bp, Zea mays
tattccctttccgtttttcatcagatggatagacacggtcactgtgcaaagcactccgtcgaattcattcattcattcatccactcaagaatcccaagagcactcggtgcaaaggaaacgaagggacggatgaaaatgcttcaacttctatctttcggtttcttacactacgcacataaataaatagagccgcgtaggcctcctttttttcttcttacacgaactaccagtgttcgaggccggcaatcggtgaagtcttcttggttcctg

SEQ ID NO: 9115 - DNA, 1500 bp, Zea mays
agaaagctggcgcgggttggaggtgggaagaaagagaaagaagatgttgttgcgccttcgattggattgggttggccttggagcgcgtactgccgccgcatgtattcgctgttccggccctgattctatggtgcaccactgtgctgtgcgccgccccagccctcgaggatttagcaaactgctcagatctgttctcgctttgcttcatcagtgaacactgaacacggtgcgtgtgtggccgttcggttctgctttgacagatttctatattgattactcccaccttcgggctttcgatcagcttggtctagtaattctagacacaagttgcttgctccgtttggttcagagggtgtgtcagctcgttcttagcaagcttatcatggttctgattccatgtagtgtcagtaccaaacaaccaccaactgtggtaggaaaagagtagtcatatcaacatgagacatggttggtggtgcgtggtctggagtgataaaccgaagagatcaaatgagctatttcaatctgttagaataataagtggctagttgataaagagcatgaacataatgtcctcttatatttttctgtttaattagtttaatcaaaagcacactttacgcaaccttaaatcttatgactaccattcgctttaggtacttagatctatccctaaatatatgtagggatttttccctgttacagcggcattcacgtatgtatggagttttctatatatgattgttgggcctaataagtgaatttactgaagcaatattttcttttgttttttttcaatttaaggttttgattatctgcatagctgtattatacatttcactcctacatgttcagttttaatagtagtgtctgctattagttcttgcatctgttgtgttaaccaatcctgctgctagttcaattctagtgatctactaccattcactttcctcctgctgttattcgctttcctactgctactagttcagttcttgcatctgttgtgttgaccaatcatgtgtgttgcctctcaggtccttagcgatccgaagaaacatgcaatctgaatgtatattggacctacagacttgcttgcttctttaccattgcaatctgaatgtatatcagacctgcaaacttactgtatatatttattttggtgaccatttgaaatctaaatttatatttatatttttcatatcatatctaataggagtgtatgtcttacatttggttgcaaggtctaatatgcattttgggcttcttttgagtcatgttgttggtgtggaaccgtggaagtaggatgtggactgcaaggatggctagtttactctttactggcattgacagtttacttgtcgttcttcagtcatttggtggcatgtatcatcaagcttctgtcctttctatacattgttatgaacgttgctatgccttttatttcgaatgctgatgcaatctacgagtttctatccttgtatgtgtgcatagacattgttatga

SEQ ID NO: 9116 - DNA, 1143 bp, Zea mays
actgggctgggctgggctggctatgtatgcatcgcaagttaccaaataaagcccaccaacagaaaaaaggagatggagaggctagggccctttctcagcccgacctacaaaaggtaaaaggtaagctgtgtttggttcagctttatgaaccacatttactgaaaatcttaaccaacagaatagatttctaaaaaaatataggttctttagtttaaatgatcagaatcatcttcgatcctaatttttttagatttatgtcatccacatcacaagttatcacagtcttatagaatctatagtcgacaattgtattacccaacaaatttcagtctttttataattatcagctcacaacaactttttcacagctcataactaaaatcagattttaatcaaaactcccgtcggcgaagaacaagcaaacaaacaaaacgaatcacacaagtaaactgaatgaaaggaagtactagtaagcaacgtggcctccacataacaatatataaggaaacatactagctaggtactacatccgttcacaaatatataaactgttgacttttttttgtttcgaaaactttgaccacttatcttatttaaaaatgtaaaattttaagttaagcacaaactagattaagtgataaaacaaatcacaaaaaaaaataataacacattatttttttaataagatgagcggtcaaagttttttttaaaaaaagtcaacaatctcatatatttatgaattgagtgagtataccatactcttatatatatgcgttaatttgtactatagtgttaccatatatagatctgacagctaagtgatcgagtagctagacgatatatatcatacgatggatgtatggcctccacacgcctatccaaatccaaccaagaggggcaggcggatggctggtagcgacgatgagcaacgtgtgatcctcgatgggggttgcattgcactgcagataagccgaccgctcaccgcccgccacgtagcacccccacccacccttccctccgccaataactctcccttgtcagctagctagcgagccgtgtggccgcccgtgtcgtgtagtgtgtagtcgcagcagctagcgcccggccggccagtcgagtgagtccatcctccatcgccatcca

SEQ ID NO: 9117 - DNA, 1500 bp, Zea mays
atttatacaaaaacttactaacaataactatgaatgtattttaattagagacataaatattggtttttcctgccaaattgaagaattatttaacttataaaaaatctggaattatatttttataggacgatgatacgatggacagtgcagactgaaaaaacaacatatatattattattaactaattaaagtcagaagacccctacataccgggagacattgtactatacacttacatgtatcagcaaacgtgtcgagcccattccatatgtagcatgtagtcgttgaagctgcgaacagaattctaaaggtctgtttggttaggctgtggctgtgaaaaaagttgttgtaagctgtgagctgtggaaaaagctgttgtaggctgtaagctattaaaaagctaaaaaccgtttggtggaaaccactaaaagtcgttaaaaaatcttcgatatatgttttcacagttccatccgaaaagccactaaaagcaggtgcaggggtgctttcagatttgcactacaagaaagtcggcttttagaaaaagctgcttcttggatccagccctttggttggcttttgacttttagggggcaaaagccaaagccaaaagtcaaaccaaacacaccctaagtatatctctatatacgagatggctaactctagttattttttttatctattttatattttttagatacaataatattttttatagaagtatgtgtatgcatgtatatttattttttattgtaataaatctctttagggaggggagtaaagcaatgcaagaacgcacaaaatagcctgatgaggtaaaactggccggtgactcggcggcctcgtccgctgtgtgcctgcatagcagcctactagcaggccagggcagcagtggcgcttgcctgctcccccgcaacccgctccgctcccctctcttcgtcttcgtcaaggtctagtctagagagaaaaaagggcgagaggcggagagagataaaccccgatacccggaatcgccgtgcaaaatcaaacaaagccagagcggcagatacaataagccgcagctgcagcaagcggcaagccgcatcacagcaggcgccaccgtcacgccaccgcgcagccgagaggggacggacgaaagggggaaatcgcctgcctgcctgccgcggtgggttggtgggtgccgcctccgcatcctgctgctctgttccccagcccacccccatttacctcgcatggaatcctgctctcttcttctccactccacgcgccgatccgccacctgccaggagagcgcggcgcgatccagttgaggaggtacacacaggaggcgggggtgcctgcacgggcacggcgtctgtgagttctccttgtttccgccccaagcctggcctgacgtcatcgcgcgcctgcacggcgtcttggtggtgtggtcgaagcagcagaggccgccgccgcgcgggagaagccggcgcgaggaagcggtggccgggccgggggagcgcg

SEQ ID NO: 9118 - DNA, 542 bp, Zea mays
tggtcaggttcggttctagtcttcttgtcaacgagaatctaatcgaagatttggggaagaggtttgagtgaattgattgagcttcggatcgctgcttggtgcttgctgtctccctcaattcctagaaggggtctttttatagagggaaagcgagagagatgaagtggaggagaaagcagtttctggagagttctcacgtgttcgcggatagacccggatagacccgacgccgctgtattggagcgtggagaatgctagagagagctatccagtggcagtccctcttttagatcgtagtactgggctgggtttctagtaattttgttcatggaccaagacctgggcttatgctggaaaaataattcagctcaacatcaaacgaggcccattcctcagacctctctgtctcgtcttcctagttcggacttcggattaaggcgacccaccgagcacctcgatacggcggagtcgtgggaagccagggaggtgaggacgacgtggcgaagtcgtgaggacaagaaaattccaccgctgtggcagcc

SEQ ID NO: 9119 - DNA, 448 bp, Zea mays
ttcgtagttttgtctatggattgtgtgtctttttctggttatcaaaccatggtcttctatggtgtgtttcgggaggtctgtccctccatatgtggctagtcgtgtgactacttcatgtaaaaacttttggtgtattggctaatcctccaaaagaggagaagctggacaaatatccattatctaaaaaaataaagtttgcctaaaagttggtgtcgccattgcagcactagcactggtaccagctactctcacgagctgcgtgctgaggttgactccttctccttcccgatcctgaaatataaggctaccgctcgtttcctctctctccccgactccccctcccttccatctcttcccttgcatttagcctcccgcggttcaggaggcgcgggccattcccaaccatcgttgcagtggtggcaggtattggcctgtcgagacgagaccc

SEQ ID NO: 9120 - DNA, 1292 bp, Zea mays
cggtgatcggtgtactcatcatatacaataaaagactaaaatatttttagttctagttatacaatatcagttggaaatcgactactaataatcggtccctaattaacgccgctttgtgcagtagtgatggatgacgcggctgcctagctagctagctatcccctgcagcgctgtccgcacctcgcctttgcctctcttttaatttgggtggtatcatcatgcactcatgtatctatcattctatcgtcgccgtctccgtcgtggggtcgccgccggcccgaagacgggacatgcatgtagacaacaagatgccaccagcgacacgcgcactaggcgtagtcgtagaatgatgcgacgccgccaggcgccagcgaccgtgacgttgatcgggtgcccaccatgcatgcatgccctcgatatatgatcgtctccacgcgggatgccatcgttcgtcgagatccattgtcagccgccatgctagggctccgctacatggccggcgtggagggtgggcactggccagggtgtgatggacatgcatgcatggccagtgcacgctttgctgctcaggcacctgcgcgctgcagtgtggccgtgtccggtgtgtgggtgtgtcgtttgggaaagtagggaagagagagagagcaaacaacacgctgatgaacaagacagcgttagcttccaaacagtagcaccacaggcgtcaccacctcttcctgctgcctccctagggtttccaactttcctcatgcataaaaccaggcccccctcttgcttccctagctcatcaccaccaccctcacactctctctctctgctagctacacccatccgcccatcaatctcacccatcgcatcctttacaagctaaggaattaatgaagtcccttctcctttgctcttctctctcccatatgtttcacatccattatatatgtattgtgaggcctccacgaacacccaagcaaacaaaaaaatagatacataaagggggaatgaacaaacccccattcccctttaattttattccacttgctttcgcgcgtcctcctcgtgatcccatcttttttcttcccttacctttagtttctcctcctcctctctccgggtggcagacccggccttctctcctccctcttcgtcttccagttcgaagctgtagcggcagctagagctagccacgtgtagagcggcacgactgcagcgtgcgaagaacaaacaaaagcagctagaaaagaagctctcactcactcacaagtagcaaaagatcaaagggaaatcaatcatatacc

SEQ ID NO: 9121 - DNA, 118 bp, Zea mays
aactggttgtctagcatgtatggtcatcaggcttggaactaacgggaaatatcgagtcacagaacttgttaccttccacaatcactagcttggagctgaagcagcttctgatcttgtc

SEQ ID NO: 9122 - DNA, 575 bp, Zea mays
tctaatatcacagcacaaaacagttatgagccacagaacagattattcattgctccatatagtattaagacagatatttaaggtatgagaaactgagaacattgatttgaaaaggtaacaaagctcagaaaactatagattcggaatctaccctagcaagcttctaaagatatagaggtgccctactattcaacttgtcaacagagcagtgttttcaaatcgtttgattagtcgagytttatcaatgattaatcaacaaatcattccctggacatgattaagtgcaccggttcgattagttcgtcgagtyaagcgatcaggagtctagttattgattaatcatgactgattgaacatgtctagttgctcgactagccagcagatcatcaagttgggccttcagcctatcaggtctccaatgcccagatcatcctaggaccaatatatatcattgagccctcttctttgacctaacttgttcagtcaccgctcctttttttggcggaaagaagcgaaaatccccagtgtgtcgcagcctccctcacgtgccacaacctcctgcactgtcacagcct

SEQ ID NO: 9123 - DNA, 1500 bp, Zea mays
catggacattggacaggcaccgcgcgctgggatcctcctcggccaccaccagcaccacctagcttcttctcctctctctctctctctacaccgcaccgcaccgcagggtagcttagctagcgcatcagtacgtacaggcggccacgagctgcgtattgatcctgggatagaatattggcgtacggaccgctccagcgctcggttcccgtgcttcctgcccaagctagctttgaccgtcaaagcgcgcggtcgcggagccggccggactggcggggcgcgcggcgctggccaagcagacttgcctgcctgatgactgctctgctagtagtaaaaggtgggcggtgtcgcgcggtgaaaaagtgaaacacatgccgttgaacggggttctaatctctggcttagctggggagggtgttgaagagcacgttaaaccccctcggttacgccgtgctcgtacgtacgggttaaacaaaggaaagaggggccccgcgatcgccggtcaaaaataccgggcgctccgtccgggggggttgagagagacacaaaggtaaaagggccaccgccaccccctctgcatgtatgtcatgtcttgctactagacgccgcgcgcatgcatgcagatgcagctcgtcgcgtcccgtagagactagagactgcgttgcgtttggcacttgagtcccgtccgtgtgcacacacgctcgcgtttctccactagctggacgctgtgcatgcacgcgcgcacgttgcacgttcggattatttggtcagtggcaaggcttagttaactattgtttgctccgtcgaataaatctactgacaggtaggcgactatcagacatgacatgagtggacgagtgggtgctctgcgagacttttgttttgaaaatgcgcgcgtcagagggctcggattcggcgattaaacatatcgcccagcgaacgcgtacgtgtcacaggcgcggcgggaccgtcgccgcccgtgcatgggctgcaggtggcagccgccatgcggcccccggccatttcccgggaggcatggtgggtcttggtcgcggcgcgtgtgcacggctgcacccgcgcgcggcgcgcgtcactgttgcatggcgggtcggcacttcgccacggcccacgggtctctcgagcggacacgagtcgtgctgaattagttgctggttcactccggcccgagcaagaggcccaggatatgcggacacgagtcggcccgagtgggtgcttgggcccaatttgctgtgggctgcaatatgcaccgcgtgtagaaccatcggagtcccgtacacgctagtgttggcgactccaagagtgttcttatcgccccgaaggcggtctccactctctacagacagccgccaccgccgccggtggttcacaagcagccggtaggtactcaacccaaaccgcaaggaggacacggaacccaaattccagcacgactcatccagccagcagcccaagcgaacctagggcccttgagctccctcccgc

SEQ ID NO: 9124 - DNA, 1500 bp, Zea mays
tttcgttggatttggatcgaatattatgcggttgcggatatggatatatattttttaagatatcagaaatggtatggagtcggaccagcgtcacaacggaagctgattttaaagatcagataatacatgtctacattctatgtcttttttatagcaatcaacaattcataaataataagtagtattatgttatgtcaaatacttcgtagcacacaaaacataatagaagttcatcgagtataaaagtagtgagcaaaatatagatgcttaattaactagaagaagcttttttattttctgtcctttaatcttctacaatctgcacttttaaccgtacatatgatcatgcaaatccgtttactggcctggataaaaaaagatgacttaagtttttgtactactaaataagccgaacagtgatgatttggtggctaaatgtaagtttttgtactactactaaataacttggacaataatcaatcatttgtcgactgactttatgtcttctatgtatttgccaaaccaatcagatattatcctattttcaacatcggataatccgcgttcaaatattgtatactccatattctatcggattttggtgataccatatcctactttgcatccgcacataaatcggattcggattatcgattattcatattcccatggatatataaactcctatactatatccatataattaggatttaaatcggaccagataattatccacaccatttgcacccctatacgtggggataaatccccgacgaggatttccgtcctcgtttaaattataattataacatacataatttgttattaatgcaaaacattatcacttatacacattgtgagatgcaagaaatcactatatgtatatcaaaataaatatatttatacaataattaatctcttaacaaaaataattatttattttttattattaactattatataaaaacattgcaagtccccgcgaggaaatatgggtgttttctgtcctgtcttcgtttagaactctagtcttgtcccttgctcccggttagaggtggtaaataataatggactttatattttatattacaagctttaaagatcgaatcggattagaactaaactatatttctatttatttttaaactataattattattataaatgagcatttaaattatgaccctagtccggtaccacactactccggccttccctcctgtcctagtcggctagtcccatcccatgttgcacacggatccatccccaacacggcaacacgccaacacccatcagtccatcacaggcgcagcgaactctgcgcttccacttctctctccaccgtccctttacccaaccaaccaccgcactggtacgctctcgactctcgacaccggcagcagcaggaggtggagctagggcatgtgatcggactccttgcctgcttcctgatctcaacctcttttcaccagcgcgagggcggcgcggtctcaagccggg

SEQ ID NO: 9125 - DNA, 104 bp, Zea mays
acccctgattactgctctcacaatatttgtttatttataataataaagattatcctctcaaataatttgaactgtttgatatttttgcagcttttgtggaaaag

SEQ ID NO: 9126 - DNA, 1500 bp, Zea mays
cgcataagggttaggaagggagttaggaaggttaacctagaagatcaattccaaaatctaaacgaaactccgcggatttgggaagttccaaactgaattgagcatcaagtgccctatagccctttgttagactatcatgaacaatgtatgtacttggtcttcaactgttctcaagatgttcgagtttttcttgtggcgataaggatttttttgatcgactgattttagttagggttttgtccttttttcttaatttacttgtgttctagtttccctatcgggggtgtttggcatggctccactctaccttagatcagctctactctaaaaatctaggatgaaggaggtctggagtttttttaggattctggagtagtaaggagccactctacaaaaattataatgcacctttcaaaactctataaagtttacaactctagagctagagtgtttagttggttctggtcagctcctcttcagaattttgctctgaaaccatgcaaacacctacacatgttagtagccttgttttatttttttataaataagttttttctactgtagttgtgtgaacttttgtaatagatattctcatttgtactaaaaacacatgttccatatgctaaaaaagcatgcaaatacagaatattttatatcttttaaataatttattttgcttatattctctcatctgcatccacacacaatatcgcgtacattgaaatgcttttggacctctcgtgcacgctcaaaggtgagcttaatttcgtgcctagattgcaccataggttgaaatcatctttggatcaattttttatgctcgtgtgtacactgctctaactcattctgtcttgtttagtttttttttatttcttttttgttacgtgttttctttcttttttattctttttcatttcatgtttttattctgtcttgtgtataagcacaaaggaactaaaaaatagactggacttttagctcgtacatacatgtataacatgttagttaatcgtatatcactactgtttctatatatatgatatatattttctttataccacacaaatcaacatgaccttgattagaggcgattgagaccatggttcaaattctgacaattgattttttatattatattttactgacgtattatattagcgcattatagtagtagagatgactctaaatattttgccataaaatcttggtcttcacaaggtggtttgacctttttgcccctaagcagaagcacctggctcaaatattctctggaacggccggccgcgccgaccaccgaactgcactgcagactgcagagcacctctcctgtctcctcatctcacgctgacaagatccaatcacgacgctaatcagtcgtcctaattaatcggcggccccgtgatcggatcgtacccgccgcagatcaccactgtccaagtgcccagtcgtagatcccgtgatcttttttttctcggtggggttgctgctgcggcttgaaag

SEQ ID NO: 9127 - DNA, 1500 bp, Zea mays
ccacacgctctaaccaaytgagctattycagcttgatgttcaatacttaactaagtcatatatattctaatgagtaagccatgtgattaggtcaccacatcaagcaatagtgtcagctccatccagatgcagaaaactcagaacgagttagttcaccttaattaggttgtgtttgtatttagcatatataataaatcaaatggaagcgactgagaaaaatgtagccataaaaaagaaaaacataaagcatggcatggcatggaatrgcttcagtttattttgatcataaagaacaattaagtggataacgttttcaacaatgctttccaacaaagctgaaacaattttttccttttatcgagcggggcaatgttcaatgcccatgagaataattcctctatatttttagtgttccatactaattttttatatccaaaaggatgttctgactttaccatttcaaaaatggtttaaagttcacatgagacaaaatattttaccttatgtcaacagaagttcttatgttttaataggctatcatatatattcccttgtcccaaaatagtattcattttagggtgttaataaattcatacaatgttgatgtatgtgtatcatatatgtgtctaratttattgttatccatttgtatatggacaaaaagaagctaaaacggactatataatgggacatagggagtataacttgacaatatactaatatttttttaaatgaaaagaagtaagttggcacgacaaccaagtctataggagttctaaaattaaattgccatgaaacaataaaatcaaactattttttgagaatgtatgtttcatacttatttttgttttattttcaacaaaaaaaagagaaagaaaatttaaaaaaaaactgcaaaaggaacggcccagggaaaaaaacggcccagagaagcacagtgcgggtgcgcccagcatcggccgaactggtctatcggcgccgcccttcacgccgagagttccctctttctcgcttgctcactcgcgtcgacgactgggctaccggcgcctccaccctccgcctggtgtccttcgccgtcgacgagcgcacaccaggtttgtccgccctttttcttcccttcctgccgtggtaaaccgagcaagaaaaccctagcttaagctatgtggctatttgtatttggatctgatcgaatcgcgttgtgcctatcccaaaatcgtgtcccaaaatcgtggggttccattcaccccccccccccccccccacacacacactaagaagcgtattgtggattgacgcgagttgcagtgagtgaaactaggtgctgcgagttaggaatgcagttttaggtagatgtttatacatgtaacatgtttccttgcacggactagttataggcttggcttaccatattctgatctttggttgcttgtcagggtacagtacgtattgctcgtgatttgtgtaactacggagcaagctgcatacagcacaagatagaag

SEQ ID NO: 9128 - DNA, 1190 bp, Zea mays
ttacggatggtcattcacagagcgcgagggaaatatgacacctccattccaaactggttggaccagtgacagccataagacttgttttgctctgatcactctttgcaactcttcaattagatcttaccagctaacttcgcgtcgagttgtaccttttcatttttaataaaatttctcagtagggggtttccctcctgatctttcaaaaaaagaccaaaaactggtatttgaatagatacccgttttcatcgctacgtgacactgatatggctataggctgactgtatagactgtgaactagaaagctttgatagataaagactgatattgatggatatagaccagtcgatagtgatatgacggtaacaacccatgtgctcagcaaattatgtatatgatcgtcaaaacgtagttttgcactatagactgtattatttatataatgaagtttaaaataatgtgtgagatagttgataatagtgaggctgctcgagatagccttagaccaactccagcagataaacactgcacattcgtattttacactctattggtcatgggtctcacaccgcacaacaaagctaacgtctcgtattggttgcgggagaagagagaagcgtctattttgcatcgtgacagggagtctgctgggaggatgaacagaactcgtgggcgtgcaaaataatgatatggagctgtttactgtgtttgctggagttggtcttaagccttaacacgcatgcactgcttacgtataatacacgccactggtacgtgctttacgtacatgcagattctttgggcactgggtgaggcggccgtgagcccgtgagggtcacccacccaagtgaatgggacttgtaggcgtagctcccatcaggctcttcagcccgggtcaccttccctccgctcagaacaccagtaacattcatcccccttcctccccgtcgctctccgacgccgctcccttgtctttccaacgtcacatcccgatccgcccgtcgcggcccccagatctctctctgctttagcgcaactcgcgctccggtgcgcgtccactcatcgcgatcgcctgctcgaccgatcgatagctcaagcacgacgagaggagagctacctatcgcagttgcgcgtcttccttcttgctcactctcagtctcttgctcgctcgccagctctttcccacttgc

SEQ ID NO: 9129 - DNA, 542 bp, Zea mays
tggctgccacagcggtggaattttcttgtcctcacgacttcgccacgtcgtcctcacctccctggcttcccacgactccgccgtatcgaggtgctcggtgggtcgccttaatccgaagtccgaactaggaagacgagacagagaggtctgaggaatgggcctcgtttgatgttgagctgaattatttttccagcataagcccaggtcttggtccatgaacaaaattactagaaacccagcccagtactacgatctaaaagagggactgccactggatagctctctctagcattctccacgctccaatacagcggcgtcgggtctatccgggtctatccgcgaacacgtgagaactctccagaaactgctttctcctccacttcatctctctcgctttccctctataaaaagaccccttctaggaattgagggagacagcaagcaccaagcagcgatccgaagctcaatcaattcactcaaacctcttccccaaatcttcgattagattctcgttgacaagaagactagaaccgaacctgacc

SEQ ID NO: 9130 - DNA, 294 bp, Zea mays
ggtgagataagctactctttagttaatttacgacggctgagatatctagacttgagttacaacaacttctctggggtacaaataccggagtttcttggttccatgtcaagacttaggcatctcgacctttcacacacctacctccatggaaagatacccccgcaacttgggaacctcaccaaacttgtctaccttgatctcaaatgctgggacttttataaccctatttactactatcccttctcagtcaaccttgcatgactgtcacaactatcctcattgaagcacctagac

SEQ ID NO: 9131 - DNA, 544 bp, Zea mays
tgtgctttgcccatgcatccccttcctcgctttgtgtaaaggtcgaggcctctggccatagacgaattgtctggctgagtcagtcggaacgtcttcatgaacacgggaccctccgcgcgagctggtaagattacaaacttatgatatcttttgaattgttaacttgatatatacagagtcaatagtttattagcaaatgaagtttacgaatctcttggagttattctaattgattttagaaaaaaaattggtggagagacaataagttctaaacccatacacagtttggttataagatcgagaccgccatccatggaccagtacacgattagcgagcaatataatcacacacttcatcaaacccatacacacgaaccgtaagtacactacacactccctgtccctgggagtcagagagacatggcgcggcagcatattgcaccgtcgcggcaacggctgcacggtgctccggcccctacctacgccgtcgtccgttcagttccccggcgccggcttgccgccgaatcccttcttgcgctcctcg

SEQ ID NO: 9132 - DNA, 422 bp, Zea mays
tttgctccgcgcctgctcctgctcctgctccagccaggtctgcccatcagccctcatcaaacccggctcctaccccgtcccgcgggggcctggctgccttcaccaccgaagccgaagcggtagccgcgcctcctaggatccgccacctgctagcggtgaaagagacccggcggtccgagctcctcgccaccgccagcacgtcgtgtcgggcgtgaacctgcgccgacaaccggtgagttcaaagtttaggataggaatcgagtattttgagtcgaaactttaggtttgacattggagatttcacacccttaggtttctatttcgaattgaagggtggaaattattacatttgttcccaaatgcttaaggtctctgtggctacactccttttttttttgcagggtggataacagcagggtgac

SEQ ID NO: 9133 - DNA, 118 bp, Zea mays
ttcgcctataaagagatcgatccgtgccactggctcactcacggcagctctgaagcgagaaagagatcgatcgtattcgtatccgcggaacaagcagcgaaggatcggagcctatcca

SEQ ID NO: 9134 - DNA, 49 bp, Zea mays
gatattgtctggccaacgtatatacgagtacgtaattagcttcaaaata

SEQ ID NO: 9135 - DNA, 1500 bp, Zea mays
ctaatataatatgatacttagattttatagcgtaaaatttaaagcgtattgtcacctctatccctacgtctctatagtggggccaggcggaatggcggattgaacatggcggtagcacaactgtgttgctgctccatgcgatagtggccgcccgtacagccctagtaggcaatagccaccaccatcttgcgccgagatcgattagttagcacttttctactgagtactcgtcgggtctgtacgtgtgccgggaatgctggaatggagtttgctggctgcaacgatatataaataaaagcattaacgtcctgtgcacgtgatggcgcagggcctgagcctcactgttttcatctcgcagcagccagcaggcacaggcgcgccgcagtccgcttgtcgcctttgcgcagagatgccgctgccgcctgccgggcaaatctcctgtccatgcggaggaaaccagggccggcagccgcggcctcgcagggagatcccgaaaaggctctcgcgtgattcctgaaacgaaaagtcatgtctcctgatcctgaatggcttgctcgcttggagatcgctcgacgcttgacagccaacggccatcgcttttaaacttctttcggccccaggcagctggacagcacggagcggcaatggcgtctcctttccaccggtcaaatatcggtgctacaatctatgacgctgagttcggtgacacgtaggcgccacggcgtccgggttgtaccagcacaacatatacctcggcgtcataatttatggcgacgaactgtgttactttggtgttatatgctatgaggtcaaacaaaaaaaatctaaaaatgacattaaattttcataaatccaaacatgatttttttctctaaaaaatggccaagatgtaaaaaattcggccaccatttccttctgcacgtcgtcaacgggcgtgtttgtttccgattataatctgatcatcgataagaaaagtgtgtgccgacaagaaaagcccggcaaacgtcgaacacgtttattctcattgcgaaaggcaaagaaacgtatgtcagaatcttaaaacaccagcgccggctcgcttcttcaacaacgcgcgttcgttcaaatcagaattgaaccaaccagcacctgcagtatcagaacttcagaatggttgtaaatcaacaacttttttatataagctgagtgattgagtagtttaaaacaaccttttattttgttttatgcatccaatggcgccacgtagtcagctccgcacgcgagctctaccgaacggcactcggccgcacgcgccggagctcatctcccagtcccagaccgcacctcctacctactcgaacccagccacccacccaactgcccgagcctgcgactgctcggcttccgcgcggcgcgcacagaaacggacgctacaggggggcagcagcgcaggcggcagtccggctgcagagcgagaaacccgcaagaggcgatcgctagccgcgagcgcgggcggccacc

SEQ ID NO: 9136 - DNA, 559 bp, Zea mays
gttttgaaggcattgaactagcagcgcaatggacaaaaaaggcattgtctagtgaaaactcttaagacatctatggtggagattaaacatgctttgagtaatgcttgagatgtgtggtttagtaaaattggagagagtgcaataaagcagctcacgaattagctcagctagcaagacgcacaatgagagaaacaacttttcttttgtatcagtgagctcgttaaactagaaagtaattatactttttggcgaatgaatgcactctttctctcgaaaaagaaatgtgcaacaaatcatgcgacctgagtccgccggctcagccgcgcaaattgcagcatgtcaccgtagcgttaagcccaagcttgttccggcccagtagcgtcaagcctgcccgcagcggtccacgtcagtccgcccggaagattcttcctccgtctccaaaccccctgtggccctgtcaccgattccctaccctcaccgtcgcggataattaataaataaaaccccaaaaagaaatatccaaggccgcgccgtgcgcgcaatccccctcgctcgcacc

SEQ ID NO: 9137 - DNA, 231 bp, Zea mays
ggtttggattactaaccttgtgttttggggtccatggctatagcactaaaagagcatccgccatgggccttgccgcacggcattccatgcatactgccatgggttgatgtgattgcttgtgggtgttgattttcctctgattgtggttgtttactctgcttcgtgatgcttctgctctatagtttatatgctgctagactgctgctgcttgtagtttaggtgtttgatgaa

SEQ ID NO: 9138 - DNA, 598 bp, Zea mays
cgagttgcctacttccagctagttgccgtgggagcatggcggcatggcgctggcacggcctggtcggccagtaaaatagttgccaattcgtttttttctttttccatggctgtactgtaccccacctcgcgtggtctgcgccgcgcgtcaagcaacccatggcggccacgtcccgtccacggcccggccgcccaaccgcaccgaggcaaagcttccaccaatccacccttcccccttcctgcaatagaggccgaaagcgacgccgcagtttcggtctcccgtctccgctcgcaaatttcagtctgctccggcaccggccctgccgtgccagtgccacctccataaaattcgctatcttggcaggcgcatccactcttctgagtcctgatctagtccttcagagacaacgagcttcctcttccaagtcccaattcccgataaccaatgtcaaagcgcaagcacactgaaggcacgaccgcacgagctagcaaggtcctcagtgactgaccggcgataaagcagcggccagcagcagtgtcgcacagcacaccagctgcttgctcactcagggaagcttccataccaccagcccaccacc

SEQ ID NO: 9139 - DNA, 1500 bp, Zea mays
tatatggacatatggttcttgcatatagatatacatcccttactagtatatggtcctatggacatatggtttttgcatatagataaattctgagccattttttgcacgcaagataaatttgatagattatatcctatcacaattttgtttatatgattgcttgtttctaagatagtacatgtgtgaaaattttgaagaaagatagattaatgtgtgaactacaatgtggactgtatgaacagctcgtttttgttaggataatcattgcataatgtgtgaaaattttgaagaaagatagatcgatttatatattgaagggcatagtttaattcaaaccgctgtgaataaagttttacatgtgtcgagatgatctccacatcacttgatacttgacggaaatttacttaggccttttttggaatgcgattttttttccattgattgtttttttcctgtgaagatgaacagaatattgtgaagttcatgtataatttctctaatattcctgtgttctaaaggaggccttaaagtgtctcatctgtctaatttctctcatgctttccttgttgtttcttttccaccatattgtcatcttttataattcttccgttctaaaatagtatttattttagtacttggtttttatatctgtattcaaataaatgatgatgaatctagatacatatatataaaatacacatcaagtattgtatgtacctaataattatctaaaacgaattttattttagggcataagaaatattaatttatgacaatggagtagacgtattaacttcaaagacatcctggggagaactagttaacacaaagatatcacgagatgagtatttgaagagtagtacaggcataaagataatagagaaaattctttacatgctattataatttatccattatcatatcgtcattgttgataccttcaatgccacttggatgtattttcttatcctctgtgttatcgttggtagtatttaagagtacgaaatttgcatgttctaatctttctatgccgctgataatgacatagaagaggaagaaatcgtatcaaatgatacaaaagggattttctgtagaacccgtaaaacgattttccagtcattaacgccaaaacggcgtgcgctggccccccaactccgtccgctccaacagcggcgaacccaacgcaccccaccgcacactcacaggcgccagcctagcccacgctgttgttctcctctctcagtcgcctcgccccaccgtgtctccctcccctcggtgtcgtcaatcaccgcacccgctgctgctagcccgcaactccctcgcttcctgcacccacatccccgcggcgctacctgcctacccagatcccgctcgccggtggtgccctcctcagtcctcactctcccgccgctggcgccgccggagcgagggggactgcccataccctactaggacgagcagtaggaggcggaggggcgagatccggcggaggccgccccg

SEQ ID NO: 9140 - DNA, 542 bp, Zea mays; identical to SEQ ID NO: 9118

SEQ ID NO: 9141 - DNA, 95 bp, Zea mays
ggtacgtcgtgcttgccgagatttcatctagctggctactagcttgattggacgctgctagctcgtttgtatacagttcatcttcgcgtatatat

SEQ ID NO: 9142 - DNA, 133 bp, Zea mays
gagactcatccaattccaccatggccgcgcgccacagcggcacagccgatggatccttccatgttcctccgtccgtccgccttgctacaagcaggcagccacaccaataagctagctcttgttgttgttttgt

SEQ ID NO: 9143 - DNA, 1069 bp, Zea mays
tgactgcacttattggggtaactagagggctacacctactacagtgtactaaacctgctgctcatctatttatatggcttactctgcttttaaccatagggaaaccttaaaatttaaggttttaaatatctctatttaggcatttcaaggttttctgggcaaatcgactctaatcaagttcaaatttttaccgaatactaatataatggtaaacaagttttccactaatttttataatttttggtgctgtaattaaatttctaaaaaacaactacaccgagatctttgctattgttccatgtgtcctacatatttgcaccgaggcccctccctttcatttaatctacaaccccgatgcccctgacaccgtcgagcaccgacacagatgagtcgaggtcaaggcggccgggacaactaccttatgcaaacggggagggtctcacagctctcgctgaccactggagaacgcgtgtacaggctcaaacggacactagaccacggtaaccaccccgtgcccaacgacggtggacattgaagtccggtgagcatcgactcgggcctacttcatgttaggacacatgcttagggctggtgaagttttaccgattcatgggacgactgatgcgtgcgtcgtaacgtccggaggggtctgggttcaaccggtcgacgtggacactgcgctcggtggtacggcatggcgacagacactccgttcccgactaataacaatagcagagcagaaacggagggctccatgagcatcacgggtactaatgctccttaaaaaaatcattatctatacatagctctaacatctttctataaaaacttaaagctgaaagcacacagatcaaaggcttcacagccccaaagttttcctggccataccgagttttctggctttagtgggctaaagacaagcagggccgtgcctgaggtagggcgggaggggcggccgacctgggcccccatctcccaggggccccaccgcacacaaagtccaataagaatataggatagaaacggatattatttactataccaatatatttttgagtttgttaggaga

SEQ ID NO: 9144 - DNA, 301 bp, Zea mays
ctctgataaaacttttaaaaattggatattgctgaagtttgttatagattaatctctatatttcaagatagagtattgatttaagttactgtccgatatttaaaatgggatacacccaattcttgcttcaaccaccagcaccaggacggaagcccacaccataccataccatatcacaccagccttcctcgcgatctctccgtctcccgtccccaccgcgccctcctccccaccggattcggaggcgattcacggggccggtgcgcaggttgctgctgcgcatccgcggaggttgactacc

SEQ ID NO: 9145 - DNA, 1500 bp, Zea mays
ttctagccaaactcaattgaagaagatgtgccaaagtttgtcaaaactggtctgtactctaacgcaccagattggtctggtggtgcaccagaccgagtatgcagagggctctatagatggtcttaggcggctggagcattgaactggtccagtggatcgtcataccgtttacgcagaaaggttgtttttgggctgattggaggctggtgcgtcggaccatctaacaggttcaatagtcgacttcttctccaatggctctgttgatgtggcggtggttcggtgcacacgggactagtccggtgcacctgacagaggttgacgctgtcaaacgactccctgccacatcagactcataggggtcgatgcgccaccagaccaacattgttcacggtccgatgtgacgaagaattgtgtagttttctacactcaattccaatggatttttggagtggttggtgctataaatacccccaaccaacacattgaagatgcaagagctacaccaaacattactacaacaagtgcaacaacccccacagattcaatagcctccaagtgccatatcaagtggtttgagctagagagaattaatgccttgcgtgagtgttctcgatttgatttgttgacaagttattgtgatcttattttgagtttcttccttcttttgtcctcgttctcaagttgcaacgagctagcaagagacaccttagtgtgtggtgatccttgcgggacttgggtgtccctcggaaaagagaagaaaactcgatcgatctccatgcccgtttgagagagggaaagggttgaaagagacacgtcctttgtggattcctccacagggagtaggctattcaaaatcaaaccttggaaaacaactcgcatgcgttctttctgtttgatcctcatttgcaatttggttgttcctctccctcctctcttgcacttgattccatatcaattaagttactctctgaagtaatccgcaatcatttgagcgacttgtgcaaagagaactctttcctccgcactccgattgtttctattcttgttgtaacactaagccagtattaaagttatgtctatctaagtttataaaatttagatttcatgtattcacctcatatagtttactttcaaccgctaggcccgatgcccggctgtcccgctcacaacatcatgtgggaacgacgctgtcacgccatccggtgcctgctcccactggctaggctacagtctggtgcttgaacaaaaaaacggttaagagggtcacactgatggtgtttgcatgaagagtgcttaacccaaaaaaaaagcaccctgaaaacagttcacaaaattcgcattgccatggttcccaaaccaacctcaagaggagactataaataccaagtgccatccgggtcttagatgcacaacacaacgcttatattacttacaacaaaagataagcccacgaatcagtagatcgaggtcccgcycagtccagcagaagcgcacacggag

SEQ ID NO: 9146 - DNA, 194 bp, Zea mays
gggatcgttgggcatgggttagtagttctttattgcaatgtgtaattagattagaattatctccgtcatccgtaattgctcttgtgaggtatgttacatttttggctgtacatgtgaagtcatatatttgtctattaaattggttggtgttattgaattataaattataaattcatgagacattgaaatagaac

SEQ ID NO: 9147 - DNA, 1025 bp, Zea mays
gctgggattggcattcgcctttgtggtataaaatcttgtgcaggttcgctaaggttagcctaaattctaatagaaagcttaaggacgtgtttggcacgactctagagcaaatttctaagttcatagttacaaactctttgaagtttttagagttgcaatataaatgtttggagtattttttgctgttccgaaatctctaaaaagttaactagacatgaaatttagagttatttatctgtcattgctactggttatgagaaagcaatctaaactttagaatatacttgctccatagagccgtcatgccaaatacaccctaagtatcatctagatacggccgagcatgtttttttttctctctccaaaaaaatacgttagttttgtcatgatcctagttagactagagttggattataaatatgtgaaacaaacacttcgttttctttcctcttgagcccacttttggggagacggactgtttggcatgtaggccgaacggtccgaacggtatgcggtggtggcacggacgattcgcgcgtgcgcagaatcagttatggtttcgatttttttgcgggatttgttagctaaatctgcgagattaactcgtgaaccgacttataacgggtccagacctcccatttatatagatgaagggctacgggcgattgaaccccacaatcgatcaaatcaaatctacttaacgtttttaccttatgcattatgagtagttccagtttagccctagtttagcctccctctgtgtcaaatcttcacttctcttcggctttacatcgactagaggcgtcttgggtggcctatcgacgccaagatacaccttaggatctctcctcatcgacggggcacctctcgagaggcgagatttaggtctgctgcgaagaagacccatacgccatcgcggaccgtccgagtcccaggcgtggatcgtccggacgtatgcggaggaagagtcgctcctgcgccaggtcgcgaaccgcccgggcctgtgccacggaccttgcacgtca

SEQ ID NO: 9148 - DNA, 119 bp, Zea mays
tgtaagttcgcgtacatacgtgctgttactagcagctagcttgcgtgctaataatgtgcgctgtcgccgtcgttgcgtcgcgtcacacgtaacgtacgccgtggcagcggctatactca

SEQ ID NO: 9149 - DNA, 623 bp, Zea mays
tacatatataacatataaattaaatactatgtgtattgtatgcattcattaattatgtaaatgaattttaatttaaaatagagagagagtataatatagagttccagatgtattataagttaaaacaaataggttctatatcttcgactagctcactaggcgggcttgatctcctatcgagtcccacgtgagatttagcaaagtatgcaaccttaataaccacgaaaatgtctcctaattcctatggcctatacaccatgatatctgactgacaaccgggcccatttcgtaggaggcgggctaggaacccggcggttacacaaacctggccctggaatgtaggtttgccctcctaaatcaacctgagggattacccgttttacctggtcccgccctgaccccgggcgacgacatgttcccgtatttgccctcgcccagccggacaagaagcgagacaagcgcccatccttggctcgggcgttttcgggtttgcgccataatcccacggaatccgcattctgaaccatttccttcgctttccccttcgccctctctctctcccagtctccacccaccatttctcctcctctttccgtcgggtctactgcaccttgccctccccc

SEQ ID NO: 9150 - DNA, 1500 bp, Zea mays
actataagagggcagatcatttgatcacaatttatagaaaaaaaaacaccaacgcaaaaacaggacataggatgttatcttacattgagtccaaaaatgcataagggcttctttggtacacgtgaattagttaaaaaacacagaaaaaacgcaggatttaggaatttatcctttgttccaaaggatgtctaaatctctaagggcatgtttggttgtctagaaacggttgcctaaatatcatatgattctatttcaaaaccttttttacttgttcctatgaaactaagatcgaaaggatgatttttaggattatagaagccagacactcatacatacaaatgagggattgctcaaaaggcagacacttttttctaaatccatgcatagattatgtcgcaaaccctcgacgagggctgtatgagaaaacttgagagggaggtcttttatgatagtcattaggaaatgttattaatttttttgccaactttaatacgatattagaatcgtaggtttctatgcattttcaatgaactcgtagaactcgatatttaattgtaacatcacatatatagtatgcaaaataaagctatgatttatttacgtgtaatctttgtgctttacggtagaagttaaaaattttgttaagattgtattttaatttgatagagatttaataggacattgtcacttgttgtcatcataaaataaaatataacctttatattttacagagagggtaaaatatagcatatttgctagttttctgtaaagcaaacataggtgttggcccgttgttacgagaagctatagaagagaagaagaaaaaaaaatggtaccatgtcacgtggtgatgggctgacagtctgtctgcatatgattcgtgggccgttctgggcatatatgctggatgaatactttccacaagatagataagcgaggcctcttcgttcacctctgtctcgctttcctttcccgttcaccccaagcccccaacctgcgagctgcgacaagttcgtctctctcgtggccacgactggccgccgcccccgcctccgtcccctcgcagattcccaggtcttcgccgctcccttcgccgccaaagagcacccactaggcatgcttaccccttctcttctcttcctgctgtgcgaaacgagaacccaaaccctaatatcagctatttggatatttgtattcggatctgatctactactagtgtatacatgtcttgcgcctacaagtttcgattttttttgcagaagttattgggtgtacactgtttttagacatgtcctttactggttccgcccctttcttggcttaagcgcaaaaatcatactggattttagatttctgtactgttttttattggctaaattctactgtatgcttatttgttttctgcggttcacttgcccctttagctacaatttgcgtcaaaattgtgtttcaggttaaatctgccagcaggacatctccatcaagtgactggtgctaatt

SEQ ID NO: 9151 - DNA, 444 bp, Zea mays
ctctaagcagagcatggatatgaggaatagaggataaggccatgtttgggaataaagtatttgaaaactacagttttgtaatacaatagttttaaaatgccaatacatacccacaattttttaccgtagcattaaaatctttggtcagaagctatatttacaaaattgtgaaagtactgcattttagtcaaaactacagttttgaaaacagagtttttttaaaaaaactaccaaacactgtataagaaaaaaatactacagtatcttcaatactataatattctataaaaaaagagaaaatacttcactgacaagcagggccgccggtggcctacgtatttcttgttctctactcgggaaacagacaggacagggacggaggccaaacccaacccaaagcccaagccgaagaggaaaggataggagacggatagggtacccgcg

SEQ ID NO: 9152 - DNA, 652 bp, Zea mays
ggcaccctcccccctctcgattatttcccaatttgcgtggacgttgaagggcattgcagcgatgtctctggccacattaacagttgtaggtcgcaatcacggtatcggaattttatctagtaggttgtttgggatttggttataataccatttcaatcaagtagggtttattctttgtattttttctgctcataatttatctttgtgttgcttcatctctaactagcatagtagagatataacgatggaggcgggttgattttatctagacgctctatggatatgtccagtttttgtgtttttttttctttttgctaacttcaagtccgtttgatgttttcctcatctgagtttaggtacatactgtatttcgtgtatgtctaattgtatttgtttttcttaatgtgtatgactaatagtgaaatgttaactgttgccatgttataagtccactcaatatactatattttgtagtatctcctctcgttacatataaaagagaattcatttcgtacattaagctccaaccaggagacagaatattgttcagtttgaatttcttggatgccagtgggagattcttttggaatgtcgaattttcttttattcctctgtcttgttgcatattttcagtttggatgaatggaatgcc

SEQ ID NO: 9153 - DNA, 1500 bp, Zea mays
gccacaccaaaggagacgggtccaataagaaataagcaacctcaccggtgtaatcggacctgatgtcctccgttgacgctgacctgatgtcccagtatggctcagtgttgctctagcaataccttggtctagcccaactagatatccatggtaaaaaaaatcgtaaccctaaacacaactcatctgtcacgatgttaggcctccacgtcatcgctgtgacgtcgaggctcggacccgcgcctccgatctccatcgccctggaccgtcggcgtcgggcagccgcgcccagtgccccccttccacctccgagccccatgttctgaccagcgatcagacgtacccgcggctccgcgcctaggccaaggcgtcgctgcccgccgactcgagttcaaagctcctcctcgcgggtgccaaacagccgcaaccaatctcctccccacgagcgcggagcagttgcaagtcaagctcctccatgtagaggctcctagtgcagagccacagacctgctccaggcggaggtgtcgagctcgaccccacgtgcctcgccactgtccaagtgtagccgccccggctcctattctcttgcctcgactcctgtttcgaccatggcgctgccttcgtcgatgctccgccatcttaattttgggattttagcaacatattaattttggagcgtcctccgccaccagttagtgtccttgacgactttcactacgccacgtacatcaaagcagaccggtccaataggcaataagcaacctcaccggtgtgatcggacctgacgtcctccgttgacgctgaccgatgtcatggtgtagctagctatatatctcaaggatgtccgcagcgccggccggacaagcaataaatacccgtcccaattcccaacctggaggaggagattagtaggagtagtatcgatcgatcagcgccagcaaacacagtcgaggcccccgcgacacgcgaggtgtaaaaccgcagacggcggccgtgaggtgagcaagtgctggttcgctgcttccacttccatgccctcgtccgtcgtcaccaactcgccgagaggtcgagcgcggcgcggtggcctatttttggacgggaccctccctccccggctgacccgatcgattcatcttcctatcctgttgaacactgcctatgctagctgcatgcatgcgcgcggtgaggcatgcaacatcacagcaccgcagtgtatatctagcagcagacgtgacagtttccactggccattggttcccgaccgcgacaagtatctgcggctcgcattacacttaatagacgtgctgttgacgatatgcttcttctctgtgctccggttttgcaggatctaggcaggaacaaggcaggcccctcgtcccgcggctgaccacgcagagatcgcacgagtgtggcattggccgtcgtcgcgacgacacttgggtcatctatcatcctccgatccgtcgcctcgccgccggccggcgagcccgagagtacgaggcc

SEQ ID NO: 9154 - DNA, 208 bp, Zea mays
aatattttagtttctatatttaataatttaaaaactaaaataaaatgagagactaaaaattagtcccagcaatccctaactttttcttatttcaatattcgtgtcaattaaattgcctccctcctcgtcgaatcagggttttgggtccacaattccgcattgccatctagtccagttccagtccgagcagcagcaagcggcggcggcg

SEQ ID NO: 9155 - DNA, 1500 bp, Zea mays
accttaaaccaaacacaatatgctaagtttggagacccaagtgaatcagagtcttaaatggagttgtatttgaaatatatgattttaacactagaaatctgctccgacatgctacatattttacaaaaatttttaataattataggactcgatctctcatattttaaatatataacctcatatattgaagctctatactcgttttgtacattattttcaaccttttattttctaaataacataatctattttctaataatatgatatagaatttaacggttggagcttcaaatgttcttgtgaccttaaatactttagaccatgttctattttaatttttggaacttaaatataagacttttgattggagaagctctttatagggacaattttactggttttctagtttcggaaatccaaagggcacaacgtaaggccccatttggtttgagggactaaagattaatctttccattttagtctcatttagtctataaatttccaaacggtgggactaaaacaatgactcaattgttttagtctctagtccctcaaggggtgactaaaagagactaaaccatataaatttcaccttttgtctttcctttatttcagttgcactaatagtgtgagaatgctatgggatgttttaatcctcttatgattcatttaatgtgttttgaatagttttagtccctacaaccaaacagagtaagaactaaactttagtctcctaactagggacagacccatattgaaaatagtgggggcacagacgctcactcaacttttacgtttcagtggactttttatgttatttagtatatttatagagctttattagttcatataccttcgctcacgctctcactcaaacttagtccccactcaggatttggactagattcgcccctcataactaaactttagtccctgtactaaaagaacgagacataagtttgaagaccgcccatacattttactcataaaaccacaaatgtgctcctgcctaaaaagaatgctgacaggtcattatctggcgcttcactttcaatcaaaaggccacaaaatcctcctgttctccggtggaaaaggagaaagaaattcgcgagtatataataacgcggggaggcgagggagaaaaagctggcaagaggaggagcaaacaggctgcagacagcaggggtgcccaaaagcagggaaggaagagcggaaaagtccaccagtccaccaccaccttcctcggatccacaacccggacgcccgagtggcgagtgcagagtgctccacccgggtcctttcttcctccttccccagtcccagtcccagtatcagtaccagtccaagccccactccccaccccgaacctcgcaagtattttagtcttactccattcgagccctaccactaccagtggcaggcgagcgagaggcggtggaggaggagcggacggaaccgtcgcctgctgcgtctgcctgcgagatctaggcgagcgcggcc

SEQ ID NO: 9156 - DNA, 301 bp, Zea mays
tgtatattgcgtattgctagacgttactgtttgctggtttcgtagatgaatgtcgcatctgatgtgctcttgttagaattgagatgagcaatgcactgcttaagttcttaagttgggcatcttgagttttgatgccagtttaacctgtgacataacctcaatagtgactgggcattttctggatttggacctgaactgtgcaggtttcttggccccgtcgacttccagtgagttcagtttagctcagtaagcatctgatcaacttcgaggtgccagacagatcctatgctgccttactggg

SEQ ID NO: 9157 - DNA, 308 bp, Zea mays
ctgagagctgactagcagagcacagagcagaggtacaataataatcgtgtcggcagtcggcacccgactcctaagctagaatcgcactccactccactccactctccagtcctcactcccaccacccgtacgcttcgcggcgcgtcacttttgccagccatacgccagcctgagcgcccgacgtcgcgggattcgccgggaacgcccacaccaccgggccgcagccgaccaggcagacgagtagggtggtggtggtggtagcggtagcgcgggggcggggcggcgctgcgtgaccgacgccacgggag

SEQ ID NO: 9158 - DNA, 1500 bp, Zea mays
atgataacaacaagtagcctaaaggtagtgaacctcttgagtttatccctacgtaaccctcgccgacttatcttcgcatggctccgttgcatgggggcttcagcgcgggaaagtcggatctctgttgcgatttactcgttcgacgttgtgggccgtccgggtttgcaccaatccggtcttatgtcttctctgctttgttggttgtctttccccaggcccacaaaagaatgaccttacgatttattgggcccttgggcctttcgtgaggtcttttactcctttagtggacccgggggatatctatcccccacaagcccccgatctttgggttaatttagaggtaatcaacccaaagatcccaggtccaaaaaatgacttcctgctgtcttctcttgctccgatcactcatttgaccgaagcttagttttgtgcttgtaccttagaggtcggcatttcgatttgcaggattctgaacttcattgggtgcaccggaggtgcacccaacgggtgtagcccccgacctttgagtagattttagaagataatctactcgaaggtcttccccagaaattatctccatttgtgctcctgcatcttggttgaggattggtctttttaatcttgtcccacaccttagaagtcggcactatctcggtttggaatgataatccatggggtgcaccggaggtgtagcccccgaccttcaaatggattttttaaggataatccatccgaaggtctttcttttgtgcctctttgctgaaaattatccctttcgtttgtagaaattggcatgaagctatttgcattatgctttggaggtcagcattatgtcattaatattttgctgtagaggtcagcatatattttgtctttagcagccaagtttgcaatccatccatatcttgctaggtagtgcaatttatttgcttctgcgactgattggacgtttgatggacgttcactgtctagtcttcacgtcgcttctatcggccatatcttgtacttcgctggctatatttggctttcctctgatccttactgatatctcatttttgtcttgaggtattcactgcgtgccctgcacagatgtgaccgttttgaaaaatatactgataattcctgggcgtccccccccaatgggtgtgggcaagggacggcttggtacgctgagtgttttagccggctgcttctgaatagtaatgtgatgggacggcgagtgtaatcatatcctttgcgctgttgactggagtcccaatgggtgtagtgttgcatgaaacggcgtcagccgcctgacgtgtcttcagacgggtggaagtgcttattgaatgctttgcgactgttcagtgaccgcggttggaggtgagcggttgcctttcccttctataaacaacgtcgttgcccctctggttttttcacatctcttcgctgttctttactgcatccttctcttctctgttctttactgcatccttctcttctctcccgtctgcttccgcc

SEQ ID NO: 9159 - DNA, 1500 bp, Zea mays
tttgtttctgaggtggtctgcctgtcacatttccctgcgctatttttactcatccatctgcgtctgtgctggaaatgctttttgccagacatataaaatgtttcaaggtagatgatccccatctacctctttctgcaaaccaggaattgggggaattttggcatgctttgaagtgttccaaagctgggttggactgaaattttgtcatagactctagagcctacttggcgtagcattcggggttttaaatctgacacatgggcaccctatatatattagatgttttgtccccatcccttgtgagatcggctagctttattatactgacttactctgtacttctctgctcgccatctttttctctttcctttccctgtgtctctgcttaggcttgtttactgttgacccttggattttcttagacccatagtgatacaaaacaaacttaggtcggatgacccactaatatgtaccgatagaggtggctttctgttctcatttcatattcggcatgtctgtccttgtcgtcgacgtcttctattgttaagtatagccttacagtcaagtatatatttgtttgaccctttaattgtaacctaaccccacatgaccaaacagactcagcattctaagtacacacgatcttgctttctcagagatctactgactgatgtgcgcacaaagactgataaatgtgtgttagctttcactgtgactgttatttattagagctcaaagttgaataacctctccaatgtattatttttccatctttgtatttggttatttgtttctgtacctgcttcactgctaccttttaagttttaaggctctctaaatgataacgatgtctccgaaggcaacacaaacatttctagtcactctcaatctgtcacctaatgacagctgcaatagtgctatctagccaagggattttgagttcttgtttatggcttgtttgcatagaccaggtcagcgaagacttatggtcattacttgtatacactaggtcgtcttcaacaacttgtccttgtgccctgtggaacgatgtagtacacacttgccacaccagctctgaactagttgcaatttctattttgaggcttcagatgattaactttccatcaatttcaacagctccctagaccgtagtagcttgttgcaaggatttgcttcctatctttgactatctgtctctcagctgtgcctccctgtgttttaaggctaacctactgacagacaataaacttctgtcaatacaatatgtatactatcacgccttacttgaaatatcacctaatgacatcagtaacagcgtagctatagcaagcagagacttcccaactcttcgtgtgatttgcattgaccagggcggccgcacaggctgtatatgagggttcattgcttatatatgtagcatgaactcgtgcatcccattcccagcaactaagcctaaccatctgctccaccacttctgttccttgtataccttagtcaaca

SEQ ID NO: 9160 - DNA, 942 bp, Zea mays
aaatctgcatctaagcttcagatcatgtattcttaaccagaacagaaacattagtgaggcagcacagctaattttactgtgtggtcaaatagacaaatgctgtactagacaattgttttctcttaagaaaatggaaatcgccagcagtaagtgtggcagcatcactaactttactgtgtagtcaaagtactgaaccatcggtttgtcttagtaaagtgaaaatcaccagcagctacagttctgtggctagtgccaattgccaaagaagggtctcgatctcgaacgagaaagggaatccgatagtggggtgagaacttcagagagacaaaaccatgagggcaaaagggaaagggagatgttggatgccaagaggatatccatggtttaaaacccttcgaaaaaaatcaagaagtacacatcttatcaaggatatgttcactatataaatattgcagtgccgcagccccacagtgagcagaaaacagtgaggtcaagataagagaggaaagaactcattgtttacatgatcaggaaatggaatgcctaagctgtccagtttcagggcttctctttcttggcagggaagcatgagatgccatagctctctgctctcttcaaccctctgccaaaggagagttgccctgtaacaggactcagcttatggttcacgattgtaaagacagattcaagcttacactgcagcttagtgttgtaccggcctatggtggtgcaaggtttgaatgcttcgtatttttactggctttattgcatgtttgttcaagcagccaaaggaaattagttgatttcctttttcatgccttactttgtggtttgctatttcctgaatgtgtctaggcactggatgcttttggttttctgtttttttttaaaaaaaagtttactgctactttgctaagaagaatttgactgtatggatgaaga

SEQ ID NO: 9161 - DNA, 1500 bp, Zea mays
gcacacatgcacaaacctgggcacatatttaccaatttgttcctggatcacacaaatttatatgcagttatgcattcaacttctatcagtaactcataaatgtcagggaagaggcaggacaaaccttcctaatcgagcatgcttagtagaggtgagagaatgaccccacccaacatagcccaaagcactataccagaatcaaagcgaaggagacatcgtctttaacaaggcgatacaagcatagacatgggccagaagacaccatgtaacagacaggttttttggacatcacactgaattgcagacaaaatatgagaactgaaaacttcagctaacaagagtcttttgaccccaccaaaaatctcagctgaagacttcacttgccatattttggatttcctgacttccaagttccaccattttttttggccttcttttctgcagaatagcccaagaatccaatcagaagcaacaagcaaaaatcacatcagcaggttcaataatgctcctgttgttaaaacaaacttcatttctaagcttccaaatagcccagagaacatcccccaccctgagcgtgattaaatttttaacatcatgaccaaaattactcagccaatcaccaaaaagggagtcaaagccctgaggacatcttttcagatccagggccacttgcaccaccctccagacaaagatagccacaggcaattaaagaagaggtgattagtagattccaaaacgcgacaaaaactcattggatatctacctacaattttctgttaccaaactctcacacgcacttatgccgaacaactagaagctgacaccaccctctcccttacctgatcttgatcagtcataaggcaaacaatgattattagcttatagtatattaagttaataattaatacttacagttgtgaacttgtgatattaaggccctcccagagcagaaagcagcaatatttctgtctctgttaattagcttgccacgtatgtggcatactggcttgtaatttatcgaggagagagaaaaaatttaaagcaatggtttttaattaagaaatcgtagtatcatctgtccaccttccagttgacagtgtcctatgggctcggctgaccaaccacatttgttaatcccttcattactatcttcttttgtgctttacatagataacttctacatgccaaaacatacttcaaagatacatttttagaggtagtgtcttttcctgtacaaaatttcgcaagaatttaataacaagtgatgtacagttcgcggtaaatatgcaaggaacttgaataatgctataagcctataacctgactcagatgatgaggacgccatagccatcttcacaactttccagccacgacaggggctagccttttggcatgtaaatctttcaccgatttcaaatgcttctatggtatgagaaacacttgaaatattaatgggatgcacacttcttcctcgaacacttgggatgtttatgtcagggc

SEQ ID NO: 9162 - DNA, 79 bp, Zea mays
tgtagagcttcgctcttcaaaagaaagatgctatgaaaatatgtagcatgtgtaaaaaagataaaaactagcttcgcca

SEQ ID NO: 9163 - DNA, 799 bp, Zea mays
cctgacaacaattcaaccaataatttacaaaatcaaaggttaaatgtgcacaattcgtaccatagccgaccacaaatagctaccttaggggaaagaaatggcaatgtctgtgtcattgaatagctccaaatcatccatggtggatccattgcacacagagaacgagctagatctggttgaaggaggagatgaatgggggagagaagttgaatgaatgaagaacaacaatgacaaactcacgggcggcgcccttcaatcgggtccgagacagcggcgcccggcgtccgtgcagatctgacgtctgacgtccgtggggggagaatctctggtgcgagagggagatctctggtgcgagagagagatgtctgcgagaggagagaagggacaactcgacggcggtggagaactcacggcgctggggacgatgccggtatcacactaatcctggttcgaaccgtgtaatggagtattcgtgtccatttcagagtgtgggctttcccctggtttttcataacggcgaatcactctcataagcctccaattcgtcgaagccgcacccgtggtctttcataatggcaaatttcttgagcacgtctttaatctgcaggcttgcatccgagcgagaagggagctgacctcgacgttgtcggtggtgaggtcgaggccggtctcggtgtcgacgatctgctcgacctcaaggatgtcagcaggatcgtgtcacggagccgcgtatcgatgatcaatcttgagcgtcgtggtggagctggtgcaggagccgcatgcctcctgcagcttgagc

SEQ ID NO: 9164 - DNA, 1500 bp, Zea mays
atacaaatttaagtaggagaaggtttaattccttcgatccatcttaatccgaacaagcccttactatttaaaatgaccctctcaatcctctccattacacttgctcctagtgcttgtttgggagaagatgattgagaggagtagaggactagaatccctcaataatgagggattatgctcaatactcttcattactttacacctttggatgttatagtatacatataggttgagggggattagaatgtaaattgtaatttatacgccgagtattcaaacatagtctaagatgttggaaggtttaggaagatccgtccccgtccaggtgagtgccggtagcgtccagaaccagaaggtcaccgctacccgacaactcgttcttcacccgcagaggatattgcatcaactcgtcctccggtggtaaattattgaagtcatctgctacacctacgaatattgcatcatcaccagaggctgctatggctgcacacaactctggcctgacatcaagaacttcggcattatgtataggttatgatcatgcgttagattaagttttatttcaagggtcttctcatgtcctcggcatacatgaacatggaaagcatgcaccttgagcgatcgacatacaagtgtgaagtcattgtcaaaagattaggtagcttaacccaaccgatctccatgtgaagaagagaaatcagatgccaccccgccagcaccggacacaatcagattcacctcactttggcctacactatatatcatatgaaaagatatggcacctaaaaaaccaaatgcatggaccgacgcaaagcgataatgcatgggtgcgtttccgatgcatatctcccttggtcgtccgcgaatctgtaaataaaatatgtggagtttcatcagagccacccgttcgagatcgaatgtttgggactagttttgcgagagaataatctgtgtaggcgaaaaagacactgcatagcttagtgtggagtaagatttactcaaggggttgatcagttaagctgctggtggcagggaaatggatgcgacgacgacgatgagatcatatgacgacaaaatctatggtctccctgaacgctgatgaacaggcgacaggagatccatcaatgctacataaaagtcctgtttgttatgatggaaaacttgttgttgtcgaaacttcgttctcgaaaccttgtatcattggttgttggtggcatgaacagacagatagagcccccgatccgaactagctagcatgaacaattaatcgccgctcctattcgtcgaaagcgtttcatttcctcatagagtcataggtaaagcggatcgatatattctttcccacgcagccggtggaagcctattgcccaccataccaaccccgcgttgcggttatatagggccgtatttcccccgcgtctccgcgtcagtggaagcgatcgacaccattcaagctaaagctgctttcttgggaaacgcttgatcgcaacagctcgatca

SEQ ID NO: 9165 - DNA, 968 bp, Zea mays
agcactgcccggcggcctttttcccatctctctctctctctctgatggcctgatggggtgtgcatgcctgactgactgatagatagatagatggtcaggtccgtctgatcctcatcggcctagctcaccccacgcgaaaaaagccactgctggctggcgcccagttgcgcttgcaacagtcactttaacgagccccgtccttgcgtttgccctcctcgctctgcccctgccgccgctgcgtggtggtgctggtgcatgaggcaggcgtcgtactagtgcatgcaatgcaaccgtaggagtgcgttgcgtaccctggtctgtccctgcggcctggcctgccgcccttgttcgttgcggatgcggggggtgccgggtgggtactgtactgtactactgggtagagagaagtagatatagatagatagagagagagagaggtcggtcaccccgggcgcgggacacagcctctgcgaaaaagcgatccatgtcgcgcctagctttgacccggaacggatcccccaaccaggaaccagcagagcaggagggccaggccaccacctctcgccattccattcccggtcctagctagtcctgttctgttcctgtagcagtagctacggtactacgagtcctcctcgacgtcccaggcactactccactccacgcagcagcaggcagcgagcatctctcgaccagatgcatacaagctacaccctcctcggctccgatcctacccatgccggcccaggcggcctataaaagcgcacccccggcccgtcttcctcccactgcatgcccattgcccccccggccttcgccgtgccaacgacacacctcatcaccggccggaacattccacgaccgaagaaaccagtccctagctagtccacgcacgaccaacaaggcaagggcgagcgacgacaagttccaaagcctccaagaagaagaagaagaagaagaagaagaag

SEQ ID NO: 9166 - DNA, 81 bp, Zea mays
cctccccgtaccccgccccacacgccaccaccatcggtcgggaagcaagctcaaaccctaaccgccggcgatgccagcacg

SEQ ID NO: 9167 - DNA, 336 bp, Zea mays
cctttgtcaaggcataggtatcattgtatttaatgattcaatatattaagtgaatataatatgatacatctgtaattcattcatccattttataccttttattttacattattttacaatgtttattgaaagtttattacgaaggttcaacttcgtaataatactctcttcaaccttcgtccaagacccattatcctcaaaggaataatgcttcacggacgaaggacagtatcatttaacattttatgttgccttgttcttaattcatagcatttgagaacaagtccccaacattggcgcccacctccggtgaactcacttccactttttgagctg

SEQ ID NO: 9168 - DNA, 354 bp, Zea mays
agtgagttcaccggaggtgggcgccaatgttggggacttgttctcaaatgctatgaattaagaacaaggcaacataaaatgttaaatgatactgtccttcgtccgtgaagcattattcctttgaggataatgggtcttggacgaaggttgaagagagtattattacgaagttgaaccttcgtaataaactttcaataaacattgtaaaataatgtaaaataaaaggtataaaatggatgaatgaattacagatgtatcatattatattcacttaatatattgaatcattaaatacaatgatacctatgccttgacaaaggttgtattccgaaagatgcgattgcaaatgccaga

SEQ ID NO: 9169 - DNA, 1134 bp, Zea mays
ggtatgtatagaatcacttgtttttgcttatctgttcatataagggtcatgcaatgagactgatagcatgatcgtgattgtttacatcattctggaatcacaacaacttctcatacggaagttagaaacataaaaggacagacggtaaaggttaataactaagcttgaagataactctgcatcggtctcccaaatatgaggatggccacaacccagaatagtgtccttaagaccttatcggcttaacctgagacaataactaccttttcatatcttacatcatatacttagcattcaagtaagtcttagattcctattgtgatgttaatgatcttgtgtgagcatgcttttgatgtccagaaatccaatagcaaagatggcagatgttgacggaagatcattcagtctttgccagtacgagtattaaatttgcttgtttcagtatcgcaagcaagaaaacagcttaattattttatctccttaactatctgtcactgtgcagctagttctacaattgaagctatcgactttgtcacctccatttattatgttccttaggagaaaattcaaaagtttaccaaaaataacatgttctgacgtctgaactgatagccagattttgtatctagtttttttccccaaatgatcagatatttatcttaattaaatgctagcatttagcttgtgtgcatatagttgcctcagaaaagacatccataaacactttgttttcaagtaccaaaatattaaaagaatgtgtaatctactctctggagttcagtactgtaagcttatccatgattaactaagtaggttctgtagaaaccgtggtctcacattaaagaaatatttagctaaatgattccgtagctgtcctgccaattttggaccttgtagccgacagacgctagtgacttcggttgtcctgttctgtgaacattctgttgaactttcacaatcaaggtatgcagttataagtggttgacttttgatttaagtttcctatatatattgctctacgattatctaaatatttcagttcagtttgttacatagtgtttgaaaattggaacagggcccgtgttcctttactcaacaggagtgttggagatattgcatgttgctcagccagaa

SEQ ID NO: 9170 - DNA, 96 bp, Zea mays
ggtcgcctttttttctctcgggttccgtctgaaagattcgattttcttttttgttctttcctttttgttttgtgtggtggtttgagcggcatggtg

SEQ ID NO: 9171 - DNA, 1500 bp, Zea mays
gtgagatccaagtttcttctggtccagcaggcagatcaacgtcctgaggctccctacacaacaaattcctccgactccccacaagaacaaccaatggggttaggccttaggctagctccaacaagaccctctaaagggttctgtaccctaaatttagaggacggggacgtcctctactccctccagcaacgtcctctaaacggtcctctaaatttagagaacgctgctggatcctctatatgtagagtttctctaaacggttctctatctatttgaatactttaaacaaccggtttaataaaactaaaatatgtacaatacatttgagagtgtgacaaatacgtatgtacaaaaattaaaaaattaaaaaaaactcagccggggagggaaagaccgccctcccggtattccgtataagaagagaccgaaacaatggtcccggccgaaaaaatccccgaaccctggccccgcatcactaacttgccggcgtcaactgtccactctgcaacggcccaaccggagggtggcggcgcacatgacatcgtaacccgagagtggatggggcacaacgaggggatttttttaaccaagccggaaaattcgctcccgataggaatcgaacccaggacttggaggtgctactcggaagtccttaaccgctaggctagaggccctttcgcacctaaggttggaacacatgcacatgctctaaactatatccattagaagaaaacttatttatctttttttttctcgaaagctaaaacttatttatctttctctatccttgagcagacgaatgaggctccattaatttcctaatggtttgttgggcttaaaatatatctggatccttaacttgagtcatgataaccactctaccgtacctgaggaaactattaggatttcttgccaaaggagttaagacttttgtacttttagttgatttcctaatactgtatttgaagctcgaaattttcatttgaaaatattgtaagcagctgacagtaatccctttttaacttttgcatatgccagctaagctgcacataaacagggtgtgggttgttgctgatgtattttggttttgttagatttggtttggtaggtttcgagatgaagacgagggcaaggtctagcagtgccaactctaggtgtgctgctgcttacactgcgyggtggtggagctggtcatgttggcggccgtgcaatgcaagtgcccgccacgcccgcgtccaggaaggagacagggttttgacaggaaaggaagatgttcgtgcaataacaaaggaagctcgatctgtggtagaaccacacactaacaaaataaaaaggtgatctcccttcactcctaatctattgtccttaaagctagacaataatcccttggtagaggtaactgtaactcaaccttcagtattttttcttgaacgcatagggtaactatgtatcattgtattaagaagataaaaggggtaaagagccttggaaggtacaaaa

SEQ ID NO: 9172 - DNA, 582 bp, Zea mays
ggtaatcagcatcttggtggcggcgctgatggccctagcatggtccacgatgggacaagcagaagcgaaaagccaaagaaaaaggaatacaacatcgtctcacctgggccctggcgcctactcgggtacatgtagtcgccaatgatccaatatccaaggatctaagcaccaagcgtgtgcctgaaagtggaggctggtgggtgcctgagccttagttaggtggggttgagcctttcttagttcttgctctagcgtgtgcaactaatgttttttctaataactattaaaccttgttaattagtagttgatatacatctgggggccctaacttttggagtccctgaacagtcgcacatgttgcacactaatgtatgaccctgatgatcttctacattttcacttctttgcttgagtcttagactctcagttttgtagcagcaacgattaaccatttaccctttattttaaatcaacttgcttttggaatccatttttctgtatctattagtatatttttactattaaatacctctgtctctgcagcctcaaatcttcaagaaaatacaatctgaacttacttta

SEQ ID NO: 9173 - DNA, 1500 bp, Zea mays
tgaaccggcactaccgtctcctgcaggctgcagatctcagcagcgcggaagacacgaaatccctactgcgttagacatttgcgtcaggttgaaggaaacgggagcgcgggacaccaggaacgtctgctcttcttcctcgggtcagcaggagccgaggacccagatccaagtgcagctgaagctgcaactgcactaggccagtagcagcggcgcacactgaatccccccaagcgcctctgatctactagtagaaggaagaagaaaaaaatcctccggaattgcagcacatggatatggatatggatatggcacggatggactggaatggaattcgattgcgggggcgagaggggcgggacgacagggaggagagcgggagactgacctgggcggatgcaggggccagccagaagccggcgagcaggacggccgggggagttgaagaggaggggggccgagtgtgctattgctatatactaaaggtggtgtgctgtgctgtgctgtgcagtgctcgggtacggatgaggtgaggaagaggcagaggtgggtctcacgcatgagaacgtatgctctccctctcctcaaatagaagcccaccgcgacgagaggcgagagggaggcaggaagacagcccagcccaggtaggactggagctagtagctgccatttcaataatatatattgtgcactgcagctgcttctaccaataattaattaatggcactaaaacaaccgactgggcgcgtggccgatgtgattacgtgaggccgcggccaaacgcgatgcgatgacagggacgaagccgaggcggtgtcggtgggacgaagagacgacgctttcatgagatcgtacgcgggtgggccctgttggccagtctcagttctacagttttttaaacttagcggtgtttccgtgtttataagactttcataatatataaagtaaaatatagatgaacatattcattttaataataaatatcgttccataattacatgtacttaatttcactatttatagagagttttaaatcatataaaaagacttttatttttataaaatgtattttttttcaaaaacaaaatactataatattaccaaaaatatttatgtgacagattattaaatacatgtacgataactaactgatgtcccgcctctgttctgggtaatatttgatgattaaacacggccctaattatgaggatcacattcattttttccgtgctggtcttcacacttcactacacaaacaccttgcatgcacgccgccgtactcgccaccagcgacagcgagcatatatcccctgggcctggctgtcgtctcccgctgtttatgggctggaatgggccgctcaaactggcccgttacgtgaatttggcggggctgccgctgggatccgagacgtggtggctgcacagcgacgtccgtgggagcgggcgggcgactgcaggcagagggtttcgtccgaaccctagtgtcctccacacgccgtcgcc

SEQ ID NO: 9174 - DNA, 622 bp, Zea mays
tatgatttcaaaacaaaagaagcaaacaactagtggccctaacatgtttgcatcagcctctcctcatgtgggctagttgttcctttcctagcgacataaggtgagcaaaagagtcaaacaacccttacgattgtcactctatgctgatctttttgatttgatatctcctaaaaatatgtttctgtcatttgtctttgctttcctatgcctgtatgtttgtgatctctgaatagttatttctgtctcttggcctttttgaatgagggtgttttagagtaaaagcgctagttagctctgtgcattcttgtatttgtatgacactttgtcgtttggctacttatttcctgaagaatgctaatatttcaaacgatcccattcctacccactccctttggtaaaaatatgcacttacacagtgatctgatttgatcttccaccaacttacatgcatttttctaagttcttataggtttatgtctccctctttctaaaatgccaacattagctatacattgtaattttcttattaatgctgtgttctatatggaagctctgatacatggttcacttgtttcaggtctacccccaagtgaaatcagggtcttcaagatagcttactgag

SEQ ID NO: 9175 - DNA, 956 bp, Zea mays
ttcctaacatttttttgggctagccgctagaggtgattcctttttctatttagtggtgtttagttccctagactaaagtttaaagtttgaatcttaattataagtttaaatatagtttaattataaaataaattacatagatgaaagactaaacgatgagacgaatttattaagctaattaattcataattagtagatgtttaatgtagcaccatatcggcgaatagactaaaggcttttagggtatgtttggaagcattctagtttttataccattttttttatcttcggttcctagaaactgttttattttaaaaactgggtgagtgtgagtttttagtttttagatgcacagtgactagccactctttctttatttctaaaaacagtgataataaaaataaaatctgtgaaatcaaaagaacatgatgtaattaaacaagcaaaaagtggtttagcaatggaagacaatgcaatgctagcttcttgttaagaaattagccaatttctataaattaggacataaaatattatgtttggaatcacccagtttttataaaccagttttgaaaaatattatataattagtttaataattagactatatttaatatttatttataaccagcgtccaacatcagatcttgatgaaactatgataccaaccaccccctttaataacgtgcgagcaatttcataagcaaaaggtagctttgaaatgtcaaacggagaaaaaacaaaagaataaaaaaagttgcataatgtagaagcccatgttgaagatgagagaaaatagaaccacattccataaacccaaaatagcaatcagctcatctttcagcggcagcgccacaggtgaccggaaaaccacggccggcgttcctgcttctctacccggtccgaattgctgaccggatcaacccgagaccttgcaggattatcgatctgattgcggc

SEQ ID NO: 9176 - DNA, 999 bp, Zea mays
ccaacagcttcgtcagaggaatcagcacttcagcggaggtgagctcaaggcccccttgcgtcgttttatctcgctcttgatccttgtcgcttccaagaaccgcccttgggcctgcccggccttcatggaccattctgaaagcttgcatgcatgtcgtcgtcatgttcttgcctggtcgtcgtgcttttgtaatttcattcatggtcaaggagcagctgctccaaaaatctagtgttgtaaagaaagaaatcagcttttcggagttcccttcaggatcagttaagacacgaaggcatacttttgtttggaaacataatgaagcagaattatgatacagatatcatcttcccctggttccttccagaattctacctgcgagaatttttagacgttagtacactataagcgtgtattttttttttgcataaatatgtggagagaaatttctgcttctgtaccattgtggtcgtccgggatccaattacagcgcaaagacagttatattattttacgttgctacagatctgtatctgttactttttttttccattaagatcacggtggtatccattcacgtactcctaaccaaacagcacatatatgtcagtggaggacaacgtgaaagtgcagactgccaaacctatggacaagcatataactcaattgcaggtgtacaagcacataggacaaattctcatttgatgtttagattgcatataactacaacaatgtagcaccacatttattatgatatctttggatactcatcattcaacttattactacaataaattaaatgcgccatcccctatccgacagggaagagctcttcaaatcaaagatgaatagaaaaattcagtaacttattcagttgaccgctagaaactgttaccatcgcaggcaaatgtgctagcatctcacatccgtttctacttgttgcagacacacagtccaggccatcgaactgatacttgtgtggtggcgcgggcagagatcaag

SEQ ID NO: 9177 - DNA, 499 bp, Zea mays
actccattcatcctaaaatattagtcattttagcttttaatttttatatctacgtttaaattatataaaacaaatacattaattactgtatgaattaactaaaaagttaaaataaattttattttgaaagaaaggaagtagaaagtaatttttatgtaaatgactcactaagtgataatttagaaaggcttttggagatactcacgccaatttgaggccatccttgaaaatcaaaatccaaattaaaattcagatcggaagccaatccacgcatgacgtggaacctgagctggagcacgatgagcccacagccccacacgcacgagtttcactttcgcacgactccaaagcagcaaaggacgtcaatcaatgagcaaatacatcgaattgcgcgaaggcaaagcgtccaagcaaccacttctgctctgcatcccgtctgggcctctgcatttgcttggctgctgctcccttctcccaccgaccaactcgatcccgcgcc

SEQ ID NO: 9178 - DNA, 242 bp, Zea mays
cagaatgctactgttgccctgagattccaagaccaggtcgtccttctccttccactagctagcagaatgctagcttgccccacgcaactgcaagtgagatttttttttattgttttttgttttcttctggcgcgcgctagctgttacagtctctcagcatataaattaattaaactagtatatgtctcacagcacacaggaaagcacaccatcatctgtctccataaacaaggcctgcagcg

SEQ ID NO: 9179 - DNA, 579 bp, Zea mays
atattcctaccccttgtttggcctggggtgccaccattgccttgggtgatgaattaatggtccgtccctcttggctacagtatatatatatgtctctacaatattcgtgtgcttgtagaaccggtgcaggcgtctcaagtcctcgttcaccaccttattgtcacttcgcgtacgtagcgtagcgtagctgtagtgcatcatgcaagatttcctactgaactgaaataagtagataaaacaaggcagacgggtgcgtataaaagatccgttgctgtgtcttccagatcgacaaaaggtgaagagtccctcaactcatcatgcacactctaaagccgtgcagctggtcagtttgttgtgtcacagggctttgaacgagttttaccagatgagatgcccatgaccatgagaaaacaaagcaaagccaaaggccaggtggtattaccacatcgccatccgtcacagtaccaccataaccaactgtcctgcctataaaccctttaacttcgcttccgcctccctccctccctccaccacgacacacctcgccttccccacgcaccgggccaggtggtataatca

SEQ ID NO: 9180 - DNA, 585 bp, Zea mays
tgtgataggctctccctcgttaccagtggtattccgctttttctattgtgagatgctttcagtgagagaaaaaaaagaccagcaaaggcacgcgtaggctccgcatgtcagtgggacaaagtgcaccgaccaaaggtgtaggcgtgtcccatgtccaagccgagcgagtcctcccctcccttcccaccaccctccccgtcccctcccgcgctccttcaccagctggtgctagctgtctctctcctcttgtcatgtgacctccgtctcactctcctatttctctatcaggctcagctcgatcccctctttctctctctctccaccccgtccctgccattcccgtcccgacattgcccaatttagcgcagaaacgagacgagcaacaaaaacgcgaggagccacgcgcgcaatccccggcctgcactgcaccgcacgcgcgccctcgctacattgtcgcccagggtctcggggcactaaggggctgggccggggggggaaggtttccggcgttgcgccaccgttcccgcgtgttgcgttgattcctcgggtcgaaccaacgcgcggcgcggggtcccggtcgcggcc

SEQ ID NO: 9181 - DNA, 264 bp, Zea mays
gaaagatatttaattatgactagagtacgaaaagggaatttaaggtgggaaatcgttgaagaaggcctggtagggttttttaacagcccattgcatagcctatcgagcgacggcctacgctcaaaaaacacaaatcgctttccgcgccgccgccgcgccgccgaccggcgctcctcacctctcccgccgcacccatcgtccccccgttcccggctaaaccctgcttgagccctagacaccgcccgcctccgggaggtagagagc

SEQ ID NO: 9182 - DNA, 1123 bp, Zea mays
cccctccctgccttggactcttcttctccggcgggaccgggggacggccaccgcgcatcggacgacggcctttgacgggggcagcaaggacaccgccacagtttgtcctatacaaacggaggccaggacggggccttccgccattgctttcacccacccccaaaccaccgctaccactcgatcgagacagcagagggagatagtaatacggaaaaatatatttttttaacctttagtcatgtcgctcgcctcccaccccacactagtgttcttttcatcactttcacctaaaagccctaacagtgccacctctgcggcgcgacttttcgcctctacggctgttgatattcctaccctctgttccacctccaagttggctccgcagatctcccctttttaggacaaacaatccatccaccaccgccctacacaccctccttcctaaaaatagtagccggcgccatgcaaatgcgattccccacagctccccgttcctgatggagctcctccgcagatcaatggacctatgagacgacgagcgacgccagtcagcaaccaggtcgtccaggtaccgcaggaactcccagcggccacccctactagcaaccactccagtctccagctgagctgagctgagcaacaaagggtatacacttgtaactctatgatactctccatgtccaagctagctcctttttatcttttttcctcatctcttctcttcgcggccgcttcagcagttcagctccattccaacgcgcggccgctgcctcggctgccaccgccgagatcagccgccatctccaccaaaggtaggagtatacttgctcgcagcgcgccagtgaggcagtgactgcatgctgcctctccaagaaaatagaacccatcccccccgcatgtataatttgactgacgaaaatattgtttcttataagcagcatcatttttccttttatgcataaatatgaaagatgcatcgctttcacacgaacatggacaggcaaagaaaatatcgagcagggcacctcagatatatagatccccaaaatggcgcatgtaatcatccgctgcgtcaatccttcatgtgtctgtatatgattcctggatgccagcaggttaatcg

SEQ ID NO: 9183 - DNA, 573 bp, Zea mays
atgtcttgcaacaaacagaagaacatgggtgctgcaatacaatacgctggaactgaaactaaaagcaaccgaaagagacttcggctgttctatatttctattgctagaactagcattatcattttgagagagagagagagagagagaatgtttcagattaaggcaccgtttcaatctcacgggataaactttagcttcctgctaaactttagctatataaattgaagtgctaaagtttagcttcaattatcaccattagctctcttgtttagattacaaatggctaaaagtagctaaaaaaagctgctaaagtttatctcgcgagattggaacggggccttatccatccacaccacagccgtcgtgggccaccgtccggctcccccggtatacggccaccacctgtccttccgcacgtccccgtcggccatcgtccacggatcctatcggtctctcctgtgtcctcttcagtctccacgccgttccagaagtcgccaaccttccctcgccgccgcgccgcaacagccgcctcccctccaaggtagcccaatcgaaaccactcgcccggccacc

SEQ ID NO: 9184 - DNA, 1500 bp, Zea mays
caagcagaaaattagaatagacacagactcgtgtagtcatgtactaggtgccacttcttcacagaatcgcaggagcgcgtcaggcgtggaccatcttgcattgcatggatggatgtttgggcgccaggcagtagccactagccaggcacctgtgactctgtgagcagagggcgaagcatcgggcatgcacagcaacgcttctgttactagttttgtgctgcagcgcagtagcagcggtaagaaaaaaaatacggactcaccggccggcacgagtggtgaggcgacaattgggctggcagcctcgaccgcagctagctcttccgggccgttcagccggaggcccggagcgacgaaatctgtcggtgcgaaaaagataattgctcgctttgtttccgtttccggccgtttctttctccttcaattctcccaacaacaaacaaccatcgcgcgttttttttccctcggaaaaccaacggccgcgcaatatatactacgtatatgggcgtttcattttccttgtagtatggtggatgggggatcgctgtcgggtgagtcaatttgacagcttcctaagctttgattgatcgcttagttccacctgctcacactcgctctgcctccgttggcgacgccgacgccttctcttcctcccacggccacgggacccgtcaatgctcgtataaacagtaaacgtataaaatacgtgcaaggatgtcatctacgaaatcacctactatatgcttgtaagtagcctgataggattgtgcctgtgattctgtgaacatatacagtaccttttcatatatcataaaaaggtcactaacatttgaaaggggctaacattatgatgtcgaatgagaattaagcattaattataagatatgttttcatagtgtatgtatccattcgaaggcatgcgtactaaaaacttttttttcttctatatttaaattagtttaactcgatacaaacctagaacatgtattcttttgaattctgaaacaaaccaaaagaaacaagaaagaaatagaaaggaaaaaacatagtagcatgcaggactgcaggagggaccaaacaaaatggtccgctccggtctctcgtttctactccgggacgagagagagagagagagagagagagagagagagcgcgagcgggggaggggaaggggagaagcaagcgagacgtcacgggagcagagcatagcctgatagctccattgccgcttgccggccatcgcctagccgccgcccggctcccgggaagagaaatcagcccccatccccaatccctcgcccccccaaaatcccctggggattcgccgatagggccccccccgtgccgccccgtattttgcactgctcgcacgcggcgacgagcattgctatttccttcttttttacctattagcatgtctctgcccaatgccaccgcctcgccgccgccgccgtcgccggaaccctaggccgccggactcggggctcccgtcggcgggggagg

SEQ ID NO: 9185 - DNA, 1500 bp, Zea mays
tttgtcaaatgcaggtctattttagcgctttgcgattagtccgctctatggtataatccatttttttctatttctaatgaattgtgttagtttttctctctttgctattagtattggctgacagtgtcatttttctgtttctaattaaccgtgtatttataataatattgcatatttataccgtcagtatagtattagtgttacgataatattttgtcacacgaattttgcataacataacgatgtttgttgtttcgtatttatgttttatatcaattcttaacttctgtggcaacgcacgagcacatacctagtttatgtatatttgtgtatcttgtattttacaatatcatacatatacaacacacagaaatggtagtaaaaatttaaatttttacgcgaccaaacaatcttttcagccaaaacacaccaaattcgatcaaaagcactaaaatccgtccgaaaacacaatttgtcatttttatgttttttttttcaattttgaatatcgaatagaattttcaaaatttacaaaaaaacaatcctcatagggtctgataacaaaaaacactaaaattcaacgaattttgtttgaaatttcgaaccctagattggtcactgtccgcggctagratggcgtcaactagattctccttttggcacctgcaaataaaatagtactatgtgctattacttgttactatctccgttatcgaatatttattgccctctagttaatttttaactgaaccgtgacaaaaaaaaacgaagagtgtttaagacaacaacacaatatctaaaatatagctttgattaatatttttaattaaaatacatagaaagtattaacacatttatattttataaaagtatttttaaaataaattggtgcatataaatattaggttttaaaacttaataataaaacagttatttatagttaaaattttataaatctaacttaaattgtgtctaaaacaataataaataataggacatccgagagtgcaagtttacaaacactgtcaatgagtccatagctcacctgccaactgaacgagaagcttctctgcctgctgggccgccatgtccagcgatccgccccaatagaacatgtgcaccgaggaacctacccgacacacgccatcttttacggtttagccctccgtctctttgcacacacactctcgcattcctcccgtcgtcctcgaaaccctaggccagaccacagctgaagccgagcggagttctgctcgccgcccatcgaatccagcttctccaagtccaaggtgtgttctcatcccccggatccgcctgacgccacatctccttcgcgccctccccgcctcaccgtggcccgatccgcgcaggcaccgccgcgacccccatcgtccgcacgacctggatctgacgcgcctccccctgccgccgccgccctccgcctcgtaccttctcgcggcgaccgccgtgctcggactcctcggcggccttctactctac

SEQ ID NO: 9186 - DNA, 1291 bp, Zea mays
tccccattgctatctctacgtggccatgcctcctaactagaggtagggtagaaaaagaaaacgatattttttataaaagatgtgttatttatttttgaaactaaatataaaaaacaaaataaacatttattatgtatatttgttttttcatataaaaatatgggtttttaagacaaaggacgagagagataagaggtcacaggagatcagacgtcgtagcgtgatcttgaccgtggttgcctcagctctgcggcaattgtggcgcacatgtttgtggtgcaccttaaaccgcttagagtagacagacaagatcaaacatataagttgtgtagccgttccattctctactaccataaatcatcagattctactgctgccatctgcttaggtgtgtttacggctttcggcaaaaactacagaaaattgtgcataagtacatgtttgaaccatactttttgactacatatttacacccactagacaacaaaaacacttattttgtattttatattctataggaaaaacaatcgcgttgtactagatctagcctaggaacctaaggctaagacacgactatgatgatccgggttagtatgggccgaattaaacaaggtctaactatattatatatagaagttgtagcaatgaacatgcattctctaactagtacttagaccctcctgaaaatttagagttggtggagcagataattaagtgccctagaaaattatgaagctaaattatgaacattcataagacatttagatgagtcattttatttattatttacattgaaaaaattctttataaaactatttaaatttatagtataaattatagctccaccttggagatggaacccggagctactctaaacacccctactatatataccctactatatatacgagacaatacttatttaacatagactttataattattaaatattttaaatacgctaaacccatataatactaagacccgccgtccatgggttgttagttaggttgtccaaatgctcaccagtcaccagcaagctgttcatgcctccaccgggtggccagagtagtccacccaaccaatccaaagctcatccgcccagtcaccatttcgagctgaagcttgcgaattgctactacatccatatgaccagagcttctagctgcaaaattttcccaaccaaatgaatggccctgtgaatatataactgcgcccagaaaaccgtcgcaacgaccgcgtctcttgcgttctagtaggaagctagaatagcaggtagcgcctggtggcc

SEQ ID NO: 9187 - DNA, 1328 bp, Zea mays
tgaagcttcggtattacaacatgtccgaagatgagggatcgaaccgacttagaaatagaatgaccttttagtccataagggtctgagtcaatgttgtaaacttttatgaggggcatgattgtaattcctcacaggctgtgtcctgtgcctataaatagtgaacaatattcctttactattcacgcattcctgtaattgctaacgcatcactcgggaattattatttgtcaaggcaaaggtataaatgtacctaaacgttgtattcaaatattttaaattcatataataagatatgtgaatgatgtcatttattttcaatgtatttatctttaatgtttcatgttttactttactttgtgttatctttataagttcaattacaaaggtgaaaccttcgtaatattatgcacgtgaccttcgtccgaagttcattaaatccytgtggagataatgcttcggcggacgaagggcattgatatttaacattttatgttgccttgttcttgattcatagcatttgagaacaagtccccaacagcaagcaatttttcattttcaatcctaaggctagcaagagaatcattcaacttttcaatcttagcaagcaaattagcattatcatctctaagattggaaagtgaagcatcacaaacatttgaatcaaccttagcaatttgtcggtgtttcgagaccggggggtccctgggccgacgagtgaatgtcgccgcgtgccccagcccagatgggtcggcgcgaggccgagcgcgaaggggggaagtgaggtcgccggaggcgggcatgagagaggtggaaatcccgcggccttcgtgttcgtcccgcgcccaggtcgggtgcgcttgcagtagggggttacaagcgtccacgcgggtgagggagcgagcggccttacgcgagcgcctgtctcgtcctcgtccccgcgcggccaaccctctgtaagagggccctggtccttccttttataggcgtaaggagaggatccaggtgtacaatggggggtgtagcagagtgctacgtgtctagcggaggagagctagcgccctaagtacacgccatcgtggcggccggagaggttttggcgcccggttcgtgtgatgtcgtggccatcgaaggagcgctggagcctggcggagggacagctgtcgaagctgtcgagtccttgctgacgtcctcttgcttccgtaagggggctgagagccgccgtcgtcacagagtgtgcggggcgccatcattgcctatctggcggagcgagccagatgggacgccggtcttgttccccgtggcctgagtcagcttggggtagggtgatg

SEQ ID NO: 9188 - DNA, 708 bp, Zea mays
ctaactttactatacattaaaaaattatacaagaaagagagagcctttaaaaatagattgctatgaccagaaatttctacatatatcctactaagataaatctaagtatcaatgttttttataacttttatgaagagatcaataatattataacagtaaagaaccatttaaatgttagtttttttactttatatcatatcgtcttaagtagacgacctattaagtcgtgtcgtgccgctcatcgtgaaatttaatacacactacgacacgacttttcaggtcgtactgacctaatctatgtttttatgctgaactatgctttaagttttaagtttctatttttgagccttttctgaacggctgtaaatgacccgttcgaaacttccatgtctactggtggctgagaaccgggacacatcgctcccatctcgcccgctcgctgctaggcgcaggcgcgcagcgactcttcgcgcggtcgcaccctgctcgagccacgtctgctcgctccaggacacgttgagccccactccccatgtccccacatgtcattttcacataaaccgatatacttaaccctttctcacacactccttcgcctcccatcccaccccgaagggcgtcgccgagctagccattgccgcctcccggctcgcgactcgcgagtcacaggcgcagccgagcgttccttggggacgaggctacatcgcg

SEQ ID NO: 9189 - DNA, 625 bp, Zea mays
tctgtgagccctccaaatcaacccccggcttcatctctgagagctgcaaccgccgctctgccaaagggagcaccctccggcgatggatggcggcaacaacccccgcagcggtgagcccctcatctcttaacttctacaaaagcggccccatcgcgaggtagctctacagagcgaaacaatccgcagagactcggaagtcggaaagaatccctcctgttcttcgtcaaccctccagaacctgctctctcttcctctacgagactacgaccgtgtaaggtccgtcgtcctcctcctcccgtgcttccatgcatgcatccatgatcaagcctatctagctgcatgccgcttcgtgcgctctcgctttcttttcgttgcaaagcagatcctgcatccgctttacatcaccttcctgcatgcttccttgtggcatcgtcctcatgtgtggggatcgatcggacaagacgaaaagccaaaatttgaacggccctcacaaataaagaaatccgctgacgcgtcgaagattcgagaatattcgggcacgctcttgttgtggatgatgtgggcgaaggttgtcgtcgacccgcgattaattgattaatttgcggttacgtcgttcttgcaggac

SEQ ID NO: 9190 - DNA, 418 bp, Zea mays
taatctactaattagtaattgtttactgtagcattagagaatcatacactaattagatttaacgtttaatatttattaatgtaattagctttttaatcaaattgtatttaatattcctaaatcaaacattgcaaccaaaaaaaaaaatgcctccagatccaaacggtccggtccggtccctcacactcatcaagggcggctcactctcatgtcatgtggcggcgtccttctccctcgctgctccgtctctctcagtctctctcctgccctgtccgtcccactccccgtccagcggagagagaccctgtgggctgtggccgggcagccgtttcccctccccttccctctccgctccctccagagtctactgtagcgcagtgccgtagggtttcgcgtcctatccttcctcgcatcctcc

SEQ ID NO: 9191 - DNA, 415 bp, Zea mays
ttatattcgtgctagtaggtaggtcgcagtaaaaaaaaacatctgaaaaatgcttgcgtgcttggtcttcagtagtagattcgaagagagagagagaggaaaggaattaagttcggtgggattgagggaggaggtattaggctattattagggcgtagtacagtgcatacacaaaaccctacggcgtccctctgatgcggcgctgagggctgaggctaagcacgtgggtggtggcctctataaaccccttcactccgggcactcgcatcccgcagcccggccccgtccgcccgcccgagtcacactcacacagagccgagccgagcccaggcaggcaggcaggcggcccaggcgcccagcccacccccctacccccgcggcgccgccggagccagagcgagagcgagagcgagcg

SEQ ID NO: 9192 - DNA, 714 bp, Zea mays
tctggagcttgacgggaagctattcgtcaacacgcagcaagcccctacctggcgcgccaactgtcggcgtttcgagaccggggggggtccctgggccgacgagtgaatgtcgccacgtgccccagcccagatgggtcgagcgcgagggcgagcgcgaaggggggagagcgaggcggccggagaccggcgtgagagaggtgggaattccgcggccttcgtgttcgtcccgcgcccaggtcgggtttgcttgcagtagggggttacaagcgtccacgcgggagagcgagcgaccccaagcgagcgcctgtctcgtcctcgtccccgcgcggccaaccttctctaagagggccctggtccttccttttataggcgtaaggagaggatccaggtgtacaatggggggtgtagcagagtgctacgtgtctagcaggggagagccagcgccctaagtacatgccgttgtggcagccggagagatcttggcacccagctggtgtgatgtcgtggccgtcagaggagcgatggagcctggcggagggaaagttgtcggagctgttgagtccttgctgacgtcctcttgcttctgtaagggggctaagagccgccgtcgtcacagagtatgcagggcgccatcatcgcctatctggcggagcgagctagatgggacgccggtcttgttccccgtggcccgagtcagctcggggtagggtgatg

SEQ ID NO: 9193 - DNA, 238 bp, Zea mays
gatagatagatagatgcccgtgccgccgtgcatgactgtggtggagtcgagtgtcggtgctgctgtttcttactttctttctcgtgtcccctccctcgcattgtggatataccactcaccaaccatttcgtttgtggcttactactactactccggagggttggtggttaacgttttggaagagcaacagcaatggagcagccagcagagcctctgcatggaaaagtagcgaaaggca

SEQ ID NO: 9194 - DNA, 940 bp, Zea mays
tggcgcagcggttggaacaagtgcaatgatgaaaacgaaattataatcaattaaccaataatacatatagtcacataagttgtatcataactccctccatccactacagcatgaaagtcattttcggcgactagaaaccgtcaaaaataagccttatgacatagaaaataagctattttcggtgacataagtgttattttcagcagttactggctgccaaaaaactcgaaaatgagtaattattttcggctacgagtcccagaccgccgaaaataarggtcgccgaaagcctagcgcagctattttcggcggcctcgatatgaccgccgaaaataratattttcaaaggaaaaaatagaaaaaaaaaattaacagaattttctacaacacaggatataataattcatccacacagatttcatcacagatataataattcatccataaaaccatcacaaatattacaatttcattcacagaagcatcaacggcaggagtatcttattgtcacttatcgaatacattaattattgtgtgaatcaactaaaaaagtaaaatggattttattttgggacgaagggagtatctaagtatcttattgtcacttatcgagaatgacggagaaacttggtgtcatgaacaataatgagaaatatagtgtggttggctaactataggttatcattgtttattatttattatttaatgaaaacgaagggtagatgctcgtgtagcacgcgcgctggcgctgcctatcttgtccgaggacgtggcgagcggcttaagtacgcaacagcaacagaaggaggcgttcagagtcacgtcgggagcggtgacataggttgggtgactggctgactgctgcgcgaaaagagagggagagagagctagcgtggactgaagggagggcgcagcaaggacgagccccgctcgcccgggg

SEQ ID NO: 9195 - DNA, 1500 bp, Zea mays
aaaagtgactaagtataaacatcaatcaattaacaaacatgaagtaatataaaatatttgaaaacacatggaatgacttcaaaaatagctgaaaactaaaggatattaacaagcaccgagtaaggttaagtgtctgaaaatacatgaaatgacttaaaattagttaaaaaaaactaattaaaggattgaataagataaaatagttgataacagataaaatgactaagcaatatgcaatgagttaagtaatatggaatgccttaaaatagatgaatattagatgaaattacttataagtgcctgagtataaacatcaatcagtttaaaaagcgcttcactggtccgacccattagatgatacagatccgggaaaaaaaatgtttcgttttgatgtctagttgattggattacaccaatataaataatggaccattggatccatcacatgaggcatgagggtgacaaatagcgcatttatttacataacaacttgtaattcggtaccgattgagtagcaaacaagccttaggccttgttcgtttccgtcggattacayccggaatcgttccagctaatcaaattatatataaattagagaagcaatccggtcaggaatcgttccgacccatcaatccggcagaaacgaacaaggccttagaaatattccaatcttatattcaagtgcaatatagtaattgctgtagccgctctcgtggatgcaatgcacccgcgaaaaggaaacagtgtgatttattttgtcagcagcggtggatggaaaattctaaagtagataaatttgtcatatgtccgtgtatttgttccgatttttatatatacgacatatgataaattttgttttaataaagcacaaaatatatgttttttattgtttaagtgggtgtgaatgtgaaaccaacaaccaatattcaaacactcacttatacataatttcaccttattttttatataaactttcttattatagtagtagagaagagattatagaagtgtgtgtcgattctaaagaaatgtagagtttttttttaaaaaaaatattaacgcgggacgaccattgtaactagtgatttaatatattagagatagagaagagataaatatattcgtatatcgcgcgctacacatcgtaaccgtgtggacccaacatttcctatgaatttaacgggyccacgagatacgggggaacagcagtgagaaaaaaccagcagtgtatatgacaaaaaggcaaagtttggcccacgaacggttactggccggacatgtcacatgtggttccgtgtaggttcacccgcctctccttcgcaagacggcaaagaggagtcgacaccgcccgccccatctactcggtgtcggtgtggtcgtgtgggcgcggcgctgcgtgtggggctgtgggcgctcctctgttcggcaggaatcctcgttgcctcctcactactccaatctccatcgccattgtcggcgcaagcaaaggggcggagcagc

SEQ ID NO: 9196 - DNA, 321 bp, Zea mays
gcgttgatcccgtgccaatcaaagaaaataagatctagagagcttatacaaattgaacatgtaagtgacagcggagcaggtacacgtggtgagtttatacaaattgaacatgtgactgtgaccactgacccgttcctgctgccttcgaggaaagtaggtcttcaactccacaggccacacgcatcatcctcgccggccttgcccccgactgctcgtataaaacggacggggaggcagcctctccaactgaccggggaagtcacactcacacgttcgcgtgttagactctcctgaaaccagcgtgctgtgccgcccgggacg

SEQ ID NO: 9197 - DNA, 375 bp, Zea mays
gggcgaatgttaacaagttggatgagtagacaacaggctgaactgtcacagctttttatgatggcatgttatattttagttcagtgcagctgggacgtggagagaaacggtcaattctgcagttcagcacgccggacaagaaagcacaccacattggcccttgtcaaattcaacgcagtttgctaacagcgtcaaaataagactgcatgtacgtcgtcttccactgcttctctttacaatctgcctgcctatatatctgctgtagttgcatctccgatcaaacaagcacttcatcactatcaaaagaaacctgctacagtttacaaagtatattctcttttttcttgccaccactcagagctccatctgtaaatc

SEQ ID NO: 9198 - DNA, 205 bp, Zea mays
ctgataggttacacaagtatgggcttccgtatccggacatcaagaggaagaaacaattcaacatctcctgacatcttgtgtctttgctaggcagttttggtacatcatcttgtctcctttgggattagggcatctcactccgggcgcggagggttcctcctttgcagattggtggagggaagtgtgctctaggagtcacaaagac

SEQ ID NO: 9199 - DNA, 929 bp, Zea mays
ggacgaagatgaggatgggatcgggggagttcgattaaagttatgtaatttaattttaattatcatgtaattttattttaattatattgcactttgtatgttttaattcagtaaaaaatattatgttgtgtgatttctgatgattgaaataaatatgtgtgaattacttaattctgtaatagaaaaactgatgtaagtatatgctgaggctgtagcctgttgtagtgtactggagcgataggagcgagagtagagtcgagagctggcgtggcagggccaacatagggatgggacactggaattggccttagccagtacactctatgtagtctgtcaaaagaactagcaaatggacaagtgttggctgtcgccatatatctcctgcaataaaaattcatatctgcaagaaacaactggcagtttctggtactgtgctagactagacaggtgatcatttagctgatgatgcccaggtgcatgaaggcatgcagccgatgcatgcatgctcagctcgtgtgtgcgaaagcgaaaaaaagagcacaccgaatagttcaaaagcaaagcgacgattagtttcagcatttcggcctttctgcgaaccctgctctatctcgagcttatcttacagccaactgcattcaattacatccctctctttacatttgcaaaaggaaagatgactccacggcgtcttcctcgtttcatttgttttttgagtggaacctcgtttcatttgttttcacgctagctcacgtgttccatcgccctagctcgcttgctgtttcttgctgagattgcagttttgggtttgttaattttgaatactttcctcatatccccgttcttcaatccttggtccatcgcgtcagtactcagtagacaccagacaccatttcttggcgagccgtagttgatgtcatctgtcttcc

SEQ ID NO: 9200 - DNA, 1500 bp, Zea mays
agcagcccgtggaaatggaaaggaatgctacagaaccaatcaacaagccaagccaactgaccccttccgtcccggtgaagtgccaaacgcgtgattccattcgggaggcaggttggtgtgcgttgagccgttgattcctgcgcactgcgctgcgcctcaaggccaacgcccggcgaggacaggatgaggggacagcgggcgacgagagggaggaaaatcccagtccaactctaggcgcttcccttctcccttttcctttcttcttccctgaggcgccggccccgctcaggtcgggacctgccgccatttcagaactcctagcttcttctagttcgtggttgctgcgcgccttgcgtaccctggtacggacctcgatgcgtttttctttctgccccctcctcctgccatctcggttgatggattgctgtaaggtgtggtggatctcggtggattgctgcgaggcgtggcggattcgttgccggctcgtgttccgatgacacgcagtagctagagtttctgttctgctacattcctggctttcttgttatctgtttattgctagttcaccgcttgaatttgatcggacgtctccaccattgagcatgtggagaatacgccaattcggagatcttgcctaccttttccgttcaacggatgttcgtctgtgtacctatcatattcatctgtcagatctattattcttctcccatcccatatgattaattgggacatcatcgaatgtgtcattttcgccgtttatgtacgttatcctgagagaattcaatgggcccttcccagcttatcgagtttctctagtataattgagttttttatcttctctttccttctacgttgttaacagtacatagaacatgtaactatataattagttgctgccggcacctgtacctgctcattttcatattccaattttatatgtccaactggagccagatggtaaatcatctgttgcctttcctgacatggcagggctctggcccacataacaatagaatattgaatatttaatacttaatctaaattatagttttttaacctactttttttcacattcaaatgataatgaatataaacatatatgaaaactacatttatatgttacttaataaatatataattagtctaaaacgaattatattttagaatggagggagtagaagattgtttctttcctggatagcaacaactgaacacgtcggtgttatttgcaaatccagagctgggcccaaatctgggcatggtctattcctcatcttaactcaatcagactccacatatttatgtaaatattctgaaagcgaaagcaagtattactctgcagtgtctcactttgcatactatcaccagtgttgtgtaaaatacctttgaattatgttgtgagattgaattggtggtgtgttattattttgtattgtttaatattttcttatgtgtcatacatcatagggttgagcatcattggagtggaagaaaggaatc

SEQ ID NO: 9201 - DNA, 808 bp, Zea mays
gggccgggcgggccgggcggcccgtttggacatctctagtgctggctaccctcccccaacttaggcctctagcgacgaagcaggcgggatatttggtgcgcgcgggcggtgtgaacaatcagcctgcagcgatcgagcaaaagccagcatcagcgagcaactcggcgacgtcggcgtcgccaggggagcccgggcagagaagcacctgccctctgcatctggaaccccgcgcgggctccgccggccgcggcccgtgccgcgacgactcggcacgcgctagccagctataggtagctgtttcccttcccgccactatcctgccgcccgggctcgcgtggcggatgatgattcctagagagccacggcggccggagcacccttcctcctcctgaccccgagctgccccgcccatcgcagcgggcggctctgccctccgccgcagcgtctgtgtccaggtgaggttgttgcccccacggatttggagccggttgttgagttctcggatttggtagatgcgtggctattcgctgctggattgggtaggctcagtcgtggatctgggagttcgatttagctgcatgccttaactgtgaagtaaatagctttgagaatctgccagacttgattgaagtaagaatacttgaggagcaggaattcgagcctcgtgtcgcttaaatgaaatcaaacttagtccatcttgttggtgcaaaaattcccctctttccatgtgtatcgctcaccgcaactgctattctccccatctctggtcgttgtcgtagactggaggatggagactccgcaagtcgag

SEQ ID NO: 9202 - DNA, 787 bp, Zea mays
gggccgggcgggccgggcggcccgtttggacatctctagtgctggctaccctcccccaacttaggcctctagcgacgaagcaggcgggatatttggtgcgcgcgggcggtgtgaacaatcagcctgcagcgatcgagcaaaagccagcatcagcgagcaactcggcgacgtcggcgtcgccaggggagcccgggcagagaagcacctgccctctgcatctggaaccccgcgcgggctccgccggccgcggcccgtgccgcgacgactcggcacgcgctagccagctataggtagctgtttcccttcccgccactatcctgccgcccgggctcgcgtggcggatgatgattcctagagagccacggcggccggagcacccttcctcctcctgaccccgagctgccccgcccatcgcagcgggcggctctgccctccgccgcagcgtctgtgtccaggtgaggttgttgcccccacggatttggagccggttgttgagttctcggatttggtagatgcgtggctattcgctgctggattgggtaggctcagtcgtggatctgggagttcgatttagctgcatgccttaactgtgaagtaaatagctttgagaatctgccagacttgattgaagtaagaatacttgaggagcaggaattcgagcctcgtgtcgcttaaatgaaatcaaacttagtccatcttgttggtgcaaaaattcccctctttccatgtgtatcgctcaccgcaactgctattctccccatctctggtcgttgtcgtagactggagg

SEQ ID NO: 9203 - DNA, 808 bp, Zea mays; identical to SEQ ID NO: 9201

SEQ ID NO: 9204 - DNA, 178 bp, Zea mays
tggtgcgccggctctcctcctctccggtagcctaactcgccttcttaccttctcttgttcttggtttggttgcttcttctcctctcgacctctccctccctcccctcgcctcctctgatcctctccctccctctctctctctctctaagctagctaccaagactagaatctactaggc

SEQ ID NO: 9205 - DNA, 507 bp, Zea mays
agtcacgccgcgcccgggaggagagggcgcggccaacacagccctgtaggagagagggagaggagggaagagctcaccagaggaggggagagggggaggggggcggcggctcggaacagtcatggctctggtaccatgtgagaatgtctgctgtacagaaaccctagctacagtgcggctacagtactagtgaaccctagcacaatgtacatgttagccaagagtatgaagtttaccataaaaatgtatttctgttcatgaagcacagtaagatttttttgggggtcaatattaacaatattttttcctacttatgtttgtttgttgctagctccttggggaacctgggaccggaggatcatctactccatcaatggttggatctgtgaaacggtggctgaagtctgaccctgagaaatccagagatacatggagtaaactggccattgccaattcaacgctggagaaccaactgaggatcttaaaaggactcttctgaaaatcacc

SEQ ID NO: 9206 - DNA, 1500 bp, Zea mays
gacccactcgtgtggtttcccttcagcacgcctgccccccgtgcttggtgccacggggctcatcgggggcgggttcctccaggacagacactacctggaggatcgacgacccctagttgctagtggctttccccggacgtgctcgctgatcgatgggtcccagggaccagggatcttgtctctgacaactatttacaacctttttgaagctctacggatgatctatctagtgcatcatattgatgcacactagacacgtaagtgcttcacctattctgaatctcaatagggaattcccttgttcgatgccccatatccggtgctactaccaactcgcttgttctgattactttttgagttagattttgtttcagatttcccatatgttcttatgtgtttacctagtactagtcatcataaagtcgacatcaccactcttaactaaacctacctaggtctagccacacattcatacccctgtctagtgtgtcaaaagaaaaaataaatgtcctatcactattctaagtgtccaacaactcaattaatacttaaaactagtcgatccttaactttatcatttatcctttgaaacccgataattatgaaaggaacatgacacataagagcgggtaaattaggcaatctaatttctctctaaactatatcctgtatttttcttatagtcaaaacctatgcatggaatactttatgttatgtgcaactacgatgttgactaagtgtcaatatctcttttgcaaagagatgtgtgatttagattccaaacatatttactagcctatagctaagctaggatggtaaagcaagacattattgattggtgtgattccacgagccatctccaccaactgctacattcaagcttgcctccatcactttagccgatagacccaatatcgcccatagacccagtattacctcttccatcacttacgacaacaaatgaccagtgagctatataagcgagtcattcgatacaggtcacaacacatctcccactttactagttctttatttgttgcttctaaacctagaagtaaatatcgatatacttgattttgacaaatccagtgggacctctttacctcacagaattcactgtaaaatagtaacagtaaactataatgtatatttttgtgctctttcgattaataagtcgcagcttattctgtcgtattagccaaccttctagcaaggagccgcgagaagccaaggcagagcacggtcgaactgggaactgggttaccggacacactgatgagaaaaagttttttcgacgaaaatacggaacattgtaaggctagatttctttcttctttcgcagcccatgcggcccaactcaacgcattgcgagaacaggcccgccgccacgccgcccaggtaggttttgtttgggatctcaccatttcttccttgtctctgtctcaacacggcgccgccgcttctgccgccgggagccgagcccaagcctaagcgaaagcc

SEQ ID NO: 9207 - DNA, 456 bp, Zea mays
ttaactattacaagggtatttaaatcactgtccacttctcttcggacagtcagtagatacgtattcctatctgtatctcaacggcccgatgcatgagttagcttagctgtcgtcctgctcgccgcttatgtaagcaaccgtagacccatccccaacatgctggctctctgtgtcccccattcacttcacactctagactctagttcgccccatgagtctggcaggtcaaagaagggaagagacaaccgaaggatcaacggatcaagcgaggtagtcgactccgcgtctaattaaacctgtggtctgcggacgggcggtcgtcggttagagcattgcttccgtgtggtgcggttgatagctcggatcttctgctggccgagttcgtcttggaggagaagagagagagagagagagagagagagcgccgggatcggagccaggaagcatccagcagcg

SEQ ID NO: 9208 - DNA, 1500 bp, Zea mays
gaacacaaggcaagaattgcctaccaaatggagctccaacggctcctaactgctttgaggctattaaagggatcctaggcgcatggagcaacacaccaagcctcgattgaacatcctaagacgcctagacttcgcaagcacgcatctgattcgttgtgtttgagatttgagcacttgtttgagctgtaaactcgctatgctgtgtttgtgtgctcgtttcttgacttgtgtgcatgttgttgctgcgactctagctcttgtgtgtttttcttttcccaccttactcttgtggtgtatttgtgatcaatcttgtaagggtgagaggctccaacttgtggagattcctcacaaagggaaacatctgttataaggaagaaaaatgtggtattaaagtggatcattgtatcacctgaaaggggttgagtgcaaccctcgtacattgggacgccacaacatggaagtaggcaagtgttctacttggccgaaccaggggataaaaatcgctctgtcacctgttgttattcttgtgcgattctctatacttctactcactcgataattgctcttagtttaatactcatcttgtgaagagcaattaagtgaagaagtcatctccctctctagacatagcaccttggttttgatttcactaacatttcataaactaagtttgtgttatttagtgttgatttttacaggatcacctattcaycccctctagttgctctcaaaagcgctgtaacatttttatttgtttttaataacaagctcagggaaggtgtttttggacctttggcatcctgaagccttcgtatttttctcggatcgagctcgttatgaaaaaacgacctagcaccacgaaggggctactgttgggggtcttcttctctgttgaaggtccacaagacggagatactgtctgtaaacgacaagatcgaatgctgaagctacaacgaacatgtgtggaaaagccaaaggtgaacatcttcggcttaaggtgacaacgaaggtcaagcataatgttgagtctaagaggaaaggactagttagtccctgttgttttgtattaggatcatatgtacatgttaaggccataaatgtatttttactcgggctgcgtcccgtgactataaataggtgaacagtacccccatattgttcacgctgaatggtaatcgctctcgcgccagcaccttcaaataagccgaaggtatagatgtaatgttaattttattaatgttcgtgcatacattctgaaatacatatgtgaatagatatcacaactcgtgtgtataaatccccattttcacgaatgatgaagacatgtctttcatgacattcgtctggagatcattatatctgaaaggagataatgcttcgaaggacgaaggtccttaatgtttaacaactatgttgtcttgttcttgattcatagtagttgagaacatgtgaccaacattggcgcccaccttcggtgaactcactttcacgaccacgata

SEQ ID NO: 9209 - DNA, 1187 bp, Zea mays
actgtaaagaaagcatggatattacagtcaataaatgcaactaattagagtaaggggcgtttggatccatttattttagaggaattgaaatccacttaaggccttgttcggtttgagggggattaaatcccttcctattcaattttgaatagggagggatttaggggctgtttggttctatatgtatggtgccaaaaaattaccacacaatcttataccacacttgcctaaggtgcctaaggttaggcgcttaaattctgcgtcgcagtttgccacgcctaagagaatcttgacacacttttaccagttattgacgagtggggcctacgtagcaggagaaaaatcttgccacaactgtggcttcaaaccgaacacatgcctaacttggttaaacttgcctaaccttagacgtggcaagttaggcagcaaaccaatcaagcctttagttttatgaatttaggtctacggtgtctaacaaccatgtaactctcttctcctttgtgccataaaaggaagtagagcaacatgtaaggagatcaaaggtaggtaagacagttaggaccttttagattcttttttagaatcttggtgtcttttgtagttttgtaccataagagaggtaacagagatagcgatagataaaaaaattgttttgctctcggggttctacagttctactaataaattctgtttagtagaccagtactagggctctttgaaaacaaaacaaaacaaaaacttttttttttgtgatcgacatgtcccgtgatccgtacgcaattattttacacataagtataggttacgagattgtcgcaaaagtatggttgtgtgcttgtgcaagtcttggacgtagctcgttatgcccaagtccacggtgcgttaatttattccgttcatgagcagagcagagaggcagggttaacttgcgctgcatgtccgtacctttcttcttccggccctggccatgtgacttgtgtgattgtgacagagaggcaggcaggtcaacgttcagcgcgcgtacataacgtagaggaccacagcccgcaggccgcaggggagggactgggaggcatcgtcgcaagcaaagcaaacctctcggggacagagaggctgtacgctgtgcaccttcttctgtgtctcgtctccgacgtactcctctgtctcgtcggagaagaagagagaag

SEQ ID NO: 9210 - DNA, 1187 bp, Zea mays
tctctcttcttctccgacgagacagaggagtacgtcggagacgagacacagaagaaggtgcacagcgtacagcctctctgtccccgagaggtttgctttgcttgcgacgatgcctcccagtccctcccctgcggcctgcgggctgtggtcctctacgttatgtacgcgcgctgaacgttgacctgcctgcctctctgtcacaatcacacaagtcacatggccagggccggaagaagaaaggtacggacatgcagcgcaagttaaccctgcctctctgctctgctcatgaacggaataaattaacgcaccgtggacttgggcataacgagctacgtccaagacttgcacaagcacacaaccatacttttgcgacaatctcgtaacctatacttatgtgtaaaataattgcgtacggatcacgggacatgtcgatcacaaaaaaaaaagtttttgttttgttttgttttcaaagagccctagtactggtctactaaacagaatttattagtagaactgtagaaccccgagagcaaaacaatttttttatctatcgctatctctgttacctctcttatggtacaaaactacaaaagacaccaagattctaaaaaagaatctaaaaggtcctaactgtcttacctacctttgatctccttacatgttgctctacttccttttatggcacaaaggagaagagagttacatggttgttagacaccgtagacctaaattcataaaactaaaggcttgattggtttgctgcctaacttgccacgtctaaggttaggcaagtttaaccaagttaggcatgtgttcggtttgaagccacagttgtggcaagatttttctcctgctacgtaggccccactcgtcaataactggtaaaagtgtgtcaagattctcttaggcgtggcaaactgcgacgcagaatttaagcgcctaaccttaggcaccttaggcaagtgtggtataagattgtgtggtaattttttggcaccatacatatagaaccaaacagcccctaaatccctccctattcaaaattgaataggaagggatttaatccccctcaaaccgaacaaggccttaagtggatttcaattcctctaaaataaatggatccaaacgccccttactctaattagttgcatttattgactgtaatatccatgctttctttacagtac

SEQ ID NO: 9211 - DNA, 1232 bp, Zea mays
tctctcttcttctccgacgagacagaggagtacgtcggagacgagacacagaagaaggtgcacagcgtacagcctctctgtccccgagaggtttgctttgcttgcgacgatgcctcccagtccctcccctgcggcctgcgggctgtggtcctctacgttatgtacgcgcgctgaacgttgacctgcctgcctctctgtcacaatcacacaagtcacatggccagggccggaagaagaaaggtacggacatgcagcgcaagttaaccctgcctctctgctctgctcatgaacggaataaattaacgcaccgtggacttgggcataacgagctacgtccaagacttgcacaagcacacaaccatacttttgcgacaatctcgtaacctatacttatgtgtaaaataattgcgtacggatcacgggacatgtcgatcacaaaaaaaaaagtttttgttttgttttgttttcaaagagccctagtactggtctactaaacagaatttattagtagaactgtagaaccccgagagcaaaacaatttttttatctatcgctatctctgttacctctcttatggtacaaaactacaaaagacaccaagattctaaaaaagaatctaaaaggtcctaactgtcttacctacctttgatctccttacatgttgctctacttccttttatggcacaaaggagaagagagttacatggttgttagacaccgtagacctaaattcataaaactaaaggcttgattggtttgctgcctaacttgccacgtctaaggttaggcaagtttaaccaagttaggcatgtgttcggtttgaagccacagttgtggcaagatttttctcctgctacgtaggccccactcgtcaataactggtaaaagtgtgtcaagattctcttaggcgtggcaaactgcgacgcagaatttaagcgcctaaccttaggcaccttaggcaagtgtggtataagattgtgtggtaattttttggcaccatacatatagaaccaaacagcccctaaatccctccctattcaaaattgaataggaagggatttaatccccctcaaaccgaacaaggccttaagtggatttcaattcctctaaaataaatggatccaaacgccccttactctaattagttgcatttattgactgtaatatccatgctttctttacagtacatggaggagacagagatttcagatttggtgcaaatcctattgaac

SEQ ID NO: 9212 - DNA, 933 bp, Zea mays
ccgcgcagactgttcggttcgtcgagcaaaaaccttatgctctgtgccaagttacggaccgtccagtcctaagccgtagaccgtccgtgctgcggtaaagaacaccgccgttgatggccgccgatactcatcgtgattgacgctacgccaacgcatacctagtggctgcttgtacgtacatgcacgcgcgcgtacgctgatccctggccctgagctaagcaacgtgtgcctatgcatactacgtgtgttcccaaaactagaagcaagcggggacgaaatgcttagcagcataagcaaatgaaagcagccgcagtttattactagcagagaggcagacgacgtcaaccagcggtgcaggtgcgctttgcaggctaccaccacgccaatcatttgccacaagcccacaagagtagactagttattataaaagccagagagagagagacgggaacggataggaataggagcgggggagtccgaggataggcaactcattgcttctgaatctctctcctcgtcgcgacgagatcctctgcatctctacttccccggggaagtagctgctagcgtgtgggtctgacctctcctcatcccgagttcttcattttcaggtaagtggtttggatcttaccgcagcatcatttttttctttccttccatgaatggttgtttggtttctcctcctcagagttagctgcagtcccagactctcgttctcgttcctggtcttcttcttcctccaccatttgtgcttgtgctgtttcagtggtctgcttgggaaccgaaccaccatgaaccttgcgtgggctctgcattcctttccttccgattcctgctgcctctgtgtctcctccaatccatgtgacgtgaagcagctatgatatatatatattttttccagagtcttgactcttcaggcccagaggctccgca

SEQ ID NO: 9213 - DNA, 675 bp, Zea mays
ggtaccatcttcaaacttgggctaacctatgtttggtgattgtagcaaacctttcaactagctgtggatccactcacgagaaatagaaacctttcaactagctgtggatattaaaggacaaactttcatctcaaaatgagtctgtaggttcaacttgtcaatttgtcagcacatctgttccatgtgccaatacaatcaactggactrctgtaagagytgttcctgtatgcagtagtgcccttatcttatgctttcagtatctcactaggattattcagatataatggtggatttagttaccagatcttttctgtgttaatttgttcagagatagctgtattcaygtgcagtttttgttgtctttgttccttaaatctgaatttagcaaagtactgttaaattgttcagagatagctgtattcatgtgcagtttctttcatcacataataaaagcgaaaagggcgtatttgtcatgaaaacaagatttgttgaactctgtagcttccattcaaatagcttagttctcttcctttttgtagaagcatttttttcctagcaaaaaagatccggcatgtttacctacccttcttatgttcttcctcttgtactcctaatatctgtggttaatatttcctctcacaccattgctgtattgccctgcagccatggactaca

SEQ ID NO: 9214 - DNA, 159 bp, Zea mays
ggtggtgtccctgaaacatagtctgtggttcgcactgaaggcttcaccatggatcattgatgctcatgaatcgctagccttaaaaatgaaaactgctgggtggtggcatgatgccccccgtctaacggtggggaacacgttttactggcagcatgtggg

SEQ ID NO: 9215 - DNA, 348 bp, Zea mays
agccgtctaaatttataaaagttatgtgttctcttgtattttattggacgaatggacggtgtaaaagcaaaacacgtgtagtgagcgagtgcggcggtggcaactgacgtgacacgagggaggcggtctgtgcctggcccagccagctgtcttgttcctccgtccgggaggacgaggaggaggaggcgcatccctccatcctctgcgacttggtgcgtctctcgagctcgagtcgattgatgattcatcttcctagtctcgtctccgcgccattctccaaatccatctatcatcaccatcccgatcccagccccagccccagccccagccccgccagacccagacccg

SEQ ID NO: 9216 - DNA, 192 bp, Zea mays
cagtccgcgagatcgccaagggcatcatctacacggaaccgatccagaccgggtggaagccgcccctccgcctccgccgcatgccgctcgccaaagccaacgtagttccggcgcaagtggcacatcatcgtcgacggtgacgatataccgccgcctgcgcgtgatttccgggatctccgcctcccggagccc

SEQ ID NO: 9217 - DNA, 561 bp, Zea mays
attggatggctgaaagagcataggacgagcggtaggagtaatctgagtataacgtcggagttggcgctactccggccacgggtctcacagtaacaaaggagatgcttgatccattttacaaatggaaggtttagcagttgaactcgtgattattgatgggttggaaaactcagggaagttatgtaacatctttttgtttctaaattctatagtgaacattccagaagagcttcagggtgtcattacatagaagcttgtttcttgaaatatgtaaatttggtaaataatctctggctctctgtcatcaatgtagtttgaagaaactaaccttatatggtggccacattgtatgaatttgtcactaaatgagcatttacttcgattctgaagtgttccttctagtatggcttcgcatccagtcactttatcaagaagtgatctgccatgattctatcttatgcatgctaaacacagcattgtgtaccatttttgcgtagtgttgctgcatgttggttcttgtgagctaatattacagcagatttggtgttcttccagaatgga

SEQ ID NO: 9218 - DNA, 890 bp, Zea mays
agtattgtactagttataattatctattgtcatagtaaaactggtatagatctttattaaatcttaaatatgtcactggttatgtctaaaacgacgtttacggttagcttctcgtttctcctcttcttacttccgtctcagtatttaacatgtttacagctctattattatattttctccaatcatctccgaaaacactggagcaagtagatgtcgctgtacacactcgaataaaaaaaaatgggacagctttgccggcaggcggtaccgttggcgtgatagtctgacgctgcaaagccgccgaggagagccctactcgcccaagtgtgccgcgtcacctctagcgctgctgggaacgccagccacacagtgcccgtggtccgcggcagcctactccggtccggtacttgtcacccaactcccgcagtcccacccacaccgatcgcggggccgatcgagtctggtccgcggcagcctactccggtccggtacttgtcacccaactcccgcagtcccacccacaccgatcgcggggccgatcgagtctgctgaagcctcgcctcgcctcgcagaagaagcagcgtgagtaaaaaacccgcagggtgcagacgaaaacctcgtccgtttccgtcgtcttcctcctccctccgtctcccttcacccggcctcggtgggtccgctccccagccacgcgccgctctcttatttaaccccggccccggcctccgctccgccactcgcgcacccatcacaccccctaaccactccacctccctcagcagccctcacggccactacccactgcggctgtaccacctgtacggctgcactgtccgtcgatcggctttgcaccacacgtccgcgcgctcgctccgtcggtgtcggtagcc

SEQ ID NO: 9219 - DNA, 1145 bp, Zea mays
tctcctccaacaaactccaaaaataccggagaagcgcaacctccagctctccgaaaaaagatcgccttcagaaagtcaggggccgagggcccgctgacccggagaactccactgtctactgccccgacaaaagaatggacacaggtggcaaggaagaaagaggccgggagaaagcaagctgctctttccgttcctccacccttaaaggagaacggaaaaagatcgtcacgaccgccgtaccattctaccccgacgtcctcttcatcgggagagtggagtcgccccccatctccgacgacgagccgaccgtgcccggagaagaaccacctcagcgggaatcccgccgacggagaaaccggcgtcgaaacattcggcaacaccacgaggccggagaacgggatccggagcaacctgtttcgcgggacgaggtctcggagataggagaaactccggaggaacgcgtcttcagagaacgaaggaactcctgacgacgtgatcgccgacgggctcaggaacaagccgagcaagatgcaaggcaacgccgggagaatccactcttcgggcgcaacctgaatcccgacttcgcccgagccatgaacacgtcgagcgaagtcggaggggtgctagctcggatagctgatggacttcctcggactcccgacactgagggctaccgacgcctgttcacccaggcagccaaccatcttctaccgcttgctcacccgccgaacgatttacgacacgccatcaacagtcgccgagatgcgcgaagctccatcaacgcttcgcgcgaacggcggcatgagaacgagattcgccgtcgggaggagtacgacagggatcatggcgtcccggctcagagccaggccacccgaactgagtcggcaacggcctcaaccggcgggaccatccggggacggtcgaggaaccgcaaccacaactcccctccccgggacagacatcgtccccgatgacaggaggacacgtgcggagtatccgctcttactccgcgccttagggccatccaatggcctcccaacttcaaggtatccaatgtctacaaatatgaacctaagcaggatccagggggttggctagccgtctacaccaccgctgctcgggctgccggggcatctgaagacgtc

SEQ ID NO: 9220 - DNA, 53 bp, Zea mays
atattagtgacaargtaaaactattcctttattgttaattattttctatatgc

SEQ ID NO: 9221 - DNA, 1500 bp, Zea mays
ggatcgggtccccattaccatctctaatcgtcggttgaacaatttgaatttgggagatttttataagtttttaaaaaatgatgccaatttgtctatgagtgtgtttggttctacttttgaaacatgcttctgctttagaaaaggagaatatgaaccaaaggggtcctgcttttctgtaggtactttgaaaaaagtagcttttgtagtacaaattttaaagtagtgtgggtcctacttttggtgcttatcraaaattgttatattaataaacagacataataaattgaaactaaaatagcattaaaataattaaatrttgtaataaataaaataataatatttttaataaaaattagtacaaatggaattaaaatttttatttatttgtaaaaattattacgaacgcagatgtgaaatcaattttttaactaaatatatcgatttagagatatagttaaacataatgcatatagacaatatacaatttgtttacaataaacaactcatagcagtttgaaccaaacaactttcagatttgtaatgttgtttgaaccaaacaacattacaaatgctggttagttagttggccatgccggtctttgacaggtagtataccctagctagccatcaaattgccaccttcagttgagtgctgctgcggtgctgttcgcttgtgatagcaagacgcaacgagagagcatatggcctttagcctttttgtcagctactaatttagcctttagccagttgtgctaacagttagttcattaattagctcaaaccagctagctaataatttatcagctagctaactgttagttgtagaggttctaaatagggtcttagcttgttagttgttagtgcaaatggtctagcgagcaccgctaacagaaataacgaccaggctagcagctagttcacctgacactgacaagctacagcgcgagagagtgtggaagcgacgctactgtttcggtaggtcctccctctccggagacagatcagaccgcgcgcgagcaaggacagccggtcgccactcgccactgctttgagaagaaaaagaagggccggtggttctatcttaacccgtgtgaagcgtgatcctcttcctcttcctgcctgcatccctataaagaagtcccacacaccatccaactccaaggccggccgtgactgcaactgcaatacatcatctagactagatctctctttttcttgggcgtatatattcctacataagtacgctctgatcttcttccagctcgctcgctcgctcgctcgatcgatcgatcgcgcgcgcctgtagataaatttatatatctatctatacacgtcatggggcctcagcaaggccggcggtcgaacggcggcgcggcggcgcggagcaagtagtagtagtagtaggtggggggcgcgaagaaggtggtgcggtaccgcgagtgccagcgcaaccacgcggcgtccctgggcgggcacgcggtggacgggtgccgcgagttc

SEQ ID NO: 9222 - DNA, 679 bp, Zea mays
ccgcgcgcccgcctacacccgtgacgcctcgccgagaaccacgcgcgatccgcccggtcgacgaggtacgccgctgctcatcctcgtcttccacttccacacagattgcttgtgtgcttccttacttgtacgggggctgcttgcgctgggcctgcgttctcgggtagttcatgtctgggcggctggacctggggactggactgcttctgttgtggattagcgagacttgtgtaggcgatcgatttgtcgctctcatatatatagtttttggctgggcggtaatgccgccattcctctggtggagatatcagatatgagtttgattactgcgttccaagctcttctcattgaggcgacctgttcgttctcaactgtgccatggtgtttctgcacttaatgcgaagagcttcgagcgggtgttcctctttttttttctgcacataatgtgttgtgtacttgtgtgtgttccttctggtgatttcgtcttgctctttggacatgcaacagaatcacgtttttacgtttctgtttgtatacgaatcgatccatcctattcctaaagacctaaaccagccaataaacgtgatgaccattttcaattcaggggcatctcgctatctcgtcctcctgggcgcttgggagaacggcaaccgccagccggccgagccaaggccaagcc

SEQ ID NO: 9223 - DNA, 594 bp, Zea mays
cttggttgttcatgtactgtgtagctgtatataatagaaacattgcaggatcagtgagtaattctgtggccgagtaaagtgcagtggtggaaggcatgtgttacctactggatataaatatgatgatgtgaatgttcagttgaaaaacttgggtgacatgaactgatgaactatagctgatgcctccactttagaaatttagctgttttagtttgtctaaaatcaaacctttctttgacaagtaacttgcataaactcgggcgaaatcgtttgggtagatcatagatgtttgtaaatttgtccgattattaacatgaacagtggtagccggtgtaatcatttcccaccacaaaaggtcagtgcgaaatgggctgtaaggctggatccgacgacacattggaccctttatgtcaagtcatgggcccgtcgtactgggaacccacggcccacgatggggcaattgcttcgtgtccattgcgtctctcttctcgacggagctcgagtcgggtctgagaggtggacggagtttcggattcggaggtgatctgacctgtgaggggctgaggaggaggaggaggaggaggaggaggaggg

SEQ ID NO: 9224 - DNA, 454 bp, Zea mays
agtaaggaggcacctccacgcccaaggtacaacccgtcgcattcaaagcgacggaagaaaagaaagaagagtctacatcaagtaggctccccatcgacgcctccaagctcgacaacgaggaaatgacgctcatcatcaagagcttccgccaaatcctcaagcaaaggaggggaaggattacaagccccactccaagaaagtgtgctacaagtgtggtaagcccgatcatttcattgctaaatgtccattatcaagtgatagtgacaggggcgacgacaagaagggaaggaggaaggaaaagaagaagtactacaagaagaagggcggcgatgcccatgtgtgtcgggaatgggactccgatgagagctccaccgactcctcctccgacgaggacgccgccaacatcgccgtcaccaaaggcctcctcttccccaacgtcggccacaagtgcctc

SEQ ID NO: 9225 - DNA, 1500 bp, Zea mays
tagacttttatgcgggaggggtttttgcctcccaagtttgtaaataatattactctatgcactcttataacctggtaatgtaataatcacactctctctatatattttgatgaatgtaaattaagttattgtaaatcgcttctgcttatttgttcctctgatgtgttgtaatatttgcgtgatgggtgaaacgctcttgggcgaggaaatgaggattcagataccgaacttgtcatgtgattatgtgcatttacagggttgtccgtccgttggacaaggacaactgtaggtgggcctaatgacttgggaggttccgtcagagctaagttttgctagtagactacaattggctaagttctttatctataacacacacaaatgtgaatatatacgataactattatggaggaagccaagtaaattgtggatgcggtggagatgacaatgcaaaagttaaaggcgacatccctaggttgtcatcttggtgcgttgctaraaatgagacacaagtctatttagaaaaaaaaacgaaatgacacgagtttctagttgttataaataagatagtagttcaacttactaaaaggaagacatgttgctaggcgaatatatttgcacaatactagttttgctgcttttgtgctcagcttgctggctttgatacttttgttgttgcctcatcgcttcttgtggcctagcaatctatatgacctgcatggatgtgctagaacaacctacatggatgtgccagaacaggacgtctgtgtcgataatgatacaaatgctcgacctcgatcacagactcagtataatcataaacaagatcaaaacttgaaaagcaaaatgaaccatcctcagtatccatggtcttatcctcgtgccctagcatataatgccttagtatcaattagttggctcctcctgtcatagttctagccatgatggtcaaccgttttctccccatgtccgcccggagaactaccgttttctaacaattttatatgtcaaattaaagtggttgattatcgagggattgatgcttacaattttatagggaactactgttttctatgacaattttatatgtacctcacataagatgacaattaattaaagaggggaagtttatattgctatttaaatttcaggtgatgtttattatcgtagcaaatagttaaatctccatagcaaccacttttaacgcaaacacgacatgtggttggctcgcatgagactggatttattaatccaaatgcatgctatatataaattagagcttaattagagtgaagcgccagagaattcggcgaccacaaattatataggactagctaaccacttattgaggaggcataactgtgcggctacaatcgtagttgctcccttgaaggaaatgcaattactccagtatatatatgaattggtacacaaaccaccatgcaaacaaccaaccctgaaattctgaacatcgatcgagtggcccagccaattccccgaggc

SEQ ID NO: 9226 - DNA, 354 bp, Zea mays
tcatgataacctgtttggttggatctcttttcaagagatcattttctttgctgctgttgtttggcaaatgtttctgttgctgttcagtcatatgatgtagacagtcaaccatatgatgttcttgctaataaattataaatgtaactgaaaacatggaaatttcatgtgctgatttctcggctgtgcagttgactagattaagtagaaaaaggaaagccataaatgattgtaactgggctgtatggcaaccgaaatactgtgcaataatccgtgtggatcatacatacttacatagcaaactccaagcactaacagtatattttgtttacttcagttcctatactagatgaccac

SEQ ID NO: 9227 - DNA, 1476 bp, Zea mays
gcccgagtccgagccctgggtcgggcggagcggagttcgccgtcttccgaaacttagcccgtgtccgagccctgggtcgggcggagcggagttcgtcgtcttccgggacttagcccgtgtccgagccctgggtcgggcggagcggagttcgccgtcttccgggacttagcccgagtccgagccctgggtcgggcggagcagagcttcctatggtgccttcggcagggcctgactgcctgtcagtctcactctgtcaaggggcaccgcagtcggagtggcgcaggcggcgctgtccttctgtcaggtcggtcagtagagtggcgaagtgacggcggtcacttcggctctgccggctgggggacgcacgtcaggataaaggtgtcaggccacctttgcattaagtgctcctgtgatttggtcggtcggtgcggcgatttggtcagggttgcttcttggcgaaggctgggccttgggcgagccggaaatatattcgccgctggaggggggcctcgggcgagacagaaatcctccggggtcggctgcccttgcccgaggctaggctcgggcgaggcgtgatcgagtcgctcgtatggactgatccctgacttaatcgcacccatcaggcctctgcagctttatgctgatgggggttaccagctgagaattaggcgtcttgagggtacccctaattatggtccccgacaattgtagatatagaagactgaatttagagaacgttactggagatgcagaatgtataaatgacggaacattttagagagtgctgtaaaagacaaagaatattttttttaaagggcgaaatttagagcacgtagctgcaacacaaacaagttttgttttcggccgtttctgtggaccgtggctagagatggcaacgggtacaaacccgccgggttttgctatcccaaacccatacccgtgaaaaatatttaaacccattaaaaaacccatacccatgacgggtttgaaattttgcccaaacccgtacccatcgggtttgcgggtacctacgggttacccgcgggtttttatctccaatatgcttattctttttataatcaataagtatcgtaatgattaatgatatcatgatccaaaatttatgtaataaacaatgagttcatgatttggtataaaaaaatattagtatagagaattaaatacaaataataagttgtataatcaagttaccttgcactaagttatacatccaccacatatataacgctagtaataactataatagcaagcatgcaacactatcaccaactacttatacattcactttttgataaaaattagggagtaaataggtagataacaagtttgttgttcgtttataaaataaaatgacaatatgcattaggtttgttcgggtttaaaaaactcacgggttcacgggtttgggtactataggaacaaacccatacccatgaacccgtcgggtatacattt

SEQ ID NO: 9228 - DNA, 283 bp, Zea mays
gaaggaaagttagccacctaatcaattgtttcctgtgttagttatttccttattagtcgtttccttgttagttatttccttgtgagttatttccttgtgagttgtttccttgttagttatttccttactagttgttttccttgttagttatttccttatagatgccccctctgtggctatataagcatgtacgagatatcatttggaataagcaataagtcggtcctaatctccctctcttctctacaaaccaacggctgaggggtataacctcgccggcgtg

SEQ ID NO: 9229 - DNA, 1500 bp, Zea mays
gtaatagtgagtactgtggttcctttatagggagtatattgtagaagggtccacacagaagagacggaaagcataactgtggcctgtgccacgacacgagtcccggcacattgacgcagcaccacgtgacaggacgtccccatccgtccgtccgttcatccagcagacggccgatccagcgtcgtttcgcgcggcccacggaacattagcgctgggccccacccaaagcctttccagctccatctgacctgagccgtctcctccgcagctcagctccagctccagggcagggtctacgggccatgtcggcggggcgcgcggcatactagtcccgcgccctcccgggcccggccactagtggaagcatctcgctgaaagcaagggggcgcgcgcccccgggctcgggacacgagggggcatcccatcgatgccttgctgggacggcctgccgctgccgtgtggacccacgcgagggggacagcgactgtgtagcaccgtgggcggggtgggccccagcggagtcaagcgggtgtaaattgcagcctctgctctggcggcccccgtgctttcatcattccgctccccacacccctgttcgtggcggcctccgcccctccctctcaggctctcaccaccgtctgctggtggttgccgcggcgccgctcctccctcgtggtggcggtggaggactacggtcggggatcgacggcttcttcgtccgttgggtaagtaatctgtgccatccgggctgtggattaccgtgttccgagccgcagctttggtccccactcggatccaaacatttcttcccccgttcattcagtttgttgtggcctgtggggtttcgcttgccacgtggtgccccacgaatccaacccgagccgtgattgcgtctgcggttagtttaggtttttcgtagcgctgttcttcagtgcgcgagatcgatctaagatgttggtaggcgcacccgcgcggtattaacctgttggtgcccaattaaggtggaggactagaaggctatcctcgtatggatcctcttgcctctcccgtcttctttcgctgccttcctattgaagaaactaattctgggaagaaaggcatgggtgggagaaaagctttagcagtttctgttgtctgaggcaaagtttaacgatttcgatcgttcaagttcacatcttggtcctctaggactaggaacagcttcgcagaaattcgcatagttatgtatgaataatcttttcactgcaaagagaagtattataggtacttatctggaaagtttttggcactcaattaagtcttcttggtttagattttatatagttctgatcatatggcttcttatcagcatacttgtcttgggtggtctagttggatcatgtaagttgtgtttcaaattttatatggctatctgtctagtggagctctgtgctcagatcttggaaacgttgccggttttgcagttggcaggcgaggcgatacatcaaccaaccaaaagaa

SEQ ID NO: 9230 - DNA, 808 bp, Zea mays
ttggtctctgacgccatagctcatagtgtttccaatcattacaagcgcagacaatagatcagactcgcaaccgtgggtttagggtttggcgagaggcttttgcgttgacccaaactcgtgttgcccccttaacccctcatttatgtgtggtgcttggtgaccggggccacaaccattagggttagtggtgcctctaatcaggacgtgagttagttagtggccccctattttttctctgtggaggacatcctaacagtaccacctttgacaaggcttcttgaggaatttcaactttggtttggaaaatgctagttcataaaaacgactccgcaagagaagctgaagaagaggggagatgcttttctttttgctaagcggtgaagttgagcgtgcttggttcaatttttttttgagaatctggctattggaaaaatctggttgtagagagaatttgagtattatgagaattatgggcggggaaagatgaagggctgcatagagtttaggatctagaaagtgacatattccttctattgcgattactcatcaattgtatgtttacgttcattttggataaatttcaccaatgtgatttttataaaaacaaattgaaaagttaaacgtttgacagtctataataactttggtggtcagaatctgaaattaagctaaaacaaagagggccaatgtggctcctcttgttttctaggtgaagcgattgcaaaagtatcggttcaccgtaaaaacaacctttacaacgcggaggccgacgtgacgtgacgtggcctctccacgccaaatcgtcgta

SEQ ID NO: 9231 - DNA, 1500 bp, Zea mays
agtgggaccctgcctcggctgaggaggagcatgaggagtgatgggacaggcttccccatctctctgtttacttatcgttagttttattccgctgcacttcgaacaatgatggttacattttgcaaaaactccgatgatgatgatggtgatgtaataatttaacattatggcatgtatggttttatgctttattgtatttgctctgtgactcaccttcgagtgagattgtggtacttgatcctgtcagtggccgtgtcggactagatccgagggattgacgggatattcccatttaagtgtggtctagcctctaaggcgggacgtcggacgcttaagatggaatagttcgggcaggcccgccacagatggtatcggagcttgtaccaccacagaggaatcgataaaatgtaaataccatcaatttttctaaataaaattggatagaaactaggttggatagatagtaggacgagcaggatagacctaggacagtgaagccttaggttaatagaagggtagctaggtggctaagtaactaggccctacaggccacttttacaggatgggagttcctccctattccttttatcttgttgtgaggtcgttcaggacgagcatgcatgcattcataattaagcaaatgaataactgagtaaaggacttaaaaacaagataacaaccaactaggtccttagtgcctttttacttaactagaaaagggctgagttttatttttccttgttctttttataattctttttcttttacttacgcttaaccgtacacagatgacttcccacggatcctccgatgacggaaatgcactgacccacactgacggacttgcacgagagggctttccccgcattttgtgggaggtacttcagggggctggatacacgacaccccctcagtacgcggtgcagcagttcgagaagcaccgagtgccctgctgtagggtgaggatgaccttggagcctcatcccctgcagccaggctggcgctctttggactccgagtcattcggataccgagcagaggacacgatcgaggcgatcgctctgcatggattgactactttctgcggatttcatcccttggagctggctacccaccccattggcttgttccccgctgagaaggaggacgacccaatgtggaaggatcgggtggagcatgctaaggatatctgggccatctacccaggacagactgcgcacttgacagtacggtgcatgaatgctctgtaccgtctgcaggtgatgcgcggtgaggccatgtcccatctgatggcactgctggaggccaccaagatcacgttggataaccgagaggagcttgtggtcgacttgtctcaagaaatggtagagaaagatttgcaagtggagcagctgtctggtgagattcatgagttggaggagctagtgggcacccgggagaacaccattgaggtcctagaggatcagctcctcaacactcagcagcagcttgctgaagcaa

SEQ ID NO: 9232 - DNA, 125 bp, Zea mays
atcacatttgtacgcaagatatagatagtactactatacagtggagtcttcttgcagtttgtctattttacacaactgacatagtcttcaggtatctcattgtctgttcttatttagttatatta

SEQ ID NO: 9233 - DNA, 295 bp, Zea mays
gggcaagtagagcgtgctaacggcatgatcctgcaagggctcaagtcgcggatctacaacgacctcaaacaagttcggcaagcgatggatgaaggagctcccctcggtggtctagagtctgaggacaacgccgagccgagccacgggcttcacaccgttctttctagtctatggggccgaggccatcttgcccacagacttagaatacggttccccgaggacgagggcctacgccgaccaaagcaatcgagctaatcgagaagactcactagaccagctggaggaggctcgggac

SEQ ID NO: 9234 - DNA, 152 bp, Zea mays
ggtgagttccactgctatgcctatctgctcaaaagaaactgaacataggcacatagcggtgtatggatgtttactgtgaagtatatatgcataatctttatctttcagtagaaacttacggtgcattttctatcaatgaaggcgcttcatat

SEQ ID NO: 9235 - DNA, 1500 bp, Zea mays
ccaaggtttggggtttggacacatacctgagcctgtccggtggaggagttgtccgagtcgtagtggttgaagcagtggtaagtttgccaaaaggctcttggcaatacgtagagtatctgatgtcagctctgcaacttctggtgacgtcgggtgtccttttattgatactatcaaggccgaatccatgctcgtcgcgaggtggaagtcttcccgaggyctgggcgaggctgctccggggcttgcagtcgtgcagggaacaatttgaaggagtggccttctgcgggatttacaggtggtagttggccgagaccgagctcgggcgaggcggagcttactgcgaggatgaggccggcttcggccgaggcggagtttcctctcgagggttagaccgtgctctgcggcatgcgcgtcccatccagagttatttgaactctgcagacgacatgggggagcagtagccgttattcccgggcatgcgtcatcgttgttggtgaaagtggacgggaccacggtcctgtcgctcctgtttgtatgcagtgtcacgtggggtaggtatccgtattgaatgctcatgtctttgcggttcccatgacctttgatcgaggccgggctcggggttgtcctcctgcatgagatgggctcggtcaaggcagaaatagttgttccgtgaagaggtgaccttgggcgggacgaggatttccccgagtgctgcccttgcctaagggcaggctcgggcgagacagagttttgagcgaccgtcgagcggggtctcgggcgagtcgtggctcatcctcacttgaccttggggaacgtgtctcacgatagtgtaggggttaaacgtgtttaaaggtgtaacagaagtataaattagcatgtttggaattatctttatttttataaatcagtttcttataaaatatatgtgtttttaaacagatccttggtcaattaaaaaacgagaaaaaaactagttgtctgtacatactcctacaacgaatcacgccacggcgcaaggaaggctctgcctcaaagccgtccattgaccttttcaaaaaaaaaagtcgttgattgactcgagtcttgcccgtcccagacgagtcaacttgtcctccttgcgcctctccctagggcccacctcgaaggcgtccattgactcgagtctggcccggcctggcccaacccagtcaatcggtcctgcccggcccccgcgcgacccttactcccaccgtcccacggccacgggcttgcggccagctcccctcgccgatcgtttccaccaaatccaccggtcttgcggccccatcttccgctccgacgatcccggggactttccagtaagtagcagcctcaagcaccaattcgtctctctgccgaagttaccaagggcaccccagttcgccgaggtggatcggtagcaaaaaccgatactggtacgttgccatggaggcagtttgatttggtggacctaacggccttccggatctcttgggagccagagcg

SEQ ID NO: 9236 - DNA, 548 bp, Zea mays
ctcttttatttggaaaacccatctagatcgaggtctatggttttacatggactaagattatctgcaatctcgaccgttcttattctttgcattgctagtatacagtatgcctgaagaacgctacacgggacagagcaccagtgtaaataatttaacaaaacgccatgggaggaagacgagacgagagagccgagagggaagctgcccacctacccaccacactcatccctagggcttagcaattactcctacagtactcgcccgcgtcttcatccctcgcgtttctctcctcctacctacccggtcaaatgtcttccagcgcatgcgccctccccctcccaccctctctctctcttataaacgcagcctcttttatctcctctcctctccaccacatctaatccttcctcccagctggtccctgcggccgctgctgctcgtccctacaagtatatcaaccaacagtgctcacatcatgcactctgtggtgtcttggtagtagttgttggggtagctagctagagagagcagcaggccagcacagcagc

SEQ ID NO: 9237 - DNA, 1500 bp, Zea mays
tcacgaacggtgcgaccgctcatcgcatacggtccgcgcttacacatagaggaccccaagatctaacgtggcgtgcgataggcctatggtttatttggtgatcagctccaaaagctagccaacggtcagccaccaaagaatagaagcgttggatcaggactagaaacattatttatttattatttatttgtttgacctatactgtcccatctagggtyacatctagcacgttgatgcctacaactgcagctcaagagtgacayccttccctatattggataatttttttatttcttgcaccagtagctacgaaaaggcctaaaatggaatgagtttgctagcggacctcacttactagggttcctactagctaaaagaatatgtctcatatttgccttcgtaaggctatctccagcagatcccctatctcatcccctatgtcaaacttctctcttcaaatagtgtcatctacaattccacgtcctctattttccacagtctactgaagacaggctaacactgttgtaatatggttgaaatcatgtataatatactgattcaaacttgttatctatgaaaaatgggtaaaagaaataagtatttattagagaacaatatacaactatataattattttaatccatttctatcatatgaatgaaacgtagttcaaaaaagagaaatcaaatagtttacttaagacttattaattattattattggatttccatcctcaacaaataattcaagatgaccgacattgaaatgagaaggatccgctcttttccaaaatataaagtaaaaaagtagaattagtttaataaatcaacytatttgtctataatataaacaacaaaatgyataaataaataagttatggcaatgaaaaaattgatcttttgaktagttataaaattctcctactttaactcgttgtaaacaattgaatggcattcgcttgggcaacgaaaccaggtacgagtctccttttcttttttactgaattaactaattcatttgatcttgacttttggatatttttatttgatttaatattattcaacaagaaaaaaatcaacaaaaatttttttttttgaaaattttgtgataatcatgagaaccaatactggatccaatattgctaatcaactccgcttcctataaaaggcactacagctagctaaagaattaaaaggtgaagaaattaaaggaaaatataaacaaaaaagctcatatacctattcaaaagaaaaataaagaagaaaaaagtatcggtcgccgacgagctcatgtacaccggcacacgagacagccaccccaaaacgcgggacgcggattgatgatatcggtcgccgacgagcggggccggagcactctctgcttctccccctacttcccctacgtaccaggaagctaccactcccccagagtgaaggaagagagagctctccgcctctctcctccgccttagagcgacgtcgctgccggagctcgatacct

SEQ ID NO: 9238 - DNA, 141 bp, Zea mays
agtgcagtgaaatagactgttttgctcagtcgacgagaatcaagcgcggcttcgagctgctgctgcttggtgtgtggccatctacggcctagctatgggctgtaattgcggcggtggaccagagcgcaatcgatgtaaacc

SEQ ID NO: 9239 - DNA, 407 bp, Zea mays
ctgcgtttatttgtttttttctccacgaacaacatgtcagcctcccaaatggccataggaaattctctcaagagaggtcttttcacacagggaaacgaactgacgtggaaatcacctggcgaggttaatttccatgggttaattagcaagtagctactaaactagcccttacatgttggtcaggtacttgagacgagatcttctgcggagcccacttctgatcggttagtttgtaacacgtaaccaagcgtgacgcgctctcactcactcactatggcgtggcgcgagcttgcataaatagtcaccgaatcgaccgcgcaattcttttcttcggatcgaatcgaacgccgacccgagtaaggcgatcgcgcggcggctgaccttccccgccgcccaccgtcgaagac

SEQ ID NO: 9240 - DNA, 951 bp, Zea mays
agcggaacatgtactaacattgaactgctaaaagtggataaatgaacttgatacccttttaagctgttaataacttcattaactcatgttactcttacaaagcaaagagccaaccccagataaagttttgcataatccttggagtcttttagtttcttatttcctggttttgtacgggtcaaactagctaagtacattacagtactcagggttctgttcccaattttgttgcagatggccagatgttctatgggtactgcgagcactgcttatacctggctacgggagatgactaagcctagggcagggcttctccattctcgtctcatgcttttggtgggttggcatagccaaaatgttggcatggtatttccaaaaccccgcaagtggtgtgggtgctagctaaataaatgtctttcgctaaacttatcacttcggtgaatgcttctaggagttatttggggcatgcgtgccatccatgttgtaataactctatgtactccgatttatgttaaactctgtggaatgttgtaacacttgatgcaacgaatgtcagttcattacgatcttcgttacgaaggaatagttcgagatccttcgcaattttattagatccctgggtttatataggcttaagtgtgatgaaatcactgctgggcatatggttttcatacttgatttttttttttataaatctgatggagtcgccgccaacgaaatgttgatttaggagtgtaattttgagtttagaaagggagctatttttttttgctttttagaagcatacaaaccctaatttaatcccaaaacaaacaatgaaatacactccttaaaaaaggaggcgggcaggcggccctttgccaattgccagtgtcgcggtgtcgccgcgtatctcccttcagcttctctcccgtatctccctgccaacggcggcggcaacgcgagggtaag

SEQ ID NO: 9241 - DNA, 133 bp, Zea mays
ctgatcacggagtgatcaacttcctgaatcctaatctgggtgcaaatctgagtttgacaatcctgctagataattatagtgttagtgaaataagcataagttatgcgacattaggcatcataaatttttatgt

SEQ ID NO: 9242 - DNA, 299 bp, Zea mays
cgtgcctggaccgtgttgtttcgtgtcgtgtctgggctgatccatcgtgttagtgccaaatggccatataagggcaggccctcgcgactgaccggaccacgacaccctcgcttcacctcctcactcgcgtcgcgcctccgcttccatgtcatttgacagcgcaacacggcgctgcagggtaaagctctcccccgctcgccggtctctgtgcccaggccagcaggacgaagaagaagccggctgggaagacccaggcctgaccgcctgagctaggggagaggaggacgacgacgacgacg

SEQ ID NO: 9243 - DNA, 1500 bp, Zea mays
aagggccaaagcttcgtgttgcttagacttcgaagaaccttcgtgtcaccttgtgttaaggagccgaaggtatgcttgtaaactcatttgacataaaggaagattgaataaaaatgctaaagcacatgagatgagtttcacacaacgctttacattgtcttttcatattgtttcattcacattttcttttgaagaccttcatccttcgcaccaacacttcgaagaagtgttaaaccaaaggacgaaggtcacaatatttaacttgtgttgccttgatcytcgataccttcaggggattgaaatcaagtaccaacatttaccgaggttcaactttgaagagcttacgtccccgttgtggtgtcccaaaggacgagagttgcacccaaccctyctcaagtgatataaagatcaaacttgagaccacaattttctcttatatcagtttccgtacagagatctccatagatcagagtatcttgctagccatacacaagttgatgggagcttgatatccaatgaatgcaagagggagaaagaaagcacacacaagagcacaatcacaacaccaaaatatcgaagaatacaggcacaaaactgaaccaaagctctctctcgcaaatactggcacttggatcactttaatgtgcatcactgatgcttggaatgaaagcctatgatcttgtgtgaattggtgtgttaagggggctcgttttggtgtatatttatagccccaaactctcaaatagccattggaaagagcatgcatagatctgttttctattagcgcactggactagtcctcgggccacgtcgcggtaactgttgcggtagtggagactaggtactgagcagttaattgtggtatggctgcatctcgggctatgcgcacttcatctgacccctgggccttttgttcgattcacccaacccctgtttgtttccatttcgtccgacctttgagagattcagtcttaccctagggttcggccttcggacgagacggagattttctcgtaagatcgactgtgactttttagaatgttcttatttcttatgacccgtgggtctaggatttttaacaccgacaccccacggttaattcatggcgttcaccgcgcttctgcacgaccgaccttctacgacggtttggcatattctatctcgagtcggataacgactatatgcaaacgtgtgatatcttttctatcttaaaattgactttataaataatattgtttatagaataaaataataaaatcaatattttaaataattatatgtattatctgcggatcacaattcctaatatacccgctcccatatgtcacgactcacgaccctcgcgccttcgcgagtctctctctttctctcgagtctcgacacaccacagcggaagcggctcgactcgctgagtgacaagacgcgacgcgacgccaagccaagaccaaattaccaaaccctaccccttcgccgcgaccgcgatcccccacatcgttggcg

SEQ ID NO: 9244 - DNA, 1500 bp, Zea mays
actgccccccagcggcaacgaccaagaaacatactgatgtcccgggccatgcaacgagttcgtcgtcgcgccccagggcatgggtcttgacatcggccaggccatcgtgtcaagcccgttggaacaggcagagaatgcacatgcacctgttcgaccagaccgggtccgggccgggccgcacatgcatgacgcaccgcatcaaaacgaaaccttgcatgttccaccgccccgccgcgcccgtcggtccacgaacagcacgacgccgccccgccacgtcgtcgcgtgcgttggatagtatggcgcgcgtcgtcccgtccgtggaaaaaagtacgtgtccgggtcggggaaatgccggccgtcggccgacctgtcgcggcggcctgcaggtgcaggtgaaggcttgtcgctgtgaggccgcgcgcgggcaggtcgccccgtgcaccaaccgctgccgcctcttcagtccggcaagggctggatcaggcgggggcgccaggcgagggaggccatgcgatgcgagcggatatgcgtcattgcgtcggcatcgacgggccgaccgcatgtcttatccggtttctgggccagggaccgtgcttatctggacgccaacttggcaccgcgccgctctcgctaacatattatccggtgcctggtgcccgatgagaaaaaacagagagatcagatcatgcataattgcaaatagagtctgacctcagttgggtactaactccgttctcaaatatttgtagtccgctagttcattttcgaactaaaccgtcacaaataaaaaagagcagagagaatattacttagagggtgtttgaatgaaatatagctaataattagctgctaaattttgatagatacatctaaaaatcctagctaatagatcagctattagttattttttagtaaattagttaatagttagctagctaattccactagcaattttttagccaactaaggtctagtttgaaacctctaaaattaatagttagctattaaaaattagttattggattctaaacactatcagctaattgttagctacttcacaccaaaaaattagttcattagctgacttaaccatataataatttattagctagctaactattagctctataaaatctaaacagggtctagctattagctacggtgcattcaaacactatcttaatatctgacatggcacgtcgatgacgcgtcagggttggaacgttccactgggacgcttgcacggttggacctgcatctgagttttttttagaaacttctcgggtatatatagccattgtgcctacgtgtacatgcacgggatgaacgcaactcactgccgtgtagtattacttttcgttattaccgtggcagccgtgtttgtgtgttctcccagtttcccgcgcctatagaagcagccagcaaacctcactcctcaagacctcaacaaagcaagcaatcgaacgggcacggctggtttccgacgagttctgtcgtgcc

SEQ ID NO: 9245 - DNA, 1500 bp, Zea mays
agcaaaggacacaatacctatatcaacttatgcataagaaactacccgccattgccaccattcacgagaaaaacattttattttcttttacttttccccgctacgtaacatatgactaaaatagataatcaaaattccaacaagccaatcaaaattccaataagccaggttaccagacaactatatccagattatttaatatagactatgtaaatcagcttatttaatcttacaagcaatataaattatttaatttataagttgaaacaaacaatcccttactcgaaggcacagctccaatgacacgttctaatggattatatcttaacgatatatttattctatttattttgatttatataatatttataatcacataataattggataacatattgggctacaaatctcaccggaccaagtttatgttagaataacgcgtcctataaaagatggacgaacacccacataattattagaacatcttcaatagtgcgacctataaaaatattatatagtttaaaaataagtatattctataggatttaaggcactaacaaaaaatctatttcaacagtaaagcctcgaatatatattatagaggcaacccactattgtgcatttcttccgttttttatttgtcgtgttttaatttaaaaataaaatagtgaacgacaaatatttgagaccgaagtaagtagtatattcgagggactcgaragaatacactgtattttgtgacttatttttataaaatgaggtattgttggaatagttttccagtgttgtacttcaatttaaagcaacaattttaaacattgttgtagatgcttttgtagcgctgcaagcctgcaacatctgagatacgaggagaacacggacgaaccagaagcataaaaaaaggtaagatactccttggtaccgtaataacaaaatagatcaactctatcaaattaaggtaccattttctcaaacgtttcracaaaatattgaactctaacagtaaatttgttttgggagtcaaatcgaagaaaaaccattccactagtaaagttgagtcgtgaaacaggctgtgaaatttaaatgtctgtatataacattgtaacgtagcatttttcaattgaatcgtagcagagggtttcttcagcaagttgcctgtttgtctcgcagaatggcaccacgccaccaccactcggcgtctcggcacttgctcgtttatcagtggggccaccacgcggcaggcctttgtccggacgggaacgggacgggcaatccacctttgcccttgtccgaacgggaacaggaacggggaccgtttctataaaagaaggcttctattagccgcgtacagatagataagcaactccagtccaagcaggagcaagaacaacaggaagagtcgaagagaggagatcagggacaagaacagccagaaagaggagaggaggctcatcaatcgcaactaattctcgcagtcgcagagacaagcaatcatcagac

SEQ ID NO: 9246 - DNA, 114 bp, Zea mays
aaccattgtgaactaactacatgttgcatatgccatttagcatgtcagttgtcttcgtcgtgaaaatatgacgacttccatgacatgatgtaaaatttcacttgttctttgcag

SEQ ID NO: 9247 - DNA, 1500 bp, Zea mays
aacccgaacacccagtcttagtattattagaggcaccagaccgatctgacatgccatcgaacctctgccacatcaacctagttgttggagttggagattaccgtttttctatcagacggtccagtgcaccatcggaccgggcgacacgctagcagttagctcctctttggcttcaaaaataacctctctgaaaagtggtgtgacgacccacgtgatcggtccagtgctctagccgtcggagaccagttccagacccctctacgcatctggtccggtggaccaccggatcggtatgatgtgcctctacatagaccaagtttggccaaacttgagcattttttcttcaaacgagtttggctaaacttgagggtgtttctatgacttagacaaacatatctagtgactttccaactagtataagccatgaaacatggttgtttaattttctccaactcatattccttttctagcttaaattggttcaaagtggacagttgaaacagagctatccaacctctttaatctatcgaatatgttcttagaggtatttagaatttatccatagtatagaactattgctagttcttttatcccaagatttatccctctaaggctggatttaaacggtttctgacttagaaactctgaagtcaatcttataaacctatgaatcaaatacttgtcagactagtcagtctatatcattgtaatggtcattaaacaacaaaattaatatagaaaatgatttaaagtcatttctcttctaagtagtcacgaggaaagaaagaaaacacaaaccgagaaagaagagagaaatacaataaattgatacgttgtgtaacgagtgatagtgtgggtattttatttctaacttcaacaatttaagtttgttggagcatccttgaggagctctactaaaatagtgaatctaaccatagatctactctaatccaaattttatagagctagacgattcgtgtaacttttcgtgaagtaaatctatttttaataaatatagtgctgattttttttaataaatatagtgttgatggagctatcctaaatagatcctaaatatttatgttttggattagaatttctcgaggccaaggtagtacctaaaccattcttctacttctttgtattaaacaatccaaattatttttaccaccgtttcagggtttttttcaatattattatactgttttcttttcggggaaaaatccaggtctgaactcagcacaagtttaaattaaaagttgacgctacgaccaagcaaatatgccatccagaaaggtctattctgcaaaaaagaacacaccgtaagctcccgtcccggacggggaagacctcgtgctgccgccagatctaaccaaaccccgcgccctcctcaccgtccggcgagctacggactcagcagatcaccgtcgctcgagttgtacctgaaggcgcgcccgtggaaccggccgcgagataagggcggcgggaaggcgggcgacg

SEQ ID NO: 9248 - DNA, 909 bp, Zea mays
aaaggatccccctgcacaaatgcgattgacgatggtacatcatgaggtcatgaggaagagcccaacaaattacttttcgtattaattccaccatagctagaacagtactgtaatcttgcggagggtcttcgagtacgagttcagtatccgtcaaactacatttttttttgtatccgtgtcctttaactcgaatatacctaagtcggcatcgtttccttagtccttacatccttttctcaaaatttcttcatgcacacagttgcatgatctctctctctctctctctctctctctctctctctctctctctctctctctctctctctctctctctctctctctctctctctctccattatatcgtctttctatttctcatctttatgggacgtacgttcttcttatttcttgtgctacaatttgttttctttatgttttgtttgttttctcttcattattattgtatgtgtcctttgctaattgagctttctgttgtgttagtttaagcatttgttaactttctgtgttagtttaagcatttgtttgtgcctatctctttgttgtttcttattacacatgattctgttttcgaacagatcgttttctttttacaagccaattattaaggcccgtctctcttgtttatttcttatggtttcgctttccaatttttaagccagtttatgctagcaaaagtgtctcggacaagatcaagcgcagaaaatacgcacctgctcctcactcttctttatattttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtag

SEQ ID NO: 9249 - DNA, 123 bp, Zea mays
cggagcttctcccgcgcccgcgtcgccatcgagggatcttaatctcacagccatccctcggtcatttcgtttgaactcggttctgaaattctgactgacgaacgcacgcaacgacctaccgtg

SEQ ID NO: 9250 - DNA, 340 bp, Zea mays
ttccattagtaagatttcagttcctcaaaatgaaagaaaacaaacgggaccttwaagtattccaccgattaaagcttaatcttcttcctgtttcttatttccttaggagaatgcaatctctaacctgaatacagacgcacccatcgtggatagagcctgccttgcacgagtttctttgtccccagtgccaatctataaaacaataagagaaactaagtgttaagtcatggtgtgtgtgctgtggaaaagaacaacccacagacacttaaggtaaatatattttgtttagaagtacatttgtaattgtatcagaaccaagcagctatgcagttctgtttga

SEQ ID NO: 9251 - DNA, 109 bp, Zea mays
tgcagcagatatagtgccctagaatttaggggcactagagccaaccctggatgtagccatgtagggccgtgcgagaggggcgcgaagaactcgggaagactggaagttg

SEQ ID NO: 9252 - DNA, 270 bp, Zea mays
caactacaattcatagaaataaaatattgtaggccacaccgaacgaccaagcttgtagcgccgagcaaaaacccaaaaacgaaattaagccttctaagtaaatttttaacgaaaaagggtaaaaatgaaaaaaaaactgtctgcctttttcgcagttggtgaaacatttacgcggcggcgatcagcgaagatcccttcaccttcgttcacggcatttcactgtctccgcaaaaccctccttccagcttcacgcctgccacagccttgtca

SEQ ID NO: 9253 - DNA, 866 bp, Zea mays
ggtttggctgcttgagtgaggagagatgtgatttggagaagaagaccatagcccgctcggtcaggtggtcagtgtcgaaaacctcaccgcagctgcgatcggaccgtctgtgcgatcgttgtgcgtgtgacggaatgaagatgctgctacgctacaacaaacatgtgttttggttgtgaatcgtggtgtcgggtagtagggtagcaacctagcaggagttgttgtcggcgtattgatatgtacttatctacaattcaagatggacaactaatgcatgactgttaatctgtgagcttccataaaaaactaattatattccgtggcctgataactgattttattgttcagtcataactttttgaagagacacattctgatataaaaatttgacatctttatattcccttgggactgaatggtctcttgattatgattataactgtagaaagaaggacactatatttttgttccaatttgattccttaatttgcatcaattttatatgttatatgataggtagcagagctatacaagtgcatgattaaatttttatatttctagataatgggttcttgggaggagcatgttaggcatttttttgttggaggaggaagaagatgatgatgaactgttctttgttattctccctgctataaacccatacctctcgggaagagaaaaagcgcatccacacatcctccctcaccggtgctaaaaaggttaaagaaattcttgaagggcatgagagctagtgcaaatctgagttcagaatggagaaagaaatattcaaagccacatcaaattttcttagaagagagaatttactacgtgacacgtgaggagttagcgttgaggagcagcttggg

SEQ ID NO: 9254 - DNA, 1178 bp, Zea mays
tgtgtgaatgatgtcttacaccgtattcgataaaaaaaattcgttactaatgatatccgtgtttgattagttccgtatttgatactcgactatctatatttgcgtccgaaacaatccgtacttatatttgtattcgaaactattcgtatccatattagatttaattacaacccacctcagccttaattaatcccactggccggccactgcttaaatccctctgtctctccttcctctcacattccactagaacactcccaccaggccaccacctccacctcgtcgtctcccaccaccgccgcgcgcgagccctagcccgatctagccggcggcaggcactagatcccgccgcttgcggcatcccgggacgcgcctcgccgaattcgccgctcctcgcactgcaacacgcccggaccactgtaagtttgccgcgctggttgagctcgaccaggccctcctgctaccttcctcgcattgggctgggggtgctccggggacggtttcgtcctgcaataggcttcatgcttgctccttcgtgtcctggtcgggggggggggtgttttggtttgtgcgtttgatttggttcgtttgggggtggtcgtgcctgggtttggattcggaacgcggagcgtgttcatgctgggggtgtgggatgtgtctaggagttgagttttcggtgccaactgtttggactcgtccgccgcctttggtagccatggtttgatttgggggcggtcaaggggggatcgccaactgtttttgttgttctgaacgatggacacttaaacagtttgtaactatttgttttggctgtccgaatcgtgctaaaccgtactgtatgtagtcacaaggccaaacaactagtaacatcatcctgactgacgtaagacaagtagcagattttgtaggtcgtagtagaggggtgatgtgcaatgtgctacaggcttgtagtattgcatcctgcgcaatttgcttgctgtttctaatgtggtgtgacttggagctttctcagtccgtggcttaacgctgtgggtaccttgcattgcagaaaaaagaggcaactctggggcataacgtacttcaccttgattacaggttactgcatgccatgtagtattttattattggtggaggttgtcaccacaagacatatgttgtgatttctcgatggcgaggag

SEQ ID NO: 9255 - DNA, 636 bp, Zea mays
ggttggggctataaataccccaaccatcccacattcattgccatccaagttttccacttctcaactactacaagagctctagcattcaaatctagacacaccaaatagatcaaatcctctccaattccactcaagcccttagtgactagcgagagtgatttgcttgtgttctttcgagctcttgcgcttggatcgcattcttttctttctcatttattcttgtgatcatactcaattgtaaccgaggcaagaggcaccaattgtgtggtggcccttgcggggaagttttgttcccggttgattgagaagaaggaaagctcactcggtccgagggaccgtttgagagagggaagggttgaaagagacccggcctttgtggcctcctcaacggggagtaggtttgcgagaaccgaacctcggtaaaacaaatccgcgtgtcactctccttatttgcttgcgatttgttttgcgccctctctcgcggactcgtttatatttctaacgctaacccggcttgtagttgtgattatttttgtaaatttcagtttcgccctattcacccccccccccccctctaggcgactatcaattggtatcagagcccggtgcttcattagagcctaaccgctcgaagtg

SEQ ID NO: 9256 - DNA, 791 bp, Zea mays
ctgcagaggtctttgctctcgcgccgcgcgcggcgttgcgtttcgtgctgggggaaggaagggtagatagatggagatacacatgcgtacgacacgacagtacatgcgccaccagcccttccttttgtaggcgccctgccctgcactgccctctctctccatcggccgccagccagccatggcgtcctctcctctcccgtccctccccacaggcacaggcccaccgcccacacacactcggcgccgctgccctctttgcttgcttctttctttctccctcttccctttggaccctttccagttgtccacgctcccatctttttcaccaccccctctccttctctctctcccccccaccctcgcccttctcccaccgcgcgcatgccctccggccgggcgcccgtcccgtccttccctacttgtaccagcccctcttttccaatttcatcctctccctccaattccaccatccctctctctctctctcgctcgccacccgcaccactctcgctcggtgtgtgggagagagaggaggggagggagctaggctggcatggccggccgcttgagctgcgcatgcctacaattcaataccagtactagcaaagcaagctaggtaggagtaacacctccccaattgctacttctactgagttagccatcccgtcgtcccggcagtcacttatacaagtacgcacgcagttacccagcagggcggctatactaatccctccctgcctctgccttccttccgaggaccgccgcggcgggccggggtgcgcgcacccgcc

SEQ ID NO: 9257 - DNA, 582 bp, Zea mays
ttcacattgttcaaacctagcgcaggaactgtttccagagcacattttttttgtatgtaaaccccgactcccacagtagtggacttagtcgatcataattatattgtagaatctgtggctggacaacttctaccagaattctttagaggtaattctgaactgtcattccatcaagtaccaaagaaaaggtccaagatataacattacataatttgctgatactttgcagaatcgggacaatctggagacaaatttcaaactataacagataatgaataactgtagaatatattaggctacaagtcatgatcagtaaaaaaacaagtataaacagaacaatagaaacttttttttctacacttatgtatgatctatgaactaacaaggtaacaacaatgtcgcacatattctactgatgacacttgatacagagcaaacgcatccaacgtttgacggacgctacacattctgcaatatactttgattacctccacagagtcagcagccagggaccggaatttgtcccgcacataccgcgagaggcagttcccaaggccgaaaggcgtggacagcacccacgac

SEQ ID NO: 9258 - DNA, 353 bp, Zea mays
gggtgtggatttgtacttttatgtctacatagatgtccctttgtaacttctttttacatcagatgtattttttttcttcagcctcttcaccatcagatatactatgactaagacctatttctttatcttttcttgggcatctgatagcacctgtgtataaagggaagtttctcatggctgctagaagatttaggcgtggtccccatattgagtacattatatctgttgatgcagaggacttatcacaagggagcaattcatacatgggaaaactgaggtgaggttcaataggattccagagttctcatgaatcttcttgtattagctctacttatgaattggttctgaaagtg

SEQ ID NO: 9259 - DNA, 1500 bp, Zea mays
gttcataattatcaagctagtgtttactgtagcataacgggacaaggcgcgacctaattgcatgccgtgtggcgcgcgctctcgtcatgcgtttggtcataatagcatgcagttcctgctctcgcgctggtgatgagacaccgctgcccatttcgttccatccgtcattttatatcgagtgtactaattaataggttggttgtgacttcttgctccgtccgattctttcaattttttttacttaccctccgtttctaaataacgccgccccggccttccgaaaaagtcatcaacgtgttcaagtttaaccaaatatatacaagaaactagttaccaactttggtccagtggcggattattctacagcagggagggaggctgtagggcttcagccgcgcatatatatctatccatgaaacttcattggagaaattaattatcattaacatatgtttataattatatatatctatgaaacttcattcgagactgatcccgtcgtcgagacgtataggcgggggcgcggggcccgatgacgtgcatgcatcagtggtccgaccgacgcccgatgctgtgtgcagcatgtgctgcatgcgcctatagccctatacatacgctgtttgcatgacatgcaaaatggaccgtccagtgcagatgctacttcggcggtatgccagaatacacattttttctacacgagtgtgacgcgaccatcctagctagggcattaggtggacgccgacactaagtgcatgtacagtggtgtttaatatggaggctcttaaggtgtttaaagaggctatttgcaaaaaaatcttagagctgtctctccgtgaagacacgcatctggctcgtaaaccaagtagcaacagacgacttactttccactgtacggatttgtcatctgttctatcgatctgctgttgtacaaatgcatttaattctgtatttattaatagactatatttatagacactgcattgtataatagaatctcttagttgtctcttatgcttggagaaccgttttagggtctctccactgtacatgccctaacaattaaactacaacaaaattattacatgcatgttacttgaaataatagtttttattatattttatatgtcaaaacttatagcataacaactcggcgttgagatccatgatgcatgccgcataccgccgagatcactgtatatgtcagcgatagatcagcacacacctcggcatcaaatcacatattacgatatagaactgctgatttagaaaaaaagactaaaaatctctaagataagtgtagttgtcggagatttgtctaatctcactaaaaaacagtgtgcatatggctgcacatgcatgtcgtcagccatctattctattataaatacacagcacatccaaaccgggcatgcagccatagccactctcctctcctggagctatagctagagagcaagagagaggggggtagatctatatctgtaccgggcgggcggcgcg

SEQ ID NO: 9260 - DNA, 486 bp, Zea mays
tttataataataaataaggttattagatatgttattaattatatttttatagtatatatatttgatgtcgtaatttttttaacaattattttataatttcaatctagtctaagatgatttggttttcaaagaatagtgagaacggggggagaattatccaaccatgtgggaacaggagtaaacgtgaaagccacacgtcagtatgcgttaggttgtttcctagcgcttgactaattaacttccgtggtcctcaaccacagatgttacgtcggtaccttaaaaaaatctcgagaatatgtggtgaatatttaatatggaaaggaaaggggcggctttcttgttaaaaaaaaaatctcgagaatatattcactagctagagggactagtagtaggtagtagtagaggagaacagccactcagccagccccctttacttgcacacaatagacaacctcgaacagaaaagaagcagttttgccgtccgag

SEQ ID NO: 9261 - DNA, 1056 bp, Zea mays
tcttcgggaatactaaaaaactgttttcaatgccgaagcttcaaaacttaaaagctcagcaaatcttggtgcgcaagagctaaaaattgagtgagcgggagcagatggcaagaaagtgtgccaaatgaatttgcggtatgatcttatttatacgcccagtgcgttgaaaattgaaagaccccgcttgtcagtgaatgttgctattctagcaaagggaaggtgttttttcggaccttcggcgtaaggccttcgtccatgtcgcaatctaaatttattattttaaaaaacaaattaatattgcgaggggctactgttgggggccttcggcttacgaaggtcctcaaaaacaggatttaacaatatttctggagtataatgcgtgagcaggtatcttcggactcaagtcggtatcacagcaggagaagaccagaataatacgaaggttcatacagcgccgaagatgtgaacaggaaagcttcggcatggtagcagaaaatgaaaccgacttaaagatgaaaaggctattcagacctcgatagattactatagaattattatcaaatgtaaagggcatgaatgtaattttgtatgggctgtgtcccgtgcctataaataggtgaacagtacccccgtactgttcacgctgatttgacattcgcttttgcgtcacgcttgtactttcatctccttcaagctgaaggtacatttgtaattcgatgttatttctgtttctacataataataatgcaaaaataagttaataataatatacaattgtctatgttatccttcatattccttatgattcatccttcgtcactgtatagtgtatttatgaaggtacgcccttcataaccttcgtccgaaaatcattatatcctaagggaaataatgcttcgaaggacgaaggactttaccgattaacattttctatgttgccttgttcttaactcatagcatttgagaacaagtccccaacattggcgcccacctccggtgaactcacttccactctttgagttttctgaacaccttcggcgatcataaaccttcgct

SEQ ID NO: 9262 - DNA, 420 bp, Zea mays
gtcgcagtaaccaactaaaaccattcaatcagaaatatatacttgtacgttatgtcggctagtaggtgagttwacgtgagtttggaggcaaccaccgttgaaaactgatgttttataccatagctgaaaaaaaatactacgatacgaagcgagccagctcgtcagagcaatacagcaagccactaccttttaataaagctcacaaccatccgacctactaagctctaaactcagctactcaggtcaggtctgagataaaccagtcactctactactcgatggaaccagcaacatgggctgtgttcctcggcattgccctctgcgcagcggcagcgctcttcctttcgcgcggccggcgcccggtctacaaccccccgccgggccccaagccatggccgatgcatcggcaaccttaacctc

SEQ ID NO: 9263 - DNA, 1500 bp, Zea mays
ctgttgaacccttcggggggccagccttcgaaccccagatcagtagtgggcgcggagcccgagtggtctgaggcggctgttgaacccttccgaggggccagccttcgaacctctgatcagtaatgagcctgaagcccgagtgctctgggcgcggctgtcgaacccttccgagaggccagccttcgaaccactgatcagtaggagggctcggggcccgcttgaaagggaaatgtgcccttgggccatttctaagtattttggtgattgagtgccaacgcaagtgcttttgtgttggtctatgcaaagtggtggacaaagtgcaaatcaagtcaaaaggtatgtttctcagacttagtacattgttttgaagactaatgtattatgtctaagtgctggaaacaggagaaaacaaattggagagagatagctttgtttcagccaaagccagcgctgtctgggtgcaccggactgtccggtggtgcaccggacagtgtccggtgcgccaggctggctcaggcgaacttgctgctctcgggaagtgattaacggcgtacggctataattcaccggactgtccggtgagccaacagtcggccgggccaacggtcggccacgcgatccgcgcgagacacgtggaagagccaacggtcgggagggggcaccggactgtccggtgtgcaccggacagtgtccggtgcgccaacggctcccaagtgccaacggtcggcttcgccagataaggaaggagatccgcaccggacagtgttcggtggtgcactggactgtccggtgcgccaggcgacagaaggcaagaattgccttcctggaatgcactcaacggctcctagctaccttggggctataaaagggacccctaggcgcatggaggacaacaccaagcattcctaagcaccaagacttcgactccgcgcatttgattatttgtgatagcaattagagctctatttgagttgtgaactcgtcgagttgtgttgtgagctcttgttgcgacttgtgtgcgtgttgtcgctctgatttcgtgtcttgtgtgcgttgctcatccttccttactccgtgcttctttgtgaacatcaagtgtaagggcgagagactccaagttgtggagattcctcgcaagtgggatatagtaaagtgaaagcaaaacaccgtggtattcaaatgggtctttggaccgcttgaaaggggttgattgcaaccctcgtccgttgggacgccacaacgtggactaggctaagtgttgaacttgagccgaaccacgggataaaccactgtgccatctctatgattgatatctgtgtgattattgtgtttcgctaagactcctctctagccacttggcattcttgtgctaactgctaatcaagttttgtggcattaagtttcaagtttattcaggatcacctattcaccccccctctaggtgctctcaattggtatcagagccgttctcttcaagaaagggactaatcgcccgaagag

SEQ ID NO: 9264 - DNA, 1500 bp, Zea mays
tgacaaacatccatgtctaatttgcttagtatttctgatgcagatggttttgagcatgctgagctgttgtggatccgtggagatatagcatgcatgatctccatagatcatacaaatacagggaggcacagttgtatgtgratctgggattgcagggtagtaacttaaataaacatccatgtgattctggccaagattttgctggagtttttaaacatgcgcgatgtataggggcatctgcagtcacaagttgtagctcacttttagtaccccaagcttacagctttaagcacactccacatgatttgcagcctaatggtgagctgctcctgagttgtagtgcctcaagttgctagtgttgtttaaacctgaggcagacacactatgcttggtgttaatttggtccaaaaaggaaaaggtttgcctgatgctagagtgattaaccactttgatctgtctctacctagtagccttttccatggacactggattggtcctagactgttcagctttcagatggataattattcgatagcacatctaaattctaaacgtagtgataacatggttgagtgctacacagtgcaagagcaccaaaataaataaaacacacacaaaaaagtagtagtgtgaagtggaacagggagtgcatttataaaaaaaataacatgcatgagaatgaagagtgaggagtttggaagaatgagggcatgtatcagccaccatgatgctctgtctacaaagagggtagcagaacacaatcatcccacatcacatgcctcctcccctccaaaaggtaatgtcaatcaatccattggctactcacctgttgcacacagcattattcatctaattatcatatcccagactacatcaacagctaagcaacataaaacaaaacctgtcaatagagagattggctagtgtgctatgcatagcacggctgtatgtgctacatcataaaccgtaggcaaaagttgcgtaaatgtgtgtacgaaccagcgtaactacagtacaggattagcaaagctgttacacatgattatggccatttgagtacttcatcatgcatgctttcaaagtttgactggctacatttaaccatgtgtttatgtatgtacgtgtatggtataacagacactactgttgggaaraactactttcaccagatggaggcaaaacaaagcaccagtttcagaaaacaattcagcttaatccctacagcaggaaattagttggggggtcaacatgtgcagtttgaaaagatgctaacagtacatgttcgtaccgtttctgtacctacaaacagagatgcattcatgcatgcagaacgagctactagtatatatacacatgcatctgacgaaacaaaaagcgtcaagctatttcctgcttggcctatatatatagctagctccatcgctctcctttgcataaagatcaccacctccattcgcacgcacaaagctctctagctcgcagataagccagagagaaagg

SEQ ID NO: 9265 - DNA, 1500 bp, Zea mays
aaccaggtggtggcaactgaggcgaggacagtcattatcgtgcggaggtatagatagataaatgagccgtttctggcgggctggtccgggacatggaccatttaatagtgtctcggtcagcccgatacgagcgtcgtaccgtgcttggaccgtagcctcagcccgtagtgccgtagtgctggcccaacccgacatgattatattttttattttataaaaaatcgtatatacatatgtataatttatatttaatattaaaaacatttgaccattatgttttactggttagacggcttcattcagtgtctcccgtctctcttccatcagggcttgggttcgaaccccatcctgcaccacttttttaacattttacgctgatttaaccaaatggtccgacgggctaacgggccggcccgacacagtcagcaagtcggcatgtcgtgcctggaccagagctgtggtccgcaggcgtggggctggcctgacgggctaacaggtcgttccggcacaatcgccatgcctgagcaagagccgtggcccgcgggtgttgggcctatgccgagccgtcatttggtcatctatatgtgttttgggacgtggatgttggttgcgcagagcggacgaacgtgcagcgggttaatttaaaataaatgtggagggttatttataaaaagatgacacgagacgaacattaaactgatgctttaatatagtatagatgtttggaaccagcgctcacaatttctataaaccagtttcttaagaactgggtggttccaaaccggccttgagccgaagataaaatagatcctaaactaagctaacggttagtagtagagtcaattaggttttaataatgtgtttttgccatctgaattatgctatcttttcccgattcctatgtctttgtgaatatgatgcgttgccactagcggtggtttttatttccttgtctggttaggccggaggagctctaaagtctaacacatttggccgggaaatggaccgcgcgccggaaaacgctgcaagtcaaaccgtgtcgcccacatttttttttttcttcttcttacggaaccccacccaatctgctcactgttcactcgaccgacgaggcgacgaccatcttcttcacccatccatccagattccagagctgcagccgcccgtcaccttcctcctcgcttcgcctcccattcccatttccccacacctccgcaatatattccccccacgccttacttaattaatccgccaaacaccgagtgaaccacgccaccacacgcagcgagcgagcgcccaaagaaacgccgtagcagccaccaccaccaccaaccccttcctccctttccctctccgccgcccgcctctctacaagaaccctcacccgaccgccgataactacctagctcccacctcgctcctcgactccgtcttctctattcttccatttagcggagatcctagaacctaggggcagccagccagggggaacgggccgcg

SEQ ID NO: 9266 - DNA, 175 bp, Zea mays
gatagagtccaaaccgaagatatctcggatagggtcggggtggttccttttgaggagaaattgattcaacattgtatgaaacggttcggacatgtccaaaggagacctcctgaggcgtgcgtagaggaattttagagcgggtcaataatgtaaaagaggtaagggtcgacctaaa

SEQ ID NO: 9267 - DNA, 186 bp, Zea mays
ctctgaggatccccgtgaatataaggaatccgccgccggcgtcatctcctcctcccacctcgactcgccttgctcgccgtcggcggccatttcgtcgccgcgcggcgagccgcccatgttgagctcgcgtcggatctgatgggcttgttgtgatctcctgcaggtaaggaagaggaggagggcagg

SEQ ID NO: 9268 - DNA, 69 bp, Zea mays
caaacgcaccataacataacagctccagcctgacctttcatcgtcatcagatgctcaaaactgtcgcct

SEQ ID NO: 9269 - DNA, 1500 bp, Zea mays
gtttttggcttttgttgagtttcaactctagcctattctaaaagatttttgttgttgtcgttttaaatatctaaaatgaatgtcggattctttgcctctgtactctccttttataaattgtttgcaattttgcctctaatatcatctccaacaatgattcaattgaatcaggaccatatcttgattaataaaaaatggctctagtagtgacctatctatattatccataacctttttttctaataatataatttattccttaaactacatgattagagtttaattgatagagctcaatttgtttttaatgttctaatcactttaaatgatgcaatactctaattgcactttaaatgacgcaatattttaatttttaagtcactattttgaggtaccttgttagagatactctatcctaatgtgaaagtttataatataggtgtgatataaatttgaccataaattcaaaatcaacattttaactttgattctaaaaatattttggatttgataaaaaaaatggtaattaacattaaaagaaaaaacaacgctgctagctctggacgtttgaacagacgccgataccgatcatgtcggtctcaatgttgattggtttgatcgtctaattgctggatctgatacgatttgttcggtcgatactaaccataattgatcgactttagtgatatagtttttattggtccacattagggatgtatctaatattttaatatagatattaataatattacgaagtataataataaatttctatataaatttatgtatgtattattttctctatgcaacaaaaatagaaacatctaatctgtatccagataggtatccaaattttatatcaagtattaaaaatatagaacaaattcagtgtttactttttataaaaaataatagattcaatactaaaaataataatataaatttacatagcaaaaatttatgtgtttatccgaataagtatctaaatccatcccaagtcacacgtgcaccacatcaactaactgttattaaccttttgaacttcaaaatgttttaaaaaattattttttaaatcctgaaattcaacgtataaagtagagtttatttatgaaatatattgtttatgttcaggaaaatattttattttatgttataaaagaaaagatgatgtaatgttaaggtaaatatagcttaacaataaaatatacagtatgcactagagcagccgccaacgtgaccccgatatatgccagcctaatcttggcgcgaacgcctcccaactcgcttgcccacgtggcctcgcccacacctcttcgcgccatctccgttcccgccaggccttggcgccagcttgttcccgccagatcttcgcgccatctcccacctggtaacccgccgtatatatccaccgtccttatcttgttccctcagtcgttaatccccgacccaaaccaccactcaccgagacaccgcagtcgccttcgccctctcaagattgag

SEQ ID NO: 9270 - DNA, 1155 bp, Zea mays
cttttcctggtgctactgtcttcttggttatcgtctctgtcctactacctacctatctctgttgatgcatctctatgtcactatgtgattctaacaaccaagatgcacacgtgccctctgttcaatacaccacaaaaagttgagtcaatcctatttttccctggtaagaaggtgcacttgcaatctcagaaatgacggtacaaaacctcacataataaaattccgtttatttttcttctcatttgcagacacagacacaccttgaaccaatgcttcagcttttccttgctccaaaactatcagtacctcttacataaaatcacatgcttcactgtcaatgcaacaaattaaaggcctatttgaatcccatgaactaatttagccactttgtgagctaaaaatccaaacataaagagctaaaagtaactaaaatggtaaaagatattcttttagtcatttttaactctttctgtttcaatatttagcttctagagtgacgaaacttgctctagctcaagggatccaaacatgccctaagtagttgtgttctcagcttttagtgcaacgtggttagatttgtcaggattatatcttcttcttcaaatagaacaatcttatacacattatttacatcaatgtgtatacaaattacaatcatttctatccatgatgtagcgcaggtaaatgggttgatcccagatcccacattgatagtcttcttagtataaactcatgtatgcggactggcccaactcagacaagagcgcggcaacaccgcgcatatacatggaatgagaagggctcagctacagccaagcgaataaatatactgtgaattaaccctaacctaaccgaagcgtccgcctcccacacacgggactccggccgcgagaacccgcgactaagccaggacgcgggacgccacagccaccggcctcagcatccgcctaggacgaataacccttctaggctgccgccgccgccgtccttagctcatattgttgccggcgaagagcgccccaggtattcccagccccttctctttcctgtccgctgcgcaaaactgaattctcgaactctcaacctcaagttatttggctacttctaactttttgcaaaaaattatcgggtccctttactagatccgcccctgct

SEQ ID NO: 9271 - DNA, 986 bp, Zea mays
taaattatgtgttgtttttttactgcaattattgtgtactaacattttawygaatagtttgtattccgttgcaagtagttgacgtaataaggagggaccacacttcatttcgggcacatctgccggccgatttggtcgccaaaatttggccggctgggctgatcatgatagtttcatagtttggcagggcagcaatgagtcatgctctaagtatacgcgatcagggcctctgctcgcacttgtttcgtggctagtatagtactgtagatgccacaaagagccaacagctagctctagcagctgcaggcgtgcacgttactgtaagaggagacgaagtcaactactgcacgcggagtatgcaaacaatgcacacggccgggccggggtttggtcgattccgcaagcgctctatctatgatggtccgccccaccagacaatcaccatgtgtccgcgcgctagctcccgagcacgcagagcccatgcatggaatcctaccaaatcatatatagacacggtgtcggtgatcccgaggcgagggcgcgcgccagggtccaacgcaccagacaattcagtagcttttatttcagcatctattgcattagagctaatttagtacgggtcctatggtaggaataacaaagttgttttcagttttcttctaacaaacagatcctttaaaaaatagtttcttccttaaaaaactgatttgctggtgaagttgaattataccaaagaaacccttacttcatctatgatttgctgtaaagttgaatagaatcgtaactgaagggatttaattaaaaatagcttctacgtgtatgatttaaaaaaactgattgcatggctccgtaactgattgtcgagcttgcttttttatttccacagcctgcacaaccatgcttgcttgcttgcagagactttacgtatatattaggctccatatatcatcgagatctctgctagctagcggatcagtcttgagaag

SEQ ID NO: 9272 - DNA, 89 bp, Zea mays
gtttttttggtgtgcagacagtttctgacttcaccagatgagactttctggaattattccccccttgccacaacatccttttcctgtac

SEQ ID NO: 9273 - DNA, 203 bp, Zea mays
tgtcataattaatgttataaatttgtccataaaactgtcttgagaatgccctataaggtcatcgcagaccggacccacgcgtcagtgagacggaagtaactgccgcatctcaagtctcaaccctcgcctccaatcgcaacgctcccgaggagagccaggaggaggtgacggcggcgccgcgaggaaggagggatcgatcgagg

SEQ ID NO: 9274 - DNA, 505 bp, Zea mays
tgtttagcgcgataaatcgcgccgctacggttgggtgcggtttgtgggatgcagcagcaggcacggttgcgcgatgaattgtgcggctacggttcggtgcgatttgcggaattgagcaacaggcacggttgcgcgatgaatcgcgccgctacggttcggtgcgatttgcggaatggagcaacagacacagttgcgcgatgaatcgcgccgctacgatttggtgcgatttgcgggatggagcaacaggcacggttgcgcgataaatcgcgccgctacggttagatgcggtttgcggaatggtgcaactggcatggacgaacatcccgcacgggttgtagcggcgcaatttattgcgctttgcttttccgccgcgtaataaaagccacaaccagcctctttccatgattgtgctggcgtcactctgatattcggcaaacgggctcaaccccgcgccgcgattcgtggtaagttggatgctttgtgagacgtgtcaggaaaggcagtg

SEQ ID NO: 9275 - DNA, 71 bp, Zea mays
caccgcagcatttcttcttcttcttgtcactagctgcaggctgcacacagcgccgccattgttttgttagc

SEQ ID NO: 9276 - DNA, 141 bp, Zea mays
agtcccttctgacccaactggtgaaatatggacataccctatgaccaattatattactagttacatttcagtgttgcacaattaacatattcttcctcagtaagagttgaaactggagtcgaagaaggagataccgtcagc

SEQ ID NO: 9277 - DNA, 1220 bp, Zea mays
tctcttcgggcggttagtccctttcttgaagagaacggctctgataccaattgagagcacctagagggggggggtgaataggtgatcctgtaacacttcaaaatcttaagccacaaaacttgattaattgttagcacagtaatttgccaagtggctagagaaggatctcaacacaacacaataaccaagagatatcaatcacagagatggcacggtggttatcccgtggttcggccaagaccaacgcttgcctactccacgttgtggcgtcccaacggacgagggttgcaatcaacccctctcaagcggtccaaagaccaacttgaataccacggtgttgctttgcttttcttaatcccacttgcgaggaatctccacagcttggagcctctcgcccttacaaaagatgttcacaaagaatcacggagcaagggagggattagcaactcacacacgacacaaagatcacagcgaatacgcacacacaaaacccagacttgagctcaagagactagcacactagaacggagctcaaatcactagaatgtcgaacaagtgcgcaagaatgaagtgtgagtgatcaacaatgctcaaaggatgcttggtgttctcctccatgcgcctaggggtcccttttatagccccaaggcagctaggagccgttgagcacaaatctggaaagccattcttgccttctgtcgtcgggtgcaccggacagtccggtgcacaccggacactgtccggtgcccgattttcttccttaaatagcgaagccgaccgttggcagacttggagccgttggcgcaccggacatgtccggtgcacaccggacagtccggtgcccccttctagccgttggctcggccacgtgtcccgcgcagatcgcgcgatcgaccgttggcccggccgaccgttggctcaccggacagtccggtgcacaccggacagtccggtgaattatagccgtacgccgtcggcgaattcccgagagcggccacttcgctcgaggcagcctggcgcaccggacactgtccggtgcaccaccggacagtccggtgccccagaccgaaacagccttttggctgtacacagccaactcttctcttttcttctcctttctgtttctgatacttagacaagcatattagtacacaaaaccaatgtactaagacttagaaacatacctttgctcttgttttgcactttgtccatccataaac

SEQ ID NO: 9278 - DNA, 638 bp, Zea mays
ccccgagcttagtgcctcggggtttatccgggggcgagcacttccagggtagacagttcccttatcccctgctagtcggtgattccatatagtccagagattcttatcccgtacaatctctccgatcggtgggcctcagagacccgtggatctttttcatgacagaaatgaaggggatcgtaaagaaatttgagtttccaaactagtgctaagagatttttcttccttgtcttttcgggagatttttcttccttgtcttttcgggtttctcttcccttactttcaaacttgcctttaaaagttctaagcaggagcagccatgcaactaccttttttatgtttgtttatgccatatatttgggtcatgctggtttcgtttggtcaaacatggaccaaaataaatgactccatgtattctctctccgaaaatcacgccataaagactctcctctccgacgactgaccgttccccgactctctctccacatcagttttggtcccaaattcagcctgagagctgcagcagcgaagagccgaagaaagccagcctcgccttccccctctccccatactaatcatcatcaagggcctgcgattccaagttgcgtttcctgtctggggattcagggtggaaggag

SEQ ID NO: 9279 - DNA, 490 bp, Zea mays
aatctgtccaaatttggacagcagagcctttctcgtgtcttttgaccttaatatgcattgaattaacttgatatgtttataaatgaattatagacaattctactagctttctaaaaagtctgggagcacctgaattggatgattgagactccaattatggatttttgaattgagtagttgaattatgtccaagtctggacagaatttacgtttagcattgtttgacctttctaagtgtcaaatcttgttgtgatgataataccaagggtatagtggactttataagttttccataaagtcctagtttactaattttcgatgcatattttgtgagttaggagcaaaacaattaaccgctgtgttgttgtctagaaatatgcaagcattaagttgctctcttgaagttgctcttgtttggctaagtttggtttaggctataggaacattatatgccttgcattcatatatacattccttgaagtacttgcat

SEQ ID NO: 9280 - DNA, 819 bp, Zea mays
atgtaacactataaaaaccatcaactaaaaatattgcatttggttacttatggtaattagggtaataaatttttatttcaagtgtgtgttatttatttgcattttaaattatttttgattgcgcatgattgattattggacgtttaatagcatttcttctcaaaggaaaatcctagtaaataaaatagtaattaaataatataataatttttaatccaaaaataaatattttatttataaataattttggtgaatttctaggaaattttgagctctttaaaaattcatttcgcaattaaaaaaacaaacttcctaaccctagtcgcccactaggggcccatccacccaaaccctatcgcgcgcgcgcctggctctccaagccgtcgtcgcctccctgctgtgtccctctctctcccctattctctctcttctctcactcctctctcccctcgcatctctcccaggcgcccctgcacccgagcctccctagcccgaccggctccgacgcaccaggccgcgatgcccgcgccatggtcgagcccaaggccgaccgaacccaccggtcccgtgctcgagcgtgctgctcctgccctgcttgcgcgcctccagggacacgaccgcacatgcacgagcccggtcgtgcccaacgtccgcgccccgcgccatgaatgtctcgcgaccgtttcttctcccttcccccattcctctccattgaagctaggagaagaaactgacgccattaaacagtgtaatggagttaaacgccgaccattctcctctccctggccgaccctccatctcccctccctctctctataa

SEQ ID NO: 9281 - DNA, 1347 bp, Zea mays
cgtttgataagttcttattgggccaaagaaagtgaaaagtgcaaatcaaggcatgaggtatgtttctagactaagtacatttgtttttgcatattaatgaggttatctaagtgctagaaacagtgctaaagaaaagataatcgaattgcaaaagacttggctgtgtccagccaaaactccagctcggcctggcacgccggactgtccggtggtgcaccggacaatgtctgatgcgccagactggtctccggtgaaaaggctgctcttgggagttgacgacagtgtacggctataattcaccggactgtccggtggtgcatcggactgttcggtgagtcatctgcgacgaactcattgctcccgggaatgaagaaaggcgacgtggctataattcacaggactgtctagtgagccaacggtcgccagcgccaatggtcagccgcgaaatctacaggcgacgcatggcagctccaacggtcggaagggggcaccggactgtctggtgtgcactgggacagtgtctggtgcgccaacaggcccagagctgcaacggtcgactgtgctcgatttggaaggaaatcgcgcaccggacaggctacagtagttgtccggtggcgcactagactgtctggtgctccactcgacagaaggcaagaattgccttccaagattgtcatcaacagctcctagctgccttggggctataaaaggggtccctaggcgcatggaggagtcacttaagcattcactaagcatcctaagactccaagactccaactccacgcatttgattctctgtgttagtgatttgagctccatttgagttgtgaactccgtgtgttgtgttttgagctcaagtcatgacttgtgtgcgtggttgtgctgtgtatttgagtcttgtgtgtgttgctctcccaaccttactcttgtgcgttctttgtgatcaatattgtaagggcgagaggctccaacttgtggagattcctcgcaaacgggaagaagactataaggaagaaagttgtggtattcaagttgatcattggatcacttgaaaggggttgagtgcaaccctcgtccattgggacgccacaacgtggaagtaggcaattgtcacttggccgaaccacgggataaaaatcgcgtgtctcttgtgttgttttctctatgattgttttgctcacaagaactcacctcaaagctacttagtcgcactaactctcaaataaactatgtcttgtggctatttagtatttgattttacaggatcacctattcaccccccctctaggtgctctcaattggtatcagagccgtactcttcatctaagggactaaccgcccgaagag

SEQ ID NO: 9282 - DNA, 1500 bp, Zea mays
gtttggtcgggggctaggttagattgaccgggtgtgctatggttgggtctaggttggttggggtgtccgagctcgttctgatttggtcgaggagggtctggtcggaagattttggttgggttaccaccgctagacctatgtgttgtgaggtggcttggacagagatrgtatgtttgaagtttgtttttgttagagcttttctatccctttaagcgatttccatatgtttgtttcaaggtaccatgtatatgggtaaacatcactaggtcactcacaaatcacgaactagttgtatagctaactaatataagtatgttactaattaagttaataactaagttattaatgaattaaaaaacccaccttcattgaatgtgtgtggtgcaagttctggagtgataggcgggatgacgacagggctagagcgacatcaagcgaggttgtgcccagcagtcgatagcgagtgtggaaattgggggcgacacgaggcacacaacacgcaacgtgagggaaaacgacaacgataagtgaaggacagttgcgagcgattatggtcgaagaaaaaaggagagagaataaggatgataagtactataaaagacattgagacaaaaaactatgtgttgagatcgataccatgatccatagcgccaagctcaacatgagatcttgatgtcgttttcgatgccacatattatgacaccgagaagtcaccatatcacttgggacatctagcatgacaccttggtgttatgacatattgtggccaagacgtgtaattttagtgccataggttaatggttgatttagagatcaaaataaaatattagttcatatggatgtccttaacacgatttttgaagaaaaagagcaaaataaaaaaaacggagattttgataggataagaccattcgcactgcttgctgcctgcaaggtcaggactcatgattgaatcggatggagaccttgacctctgcggttcttttctctctgtttttgttggaaaaaaaacggagaaaaccacacaaagtgatttttttaaagttgaggaggaggagaggccacggatacaggtgacggagcaccaaatcctaatgcctgaaagccgaccaacgagcttttatattggttccacttgcatagtatgaattgaggtcatgtttagattcaaaactactgcattaattaattcgaacagctaatattggttctgacatgttaactagctaattgagtcactaataattctttgttaccgtaaaatagagaactgttccagccacgtggaactggtgtgtgacgagagcagggtttcaaaaaaaacacgaaattgcaaaaatattgtagagtgcatttgattttatacggtactgtgatgaagttataatttttaaatataaagagggtagtgattaataaaataataataataaaacgaaaaatccgacaggacagggttgaagttgaaggcggccggcggaaccggaccggacgacgaac

SEQ ID NO: 9283 - DNA, 1500 bp, Zea mays
ttcaacaatctctaacaggaaaaccatgatatatataaattctgatcttcgctattttttttaaaaaatatgtgactattgttcgtaaccttcatttttttctccaacacaaaaacattcattttacatgaattgaccaagctttttttttcatgtaggatctattgtccatggaaagaaatgatgaggctggtgtttctaatcttagtcactatgcgcaccaacttttgtctaacacaaatgtttatgccttatttggaaaacaatatccaaatatattttgtctatgcatcgtagacttaatgggtgttgaagacatactgtttgtacgtacgtcgacacatcctatgatgaccatattatgtaatgagcactactatctttatatgctaatcatattacgtaataatcactactatctttctatgggacgctaatctggaaaacaggatcctcatgtctttttgtctatgcatcctgatatatgtagactgaaatgctaccagaaacatattgtttgcaactcagccttttatgtagccatttcttcatattatataatgcccataatcatcgaagcactttatatccgtattgtaatataatgtctctctttgtatgccagtattaagtatttaattttgcatgcgcgcgctggcgcgcgccattgactagtgctcatgaggcaaatgtgcctctgtgcgacagcatggcttcgtgaacgggcgccacttggccgggtagttgtaggcttgtagcagtgcaaagacagtgggggaaagggatttcaggccttgagtgtaagcccaagataaaagtccagtcatgcgtcctggaccgttatcaatcgcgtgctgggctaccaaccaaaaattgcatagtgaacaccagcaccaaaagtttaaaaaagggcccgagtcactagctgtgttagatctgccgccttcacagttcgtgtgttctataggataaacagcccaaccttttgtttccaacttttaccaaaactgtgcctagaacatcgtcgacaattagccattgctgggcacaggcggcaggagctgctgttaaattatctttagttttgcgtttgaatgcattagaactaatagttagttgactaaaaattgctaattgaattagctagctaactagtagctaatttactaaaagtagctaatagctagactattagctagactgtttggatatcttcagctaattttagcagttaactttgcattcaaacatgaccttaatatgatataaactaaaggttagatttatttttaaattattgtttatgtaatctaaagtttagaaaaggttgtacctgagacgaaatccgggcggcagcagccatcggaggctgggcggcagccgccagcctcccgctcgcacgggagccacacacggacaccacgctgcgttcactcgcaaccgtggcccgtggcccgtgggtttcgcctgtggtcaccgcgaggccgcatccagtcgccc

SEQ ID NO: 9284 - DNA, 1500 bp, Zea mays
gtgggccgatgaaactgggcacacgtgctgacacggcacggcccataattagatatgtgcttttgtgggccgtgcctttatgggccgtgcttttgtgggcctgtgccgtgccgggccaggccggcccacatgtacatgtatactgtgggagcaaaggggtggctggaccggcccgtcttgggctgttattaggccgtgggagagggttgggcctctcagcatttatatttaggtctcgtttaaatgtcctaggtcatgttcaaaggaactaggatctatttggttgtggaccaaagaagcccgaccaaaatttggtagcttaacaaagctggactaagccaaaatttggctcaagttttggtgtttggtttgtgaacaaaatgcattgggggccaagccaaattttggcagccaatttgatggaattggttttggctaaaaattggcatagatttatattggcgatgaccaaaattgtggacatggctaaaatttagcctataaccaaataccaaccaaaatagcttgataaggccaatatttggcatggtacttagggcctgtatggattgatgtctaacttgcccaactttgtctaacttttctgtctaagattagttattaaattcgaactactaactttaggtaaagtaggacacagctaaccacaaaccaaacatgcccttagtgctacgtccaaacacacccgcggcccgtcgcggcatcacgccataaacagagggcaagctgccacacgagatcccgccccactggccacacagaatagacttgtctctgatctcatttctgacctcactttgtgttcgtgtggtgcggctgcgggcgcggaaagggaaagcgaggaaggagaggggaatccacctttgggcagcgaaaaagacgtccaggttcaatgcacccacacgatccaattcccagccgcctgcaagtgcaagcgcatcttggccacctcgtgcctcctcctacgaacagataaaaaaaaaatacaccagcagaacgagtgctagatgctacgaggccccgggagcattttcttgtgtgactgacaggttgggctagcatgaccgtaatcaacttgtcagtgactgggacgggacgggacgcgtggtctccacagtcgtcaggtgtggacagcggcgatgcttcaccactgccgttcgtgtcttctccacccccgcttctcaccatcgcacaccgagtgtgcgtacaccgtggtacctcgaatccctgacgcatcggcccaccgatgccatcgccaatacaacgtcgagcatttcccgtggaccacgtccacgcgagtgatctccactggcataccccggtgggccccacctctccctcataaaacataccgtacccgtcgtccgcgagtcgcgacccctcgaccgtgcgaacgagcaaaggacaaatatcctcgctcgcagtcgcagctactacgccgccgcacctccgcccgccaccttcttcccggctccagcg

SEQ ID NO: 9285 - DNA, 1500 bp, Zea mays
taaagctttgtgtgaaatggagagggatttgattacttgggtgtgtctagaattgaatgctagagctcttgtaagtagttggaaggtagaaaacttggattcccctggtgcatcggacactgtccggtggtgcaccggacagtccggtgcgccagaccagggcacacttcggttgtcccttgctctctttgtttgaacccattcttggtctttttattgacttattgtgaacctttggcacctgtataacttatagactagagcaaactagttagtccaattatttgtgttgggcaattcaaccaccaaaatcaattaggaaataggtgtaagcctaattccctttcaatctccccctttttggtgattgatgccaacacaaaccaaagcaagtatagaagtgcgtaattgaactagtttgcataattgtaagtgcaaaggttacatggaattgagccaatataaatacttataagatgcacatggattgtttctttcattcttaatattttggaccacgcttgcaccacatgttttgtttttgcaaactcttttgtaaatccttttcaaagttcttttgcaaatagtcaaaggtaaatgaataagattttgcaaagtattttcaagatttgaaattttctccccctgtttcaaatgcttttcctttgactaaacaaaactccccctaaatgagatcctcctcttagtgtttaagagggttttgatatatcatttatgaaatactactttctcccccttttgaacataaagagaaaaccaattgataatattcttgaaagcacgaagtttttgaaattggtggtggtgcggtccttttgctttgggctcatactttctccccctttggcatgaatcgccaaaaacggaatcattagagccctcgaagtactttcttcccctttgatcatagctaaatgagttgagattataccaaagacgaagtccttttgctctctcccccaaagaaaggagagtggcccggagcgacggcgaaggatgagttacggagtggaagcctttgtcttccccgaagactccaattccctttcaatacacctatgacttggtttgaaatagacttgaaaaacgcattagtcatagcatataaagagatatgatcaaaggtatacaaatgagctatgtgtgcaattttaacaaaagaaattgcgcaaatcaagaatattgagctcatgcctaagtttgttaaaagattgttcatcaagaggcttggtaaagatatcggctaattgatctttagtgttaatatatgaaatctcgatatctcccttttgttggtgatccctaagaaagtgataccgaatggctatgtttttagtgcggctatgctcaacgggattatccgccatcttgattgcactctcattatcacatagcaaagggactttggttaatttgtagccgtagtcccgcagggtttgcctcatccaaagcaattgcgcgcaacaatgacctgcggca

SEQ ID NO: 9286 - DNA, 418 bp, Zea mays
cgggctgaaagaatcattacacatgtcaactattgagagtctaggtattctgttattcatttgtggagggaatgagtccatcagtagagttgttaatagattcaagcactcgagtgaaactattagtagaaaatttgaagatgttttgttcgctttgatggacatggcaaaggatttcattagaccaaaagatccaaattttcatattatacataagaggattacggatgacaagcgagcctatccatatttcaaagattgcattggagcacttgatggcacacatatccgtgtcacactttcaccggatgagcaagtgaggtacattgagaagacagggatacccacccaaaatgtgttagcagtttgtgatttcgacatgtgattcacatatgtgtcaacgggccacccgggatct

SEQ ID NO: 9287 - DNA, 158 bp, Zea mays
tcttttgctcgaggtttctagcaccatcttctctaatagaactaaggatggcatggaggtttctggataaataagtgatcacttagtttggcgaggggtatatatgtgtttgtaaaatagttcttcactccattgtaattagcatataatgtactaat

SEQ ID NO: 9288 - DNA, 1500 bp, Zea mays
acgtaaaggttgaaccttgtagatttcgctttttttttaaaaaaaaacaaaaacacatacatgattttctcatgtaatctctctacaattagttcttctgagtgatcacctcatcttcatttctcttgctctgtctaccactagctgtgtgtacagtaccagtcctcatctcttggagatatcggccactcgactcttctgtccaacgtcgcctttacccaccatcgtcttgcgtgccttctgcaattatggccatttccaattccacctttgccctcacccttaggactcgggatgtgtgacttcttggccttgtgcgtcatcactgacactgagagtcatggcttgaataggtgtttggacttttccgctccacagataagaattttccgggatacgataagatgccgattttttcctccggtccttgtcagcactgtggaaaaccagagcttttggttctctgcaattttgtttgctacccccaactgcttgatattggattattggtggctggccactcacgaaattctacagattgtaaaggacaaccatgatctgtttacgtcaagaaattcatgatcaacttagtgaaatgtcaaaggtagccagttctgatgtaacagaacaaagcatcttccatctattgctttacgcaacattgccattagcccagtgccacaaaatgatgtgttccaacctccttctgttctgctacaaaatcttcaacaaatatagtgtggtaatttcaattcactattgctgaattccaagaaaaaaaattcaccacgtgtgtgaaatagcgctatatgtatagaaacaaaaaggatatatcacatacaatgcgcctttgtcttgctatgccatgtttagggatattcatgctttggggcaccagatatggtcagaatgtctcttttaggactaatttgagaactctatttttccaaaagattcctattttcccaagagaaaataaactaatttctcttacggggcgtttggatcccttcattttaaaggaattggaattcactcaataaagtaacttatttagtttggaatttggcattccaccactttccaaagttcagatataagactatctcaaattcatagggtgtaggataggaaatgattttatgcatgattagaatttgtttctaatatgtaacttacatgacactcttcgttctactcctttatagtaaaaatgtagcaaataaatatttaggacatcttgctaataatagtatacaaatatattttgtataaaagtgaattagcttaattggtatatgactaaattactattattagaatagaattcaattccagtgatccaaacggggcgttaggaaaatagaaatcccttcccttagccatatataaagccaggcctcatttaatgtatttgtttctcagaaattcgctactatgtttctatgagtcttggcatctatgagtaaatagcatattaccacagtgcctgcagatggg

SEQ ID NO: 9289 - DNA, 822 bp, Zea mays
acaaaggttagaaaattagagttgtttagaatttctgaacaagacttttcaactcgacttagaacgaccataactttttcatccaaactccaatttcaatgatcttgaactttcagaaagtttattcaaagggctacgcaacccactttaatgcgtacaacatattaaactatactatattttataaagatgatatctataaaatcaggaaagcgttgttgcatatctcacgttaaccatccataaaaatacacaccgctcaatttgtatacccactttgtcgtatactaagtttcaaaagttaaactgatatgtctgcagctagcatctagatatgcgtacaccgtatcttcaagatatgctgacattaattttaatccaaccgcaaagatttgttgagtgtgcttgttgcttcgccgctcttcaccctccccctcggcccagtcctatataaagcgagaaccaaaacttcttcgattcatcctaaagccttcagtgcctcagaaaacccttccataagaattggatactgttgtgagagctgccctcattgtctttggttgtctacaactacaagtccttcatgagaattggaaagagtatatagaaaaaaaaccttgtcgttttagttttgggtaccccaagcaagagcgccaccattcactcgaaggtgggcctgcccctcgtcgcatcgctcgactccaactatagtcaactcccataaacaaacgatcttctcctttaccctccctttcccaaaaggtcaactcttccatcccctccactcgccgatccccaaaatccaaagcccaaggaaacaaa

SEQ ID NO: 9290 - DNA, 1500 bp, Zea mays
tactttaacatttagaaataaacaataattatatttgcattctaggtatcgctatctcggtctttctcctcgtagcaatgtatgagcacatacctagtaatgaatgagattgaggttagacgaaaatagcctaaatatgaggtaaatgccccgtgttccaatgtgcgtcccaaaacaatggtctggtctccctgcgaaggactttttcataaaagcccccggacttctccagcccaacctaacccctaaaaagtattaaacaaacaaagaaaatcacacgcaccaccagcatctataacagccgccaccttcccccttatactcgccggaggccaaccagtactcgtgccacgactgccacccctcctcttccttgtgatctccgaatacycatctcagattccaagggccgcgccgtgtaatccccggctctccccacccaccatatatctagtatccgcgcctcaaatccctcgcgaaacgccccgccgtaagcagttgttgtctgccgtgatttgagccgggcggacggattgatcccgggacgaggtgtctcagctcttgatcttgatcctgatcctgggaggcgttcctggttgattgttgggagcgaaggtgagatccgttgttttgatccgtaaagttttcctttttttttttttgcaatatatggttttgttattaggccggtgaatgatctttagtctttaccctggtccccggggagcgccgtcggtcgctgttggaaccgctgccgcggacttcccgtcctccccacccactccacggtcggtgaccgtcacctgttggcaccggtctctcgctgctgtaacacccaacccaactgcatgagcgcaccacatcaccacacaatttcctccccgccttttgtctgttgtttttaattactgcgatccaaatcaaatgttttttttggttttccttgcgcgtgtgggtattaactgaaaaaggtgggtgatttgcatgtgaaatctgattgagtagatcacgggacttgcygacttggggccctttcacggagaaaggtgacacccttacgcgtagattactagtcgaaaacgatgtgctggatgcagtttgtcctcatccacaattttagcctttagcgttgggggattcatctgcaagattttggaaggtgcttgctttgccgtgtcgaattgtgtagtattgtcttcgttagttagaagcttatgactcgtggagtggaggaagatttcttgctttggatcatactgtcaattcattcatgcccatatttcttgaactagtcttcagaagaaaaatttcataccgttttctgtgtactaaagcgctggtgcattcttttacaactcaaagcaatgttttattcagaaggaacgtcaaaaaatttcttttccccaactctttagggaaaagtccaagcttttgtgtggctttctatatgtacttcatatactgccatctaaaactcttttttgttgatctgcagaagcc

SEQ ID NO: 9291 - DNA, 868 bp, Zea mays
gatccccctgatccgagcactttatttctccacaacaatgaccaccggtaagatacacaccctatgatctaataatatcgtggctttgtttaaccttactagtgtataagctatgcttacactagtatttatgttcatatatatattggttaatctaactagctagtatacgagctatgcttatactagaatatatatgatattttcatgatttatgttctggttttaatctaaaatttttaatttgtgacagacaaagtatatataatgtataatacatatatgtataaataatcaaaatattattttgctaaaataaagaggcatggacgccaggcggcccaaccgtatccggtttcagtggcccagcaacccttacgtaattcttcttgcaagtggaggataaggacatcatcactcattttcaagtcacccaatctgataataccccttcctggaaggtccaatgtatgtatgttccacgtgctagcaccctttgccgaaatctgccttgtctgagacatatgaattaagagctagatccaatattgacacatgcatgcatgctctcaaatgcacagatgctccatacctctctcgaatcatagcctgacatatgtgctataataatatggaaaattaattattaatatgcatgtctctctgatcatatatggcatgcagctgatgattcacgtgcaatacatagcgcgttgtgcaccacgaacatggcaaattaaatttgtctataaatttagccatcgtccacacagcttaagattgtaaaattgttgtgctagcttagcttgtatgtgctgagctttggctccccccggcgcaccgctgaagcctcgactcgcaggcagcc

SEQ ID NO: 9292 - DNA, 229 bp, Zea mays
gatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgct

SEQ ID NO: 9293 - DNA, 1500 bp, Zea mays
gagtgggttattgcttccgcaggagaggaccaggaggagtagcgtggccaggcttcgccatgttactcggttttctccgttagttatttccgctgcattaaaatttatggttattatttctgaaactccgataatgtaatcactaatgatacttattaaattgtggtattatgttttattgtatttctctgtgcctcaccttcgagtgagctagtggtatttgaaagggaattaggcttacacctagttcctaaatagttttggtggttgaatcgcccaacacaaacaattggactaactagtttgctctagattgtatgttctacaggtgccaaaggttcatctacaactatactaattcgactgtccggaataccgtagattattccggacaggagaagctttttggaaaaacaggccaagcgcggaccgtccgggctcctgcggcggaccgtccgcgacacaagaatgaccctcggacagaaccaatgcaaaaacacaagtttccactacagactgtccggaggaaaagcaaagaccgtccgagacctcgcgcggaccgtccggcctcaggcgcggaccgtccggtcggtaagaaaccgaaaaacccgaaggtgacgggttcggagaaatgaattatagggggcctcgcggaccgtccggggtgcacgaccggaccgtccgcgactggctctgtctgacatctgacgacgcattaaatgcaatatagccgttgatatagccgttactgctgaccgttgcattttcagccgttgatctataggggcggaccgtccgcaccaggagggcggaccgtccgcgctcagcagaatggcccaacggctaggaagtggttggtggctataaatacaaccccaaccacctccattcacttaatccaagcattccaaccctcaacattcaatacaagagctagcaatccattccaagacacattcaaagcctccatctctccaagtttcacaattgagaaaagagatcattagtgattagtggcttgagagagaaagtggtccgtgtgtcatttgtcgctcttgtcgcttggcgtttttcaatcgtgctttcttgattccttcattgcaatcaaactcacttgtatttgaggcaagagacaccaatcttgtggtgatccttgtaggaactttgtgttccaagtaattgagaaaagaaagctcactcggtccgagggaccgtttgagagagggaagggttgaaagagacccggcctttgtggcctcctcaacggggagtaggtttgcgaaaaccgaacctcggtaaaacaaatccgcgtgtcacactccttatttcattacgatttgttttgcaccctctttctcggactcgtttatatttctaacactaacccggcttgtagttgtgtttatatttttcagtttcgccctattcaaccccccctttaggcgactatcaattggtatcagagcccggtgcttcattagagcctaaccgctcgaagtg

SEQ ID NO: 9294 - DNA, 212 bp, Zea mays
ttggcctagatatctattttcatgttcttgtttctttgtattacctaaacaaactctcctaaatactgaacatcgtcgtactagatatattacaaaataatttacgtgaactgatgtatttcttgtcacagtgtcggcttgcactccaaaggaaacacttgcaatactgaagttataaaaggatttttcagatcttgcctgcatactaccag

SEQ ID NO: 9295 - DNA, 147 bp, Zea mays
ggttagtacaacatactttgtttttccatgcatcgatggaataacaaaacatcatggatgcaccaaatttgcatactaccagagtgtgatgtcgacttgccttgtttacgaaccaatgcagctacaacattaacaagctggcatctg

SEQ ID NO: 9296 - DNA, 1500 bp, Zea mays
aaagcccactgactctgcgcacagacgcaaggaacacctgccaaaagagatgactaaaaagaactcatgacgatcgaatttacccgagagaagattgatcaggcagttgaactagcaaagaatccaatcttgaaagcgaaggccgtcggagaaatccagggcagatggaccagagccaaccgaggggccccccatggcccaagagctggggggcactacgccccgacaacgagggcagcctagccggagcgtcgcaccgccatcgccgccgcgagagagcacaagttgacggactagctcatgaggtattgcttcgaacktttttaatccccttcgggattgaaggggattggagagaaaattagttcatttccacctcaatccactccaatcccgaaggagatatgaggttcctaaagtagcccttaatgccaagatggtagatagtttcctttcaggatcccaggttatgatgcatataaaatacgatatttgtgataagagacatttcatgtgttagattgacattggcttcgcaaactgatttacctaatattaggtgttacataatattgaatgttgtgcatgcatgcatgcttatatgatttctcacttaagtgattttcaccgcctatttatagggtaactgcagctggtatgaaaggaatatacagttcacatagttcacatgtgacgcggggcggcctttttgtagtaaagatatgaaatgattgtgtgccgtcgcaacttatggacattatactagtaggtgataacaaaaaagaactatgttctatctatatatttagagaccagtggacaaaaaaaataaaccgaaagaaacttggccttctttatggttaatagataatattaatatagaagaaaaggaaataaactactgcaaaattgcaaaaacccaaagcatctgaaattctagatcttctacgctctaaacataaatcctcacttctatcaagcgttctgaaaaaggcgacacaaactgaaagcagccagccgtccacctccatcacctgctactgaagagctgcccggcgtcttctcctctgctgccgtgccttcgccggcggctgtccagtaccgcttgacagcgaagagcaccttctcaggcacgttggggccgtcctcatggtttgctagcagcgtcttccaccgcatccccttcaccgtcctctgcaccttgagcaggagtgcaggacagcggccgttgcaacaaaacaggcggccgttgcaacaaaacagactcccgttcccgtacattgtggacgggctaaacggcctttcgtccgttttcctcgttccaaatcatccaggattttttttataaaaaggagaggtcccgtcgtcagggccttgcctcgttccctcccaatcatcctgccgcgcgccgcacgtagacgtaggtagctacgattcgattcgtgctaggatttagtcgtcctgtcgtcgcaccagcattactagcattcagcaacacca

SEQ ID NO: 9297 - DNA, 106 bp, Zea mays
ataagtcttgccacatatcatccacagaagaaatggaggttgcatgtgtaaagaagagctctgttgttggtgttgtgtattgtagtgagctatagctgtcctgaac

SEQ ID NO: 9298 - DNA, 1462 bp, Zea mays
gctgaaccgatcgaccctctccctccatccctccctcactgtctaaaacatttttttctttgcttgaagcaagcaccttcccctttctctgcctccctctcccctccatatatacgccattgtgtcgctccgctagtctcgcgcgacgcccatgggggaggaggggggcctgatctaatgtaggggcaggaggaagcccttccactgttccatctctttcccggagtaggtggtgggcacgacgaaggcccctcgcccccaccagattcgtgcaactcggcgcctcatccgatcggcaccggccgcccaacgcgctacagacgcgctgccggtaccctctccctctccgcccggaagatttggtttttggtgcatttgtttagctcttggcgatgaatccctgttcggtctgttcctgaaagcgtcgggactctggaggacacggcggcggcttggtggattgtgggagggagggccttctcttggatttctgttgtcgaggacaggtaaccaatcgcatcgtcttcccccattcatgtttgtctttttttttttcagtgagacatggattgtttgggggattctttttttttattttttggggggtttagggtctatgcttcatcatgcattgaattgcgggttagcgcttgctttttcgcgcggcgtcaaggattggtactagccatgaggcgtgcgtttcgtggtgtggtttctggtaaaattcggtgggtagatagtgctgctcttgcctgcgctgcttgctttatttgtctgcgcctgcctttaatgatcgtgatgtggccctttccgcggcaaattgaatgtggtggccaaaaatcagctgtggccctctctggaaaaaaaataataatagagaggttctatttgtgatggggacgttattgtccggcaatttgtccccccggcaattagaagtagctgtttctgtcatttttccccgtttaatcgtcctcgtggcacaagacaaatatacggatcgagaaaagatttatttatttatttatgtaacaagtaataaagagagagaaactggtcagacctctgccatttgttgatcttactgcatttcatgtcgttgaaagaaggttagattggtcaggttggattattgcccttttcatctaggcgagtttagtctgttaaagaaatggcatacttttggtgtttggttaccggcagatgtgcccttgagatgtagacagccaccaggttgttttcatcgaatttgcattatacatggtggtacagagtatagagagtctgacctgaacattgcttttctatttacatctactctgtactcagaaaaatttggctgggctgaaaatgcttgcttagttttatctgcatcagacgttttcatatttggttcatttcccttatttttatcgcaacaattgtctcttgcagggtcttgtattagctagctattcactgg

SEQ ID NO: 9299 - DNA, 975 bp, Zea mays
tctcgctgaagtagcgtcgacagcgggatgaccgcgaccgccgcgcggggaggggtcacagagcgagattggggggcgagggcgggggcgaggtcacggagcgagattggggggggggggggcagcggttgggcagaaccgtgcaccgtgtggattgtgaacgcctacgttagtctcttaagaagtagtatagatatatatatatatatatatattatattaggagtcctgggcttccaataactaaaggaagcccaggccagacagtgcaatccggtcgagccggaccagatccagacgtatataaaagaaaatctgtagtgctaggtgtcggcgtttcgaacccggggggtccctggaccgacgagtaaattgtcgccgcgtgccccagctgagatgggtcggcgcgagacggagcgcgaaggggggaagaggagccggagggagacaggcgtgagaggtgaaacccgcgaccttcgtgtttgtcccgcgcccaggtcgggtgcgcttgcagtagggggttacaagcgtccacgcgggagggagcgagcggccctgcgcgagcgccgtcccgtccttcttcgcgcggcccaccctctgtaagagggccctggaccttccttttataggcgtaaggaaaggatccaggtgtacaatggggggtgtagcagtgtgctaacgtgtctagcggaggagagctagtgccctaagtacatgccatcgtggcagccggagaggttttggcacccggttcgtgtggtgtcgtggccgtcggaggagcgctggagcctggtggaaagacagctgtcggggctgtcgagtccttgctgacgtcttcttgcttccgtaagggagctgagagccgccgtcgtcatagagcgtgcggggcgccatcattacttgtttagcggagcgggccagatgggacgccggtcttgttcctcgtagcctgagccagcttggggtagggtaatg

SEQ ID NO: 9300 - DNA, 603 bp, Zea mays
ggtgagacgagctgaagacaagatccacctccccccactgcccaacgccgcagcgccatttttaatcggcgatccctcctcagctccaacccccagctgtttttaattcgaaaattttcgaaccaagccctcatctctctcgtcttccacctcctgccttccccaccccaccgcacagcgccctgtccggccccagccagagaccagactagacagctccgtttcccctccccgtcctgcatccatctcgaccgcgcaccaaacccgaaaacgcagccacattccctcctgcagccaccccccccccctccgctctcgcgcccctccgctgcgcgtcactccgagcggcggcggcggcggcggcgcccgcccccacagggcagtggcggcggcgaacgagggagggtttgttccccggaagagggagggaggctctggcgggagtgtgttacgggcttacggccgcctcgtgctggtgacaggcgctgcgcgagatccgggctggaagggctggcgggtcccgttggtggcgccgtggcgtcggcgtgatctgagatgagattggacccggctgcgcggtattcgctgcggaggtagacggcc

SEQ ID NO: 9301 - DNA, 312 bp, Zea mays
tgatcattggatcacttgagaggagttgagtgcaactctcgtccgttgggacgccacaacgtggagtaggcaagttttgtacttggccgaaccacgggataaaccaccgtgtcatctctgtgttgatctctttgtggttatcgtgttgtgcaaattctcctctctagccacttggcttaactgtgctaactctaatcaagttttgtggattaagttttaagttttcacaggatcacctattcacccccctctaggtgctcttaattggtatcaaagtcgttctcttcaagaaggaactaatcgcccgaagag

SEQ ID NO: 9302 - DNA, 306 bp, Zea mays
aaaagacacaatttcatcatgtacataataataaacattttacagtaaagtttgttcagctaggcctctctcattttctctgcatatgcttttctttgtcttttactttgtgtgtgtggtctctccattaaagttatataattttcaacctatgctgtagtttctgtttccttccttcatgccagtagttgtacaacatataaattgcatttccaatgtttatttccttttagatatgatttttaacatatatagcgtatcaacattattataaaattctttatcctgacaaccactaggttggat

SEQ ID NO: 9303 - DNA, 547 bp, Zea mays
ctgtagtatttataagaaaattttcatcaacatattttaaattttataaattcaaaatgtaaaaccggtcggccagccatacccacggaccgattaccggctagcccggtgtgcagactgcagaccgatttgatttggtgaaccttgagtctttgacccaacctatgtaaaagaaaaaaaaagaagaaagaaaaaacctggcccctgcgtgccgtataaataagtaccttgcaatgagccccgccgcctctccgctctgtcctagtgtactcttgccttgacacgaatactcagagagctcactctctccagcccatcccaaacctagccgccacgccaagcaccttccctcgcctccgatcctttcctttcccccaccggcgaggtcgccgcccgcccgccgcccaggtaagcatcgcatccgtcccaccctcctgactgctaaatattacttgtgttctcttttccgcgccctcccgccgtcgtcggattcggcgttgtgttcgcgatgaggtgcttacggtttctgcgcaggggtttcctcgcc

SEQ ID NO: 9304 - DNA, 1500 bp, Zea mays
attgtcggccggatcttccggcttcccgtctgtgcctgtggtatgggttgatggcgtagttcgtcgttttctgattttagtactactggttagtgctaaggtgagtccagtcagggtacaggccgggcgttctattagggtatcctcggagagcgtggtggatggttggttcacttcgcgaggaattttgcgtaattgtgtgtggtgggtgggcactgcagtcactggatcagttttactcaccatttccatgtctgattaaagctccccagccatggttctgggcatgcacctagtcaccgacaccgcccttgatacggttccagcttgtgctgtccgaatctctgactgttgggtttctgcaacgctcaccggagaattggcgcgcctagtgttaaactcagttcggattcggccgttactaatggaggatccgggtgacgcgttaaagatttccgagtacgacaaactgcggtgctattagtggcatgccgaggctggagtgtgtacacttgttgtaccatagatttgtgtggtgatttggattattgtcgtaggttacctttctgttctccgtggaccgcgtttcaagtttgcgataactgaaggaagtttgtgttcatgtgccgatataatcgtcctcgaggattctagagggaaagaacagaaatttccataacagaacatctagttgtttgattcgatttgttttcagttggcgcttatttagcccgtttttccgttacatgtcggtatggtctgggaagtgcttttccgttacgtgggcttcaccttccaaaatttccttttaagcgtcggtacgttataagctagtaaccattgaggaacctagattttatgatctgagctgtgtaggatacttttgatatggttatggcttgtccactttttgggtcatgacttgccgttttgtgctgcagattatagtgttttgttttttaaaattttgatatgatcagtttgtgcactacacatgtaagctattttgtaccacatgctaaattgacaccagtgggtatacagagttactgatattttctttcatgccagcgtcgctgaactctgggatattatctaatagcaaaaattcttgaatacttgagtgcaggcagaaagttgataccgctttggcgtcttccctatggaacatcttccctcaacactagcatggatctgcagtgcgtagcatgagtttgcatgcacgtttggcttttgttcgtcattgaggctggtgcacttctataatgggttcacgatcaaagaacgaagatgacaaggctcttgtcttgtgccaggaaagaaaacgatttgttagagaagctcttgacgggagatgtgcttttgcagctactcatttcgcttatattcagtcactgaggcacacgggatttgctctgagaaaattcgtagagcctgaagtgccgacagattcgtcactgttcacatcaacatctgccactccagaagcctcctacaatc

SEQ ID NO: 9305 - DNA, 308 bp, Zea mays
ggtaagaaagaagataccgaacttgtcaagtagttcaggggcacctacagggttgtctgaagtccgttggacaaggacaactgtaggtgggcctaattacttgggaggttccgtcacagctggtatcggagcgtagcccttctttgcagatattatgaggcatcttcaaaaggattttctaaaagtcttacctagaaactctcttcctttcttacctaagtattctgaagagtttatcttaaagaccagataggaagagtgcaatgtatagaaggttgaatcaactaaggttgattctgtaattacac

SEQ ID NO: 9306 - DNA, 196 bp, Zea mays
atttaagcagcggaggcgtcttttgatggtcggtcgatcgagctttcgtgtgaatgagttgacaatccgttggccgttgtcggctgaagacgagacgagtagtgttatcttgcttgcatctgttgcttacttttgagaccgtgacaggtcacatgacgatcgtttacgtttggatggtgctccgctgtgcagatta

SEQ ID NO: 9307 - DNA, 702 bp, Zea mays
gggacagcccgagtccaccctttggtccatcacaccaaacactccatgactacgttggctacgcgtcgttcctttagagctaatcaagattatttttgtcgcattgctaaggcgacacaaacaatctcaattcctccctcccagaaagggggaaaaaataatctcaattcctcaacgctagctcagcagcggtcatcatctaatctgtaagctgtcagtgtgcctcgtttcgatgtagacttgcttgcatttaaaagaacaatattattaatcttgcttagataattttgcttcgatgtaactataacatttactagtattactacattttcaccagatattcgccaacaatcgtgggtacttaagaaaaaagggaaacaattgtgggtaatgttgtcatgggcattgctttgagtcgcgtggtagtttaacatttcgagacgccgtgttccagtgctactctgcaaatgcaattgagtgcagatgtattttatgatatgcaagtggcaaaagcggctaggagataggcgacaaaaaatattgacttggacaacttgacctggagctggcctgggagtagaggggcccgtgtgtgtatatatatacgtgccatggatcatttgctttcttcatccctgcagcaaggaaaaccagctcatccaacaaatttgccgttagctcctcgctcgatcgatagcgccc

SEQ ID NO: 9308 - DNA, 271 bp, Zea mays
agtaagattaaactagctctgaattattctttatctgctgctccatctattttcatatgtgtggtgtatgaactaattactggtcctaaacatcatatatttaaaagtggagggattatctatttcctattgctgatcttgtgatccatgtttacaagtaaaatatgtgtattgtcaagtaatttgactggttgaatgttgcttttcggttcaggtattccattgttttgggcagtacttctgcctgcacttcgaggcattccagctcgga

SEQ ID NO: 9309 - DNA, 988 bp, Zea mays
cttacagccttaatagatagtagagatatgctcacttccctctcagctgatatcgcgcgcggctgacggttggagcggacacgggagcgtttggcaaacgaagctgaaaaaagcagctcgtgaagctggccgtgtggcagttggagctagtaggagtgtccgtacacacaaacggctccccgcctctcactcttttccccgatgaccagttctcacaaaaggcaggacgcaagcagcagccatatcctccaggtttcatgattcttctcttcatcctctgcttccatcttcctcctttggaactggagaaaggagaggagacaaaaccatccaagcgatccgtttctcccacttgtctcgcgccaccattattgcccgcccaatgggacgccgccgtatcctcgccgcgccatagttttaaccttgcgtccacgcctgcccaagtgcccatcccacttttcttccacgcaaaggattttctctctctctccttttccattttaatactgcacgatctctgatcgattgattcggccgagataactggagccttgtgttttatttcgggggtcttgtaccaaaatagcgtcgattttatctacttgacccctgacccattctctctctctctctcccttttcaatttcgggggctttatttctctcctcccacgccttgcatcttcttgatgcgttgcgtcccgactcgaggcagacatcggaggcgcgccactgacttagctcgcgatttctagatccgcaaccctgcgctgctcaactccgattcttttagttcggattcgggtagcagcagggcttcggtggcgatgacttgattgatacgaattggggatttcttgctgtttgcgcctctcttcgtatcggcgctgaagggctcagctcgagattagaacaatttgggttttggggtcttttcttcttctactactgctggtcaagttcacagaaatcgctggctccgtggtcca

SEQ ID NO: 9310 - DNA, 116 bp, Zea mays
agaaaaatggagttaccaaactagccctaagattatctcttcacacagcttcagtttgcaagactgttgtgcttgtatatatgtgctgaactttggcttgggtacttctctacacc

SEQ ID NO: 9311 - DNA, 433 bp, Zea mays
gctggctcttcgattgggaataaagaaggccgaaggtggtatggtggccggctcggcctggctcaagggatccgctggctggtggtggggcaggcaagatcacgctctctcatagagcgtaatgggttgcgtaacacactcctgtttgtatttggatccgatctaataattaaagtttatttacgtggtgcacatgtagaattttcccatgcccactgctaacttggattggatttttgccaaaaaaacgggtgtgcacccaatcacttatagtgaaaccgttgtgtgtttgatgtgcttctaaccaagtacaaatccagtgaaaacacacctaccattcaacaatccacattttggttgcaattatcagcattctagaaaggtgcatgtgcccattgatacacttgctattggtgcaggccatatctctgca

SEQ ID NO: 9312 - DNA, 1500 bp, Zea mays
ggattcgaactcacaacgatacggcggagtcccgtgttcggtgttccctgatgggcaactccatcaaccgactcgccggcggcgcgcctctcccgccggagttcgctggaggcatgcctttttgtcgtcaccccatcccaaacatctaggcgttcctcttccccacctctacccgcggttctccctggcccctgggcccgtttgcgtgctactaccggctacggctacggcctacggggaaagcaactgtggcaagtacggagaatgcaagtgcaaccgtccggcacggaggcacaaaagaaagccgccgacgaaacgaaagcgcctgccacctgcgggtgctccccatccggtccaggtgcatgcatctttccctcctcctccccacatcacaatcaccgtcctcctctataaccgcgcctcccctccactctttctctctcgagtcatcttcttcctgcccaatacggcgagcatcggcggcggcgacccaagcaggttgaccccgccccggcaacgaccagcgggtcgtacagcacgccgatccaattcctccggtgagttcccctgtttctgcaccccttccggcttcggttcgcggcgtcgtgttatatcgggccgctgtgctcggaagtggtggctggctgagatgggagatcgcgggagtggttatcgaagcacaaccagctgcgctgcgattcgcttctcgttattgtttccgatcagtctacatggaaccccacrgagcagggatgcatcatccggccatacgcctggaattgaacttgatactaaatcgccagtaacactgagcgaggttagcacaacattccgttgaactgctggaagacgctggtgtacactagatctggattggaaagaggagaagcaacagcttttcaaacttaggagtatatccagttgccatttcttaccagttcgcaactatcttcttcaacttatcgtatttaagagaacccttaatatgttagacaaaagtaagctacactaacaaatgtcaaaagtatgtaaaatcttttaccaatatatggtactgataagaacgtaatgatagctttccaatttgtgcatgggtgcctcctcagatatggcaaaattaacgcctggtccatctgtgcccaaagtacaaatggtgacatgctaatctttttctggtggcgtgtgttggccgttgggagaaagatttgtattagtggtaaagatattcacatggttcaggacccattgcttgtacttttatgtccacattcaatgtattgcatagtgatgttgccgtatgaaattgtaaaggtagtgtactaaactaggtgcacatttttaatccttcaccagttgttttaatcatgaagattgagaacctaaccggatagctccttttcagtgaaggtcgatatactgtgagatactgagattgtagctgctcactgttttagtttcttcaagggcaaggaacattaatatcaccaaatactttcgtca

SEQ ID NO: 9313 - DNA, 447 bp, Zea mays
cggtccgagcgagatcgatcgcccctccgcaaggccgcaacaacagacgcggcaagcgggtacaagggagttcttctggaggcgcgggagatcacgcgagtgtgttgcgcttgaaaagaagaaaaaaacaggcagggaggagggagtcccgttcccgaacccgaactacaagccagcgcaactgctgctgccgccgcccgcccaggtaaggcggaggcgcggaccgggagttctccttttttttctaccgatctaatctagcagttttctctctcgatcggtttgcctggtctcgttctccctctcccgtatctgagtctgtttatggcggcggcggcgtcggcggatggaaatgcagcaggaggagcgagggcattgcccggccccatcgccgtcgcgccgtcgccgtcgccgcgctgcaggcagaggaggacggcgccggccagc

SEQ ID NO: 9314 - DNA, 1500 bp, Zea mays
cacaggtgatgagatatatgcatgcatggcaccgtatgtacccatggtccccatggacaagcgcacgttgccgccacttttctagggaaagcgctagcatgccatggcatgccatgccatgccacttcatgcacccggcgcggactacggcaccacgtaggcatacatggcacatgcatggacgtactactctagctatctgtatgtagagcacgcacaatgcgtgataattcgataagaggatcatcacgcagcttgcttggctaaatcaattccttcgaaagtaagcaatagaaaagcaaaaaatatcctctgcaattgcatatgcatgcataaaatcaagcagctggctcagtaacgcgggctaaaaactgaccatggtttccaggggctggcgcgcctggtggacgcacacttgtcagtctcgggcaccgagagctatacgcacgggttctgtgcgtgacagtgtgagcgcaggctacacacacatcatcgtatcgtgtccagagcagatagatacatgagggtgtgtctacatacatacacacagccagcagagtcagccagcacaccgcgcgcgttctccatgcaccggaaacgtactgggtcgagcagtgacgctctggcgcccgcaatgatcagcagtaccagatcacgacgaccccagtcaccggcctgcttgtcccagatggatgcctacgtacgtacgcgcgtctacagcgcagcgcctgcaccgcgtgcgagacagcgtggaccccgcgccatccggcctgtcgtccgcagacttgggtcacgaagggcttgcaggcgggcgcatatagccggccgctgacgcgcgcgcatgtcgacgagagggacgacgcgcgccagccgcagcacagcagccctcctgttgccgcctcatgcagatgaggcggcgacggccggccggcctgcgtgggtggatacgagagcggcgtgcggacgcgtacgtccacaggaatcgcaggcaaaccggagggagggtctcagtctcacgccgcgcgcaggcagatcgagagacgacattccagaagccgggcacctgtctgtcgccagcagcggccgcgcgcgcgaggacaagcgcggcacagttggaaagaacaagcgtccaatggccagtagaaacagacgccaccagaaaaagaggaggcttcggcggaaagtggcttgcgcggacacgcttcccgcctatttaagccgcgctcgcgcgcgctgcggctggcacagtgcctctcgctcactgactgactgtaataccagagatcgaacaacttggtcctgcagctcaagaagagagtttttgtgcatgtatgtgtgcttcggttgggtttttctttcagtactgtcgttgtcagattatatattgagatccttttgtttgcttgatactacggttggttttgctgctgctcttcctggatctctgactgactgactgacctcagttgggggccgggggcaagagagagagagagagcc

SEQ ID NO: 9315 - DNA, 139 bp, Zea mays
tagtttcatttgccaggttcttgggtaattgggttcaaacatatttcctgtagcgttttggtccgaatttcttgaattttgaatttaaaactcttatgctttaaattttgattattacagctatcactgctctgagaaa

SEQ ID NO: 9316 - DNA, 268 bp, Zea mays
tcccgcgagagtgcagagtgagcagtgatgtgtcgacgtgcgtccgccattggggataagaagggaggcgacgagacgttttcagcccatttgtaaaggcccataaaaggaaaaggcctagcccatgagccgctcaacggcctaaccgccacggagccctccgacaaggcaagcacccaaccgccgccggagcccggagcaaaaccatctccaaaaaccctagctcccatcccctcgctgggaagtctcgtcgtcgtcggcggcggag

SEQ ID NO: 9317 - DNA, 1361 bp, Zea mays
catacttattggccatctatagttgattcaagaaaaattgagggttttttacaaaattacaatggacacacgaaaaagctcgttatttaggctatcttcatcaacttacacatttctatacctatattcaaactaatcactatgtggatagtatattctatagtgtataactgctgcagacgaccttatattagtaaagataaagatcaacagctgcaccatttaaatattttcacgttgaacagcaacaaaatattttatgaatcattagccaagttaattatttaaaataattactattgtatcttaataatttttgcaaaataaataatgaaccaaatttcgggtcgggtttgggtcactcgcgagttgaaatagaaacatgcacccatacccgcgaaacatcgggtcaggtgcgagttgcacccgcgggtcaaaatcttcactcatatccgcacccagcgggtcggttatccgtcgggtttcgggtttgtgggttaaaattgtcattgctattggagataccactcaagcactcagcacaagatcatagacattgaaacctgaaccatccaaatggcctataatttatactctcatacacatcgagtatttaattgtttgtggagactatgaaacaacacatgatactatgcattatgacaattatgtcttctatagtaacatatgatgtgccaattttaaatattgtgataagaaataattggttgcaaatagaattttaagtgtcagtatttaacaagaaaagagctgcttatttatgtgcactccaacaaactatattggatacaagcaaatacatcagtactggattgttaatcatcaattggggcagaacgtccaattatcatcgaaaaagacacccaccattccaccaagagctgcgccatttgattccgctggctttcgttccacggaacgctgtgtactccgctcccggttgtcaacgacattatcgatcgtcaccatcgaccttctcatgtaccaagattattttggcttatggcatgttacaaggtacaagaaaagacatccagtccgccataaaccgcaaacgggaacatgcgtccgctgcagctagcaatcttgttcgctagttcaaacccatccagatcggcatccccacaatccccatctcaacctcacatgcatatgctaactactagttgattacagcgccatcgcgctctgttccggccacctataaatactgcaaccgaacgccgtctgcaaccatcacaagcacttattagcgatcgaggcatcgcaagcagagctcctcacgaagctcagtctgctttgtgccttgtggtcaaggaggacactgctgtgcagcaata

SEQ ID NO: 9318 - DNA, 1500 bp, Zea mays
taattaatgaatatatgattagtctaacgaattatattttaggaccgagggagtaattagtaatatagctaggatgaggaatgggaacattccactaaatttaaacaaatgaactcatcatcacctcatctagaataggttgattccccaaaaccaaattcatagatgtaccaaatgacacccctgtttgccatagagaaggcaccaagttcatcttagatcaagcaaggtgttcttcagaaggccaactaactctgcatctgctgcacaaactgatgtttactccgacaggcaatcacatcagagattcatgaagcttttaccatcactactgatttatcagcttcacctagctgttcacaaggccaagtagaatttcactatctaacgtcaaccaggcagtgatactgcatcaaagctacgagttatcagatccgtacttcctaccctcagaccaccagaccagatctcacagcaatataactagaactccactaagaaaatcaaatccagcaaaaattcaagttcatatagtcaagccacagcagatcgacccttaaattccatttcggtgccaacttcgctttccatttccgacttgaccgtgcacgatgcgtatttagattttagagtccaaccaagcaccgatcaaagatccacaagcggagatctcacggtaccagatcagttcacatatctgcactgcagtcaagagcagcagttcaaccactagttaaatcaggtttaaggtggattactagcgaatttcagtgttcgttcgttagttcctttccctcccgtttggatcgagcagcgttctattgcatcgacctccatgcccgtcatttgcatctcacggtaccagatcagttccactaaaagcgccgccgcatgcatacagatcagctcttgacctgtcctcaccagtccatgcggagcacgagcctcgcgagcgcggggcaccgcgccatgagcgcaccgacggaactgacaccggcggcgcaaaggcgaacctcctcggcggccctccagacgcggcgcgcgcactcgtgccagccgcggctgaccccggccgcggccgccacggagcgtggggacaggcgccgtagcacctcgaccaacacaaccccgggcgcccgccggcccgcgccaacctcgacccaccgctccgccggcgggtcgttgtcgccgtcgccgtcctcctccacgtccaccgccttcttcgaccccgcctgcagcggcggcgccgagaccgccagtggcacggcgtccagcaccacggccgacgccgccgggtcgtcgaaatgcagcgcgcgccgcggcttggtctgtggctgcggctcccccgctttgtcgccgcccccagcggcggcggaggaggcgggacccgggacggagcagacgtggcccttcttgggcagcccgcaccgaccgcagttgtagcttccgcgacgcttggcgggcacgggctgcgccggggcgtcggtggcgtcagaggcc

SEQ ID NO: 9319 - DNA, 1150 bp, Zea mays
tctatggtatgttcttgtaagaagaacgacaacgactaattgtgtattgacgattcagtgaattgtagatcatcagtgtgccgagagtggagtcaccctggtgcttccttgattgccaaggatcattctaggtaggggaaaccatgttgctggctgcatgacactaaccaaatatttgcaagcacgcatgtaatgtgtgtttctttggtgtccccattatactcatatttctagagaytgaatgtcacttagtagttatgcatgcttcgtgaattacagactgcaracttgmtgttatctctttattcaacttttgttatagaggcttgacatggttttaacaaggtgcgttcacattctctattttttacttttattttcattagcwaggtaggaatatatgtttgaaattggcaatttgcagtatttggtaggtactaaagtaactgggcttatgaataaaaaatggattaggtcttgcatagaaaatggagtaaaaaaattgcaataaaaaaacataagccggtaatacataacaaacacaatgcgcccctgcaacgtgcagtggcccgtcaaaaccaatacaacatgtcctcatcaattgagcagagtatacatagcttattatatgaatctaggatttacaattcacttgcctcataacaaaaagaaagggtcactgaggcacatataccttttacctgatcaactatccacgaaagaatcatttttatataactgaattttgtgttgtattttctactttgtagtgatgacagagggaaaacaatactaggattagagatcctaagctactaactgatcttataaaatatcagtctgtgtacatttgtctcagtgttgctgaattttgcttaacttggcatccagaaactggtccgtcccttcttatattaggccaactattttcaactcaactctgaatgaagctttagaggcgggaacacaagcacaaactactgtccagattgatgaggagccaggttctgatgaagacgacgatcttccaccacttgaagcaaacaccaacaggaatagaccatatgaactaatttctcgacggaataactaattgaattttttgtccagtgcaagatattagttgtgtaacaaattgttaaattctcac

SEQ ID NO: 9320 - DNA, 133 bp, Zea mays
cggcttccgccgcctcctaaccctagaatcttcgagaagcacccggcgaagagcgcgctgccacggcgctttccggaaacttcttggagagagagagagagagagagacggccccgcagcggcggaggcggag

SEQ ID NO: 9321 - DNA, 559 bp, Zea mays
cacataaacgattttaaaatgaatccaaacggatctcccaccctgaaaagcaccctcttgcctttctttcctttctttcatacaagaactactcataccaaggactaaatcaccaataacatgtttatttggctttaatctatactaatttctactatttctacaatgttttatgtctatataaattattataactacaacagccgactttaatacgaatagaagagtcttttaatccaaaaagagaaaaccagattaaaaacctcttttaacccaaccaaaaaagaggaagcccgattaaaaaaaataaccagagcgagggaaacgaaaattaaaaagaaaggctcccccttccacgaacaaacacttggacctccttgtccccacctccgtccttgtcgatcccaaccacccccagcgctcctcctcgccggcgggcttgctgggtctcgcgatcgtcctcctcctcggctgtgccttctggggcggcggcggcaggaattaggtaagtggaggcaagggaaggggaggtttgaggtagagcggagccgcagcggcg

SEQ ID NO: 9322 - DNA, 241 bp, Zea mays
ccaaactagcctaaaattgcaggcacaaatatggagacggtcgcggacggatttattcgatagactttatgagtaggatccgacttttactcaacgatccgttgccgtctctatccacagccaagcctttttattggatagtaaaccctagtcgtcgaggtacagaaaccgatctccatcggggtctatctactactagatttctgcctcgtcgccgaaactatagatcgatctaggtacc

SEQ ID NO: 9323 - DNA, 1316 bp, Zea mays
ctttattattattattaagtaatgaaatcatatcataggacatgtcattctctatcattttagttttgtattgattgttaaaaaattatgatatattagcaagggcaaagctaggttactaaccgtgaatgcaaatacacccaaaaaatgcaattcctgtagatttagttaaaatttcatcataaatatgcacccttagaccatctccatcagcttacaaatacttgtacccatattcaagttacactctataaaaaatacaatctacatcgcaaaatgtgtttttgtgaccatatgagtgaactactgtacattgcacctatatggccattagaaacaccgttttacatcgttttatattgtaaattgcactgtttatagagtgtagtttgaatatgggtatgtgtataggtaaactgctggagatggtcttagaaaacattcttatgcatccacaaggctaaatgcaccctactcaattttgctctggctttgccattgtatattagaacgtgtccagcagattacccatatgaatacccaaaacactgtttttgcattatagactgtactgttcgcatagtgaagtttgaaatagaagatataatgagtgctagaatagataagttgtcgtaaatagtcttaagatcgatgataatatatatgttgttcatttttatttaattgttttgtcctaacattatactyacactgttctaaattaaaatttgttttaactaattaatagattgatacaatacttaatatgtatattttatatgtgcgtctagatttatcatcgtatatttgaataatgataaaaaatccaaagctaaaaccaatagtattttagaacggggaagtattaaataattgatgggttgttgcaatttaccagcattgyctatatataaacccggtcgcccctaggctgctgtggctcgccgtctcagttctcatgtccgggtgaagaaaagaaaaatcctcctgttcctgactatcgctacccctccacatccaggtatgtcgccccctccctcggtcgctccgcgttgttagagacgaccatacgttaggttttcccggaatactatttcgaatcggttagaatcgtataatttcccccaaaaagtccctagttaggctattgatcaccctaaatatcttcgttgatccgattaaatcgtataaccctccccggaaatattcgtttattgatccacccgtccgcaataactgtcgattgctgtggatctagttctgcttttgtggtaatacttctcctttacttcccgaatctgcaccgagcagtggcc

SEQ ID NO: 9324 - DNA, 47 bp, Zea mays
ggtgagatgctcagggcgggaagagcaaggcattctttgcaagaaca

SEQ ID NO: 9325 - DNA, 1500 bp, Zea mays
gcaaccaactcaggtgtgaccgtgtgagtgtgactgtgtgagtgtgagtggaagtggtccaaccgtcgaaggcctctggtctccggcaacgcaccagtggtggcactccatgcccagctgatgcggctgctggtctggggaaagtggacgtaccttttcggttttcgccatgtagcttctgtgagtagtgccatattctgaataatatgcagagctaattatgcacccctccatattattgcactgcaacaaagctgaacgagaagggaaaaaaacgtagcttgattaggaactagcttctttttattgccgtttaggatctggtaacttgcaataccttgtagtctaacattaggccattagctatattggattgtcttagtgatgatgctgtgtgcgggtctgttaaggtaggtcaccatggaaaactgaaaccaaacaccagtaatgggtccttttttacgtgggctatttgccactcgaatctccaagaatatcccgatgtttggactgggaaaaaaaaaatctcgtattaagcagcactgcgctaggtgcgacacatagggaggataaaagctggatagtttggagttagtataaataagtggcacatagggagggagattcagatttatggacccaagcgcttagcttttggttctagctgtgattgagaggttctgcatctctggagcatcaggttctagatgcctagctttatgcaatggccacgcttccttagtcgagtctgaatctccttccccccgtccacttcttctttacaccgactcgaaaccttccagctttatcttctgagttcggactgtcattatctagcattgtgtgctgaaagccatgattattgtcgagttctaacattgggagactgttgcagattcgaaattttctagctcagcaccataaaagggcagacccagtgtcggaggatctcacatgagtggattctgggtaagggataaaccaagggaaagtctttcccccacaaatgcggagaggctgttttgaacccgtgacctggtgagtggtgacccagtgagacaactgttaccactacaccaggcagctcagcaccataccatgtcaatttcttatttcgtcaatagttcaatttcttagggaaggccatcgagtggagttgtatttactgtgtttcactgttacacacttttggaagatcgactcttgcctttgccagttgtggaaatgaaaacataatttatgggaatagttttgttccttctactaaatcaaaaatattaatatctccaacttctactcaaaattccttcaggaatgaacctgatttgttgctttgtgacccacaggtacttcttgcgggtgtaagcatttcgctgcacttggagacgcttatttggagtatttgaagtatgagttggctctctgtcctgtcagttatgtgcctgtgcttcataaaaaagagctacattttcttctactagggctttggagactgcccag

SEQ ID NO: 9326 - DNA, 362 bp, Zea mays
cgccgcggcgccgtgcaattatctcaaaaaccaaacggatgagctccacccgacggtcgcccaagctgaaatcagcaataagcagtcactgacgatgggcctaaggccttgtgtcccagcttgacggcgtgacaggcagcaaacggccgcccccttctccttccctccacccctcttcgtctcgtctcggcctctttccttcctctgttcctcatcttcgtctcggcctcacccccgacgaccccgcaccgatccctccacgcgctcgcgcgcagcacgggcggagttgggcgaactccgtgctcgttcaacccgtactctagtacctccagggttcgggtcgggtctgccttcctcttcgt

SEQ ID NO: 9327 - DNA, 64 bp, Zea mays
cgacttcattatcgtcccagcaggtttgagccatgtggtctcattcagctgcaagggatgagat

SEQ ID NO: 9328 - DNA, 231 bp, Zea mays
tgccaatctccgccctaactggaattacaagcccaagcgcagctgcgcagaccaaaggccctgtacgtccaatagggccagatgggtcttggtcgtctcacactgttcggcccagaccacatagtgcccttaactccccagcaaccagcagcagcaaaaatcttcacgatttagaaaccctcacctcttcccttcctccccgccgccgccaccgccggaaggagaaaaaaa

SEQ ID NO: 9329 - DNA, 1500 bp, Zea mays
atcgattgttggtgtttcaatcggccgtagccctccatatatatagagagagaggttcggacccgttacaaaccgtctcccaagctaattccacggatttagctaacaaatcccgcaagaaatttagaactctaactggctctgcgcgcgcgaayggttcgtgccataayggtgaaccatccagaccgcggagtgtccgcatgatcaatttggtgctcaacaatacttaggtcaatttggtgctcaacgatactaagatcaatttggttytcaacgataccaagcgaggagaaggtgggctgctagcatgccgacatgcatgctgctagcgcgacacacactcgccatggaggtaacaagacaacatcagaattaataatattattagtcgaataaaagcaaagttttttatattctttatagtttttgagattttgattgtctaactgcctatttaattagatgatcaaatataaatatatatatatatatatttatttgtgtctagaaaaatagagattgaagatatactctctatagcacgagttataaaaaaatctactcaacataaaagtataaacatatttttattcaaaattaatttttagataatgatttagaaagtatagactctytgttccgaacctttatagccaattgttatctcaaataagttgttaattgattttaactgggtcagagcaactaccaaatgtttaagaggcataactatgaattagctcgtacattagctgatctgctaaaaaatagctaattttagctcctaatcagtactataaattttagaggtttggaagagacaaaatttagaatgaatgcaggccgggctaaaagtctcatcttgagccccactgacagtattaataaatacctgataaatgcgatgtgccgtagagaattcagcgaattggtcagcaacacctcagcattgagcatgcggcaacgaaatcgtagtcatgtaaacatttccgtaatactcgctgttgcctgttgctcatggtcactaacctccatcatcatcacgccataactcatgggttgctgctgatagttacaggaaagtgcagggcaaaagctgggtgaagttgaagaaatgcaaaaagtccagacaccaaaatacgtattgctgcggagcaaatggaatcgtagtggacaaacggaattgctggccggcagctagtctgccactcgatccatcggcggacggcggcagtggccagtgggcagcggcaaagacgcgaatcaaccgagctggtctccctcgcccctgaagcaaagcaacctactccgcgctcgctcctccacttgctcccctcctcttccgtgctcgtcccgtccaccgccccctccccctccgcttacgccacacccagcccaatcaactcgccgcggaccgcgcccatgccctcatctccctgctcctcccaaaattgaccacccaatcaatcggctcctagtcctcacccccgacccgttccc

SEQ ID NO: 9330 - DNA, 179 bp, Zea mays
tgtgagtgatcctatttcaacttcagtcttgacatccatgctgtagtgcttttttggcgtgtgattgagtgacaaaattttccggttatctaattgatgtgtcatatttttcttctgtactgttaggtttgttaatgcatcacggcaactggcaaaaaatctagagcatcacaccttaa

SEQ ID NO: 9331 - DNA, 1500 bp, Zea mays
atgataacaatgtgtagctaaaagatagtgaactgttttagtttatctccctatagttctgccgacctatcctcgcatggctccgttgcatgggggctccagcgcgggaaagtcggatctctgttgtggtcgctcgctcgacgttgtgggccgtccgggcttgcactaatccggcctcatgtcgatctgctttgctgattgtccctccccaggcccacgaaagaatgaccttacgatttattgggcccttgggcctttcgtgaggtcttttacttcttctagtggacccgggggatatctgtcccccacaagcccccgatctttgggttaattttgaggtaatcagcccaaagatcccaggtccagcttgcaggtaatttggggaaaacgatttcttactgtttcctcctgctttgatcactcgtaaactgaagctttgtttcgtgcttatgccttagaggtcagcatttcatcttgtaggaccctgaacttcatcgggtgcaccggaggtgcacccaatgggtgtagcccccgagcttcgagtagattttggaaaataatctactcgaaggtcttcatcagaaattactttcatcttactcttgtactttggttgagggccagccttgtctttaatcttgttctatgccttagaagtcggcactatcttggctttgaaatggtatttcatggggtgcactgaaggtgcacccaatggggtgtagcccccgaccttcaagtggatttttgaggataatccattcgaaggtcttcctttggtgtctttttgttgaagattatcctttctgcctgtgaaaatcggcatgatggcatccgcattatgctttagaggtcagcattatgtcatcaatattatgcttcagaggtcagcatgtattttgtcttttgcagccgagttcgtgatccgcccatatcttgctaggtggtgcaatttatttgctctgcaactgattggacatttgatggacgttcccgggctagtcttcacgtcgcttctgtcggtcagattttgtacttccctggctatatttggctttcctctgatccttactgatatctcatttttgtcttgaggtattcattgcatgccctgcacggatgtgacagttttgaaaaatatactgataattcctgggcgtcccccccaatgggtgtgggcaagggacggcttggtacgctgagtgttttagccggctgcttctgagtagtaatgtgatgcgacggcgggcgtaatcatatcatccatgctgttgactggagtcccaatgggtgttgcgttgcgtgaaacggcatcaaccgcctgacgtgtcttcagacgggttgaagtgtgtattgaatgcttcgcgactgttcagtgaccgtggttggaggtgagcggttgccttcttcttctataaatagtgcctttgcctctctggttttttcacatctcttgatgttctccgctgcttgctttcttcctctccttgcatttccacc

SEQ ID NO: 9332 - DNA, 668 bp, Zea mays
tgcagtgtttgtagagtgaagtttgaatatatatggaggtgtggatgagtaaggtactagagattgtcttagtactatatgcaatgcatatgaatctaaactacttagtagcactaggcagctgaccaagttgtccggtgctatttgcacgtcgcatggtagataatattttgtataccattaaggcattaataacttgtagcgttacggatctcgatccaactgaaatcaatcactaccgtacgaaccatgactgtttcttcctcgagtaccaacaaaccatgcagagatcgaggttcgctgaacagtagctagtgcatatgagtaaatctcaaggaacgtaacgtcgtcgtcaacttgtgcatgtcaactcgcaacatgttgcaagatgcgttgggtgaagtctcaaatgcactatatttcttataatatgaactagctagggctcctaaatgctaaataaaggtcgaccgatccatctgcaagctcggtgcctatatataaagcaccgaaatgacccgatccatcatccatgtcatgacgatactgcaggctccaattgtcagctgaactgtgtttgcccatcttcattatacattctgtctcaaatctacttgtcgacatagactcaataagcttgcttattagtacgtccaagaacgacgtac

SEQ ID NO: 9333 - DNA, 934 bp, Zea mays
ggcgcgagtgagggggcgacgaggacgcgggggaggaggaggttaggggcggcaagatcactgtgatagaggggaagagaggggaagagatgatagatgatctaaataatattgtttattggatttgagtaagagaggagttatctagcaatccaaatcattggttttaatgatgcgttaagtctaagtgtaaattattatgagtgtgagttgaattggttatgtgagttttgcaaaatatatatatatatatgataaaagtctttggattataagttagaagttttagtgaaatagtttatgaaaaaaaatctaattagactttttcttttttgcaaggtaactggcaactatgtcccacgtataaccttgtgttccttccatttgttaggtcgtcttgtgtttatcgttgtgaataattttgaaaattttaatttcgttgatgaaataaataggaggccttacagtagggaacataaaattatacagtatacaacatatgtataattacttatataataataaaaaaggaaaaagaaacgaggggaaaaaatctgttcacctccttcccctggaccgcgtgggtaaacaagaaagtgatgaaatacgacgttgggagatgtcgtaggagacgaagattctattcgcctccctttctcgcccctcctctgctactagcctactactacttcagttctcgccttctctttctgccctcacctgactcctcccttcctgccatttctctctcgatagtcgataccaccacacctccgctcccctccaagcctctcctttttccaccctcggaggcgccgacgtcctccgacttccagggcggcgccgagcaacaactactacctggtcacccagccaaaaggggattccttttcggtgcgctctccgatcgattgatgagcggcgggcggcagcg

SEQ ID NO: 9334 - DNA, 865 bp, Zea mays
acaattgtccagcctgcgtcctgccccagtatttgccgtaccatgtcctacatctcctatctagtactacgcggagtctaaggctagagacggagccagaaaaaagtttaggagcgactgaacttaattgctgcagtataaaagctcattctacattatattatatatattttatattagaggaggctataatgtgactctatgggatccgaagcggtagggggctcgagtcccgcccgctccaccgctagatccgtccctgtctaaggctatgttagtgtaaaattgagaacacagaactgtagatgacactgtttaacattatctgtagagtgggtttgaaatataggagacatagaaaataggattggrggtgtgttggagatagccaaaagcactagagaagtgcagtcccaacagcgacgacaggtttggctggctggatgacatttttcaaaagcgctgaaacccatacacacactagactgcagccctcttcagtctagctagtctgtctctctccagtctccactctccactacactactgcagcatgcttgctactcattcagtgtatatatatatactagtatatccttggagcatgcactcgctgttggctgttgccctggccggccggcgtttataaaaaaaaaaaggatgcaggcagcaggcttgttgaatcgaatgatgtgagcacttgccggtgtttatatactagcgcatgcatgtatatatgcatgccactcgcgagctatatcatttaggggctgagcaggcgtggtcgtccgtcccctcgtcgctgaatctgatgcacatatatactaccactaccaaggtgcaggtgcaggcgcagggtgatcat

SEQ ID NO: 9335 - DNA, 710 bp, Zea mays
gataaaacccagatgaatacctttcctgatagatgaaacccctaatgagattagtgttagtctttgagtatatttgtcagtgcctcaatggctaacatataattgcaattcatttgtctagcaatattttaggatgctctgctgatgcttcctcatgttgtttttgtttttttatgccatggaaaaagcaaagttaattagagcctgagtgcatatgtcactctattgttctcttctacgagattatatgctgacttcccatgcctgtggaatgagaacattgtttgttttgcaggttatgtaaggaaaattacttatcgtgaggacattcaaaagatagacgagctagacagtggcaaactaccgtagtttagaatggaaaagattcgagagcaacttgaaggccatatcaagaactatagggtatcatttagaatggaaccttacattttcaaatgcttggccaactatcttagaatgggaggattggttaaagatatacaagaatcaaagttgaggaaaaacatgggttcttcctatacatgattagccacaagcccacaatacgacatttgaggatctccaagtcttttttggtcatagcaatgatacgtttcatcgtgtcatcaaacatttcttcgacattgttatccttggcattagcatgcggttcctaaagcctccttccaatcaagttcatccaaaaaatc

SEQ ID NO: 9336 - DNA, 412 bp, Zea mays
cttgcatgcctgcagataatatataagggtttgagtcaatgaatgccttggtggcattgctttcccctgggatctggcaacatttgctgtttcatgtgaacaatttgttatctttactagataggaagcatcatgttactagcctactcactgtctcaatcaagctttcatgtttcagtggcttgtagtttcctatcctttttttccaatggaagtgtgtagctgaaagtatgttaaccaactgcttcttgtttcaggtatgccataacaaaagccttttgcattgctttcgtcatgaccttcttctctgtattcgatgttcctgtcttctggccaatacttctctgttactggattgtgctctttgtcctgacaatgaagcgacaaattatgcatatggtcaagtacaagt

SEQ ID NO: 9337 - DNA, 154 bp, Zea mays
cgagacacacttacaccgaatccagcgaggagccgaggactgtcatttcgtctggacctagttctgaccgaacccaaccgttcccacttcccacaccgtctgcggtctgcctgaccgaaaccgaaccccccagcctacaccacccgctgtcctg

SEQ ID NO: 9338 - DNA, 785 bp, Zea mays
ctgctcaccctggcccctgctacacagtttgccttgcaccacggcattgccttgctccacccacaagaatccttgctccgaaggtaacgggacgggggcttggggcctgtggcctgtgcctgtccttccgccgcgagacggaacaaacctcacccatccattaccaactcacgcgcttcaaaaccatcacgaacattaaccttaaagccttgttcggttacaaatgaataaatctcatcatagatttaatctagatctggattgggtgaatccatatgtaacactcaatcacatggtgagattaaatccactatttaataacatatctatcaaagttagctattcttttgatccatggattttaatatgaacttatgcaatatctttatgaattgtttcatacctaataagctatggatagaatccatgtcttctataatttagttttttttaaatctttagattataatctatgatggatttaaccaaataaaaaaaattctcaacgcgctcgagaaccgtcacgaacctaagccagcaagctcccattggccgggctggtgccaggtcggcgccgcgtggcgaacctcgtcccgaccctatcgcgttatcgccaccgcctcccggacgaatgaaaactcctgccgcgcctcgccttcccaccccaccccacccccacgcgaagaggaagaggaagaacccagccaaatcctcagtcctcaggctgctcacagttcgtgctatccgctcgcgctcccggtagtctgcctgctcggcaattcggc

SEQ ID NO: 9339 - DNA, 497 bp, Zea mays
gactacccgcagcggcaaccgcgagccgcccctcccctttccctgtgcacgcgtatgtgcgctctacgggtgcaacggtcgacgctaaaatgcccctacacgaaacaatggtagtgtgagtgtttgaagtcagctagatcaaggggagtgatgtagcacccttcacttgcagagtgctactcattatttaatagtagaataaaaatggtaataaataatgaatagagttggataatgatattttagaattgtagtggggtatagtatagggaaagaatatatagggaactgctgtggggcatgaaaaaatataggtaaaatctagctgatttggcacaaaagtgagatatagtgagataaatttaggtgaatcctgcggatagcctgacggctcgtttgaccttcgtctgtcgtctcgtctcgtccacctccccagcggcgcgtgaagcttgaggcaatccccgccctctctagccctgcgcaaccagttcggttcc

SEQ ID NO: 9340 - DNA, 306 bp, Zea mays
aatgagaataaatttgtcccattaaattaaacggtgctgaaacggggaatggatttggaaagaatcctgaatcagtgcagaaagaatcctgaatggacgaacgacggtatatgcccatggcaacggtgacgcgatgcccgtcccgttcccatccttgagaaccgagcggacgccgagctgcaagtaactgcaccgactttcaaccggaagagccgagccgaaccaaagtcgcctcttcttctccaacctcccctcgcctcttgactaggccagggttccatcccaaccccgccgccatccgatccg

SEQ ID NO: 9341 - DNA, 276 bp, Zea mays
ttgcttgtattaacgtgttaatgttgtaatttctcatgcttttatgtcctgtatgcagccaatatgccgttaacaaaacaccttagagtcgccagcgctggagtcaagaagttacctgggcaaaaacagtatacccgattctagggtcagcaccgttacccctgcaaccatttccttcttcgagggtatgattctgaatcaactatgtgcatcgtcatacttaatttcagttgtatttcaactgtcaatggtatttggatttaagtttgagcttgt

SEQ ID NO: 9342 - DNA, 248 bp, Zea mays
tacgattgtaaatttaatatacaacgaaggagaaatgaaatattataatgtttgagatgagttaacgtgtttaacttatttacatccttgtacatcaattttatatattgttgtgtgatctgtttgattaaaagctcaaccctgatgaatcccctaatgatttttatcaaaatcattaagttaaggtagatacacatcttgtcatatgatcaaatggtttcgccaaaaatcaataatcagacaacaaa

SEQ ID NO: 9343 - DNA, 1038 bp, Zea mays
tatctttggaactgacgaaaatatgtccttaaatccgaagcttagaagctcagaaaacttaagaaacaaagcaactgttggaaagcaagagctaagaaatcaagcaaagcaaagtaagcgtatcaaatgtgctcggggtgagttcttatttatacgcccaacgcgctccatgttggagggccccggctgtcattgactattgctattctagcaaagggaaggtgttttttcggaccttcggcttaaggccttcgtccatatcgcaatctgaattcattattctaacaaattaaccttgcgaggggctactgttgggggccttcgtcttccgaaggtcctcaaaaacatgatttaacaacgtttctggagtataatacatgaacaggtaccttgcggactcggattagaaccacaatatgaagaggtacaaagaatgcgaaggttggcgcagagccgaagctgtgcgtaggggaccttcgacgtgacatcagaaaagggaatcgacttaaaagggaaaaggctattcagaccttgatggattactatagtcattagcaaatgtaaagggcatgagtgtaattttacatgggctgcgtcccgtgcctataaatagatgaacagtgccctcgtactgttcacgctgatttgtcatcctgcttttgcgttgcgcttgtacttttaccttctttcaagtcgaaggtacatttgtaatttgatatcatttctatttttccataatgataaaatagaaatgagttgataataatacataattgttatgttatcgtttatatttcatatgattctctcttcattattatatattgcgcttatgaaggaatgtccttcataacctttcgatctgaaaatcattatatcccaagggaaataatgctttgaacgacgaaggactttaacgtttaacattttttgtgttgccttgttcctaacccatagtatttaagaacaagtccccaacattggcgcccacctccggtaaactcattcgaccaccttcggcaagcatcgaccttcgtc

SEQ ID NO: 9344 - DNA, 1041 bp, Zea mays
tgacgaaggtcgatgcttgccgaaggtggtcgaatgagtttaccggaggtgggcgccaatgttggggacttgttcttaaatactatgggttaggaacaaggcaacacaaaaaatgttaaacgttaaagtccttcgtcgttcaaagcattatttcccttgggatataatgattttcagatcgaaaggttatgaaggacattccttcataagcgcaatatataataatgaagagagaatcatatgaaatataaacgataacataacaattatgtattattatcaactcatttctattttatcattatggaaaaatagaaatgatatcaaattacaaatgtaccttcgacttgaaagaaggtaaaagtacaagcgcaacgcaaaagcaggatgacaaatcagcgtgaacagtacgagggcactgttcatctatttataggcacgggacgcagcccatgtaaaattacactcatgccctttacatttgctaatgactatagtaatccatcaaggtctgaatagccttttcccttttaagtcgattcccttttctgatgtcacgtcgaaggtcccctacgcacagcttcggctctgcgccaaccttcgcattctttgtacctcttcatattgtggttctaatccgagtccgcaaggtacctgttcatgtattatactccagaaacgttgttaaatcatgtttttgaggaccttcggaagacgaaggcccccaacagtagcccctcgcaaggttaatttgttagaataatgaattcagattgcgatatggacgaaggccttaagccgaaggtccgaaaaaacaccttccctttgctagaatagcaatagtcaatgacagccggggccctccaacatggagcgcgttgggcgtataaataagaactcaccccgagcacatttgatacgcttactttgctttgcttgatttcttagctcttgctttccaacagttgctttgtttcttaagttttctgagcttctaagcttcggatttaaggacatattttcgtcagttccaaagataag

SEQ ID NO: 9345 - DNA, 488 bp, Zea mays
agacaatcaataaaaaattttgagatgtttttggtggatagtttacgtgggtattattgtaagccgttgcaacgcatggacaaccaactagtttatcattaaaattaagttgggccaaaacactctacggggcatgtatgacatcggtttttttttctaccgacgtccggagaatttcattagcaatcggtggccacagagagttaactaaaaataattcagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaaaagaggagcgaagcg

SEQ ID NO: 9346 - DNA, 477 bp, Zea mays
tcttcccctttccgtctctctcgctggctttcttttccctcttttcgccgctaaaaccccagctcgtggaaacagggggaggcggcacgagaagaagcgaggcggaccaagggcgaacgggaaagaaaggagagaggaaggccttaacgggccgtttgtgaggataccagcccaaatttgagaggaggggagcctggtccaagtcgccgcgaaaacgacctcatcgaatcgcttggcgatgaggcaaatcgccgagagcccgagacgaataaaccgatgcgacgcgtcttcaatccacctgtccgtgatccgctcacctagaacctactagaaggcgaaccaacccgcacattcacttctcttcccatccgtacgaactcgcagatcagagagaccgaggcgcccgcggttctgctttccttccttgccccgttcacgagagaattttctggagtcttcgactcgagcagggttccg

SEQ ID NO: 9347 - DNA, 477 bp, Zea mays
tcggaaccctgctcgagtcgaagactccagaaaattctctcgtgaacggggcaaggaaggaaagcagaaccgcgggcgcctcggtctctctgatctgcgagttcgtacggatgggaagagaagtgaatgtgcgggttggttcgccttctagtaggttctaggtgagcggatcacggacaggtggattgaagacgcgtcgcatcggtttattcgtctcgggctctcggcgatttgcctcatcgccaagcgattcgatgaggtcgttttcgcggcgacttggaccaggctcccctcctctcaaatttgggctggtatcctcacaaacggcccgttaaggccttcctctctcctttctttcccgttcgcccttggtccgcctcgcttcttctcgtgccgcctccccctgtttccacgagctggggttttagcggcgaaaagagggaaaagaaagccagcgagagagacggaaaggggaag

SEQ ID NO: 9348 - DNA, 1500 bp, Zea mays
cgacatcacctaaacgacttggtagcgaccgagagtttagtgatcacctgttgaagattgtggatggtctaactaatgcttaaaygactacggggtaattcatcgtrctggagtgacgaagaatgaatctatacttgatccttacgcagatcaagaaagagtctcacccttgtgtggatgctccaacgaggactactaatttagtctctaaattgccaaatacgaaaattaaaactctattttattttctgtatttggcaactcagtgactaaaatgaaataaaatagatggactaaaaattagtccctagaaaccaaacaactccttagtctatttttccatcaaacgtagatggcctttaaaaaagatgcaaccttctttagccttatagaaatattccctctatcctaatatataaagcgtaaccacgatctgattcaaatataaaaaaataaatttaattctctctatcaacactaatactactgcattgatttacgtatgtctagatatagcatgctttataatatgatactagaataaaatatgataggactggcggagggcagtaacttatagtaatgtaaagtaaggagcaaattgtgcggggttcgacacatggaattgcttcgtggtcccaattagaaaacatgaaaaatatcctggtgtccctccaaaagcagaagggaaactcgagtgtttgaacaagcatgggatggaatcgattggcacacggcgacttggcgaggaaacgttagccatccattgtgcgaaaagctcgcaatcgcaatgcgccagattctcgagtaacgaaatcgcggatccacattcgccgtggaccaccgcatacaatggttggttcccgtgtacgccgtcgatacagcagagcacgtggacgtggatctgattggacttggttggtggtgcacccgaccgatgttgcgtcgacgagacatcctcgcacgacggggaatccgccgctctggcaagccactctgtcatgtgcctcttggatcctgcgatccgccgctggagcgtaaccaccgcgtccacatgctgcttcattggtgccggcgcggaggctgcttagctcgccgccgagggactactttgcccgccacggttacggcgtgatgcggaggggtggtgacgtcactcaccgccacggcgatgacgcgaggggatatcagtcatcagtccacccaacgaccgcggggggtcaacctcttctcggtcgtcgtcgcgtcgtcacggctgacgccacgggcccgctgcctgccggaacgcccacgccgagccacggcgcagtcaccaccagacatcaagttacgcgtccggcttcccggccgctataaagagcgcgcgacggcggcccctgggagagccatgcgagactggaggcggaaccgcgcacgacaccaagctgccgcgccggactgctgcacgcaagcgcagcgcaggaccgaccgacctccgtaggcacgcacggcgccggcggc

SEQ ID NO: 9349 - DNA, 1500 bp, Zea mays
cccgtcgatgaagtctttctgttgtttatttatatttatatgccggcccacggtggctgccaaggaatacaagtgcacggtttaccccagtttaatccaagttgaggtgagacgttctcacttgtcggttctcacaaaaaaatgcagattttttttttataaaaaaggtaaacccgttccaaacctttaaatctagtggttagtggataaaattagctaatatgtttagaacgaatcaactcatgaatcaactaattgttagttataccctttaaatagttattactttttacgtcccataatataaggtgtaactattttttattctagtcacataggagtgtgtgcaatctcatttaacatggagtctcttaaagggtttttaagaggttagatgaaaaaaaatacaaaagagtttgtctttacacaactcgacatgcatatcgtctcttaacggcatttatggtctagaggcttatggttgtatcacagagtttcttgtacttgaaaaccgaaccagcgtcttagggttgtatatgccctaatatatgctctctgtctatctctaggcacacgtacatcgatatagcactactagtgttgatagagaattagagagaattaaatacaaatcttgatcttctaaccagaggtgattatgccttaaataccggaacagatggagtagttgttagttgcctcaactcaactaaaataactgactaacaaatagctctagaggtttgatcgatactagcttgcacaaggttaatgcggattcatttccaatacatagaacccgaaataaatttacttctgcatcacacactatccaattagccttgatgaagaactttatacagtgtcttcttatcatgtgtgcgaaaaaaatatattgatattttatttagaacatgtatatgatgacaaaataaggtactagataaaaattgcagtggtgtatataaagaatcttctctttgtttatctacagtcagcatgtgcctattacataagctgtacttttgacctcttataatactagtacttggcagccacggcagctgcatagctaaccactccctccgtgcatcatgtaatttaacgaaagagtatcaatatctgagtcacgaaatagatctgatataaagatatgtttcatggcgaatctagtgatacctagtataagatagcatacaaatttaaacaaactaaaatgatgtagctcaaaaaagtagtcatattcttggagaattttgagctttagcagtccatttccgaggaagtagcagagtccaagtatccaagctgtggctagctacgagctacgcggcagcttcccatttccgaatatctagaatcttctgcccagcttcatgtataaatccttcgctccagtgagtcatccttgcttctccagttctcctgcactctgctccccatattttatcccttcggagttcggtcggatcagacgcttgtgaatcctggtcatcattc

SEQ ID NO: 9350 - DNA, 130 bp, Zea mays
agtaatgctctgtcaatgcaattgcttttttgtgtcctgtcttcttccttaaatttttgccaattgttcaaggtacgttcgccgaggaccagaccaacccggatgctggtttccctctttttgactcacc

SEQ ID NO: 9351 - DNA, 1500 bp, Zea mays
attcagcaatactgaaaacaccagagaaacacttactagttactaatactacaagtcccagataccacacaacacacattaccacccagttacctaaagaagatcttcatccaactgaaattcatcacctgcagctccaaactctgtatgtaatgtatcaaatgaataaggaataggatggacgatggattacaagtctacactctacaggaatagccgaataggatggactgatggagtacaagaacaaaaatttagaagtccagtccagaatgacacaacacatacaatacaaggatgaaggatgaagattgaagaacagaactacacaaaagaatacctccagaagatgaactcatgccgacgaaaaattctggatttctggatccgcgcgtgtctggattggaaccacgagtgtctggactctggacgagaaatctgggtcggtgaagtccggaacttggaactggatttgcgcgtgtctggattggaaccgcgagtgtactggtgaggtgaagtctagattctagaacaagaagtctaggagccggtagggaaatagagaagaagagaagaaaaggaaagagattgagaagccaggaaagtagagatgtgaactgtcggtttagtagagagtagagacggctggcgttccatctccctgtagctgggccgcccgccaaaaaagcccacaaaatcaaaaaatctggatcctaaacctagtcgcgcagaaccggctaatcgagcgactaatcgaccctaatcgtcgactagtcggacgaccagggcgattaggtgctctaatcgagtcggttgtgctaatcgagctctgctaaccgactagcctgactaatcgcgactaatcgcgattagtcggacgacttgaaaacacagaatggtaatggtaatgattcacactcgttccggcaataagaagttttaataggtcgatatcaatttctagtgtgctatctgattgcggttggacttaaacagatatgatttaacgttatcagttacccattacgttacaaatatgtgaccaaacgacaccgaagttgtgtaattccacgagaagaggctctagtgataatcaacatgtcatcggcatattgaataactgggccgctctggtcatatgtcaaagggtgaagcacaaaccattcttctttatcatggcttgtttgtaacacatcagtaactaggagaaaaaggtaaggggataggggggtctccctgcattaatcctttttgtaggtaatccaaggcccggggcaaccgttgagcagcacggcagttttgaagaggagactggagagcaaggtgttaacccgattgcatcacaaggtggggaagcccatagctgtcatgatctgggagagagcagtccatctaaatgtatcaaaggctttagcaaagtctagtttgatcaccaaagctggttgtttgcatttggtacaggtctggatcagctcaagggcttaggcgaagttttccgaa

SEQ ID NO: 9352 - DNA, 169 bp, Zea mays
gagcccacctcgagctgctggaaggaaataggatcacactgctgtcacatgtttgtttgttaatcagttgtgtcgtgctgtacatatacgatcgagtgagtttctcatatgcgagatgagatgacgagtacatgttttttatgtcggttrtacaggagtggattcaaag

SEQ ID NO: 9353 - DNA, 1500 bp, Zea mays
gtaccaaacctctgctgctttccataataatcaaacaccacagtgccagtgggggtggtgccacgttaactgaaacaccaccccacaccacttcaacaccccactcctcttcctcactttgccctctctctctctctctctctctctctctctctctctctctctctctctctctctctctcggagccgtagccatggcctgagcagagcctgctgcttcctcttcctaggcaaccgtcttcttcaggcctggctccgatggagtggagcggtgcacggagttctgcttgcgggtggtagtggtagaggtaattccgccgcctttcgctgtagccagcaattctcttgtttctcgggagcttccctcgagttcttggcgcatgcagagttcatgtccaccgtagtcttctatccaccgtctcggttctctgaatagccatccagttctctctctgggcatgattcgtttcgagcccccagattgttccatcgagttaataaaacctctcctttatcaataaagaaaagtaatggtactggaattctgatgtggaaccactttgctcggttggtgtctactatgctaaagcatgcttgcatgttagtctcgtctaagttccgtcatggtttctgtctccttccttccttcctatgcttggtcacataagattactttaatctctggtccagatgctttcgctaatgtaccaagccaaaacaaggtaaatttgctgacattgtcttccggccctatgtctatatgtctgaaagagtttaactgttcttcaactcgttcgaattttcaaccagtaatttcgtggcgcggcatcagataagcttcgtattcttctatgcagagagtatttaccagcgagagccgttctcctgttagtaatctgtcgttgttacccaacctttacagttttactttgaactggtggaattatccggagaacgctattttttttagctgcatggttaggtggtgcattgtgagcaggtgaattaattaacctaaagtacagcataatttttaaactaatgtggtttatatatcggagcaagcaagcaaacagagctccccgtcttttctgacagctactggatatgctattctcggactttactgttagataaggttcggttttagagattctgagaccagaaaaaagacggcttgcttttcgtatgtttatctccggacacggaatttcaaactagcgtatcaaggcctatggatgaatcggatgcttctcatgattgttgagcagaaaatgggagcagtctgttgaacacaaagcatgtttcttaccttcatcatgaattgaacccatgcgtctgtgtttctgccttacctaacctgtcatgttcacagaagaatcgtgatcagatttttagatcggggcatcttattcgtgccagcggcattcacacggaagtgcttgcatgtaggcgagacagagaaaccaagtgacgtgcgggtgaaaagactgttgcgag

SEQ ID NO: 9354 - DNA, 809 bp, Zea mays
atgtctctctccttttaattagtgagacactaacttatattagcactaacttgtcataatttggtatgaagtgctcttatatgttcaattcagtgaacgagacaagcatatggcaaaaaggaaaatagctaatctgtttcagtgctgtgtattatttcatacaacacctgcatttcttgttatcttgatcatggtttgtctccagtatatcatgttccatatcttaaacattagactagaataacaatggctcctattgcttggtagctccgcaaaaaaggttgatgacatttctraaatcaaaatattcctgtctccagcatggctaattaggtcataactctcaaaagagttaacatcgtacaagtgatatatgtggcccattaatgtggtatgtcaccacattcaaatttctgtggaacccaagtggctgattggctaagctattcagtctgattactgaggttggttgttttgggagcaagttcaaagcattcacagcaaactgatatcagccagtctaaggttttaacatgatttttaatatgtttgatatcttgacaacacatctgatatgcctggagggaaagacctatgtgtggtactaccctacaatgatgtttacatttttttatattaaatgcaataacatgttccttgtcctaagtccatttagtaaaaactcaattattggataaaccacgaattaacatgtccttaacctactgttgtttcatgtagactgtcttaatccatagaagtcattgcatagcattattattttttcctgctgaattatctttgtcaaa

SEQ ID NO: 9355 - DNA, 303 bp, Zea mays
tacaatcaccatatggctggtccaacattgaatatgctatcttcaactaattcagatattataatgggagtttatggccttttgtttttttgtgcattgtgtgaccaataataacagttcattcatatgaaaatatggttttcattgtcaccttattcttcgcttagtgtgttaatatggctaccctgaagcagtacttgaagtatctctatgttcaagctgctactccagctgtgcaagggcgtgggttttgttcacggccgggggggtgctccaccgtgatctgaaccgcacaacctgctc

SEQ ID NO: 9356 - DNA, 1500 bp, Zea mays
actttctctccaacaacatcctctaaatcacgtcctctatactcaaatacctatattatagacattttttatttttattttttatacatacgtgtttgtcatactctcaaatatattatacatattttagttttgctaaatcggttatttaaagtattcaaatagatagatgattgtttagagaaactttatatatagagaatccagcaacgtcctctaaatttagaggaccgtttagaggacgctgctggagagcgtagaggaccgtttgatcctctatatttagggtagagaaccctttagagggtcttgttggagccagccttataccaattggtgtgttggggtattgtaacaccccgtccaatctctggaccgacggtacttactcctggcaattctctaggatcatatattgtccacacagaccaacacgggtcttttgtgcacactttgtcctcactcatgcgcacccgagaaaaactttccggtcggtcacctatccaaaattgctccaaaccaagcacacttaacttggaggtttttcatgataggctttcgaaaaagaggatataacttgttggtatgtatactttattgattctattaaaccttgggccatgatatcatcatctcaggggctagaatatccatattttgtataattagaaaaggtggattgaaacaaaactaaatccagattttaataaaaagtggattgaatcgattttgtaattagaagatggtataattgttgttaagcttacatgatccgatgatcgtccactccgtcctgattgtctgtcctacgtacacggcatggtcgttgtccatttaaccaaagttcacggcaagaacgaaggagagagcgagggagacatttaaccaaattaaagtacacacggcatgaacctaggggagtgagagaagacgtgtaaaatgttgaagagtaggcatcagtcgactagcgtctcaagaaaaataaatttccaaagactttgaaagctggcctcatctactatataaactagttagatcgaggccggccggggcaaagcaaagacttttctaggcccttcgtctcgaccgatgaccaagacttttcgggcttgttttatctgccataccaagacatcttcaagctcctcctagtccagtccactgatgcgtagatgaaacattattcgcaacattgagggacttgccttaccctttattattacccttcataacttaactgtgtagagaacaaatcttccacgcccttttgccgtcgccctagcttgccttcttcagttcagtcccggttgaaactggatggatatgtgattcagtcagtcagaggtaggttcgttcttacaacatgctaaataagctaattaatctttgcaagtatgatccagtgttcatattaaccatatctattatattgctatacatactttcacatgcatgccctacacagcacacagcagccggattattccctgaaccctaata

SEQ ID NO: 9357 - DNA, 533 bp, Zea mays
gttccgtgcagccattaattacgagattggaaaaaatacatgtttgtttgtttccttgaagtactcctgatcggcgagtacagtgctagtatatatagaacggattgcagagcagtgtagttcgacgcgttgaacggacggaggggaaaggaagaggaccgtggggcggagggtcaaagcagctcaggcacacggtgacatgacaccagcgtgtgttgtgttgttgtgtgtgcctgccttttccagggaaggacaaggaaggaagctcgtctcgtcctgtcaacgcggcgccttctcgtctcaactaccatcgccttgccttttttttttcttcctttggcccggtccgccggttaaaaacatctgctttcctccacaacaccaccaccaccaccgacaccgagcaatcaatcagagcgggcggggaggagaatacaaggccccttcgtctcgcctcccaccaccaacccttcctccgcctccgccgccgccgcctggagctgaaagtatcccagatctgagcccgccttccg

SEQ ID NO: 9358 - DNA, 373 bp, Zea mays
tggccgccgccgcgcggctcccggcacgcgccgtggtggccggtcggagcgcagagactcgtcgaacgcctcgtgcctaccggcgcagcgtcgtagcccgagtaggagcaaggaggacggcggagagctttgaatgggtctggactctggaaagtaatcgcctggttttgacctggaaactaattggtcaaaatggacaaatgatgctttataatcgatcgatggttcttcatcagagaaaaaatgcatcaggcacgctggtagctttaatcatggcagggtaccgatcgtgcgtgctattccggtgtggctgtgtcaggtcccagctcccaagctttggtcctagctcgtcaggtggttcggtgaggaaggg

SEQ ID NO: 9359 - DNA, 1176 bp, Zea mays
agacgtacggttgtgtgttctacggatgggggggtggggggggggggctttcctgtgcgcgcccagctcaatctgcaaggtgtggttgcaacaggcagatcagacgaatcgtttagccgtagtgaaaaatataaaatcactatctttaatgcgatcatctgatatgtgaacagactttctctatcaaagcatgttaggtttcagaaagaacataaggcgacacatagggggtgtttggtttgaggaatcattccattcaaaatgtggtggtgtatcatgggtccattccttaaatttggtgatatgacctcattcattatattagtactaactaaataactataaagaatggggtgatgatgaatcaactcaatccattccacaaaccaaacagcttaataatacataaaaggatctcgatagcacatcccctatccattaaagagtacacaaagaaaccataattcttttaacaggtttctagcaccaaaaacaaatattacataatgcaaattattgcaaatcaataaattaactataacaactttactaatataaggccctagctaattacttagaccctgtttgtattggattataatctctccagattatataattcagcgcaaataatttagtaggtaaacaaacaactagattataggttcagattatataatctaaagctcagattatgataatctcataatctccttaagagtagcttatttgagattattttgtcaaaagacccactacccatggttatttaaataaaaattacaatatatgacatcattcttttctcaactcaaataaacaataaggatattgttgtctttgtgaataatctatatttgtataatctaaactaacaaacaactacatatagattataatatatttagaatataatctggattatataatttagattataatctagattatataatctataagctgaactaagttatcacttgacagtaatttggttgtcctcctcaaattctgccaaactgactgtctctgctttccgcgaatcggcaccttctccttttttttaagctgaatccccatcttcgacttccgcacctcgcctgaatcgctcattcgctccccaccccaacgctccgtccccgcggcccaccaaccgccgccgccgccgccacagcc

SEQ ID NO: 9360 - DNA, 1187 bp, Zea mays
ttttcccctcccccccccactttcccccccggtaccggttccggttccggttccggatagcgtggctcaagcatgcatggcaaggaaagaaaaaacaacctttgcttgctgccggaaacagactgcgccgcgttgcttagaatggacgaatggtcacggacggccacgcagcctgcttgcttggccctccctatcctctctgctccgcggcaccggcacaggcacacacagagccaacaaacatactacacaggtggcaaatgcctgcggcggggcctatgaaccctaaacctgatcgtttgtctttaataacataccgactttcgcaccggcttttactatttataaactgtttttgtctctataaattgtatatgtagcagtctaaacaacccgattaagcccccccttctgtgttcgggttgcaaagccatacccgctgggaacaaaaaagatccccgcagtaatttcccttctttcctgcagtaatttccacaggcccaatcatttctccagccaacagcttgacatgtgagttcactccacgcagcggagaccagagcttctctacggcgagggagcgccgaggggcaaatccgtcagcgcgggcacatcgcgtcgcctttccggcccccacacctctctctctctctctctctcttcccggtcgacgagcggagagctagcggcggggcgcgcgctgctatttatcgagcacacgggagccacgccgcccgtccctgtctccatcttgccgtcgctcccacgccgccgttccctccgcctgcctcgaccgcctcgtgccgtgcgcgctaaggagggagggagggagggaaagtgaagcaggagggtggaccactgcgcgcgtgcggcgccttcctcctcgaatcaccgccgacagcttctgcagctagcgttatcacccccaccaccccggggctcggattaggtacgctgttcatgccgtctccacggccaaggaccggggaggagcttctttctctagctgggggatgagcaacaccaagtgatgttccatcatgtttgcttaaaaagacacgcactgcctctgcctgtgcctgcctgttcatggtcctcatcctcacagagctggttaccgaaaaattggtatactttttcttggcgcaggatctgagctgaagctgccaggccaggcgatcgagccg

SEQ ID NO: 9361 - DNA, 900 bp, Zea mays
ttcttttgcggcggatgtagtaatacttagtcaaaacattggctgcacatgtttgattggttatctgcatagattttgcttaagagaaaaacataggccatagtttcaaagaagaaaagttagattgcctaattcagctcctcttggtcgtcctccttcctgacatatctaattcgatgatgaaaacagaagtaaaataaacctacctggttagaaacgtacaaataaatttaaactccacagttgaaagcatgttttgtacatctagagtagaaacatgtgtccagatgacgaattatacttgaatattatcatactatatttatatttatttgcaatacaagattgataatattagacccgtcatgaatgatactttcataacttatgtaagataatatatttctatagagattacaagttttaaaaggtcagtagggaaaacttagacgcacttatatttcagtatttctgattggaggatggagtaaaaccattgcacaactagctagctatccagctatacaagtttaatttttatttgtgaactaatttgataatttctggttataatctatattaggggcatggtcagagaagtggtcttatgctcaaaattcttaggatttagtgcgatttgatttggagtagatcactgaaatttgtttaccaacctatctctctcgaactgtcctaaggctatgaccagtatatctgtatatatctgtgcaaaatactatagaaacactgtctgtaattgtatagtgtggtttcaaatgagagatgagaaaaagtaagctgctcgagataggctaaatgtaaatttctacgtctttcacaagatcagatatcaaataggagtatcaaagtacttggaagagtkgggtagttcgttgtagc

SEQ ID NO: 9362 - DNA, 353 bp, Zea mays
caccactggtcagtgtcatttgatgcttatcattctagtaaggccatgttgccatatcaactcacacaatataccctccaggtgctcagttgcttctgactttgccatcagaaatgtccaacattcaagaatccagttcatctatattgcagttagagtggagtactaaatccacagaaccaaatgctgaagacaagcatctttgtctagggagtggcagcaatgggaaacctcagggaagtagctcctcgaagaaagcaggtaagaggaacagtcctgaaatggttggggaaacaagtgttctgcctgctgcggcccaaggaaaacccaatcaaaaccatggattggttgcg

SEQ ID NO: 9363 - DNA, 177 bp, Zea mays
ctggtcgtctaacccgcgccgcagcactataaaacttggcttcctccttctccttctccttctcccctttctattgattccctccacctttcttgttcgttcccacaagctagcagcagcagcagcagcaccgtagttcttggcatcatcatcaattgaagagattatcgatcggcc

SEQ ID NO: 9364 - DNA, 172 bp, Zea mays
ggtgagcaacgacgtagggaaatagggctggcgggggcacgtgggtaacttggtcctggagcattggagaaggagcataccacaaggaaaccaacacggtcagtcaaaaccaaatctagataatcatcatgctacttctatgttttatgtctgtttttgtattggcaggtgg

SEQ ID NO: 9365 - DNA, 395 bp, Zea mays
cgcgcagtaggtgcgagcagcaggcgccgagctgcgcgctggcacgcgacggccacggcaaggaagctccgcaagctgggcaactacgcgtccgtcaagcagagcagggcagtcgtgccatggggaaaaaaaagcagcgcgcgcctagggaagcagactccggcaaatcccagggcgcggccatgggagactcggtaggggcatgaccgagcaaaaatggagctcggcaaactccatgggcgagcagagcgcagggcgctccggccaggcgagcagggagagtacgctatgactggaaacttggggaataaataaaaacgcggcgtgcagagagaagcgactgccagacgccataggagacagggcgcgatccgagctccacgacgcacaggaag

SEQ ID NO: 9366 - DNA, 1068 bp, Zea mays
catcgatggatacttttgattcttctattttctagaataaaataaatgtttgtttatttccgtgctagcgttggattaaaaaaaagggctctgtcttgtttgcatggccgttcttgagttttaagagacccgggacgagataataaatagaggccttaatactataagatttttttcccctattataaaataactaattaaaattgtccgatgtatcatagaaaaaaattgagcggtaaatagaagagagattattatctcaaatatattgtagaaatcaccttaaaattgttttctaacatttttagatgcacaaaaattatctatcatgacattgattacatgacctatcatttcatgtctctttctccacccgctaatcgttatggataattaaggaaattcgtacaaattaattgtattacagaatctagagtctatgtgtaagctaaacatttttgaacgatgtcttaccaatctatcaaagctatatcatggtgaagctggaaacctaaagctgcaattcttgaaacggaatcctcccaaacaaggcctaaatacatattgtgtatagtaatatgttctcgactctaggatggccgccaccctcgccccctccaggaaggaacggccctgccttgacatctagcagttgatagcatgttttggtgagctaaaacaagcaaaacattggcacgcaaaaaaaattaaaaaaatatctgtaacaaactatatttacaaaaggaatcacgcatcatgatccaatgagctaggctgcccatttgtccactcctgggtgcccttaccatttttcctccctcgcctaaacacgattacacgactcatccaaaatgacgcgtcacaaactcacgaataaaaccgccaccacggcgcgagacgtcggcgcccggaatattcctgtggcttcgcatcaccagcaccacccgttgctcgtcgtcgtcctctgcatccgtcccctatttatccgtcccctcctctcccgcactagctcccaagttccatcccatcccgccacgaaattctccacgctccgatccaatcgcaaca

SEQ ID NO: 9367 - DNA, 1500 bp, Zea mays
cttgccctttaccttggatatacacaagattgctcattcgctgtaaccactagttctagaactgaataggaaaagctatatggcactcaaacagaatggatagcaactgaaactccaagaggtagtatactaatatactttttttcctaaaaacctaagatgcctattggtctaagctttatatctatcctatcgctctcttgcttaaattcacttccttccttaactcagatctaaatggcttcctttggatcgacatgcgtagaaagaggtaaaagcacgggcatggaaaagggattatatggcgtgctgggctggatgaaagaagcaactacgcctacaatgagaatagcgggactcccactagctgacagagaactcccagccaaaatgaaactggacttccagcaatagcagcaatgtcactagaacctttcatactggagaataactagaagtttatggggaatacaacccttaaggtttggctatgattctaaatcaaccatgcttactaaacaactcaatcatgcactcgtaatgctccattcgaggcgtaataccagaatcttcactcatcgagaacaagtatctttgacctagattaacatatccttcacaaatacaagctagcaaggcatctggataacttacaagataagtttatgcgtgccacctatcatttgatactgcctgatcaagtctttggatcaagtatgtttagaaaaaggaatatgcacaggaaatcaagcaagaggatgcggacagtaacgatcgcgtaaaggagggcccgcttactaatacggagagggttccgcatgaaaaagacaatcctaaacttcttcgtttcgttggtttttccaaggtcttttaaattatcttttttttgaacatgaacggaagtagcgtaggacacccaatcctcggtcaaacctctacttcaatgaaccacgtcgcgttctttatctttctcactcgtcgtttcgttggaaaaacccacgcccaatatcatattgactctctctcgtccaataagagtttccgagagttactttattcaaattctctcctttccaaagctccacaaggctgacaaaaagagtaataggacaacaagcaatcttgctttcatttattttgagttctttctttgttgagatggaaatcgacgttcttttgaaaagggctaggtagtttgcacgcaggcttcttcatgaaaggtcaaaaatagactttgatttcatcatcaaaaatgactagtcgttcgtttgaagccttaagaaaccaaagcggyagtttttttttccgaatgacctgatttcgagaatcaactaaccaacaaatccgtagcccaggtgattcgctgcctccctctcgccaaaccaaaatgggatgaatcttctcatgcagcttttttcttattcagggcgctgcgaagcatcaaggcaagggggtaaataaaataagggggaagaggagttgtcacgatagaaaagagaa

SEQ ID NO: 9368 - DNA, 63 bp, Zea mays
tggctgccatgccgcggtcggcgtccgtgcccgagacagcagtcggtgccatagccacctgcc

SEQ ID NO: 9369 - DNA, 1330 bp, Zea mays
attcggaattagaatatttaatctagttaaatatcttgaaagcatgtcacttatttctccaatattataacatgggcgtagcctatatgtgcggagatgcgatgagggagcttccctaatggagcaggtggcgggagctcgacgcgartaaatcggccaacaaatcacgtcgatagtgttgttgttgtatatgtatgtgttgtaggtatatgtttcatatattttttatatattgttttaatatagttatatataacatttctacatgtctgagaaaaatacataaccttttcagtttttttcttgagaagctcgtaaattacgtgccaaccttttttgctatcgtctcaaggaaattagaaagataaacaagcatgagctataaaaagagagacaaatgtatcatgtctttgagactttgaaaaaaaaggcgtggactctgaagcgattacaagggggtgcgtgcaaaaaaaaatcctttaccagccacgtaggcgactttgtggcgaagccatgtcagctaaacacgcgccacacacccatttgaacctaaatgacactagattattgtttcattttagggctagtttgggaacaccgttttcccaaggaaatccaattttcccaagggaaattagttcattttctcaagggaaaattgtaatcctttggaaaaacgatgttcccaaactagcccttaagagtttagaaacctgtctgatataggttcataagtttagggactgccagcatattttattttaaactaaacgagattatataatctagatatattataacccaatcaaacaagcccttattatctaaccaagagaattataaaaacactatatttacattcacctagccaattcaatacatatacttttgtgttttaccataatatagtttaatatatataggaattgtacgcaccggcatgtgactaatgtaaagagcagtaaattttaaaaacaaacagacaagtgagaaaacccaccgctcgtgctccacttgtgttgtgtccacacacgcgagcgaacccgacgtcccgacccctgctatacgaatctagaggtgaatccaacggcgtaacacccttctccctccacacccttcctctccaaaaaacgaacatcaaaatgcgcgagagaaacggagcaaagtcgaaaggggaaaaatgagttaaacccaaatcgacaccaaacccactccaggaacacccgcctccgccgccgccgccgccatcgccggcggccactacaagcgcggcgtccggagacagtactgcgctaccaacccctagagcctggattctgatgagccctcc

SEQ ID NO: 9370 - DNA, 310 bp, Zea mays
cttttcgtcgtggatgcaaagacttttttcccatgaacagcgaccattcattccgtgacacctatggtcttcctggtcaatttccttgcttattataaaaaacaaggtcactttcctttcgaagatgaaataaagcttggtcgctatgttttttttatggatggttgatctgctatattgacttcagggttctaccaagaattagtacaggtctgggtccaccgaggccggccacacgtcacatgtacatttatttcctgctggaagactgcttgtctctccctcctgtagaaactagaaaccaacaaca

SEQ ID NO: 9371 - DNA, 163 bp, Zea mays
gatcttgcggctgggtatagcaaacacatcatagagacacatatagcaaaatatttagatcaatcctagcatattttgttttgattgtcgattaaatttgcagtttagttcattacaagttgttggacagcatgttcgtcagtgctttgcaaaaacaagaaac

SEQ ID NO: 9372 - DNA, 115 bp, Zea mays
ggtatgcgcgtggatatatacatgttttttcatcgctcagtgtacatgaaacttatatatgattgaaacttgattttgaacaagattgtttgtttgatttctcaggtaaaaaagc

SEQ ID NO: 9373 - DNA, 726 bp, Zea mays
tcccgaaggtgaagagtttgagtctgagtcccctggtgcaccggacaggtactgtgcactgtccggtggcacaccggacagtccggtgcgccagaccaggggtgccctcggttgcccctttactcctctattgaatccaacacttggtctttttattggctagatgtgaaccttttgcacctgtataacttatacactagagcaaactagtcagtccaatatttgtgttggacaattcaaccaccaaaattatttaggaactaggtgtaagcctaattccctttcaggattgctttcttctttcttgatcctttctttgcaatcaaactcacttgtaattaaggcaagagacaccaatcttgtggtggtccttgcgggaactttgtgttccaagtgattgagaagagaaagctcactcggtccgagggaccgtttgagagagggaagggttgaaagagacccggcctttgtggcctcctcaacggggagtaggtttgcaagaaccgaacctcggtaaaacaaatctccgtgtctcatttgcttattcgcttgggatttgttttgcgccctctcttgcggactcatttattattactaacgctaaccccggcttgtagttgtgtttatatttgtaaatttcagtttcgccctattcaccccccctctaggcgactatcaattggtatcagagctcggtgcttcattagagcctaaccgctcgaagtg

SEQ ID NO: 9374 - DNA, 224 bp, Zea mays
tggaacagaacagacacagaattaaaccccagtgctggaaggaagaaaaatgaatggattagagcaaacacagaattaagccccagtactggaaggaagaaaaactaaacatgcacacgttgtgaatccatgatctctcattacttgtaaagtccagaaatatttcctggtaggtttggtcttaaactttaactgatgacattttatgaactcattcctagaca

SEQ ID NO: 9375 - DNA, 305 bp, Zea mays
tttcgtcggttgcgggcgttccggccggccaaggcgtgcagttactttatccgaaacgatatttcttttctgtcggaatgggatatgagtgggctgggccgaatgcaggcagggtcgtctggtgctacactgctactctttccacgaccccatggcaaaatagcaaatttctctcgattgtgatatcagcccacatagatataaccgtttggggaaaagaatcgtgggctgtgacctgtcgtcttcgtctccggcagagcaaagcggcggcgaggcgggagatatagaggagagacgagagcggg

SEQ ID NO: 9376 - DNA, 1500 bp, Zea mays
tttcgtatgctattttcagaatttttatgttgtaggaagatatgttcgtctgttttctatggaacatcaggactctagttttactatttccttcttttgttttgtcggataccatagatttgtgctcatgtgccatatacttaatcatgcaaatggcatatggatacattctgaggatctttttttttgaaacatgcaacggaggggacgaaagatccccacctgattgattatacactcataaagttcaaggtacaagcgcggtcagggaataggaaagctttgggatactttagaaaggatggacacaactagagaaagaaaaggataaaaagacagttaaagaagcccatgagaagcataaagttagtgcatacagagctccttctcttattaaaatttaaagaaattaaacatttggtgggtatcaccgtggtttatgaaatgctttgaattagtatcattagtttatggatatagattttttctagtactgcatgttattattgtatagaagcaatgaaaatctagccattttttttcatacatctaatgtagacacaagtggtcaaaacttcagaagttctaagttctggttaccttgatgacattcttytgtgacctgaggtggaggaagtggctgagatttttattttattgactcataagctattaacattggttcagttcatggggtcactgacttcttttacgatgccagcaaaaaaaaacgtttacttcttccctttgaaaatatacaattttacataagttagcaatataagatttacattgttcctagtcgttatgaaaactttttttataatactaatagaaaaggtggcaggtggtcctgccaaatgactactatttttttttgtgtatctggctatccgttgctatagatcgtggttctgccacttgattcctcgagctgaaattttgtcgttttaggttggcagtgttgacgtactttattgttgcaaggctatctgcatcagcttatctattctcatacccatattcaaactatatcattatcctttaatcgattaaaggaggtctatatcattaattcattatctcaagtggatgtggtgtcgtagacatgttttactctataagcagagtggatctgagccgtgctacaccaaagtattcattcatctcatccggtcctcgctgaacgcagctagcgaggaacttgagcaggaggcgcccgtatgcggttctgccacgtgtcacgtgatcgacgtttccccccttccgcggttctgccgtcgtgcgcgcgtcacgccgtgacctgaccctcatgacagcacgaatcccaaagcagaaggccaaaaccccgtcatcccagccccagggcccaggctcccggatcgtctaatcaatcccgcattccccattgcacgccgtctccgctagggttttactccgccgcagccgcaccgcgccgccggagcagcgcgagaccgcgaggcgagccacgcgagagag

SEQ ID NO: 9377 - DNA, 1500 bp, Zea mays
gaatgactctctttatgtcttaacatgtgtgtttgacttagagatagaaatttgaatttgatttgcaaaaacaaaccaagtggtggcaaagagtgatccatatatgtcaaatttgaatcaaaacaatctgagtttttatttgaagtgatattgtatttgttccacttactttatattgtgttggcataaatcaccaaaaagggggagattgaaagggaaatgtgcccttgggccatttctaagtattttggtgatttagtgtctaacacaagtgctaaaatgtaaaatggtggacaaagtacaaaccaaggataaaggtatatttctcagacttagtacattgttttatggactaatgtattgtgtctaagtgctggaaacaggaaaaatccaattgaaattgtcttggctcgagcagccaagactctgctcactctgggagcaccggactgtccggtggtgcaccggacagtgtccggtgcgccaggctggttcgagcgaagtggccgctctcgggaattcaccggcgacgtacgactataattcactcgactgtccggtgtgcaccggactgtccggtgagccaacggtcggccgggccaacggtcggccgcgcgatstgsgcgggacacgtggccgagccaacggctagaagggggcaccggactgtccggtgtgcaccggacatgtccggtgcgccaacggctctctggctgccaacggttggctgcgccagttaaggaaagaaatcgggcaccagacagtgtccggtgtgcaccggactgtccggtgcgccatgcgacagaaggcaagaattgccttcccagattgctctcaacgactcctagatgccttggggctataaaagggacccctaggcgcatggaggagataaccaagcatcctttgagcattcttgatcactcacactccactcttgcgcacttgttcgacattctagtgatttgagccccgttctagtgtgctagtctttttgagctcaagtctgggtcttgtgtgtgcgtatttgctgtgatctttgtgtcttgtgtgagttgctcatccctcccttactccgtgattctttatgaacatcaaaagtgtaagggcgagaggctccaagttgtggagattcctcgcgaacgggataagaaaagaaaagcaaaacaccgtggtattcaagttgatcattggatcacttgagaggagttgagtgcaactctcgtccgttgggacgccacaacgtggagtaggcaagcgttggtcttggccgaaccacgggataaaccactgtgccatctctgtgattgatatccttgtggttgttgtgttttgttgagactcctctctagccacttggtgattattgtgctaacacttaaccaagttttgtggcttaagttttaagttttacaggatcacctattcaccccccctctaggtgctctcaattggtatcaaagtcgttctcttcaagaaagggactaaccgcccgaagag

SEQ ID NO: 9378 - DNA, 94 bp, Zea mays
atttgaatatctaaactatgatgttctatgaaagatcattcttgaatttttgcctttaaattttcttgttaaatcttgtatactacactattaa

SEQ ID NO: 9379 - DNA, 1500 bp, Zea mays
tgtgattataattttacctttattggggttgcgtccatacaaaactgaaggaaggtactccgtacctttcatccatttatttttaatcactaattactaacggcgttgagagtgaaggccaaactgtaacttcatttttaaaatagcggggtaaaatcataaacgttttacaagttgytggtgcaggagttaaacgaaaacacacaataaaaacatgaagacccactgacccagccacttctctcaaagtttgtaggaatatcttacaagtcctgacctagctactggggtcgtactgactacaacaaaaagagaaggaagtgaacgagggatgggggctcgggcattggcctgcgcctagtccgacaccacaacgaccagatcatcgccaccgtccccgggtcggtcttcagctcccggagatggcaacgaggaaccgatttcctgcggggaattcctctattagggaacaagtataaaattaatttagtctctgtggatatctaaattagggaagtttaatccccgtcgggtttacggggacagggacggcgtccccgttctccgtgtgcccactctacgaaactattttatccaagttagtcaatttacttggggagccattattcgacgaggaaatcccgttgccatccttacggactaggcacccagccacatgcttcgcgacgttaccatattttactaatttattacttggccatcgaccacaaccacacgctttgccgtaactaagttacaggacccggggtttcaaggacccaaattgcacagcgtccgtattttactcactacggaaaacttgacctccgtggttcttgcaatttcgtcgtcatcacactcaatcttttggaattttagtgttgaaaatgggtacagtaatattgcaaatgtattgtatttcacaattgctgtgaccagtttcagcgtcttatagttacgtctctattcctgtcccatatatagctgtacccgttgctacaatgctacctgcaattttcttgaatcttctatggctgactcacatgtctatagctaagcagaacatagatgacacctctctctctctctctctctctctctctctctctctctctcccaacccccaaccccatccatctcacattctctctcccttctgacttaacgaattagatagcagagaactacaaaaagcaggagccccgaaccttatcaacatgcatggacgacctgctgttgccatccaaatgttccatattccacactaaaccgacgcgtggtgtcgcaagaaagaagcttggccattatccagacaccattggcctggccggtcagatagcttggaaactgtctctttccaatggctatataaaccagcctcacttcactaattctgggcaaagcaagcaccgctacttgaagcatcttacacgaagctcttctagctattcctcttcccgcgaagaagtggtaatctgcttgatcagtaagtacacaata

SEQ ID NO: 9380 - DNA, 1500 bp, Zea mays
aagtggtttgaagagaatagaaagtgtttaaattcctaataaattaaatctccatttaatatattttaatccacttgatcccactcattactaaaatatctaaattagacattagggacaccggtgtgagtagatgggcagtcttgcgacacaccgtgtactccttgtaaccgatcaataaaaatgataaatacgaaaaacatgaaacaaagaaaaacaatttgaaaaataaataaaataaactataagaaagaaaaacgctgaatgaacacaaaatcatgaaaatatctagccatatgagaacaccgaatgtatcacaaaaaacatgcaacaaaggaaaatataattaaaatttgtaacaaaataaaaaaactagaaggaaggaaaacaaagaagtaatcgtacgaatcatatcgtaaaaatctagaaatatatcatacaaaatagagagccaagaaaaggaggaaaaaagaagagaaatataattgagaaacccacatacgtactcctacttctacttgttccatcgtggaaaactggacacgttcatgtaatcatgtcgcttgcagcagcgtccgcacacgtgggcgacgctcagtgcagcacgcgggatccctcctggtcggcgggcgggaccggtcggacgggaaaagtcgcgaccactgcagcgcacaagggcgaaggaacgggactagattttatattataaaatttaaaaattaatcgaattatgaccggactatgttactatttatatttaattaaaattaaataaaggttaacgaagataaatatttaaatcatcattcattactaaccctatctgcacaacggagacaaaggtaacggcaacgggaatttcccgtcgagaaacatttttccatcttcgttcccgtgacggaaaattttctcacgaagaccctagtccctacgaaccctatcacacgtgttattatttcatttttccatcttcgtttctttctcatccctgtttcggataaattctgacaaagattgtgtcccgtttaaattagtataattaggatgtatgtcttttttaatgcaaaatattgtgatttwtgcatattatctctactacttattaaattagtaagggttaggctgcgtctagctaaaattaaattaaaaaaacaggctccaaggggattcgaacccgcgacctctcaaataaatgtgtttgtagctaccactacaccacatgtgtgtttatgtctacatctattatagtaaaaacatataatacatctctcccgaagcccacctgctacccttgcacaatgtgtagtagtagataagtatcactgagattattaaattatatttttggattgagggagtagtatttaaagaagagccttgcatgcaatttcttttgtttgaataatgttttcaacttaaatacttttttttgcatgtgtaacatttattctccataatatttttccatggatctaacttataaatcattttcataaacca

SEQ ID NO: 9381 - DNA, 666 bp, Zea mays
caaatcaacccttagggacggggatggggaagtttctttcccccatggggatgtaaacgggaaaaaaatcttccctcgacaggtaaacaaggacgagaacgggaaaacattctccatccccattcctcacagggacccattaaacttgcacatgatgatgttttcttatactagtcaatgataaaataaataattagcatatcaagagattatttattgtacaaatgtgttcattttaacgtacacataatgatttcttacatctgacaatatgtataagtgatagtaatttacattaataataaagtatgcatgtcctaattataatttaagcgaggcgaggattctcgtcggagatttatccccgcgggaaacgagaatggagaagaaacgtcccttgcaagcgttcatgggtatttccatggcgttttttgggacataaatgagagctattttctagcggagaattttaattggcatccctagtctgaactttacattagaaggcgtaactaaaagtctacgtattcttaggctgaagacagaaaaaggatgcttctgcgttttaccccatgcttcggcagccccgtctaaatctcctattcatcgcgcaggtgccgccggcgtcgccgtcgccgccgccccagcccctagctgccggcgaac

SEQ ID NO: 9382 - DNA, 1500 bp, Zea mays
gttcatagcataatgatggtggtctgtggacaacggtccatggggatgcgttgtctacgagacggaaattggaataaggattaaggtgtggtaccgtgtgtcaagcgtttgaacgtactaagcacatgccgagaaatatggtaaatcggtaagcctagtacctgagtgaacctggcagtggacatatcccctcacgcgacctgagacgtggtctcccattccggttatggtgggtacaagtgcggtcactgcacgacggtagtcggggtcagtgtggcattgtacgccaaggcggtgagccctgatctactggcggggaatcgatggggaaggttgatgtgtgtggggacggagtggctcgccacgtcgtgtgtttaggtttaccttgcaaggataaaaactcgattcgaatcgtctacttctcgcagctaatgagactgcttgatccatgctgctacattgagtaacaagtggaaatgtgatgatttagcaaaagttgttgattgctaaatgtttgatgccatgtatgattagataggtacacctttagtcttaagagagtcacactaaaacttgaaaaggctaaaacttgattttagactcagctagtgcttttggcaaaccaaacccctcagccaaacagtgtccactgctcaaattatcacttgtttatttattgtttcccattatctttttgttatcgccttatcggccttgtttacatgatgcaattttctcattactgttaattatgaagtcgcgaaagggcctctagccgagttggttaggtgacctgagtagcactcctcaggtcctaggttcgactccccgttggggcgaatttcgggctatggttaaaaaaccccctcgtctgtcccacgccaaagcacatgtgtaaggcccggtcgcggtcgtttctcacatgggctacggtgccgctgtgtatgggtggggcaggggtttggggttttctcgacctgtgtgagaaggtcttcttcttaatataatgcccgagggctatctaccccccctccccgcaggtcgatttttgtttttaaattatgaagtttggaactcaaataactaaaaatatttaacattgaatattatgttaaagcatcctctctgaaaccattatttcatattttttgcaaactcacagttgtggcatttattcaccatactattcactgtattggcatatgcatgtaagatgtgcccctagagaacatgcaagcacattttatgtcaaacgattactaagttcatgatgtggtatctgtttgtggttatctaatgtgtccaattctaatgcacttcttaaaaaaacaaccaaatctgcttgttacaaatataattgcttattctgataaaatattctgaatagaataagttacatgcctctgaactcttatcttactgattttttgggttcccaataaatatgtgaaatatggaacatattgatattgtagcttacttttccactctctcagtgaa

SEQ ID NO: 9383 - DNA, 178 bp, Zea mays
atgaaggaacctggtgcttttagtcccttctgacataaccaatagcctgttttctgtcgatgtgcgctttagtgtagtcagcatagtactctcttgctttagatatcagttgttaacaagatttcttattgcctgtgcttcttgtcagaccctttgcataattgcaggaatatctgtt

SEQ ID NO: 9384 - DNA, 1500 bp, Zea mays
gacgcttgtaaccccctactgcaagcgcacccgacctgggcgcaggacaacacgaaggccgcgggtttcccctttttgcttgtctccttccccccttcgtgctccgtctcgcgccgacccatctgggctgggacgcgcggcgacaatttactcgtcggtccagggaccccccagggtcgaaacgctgacaagtataaatctattgtcccaaaactatcaaccgagtccctgtgattgaccattcggagtgagtccacactagcgtcctccaccgaacacaaatcttattgtcccccggtttcagaaaccacaacaatgttattccaaaattcataacacgccatttgaatatttagtgtgcaaatattttaagagtgtgtttagtttagctatgagctatgaaaaagctattgtgagctatctactgtgagaaaaaagctgaaaatcgtttggttccaactgctgagttgtccaatctaaacaaattatatattgtttatatgtactatgtttacatatatctcttaactaatatatctaatataaaaacagatttcacatttatgttcatgatacttttacaaataaattaaatttaaaatttcattttaaattattttttaaaatatttttatttcatttattataacacttaattatttttcatcatatgttggtctctacttgcctcatctatttattaatataatgaactcagataaacagtaaaaatagggtccacgctgctattaatttttcactacacaaaatatgtctttttaaaatagctgcaaaaaaaagctgaacctactttttcgaagtagaagcagttctaaaagctcaactaaatcaacgacaatcaatgacaatcaacgatcgtgtctaacagtttatctgtacatccaaaacactattttagacggtagactacacaaaattttgaatatgaggtgtaacctgacgtgagaaaaaaatatcgtgcccactgcggtggtcggctcgagccaagccagaaaggacccaatagccaatgtggtctgtcagtcgtgggctcgccgttgactaaagcagacaccagctcagcccaacgacggcccagagagttctagcccatagcaacatgccaacatcccgccccggagctctcagttctcacttttcggacggcagccgacgacacttccggcgggcggcggcgaaagattctccttctcccgcgccgccgggaccctatcgactcgctcctgctctccttgtcgtttcatttctctcggcatttaggtttgtgcacgcaaattggggtttcccatggttccatggacgcctgagagctacaatgccgaatacgtagctcatccttgctttcattttggataagcccatagatgcttattttaaaccttgttttttttctgcttctgaagtttcccttttgcatcctagtctcagaatccctggatctgctgcaggtttcaaactaattttgcatgctcaggtagg

SEQ ID NO: 9385 - DNA, 1500 bp, Zea mays
aatgaggtagctaggtcaaacacgtatgacacaagtttctccttcaccgtcgaacccaactttctcataggttgagccaccggaccaccactcatccatagttcatatcgaccggccttttttcttccgctctcacatcatctgctctcaaccttattatcaggcagatctcataggaacaaggccgctaaagctagattcaaaatcgaactacttcctaaatatgagcaactattggagactaagttattttttacttccaatagctatttagcaacttgctaaacatgattttagcaagctattttttagagaactactggagttgctctaagggcgaaacgttagagagaggtcatgcctttgagttatgtcagtttttgtctatctctgcttagcctctgtaatttgtgtactttttttaaaaattcccctttatcatcactacaagtgggcaagtttcctgccgagagcagtttgtaattaaggatagaatcctaatacttgattttttatttaatacattatttatagttagtttatattggaattaatttaagttatattcagatatatcagtcagcagtttcttaagaaataataataattttatcagtggaggtgtaataaaagttaggaaaacgttgttggatctaattggcgtaaaccatacaccacaaaattggatagccacaattattttttttcctaaaaagaagttggatatatataaactctatacgtgtgaccaaatagtttccatataattgagtaatttttttggcagcaccttaattatattttcttcataaaatatctacgtatagactgcgcccacacatatataaaatcaaggtcttctcctccggagtccagagtcctatctttgttcacaatattgtactcgtgaggacatcacatcattagcaaagcaacggagtgagtgagctcaaggcgcacgcagacgtatccgcgtgtcgtcgcggaagcagccgtctggcgtgtcagctagctactgcagtagtatgctgtgttggatgtttttataagatatgcggttggcttagcttggagtgcgtgtgagcaaatagtgatcgatttgagtagtcaaccggtgtaggcatatattatgtaatatgatatattttctaaaaaaaacattatatgtaatatataatagtaaaaagaataataaaactcggagacttggtgccaaaaccgctgtcaccacagtccagagttgaagccaaaccatgtctggtttcagagggcatcagcatcgatttctcttctcctataaatagcagcagctactgggccatccgcaccacacgaattgcacatctccacagctcacgattccaacactagctacatatatatgtagctttctaggctactatatacactcaccaccaagtgtgaagtgtgtatatatagtgacagctactgcaatatatacatacgcgtcacctatatattagccaagctagctattat

SEQ ID NO: 9386 - DNA, 122 bp, Zea mays
ctgaaatgtgccaaatatttcctgactcataagtaaccaatcaactatagttttatttagacatacacagagaatctttattgctgaaaaaatgttctagaaaaacagtgattgaactttgg

SEQ ID NO: 9387 - DNA, 205 bp, Zea mays
tggaagatggaagacgggacgccgctgctacgtgtcggtgtctgcaggctaccagccgcgcctgcgcacgtgcacacgcgcgcgcgcgcgcgtatgaattcgcagggtcgagacgctcggttaattttagaggaagaggaagatgtgtaacgcgtaagaggaagaggtgtggccgacggcaacggggatttggagggagtggaca

SEQ ID NO: 9388 - DNA, 694 bp, Zea mays
caacatcttgtctcaacataaaaggcgaatatagctccacgtcgccagatagtgtcagaccaacacgctctactgtgataggacaaaagcgcaacacaaaggtaagtgactagcaatggatctgctatcatagtgaagagagtggtgagcaatcttacaaggacgatgagaagataagtcaataaaatttatacaagcacttcataaattataaagttgctggattggaccaccactaatatggacgatgatatgaaaagaatccatagttgataaaaaaaattgatcaagaaattgaaacgagatgaagaaaaatactaaagaggtgaagacaaaaatgacatatcgttttttactaattatgtaattttaattttctttatgttgcattttttttttacttttttgagttaggatacattttttttcttaattatatgtttgatgatttttaaaacaatttgatagataaagactaacaacttttagtcagtagttggcgtcacagcaggatatacgggaatctcgagtagagcactatcgttgcagacagctacagccgtatgtccgtgtgacattctgctcagtcggccaatcctcaccaaattctccatcaaatccaaccaacccctcaccgcctatgccgccgcgggccgcctagggttccggcggccgccgctccctcgccggcgcg

SEQ ID NO: 9389 - DNA, 213 bp, Zea mays
actctacccctcccctctgcttgccatgcctcctctcttttcgcggttactccccgccacgcctctccaatccatctggaagcgcaattttcaccagttctgtcgatttgcccccctttttttggatttgttcctctcagtctttccaagatcagcgaagagagccccgcgtgttgatgaaatatttggatttcgttactattcgcgtcggcc

SEQ ID NO: 9390 - DNA, 882 bp, Zea mays
gcctgcagagagagatctgacgcccacggttgctcgtcggcgacttgagcctcaccggcctgttcccctctgagaagagcacaccaggattcaagtgcgcaattgccgggcgcttcaattctaccatagcaaagactagtcaagattcaagaagacaaccgtatcaaagacatgcataccctccttgctctatgttactcaatcactatagctaaataccagtatgcgaggtaaatcttaaaaattaagtattagtctacaagaacagaagaacaaaaaagaaaggcatgcgttgcgtggccacaaattactgatctgttataaacatcatgctgcatttgaaacgtaaagtcgtacgttctgccttgaacatataataaaaaaaagaacactaggtaaagttgttctgtactattgtatccgtaaacaaaccgggccggcatgtcacatttgaaatgtgcactatgtttcttttttttacaaaaaatctaagctgtatggtacatacagcaaacccattgaacacctggccactactgatgtctttttttgcagaataagaaaggctggtgataacaccggcgactaaaaatcaaggaagacattcgttagtgctggcttttacaaaggtaataaacaagcaatcaaagagaaggatatagacagtgaggctggtgtgaccagcaccagcaatggaggggccacatggaaagaaagctcccggaggaagaattaagggcgaacctattctattctatatccccttcaagtttcaagctaggggccggggctttttaaggcaacggtggagagcgtcagtggcagcagctcgtggtccgtccggggtttgctgctccgttttcttcagagcagcgtccatcc

SEQ ID NO: 9391 - DNA, 1500 bp, Zea mays
tgcagagcatcgacacacatgatccaacaactgtttccatttcctggcatcgtcttattcattcttgattcgtcttcttccatgtgcgaagaaattgctatcaagcgtgtttttgtagctttgcttggatcgccttgcctccaagttctgttaatcgctggctctgtgcttcagatgcaatcccaccgaggtttgaaatttgtcgttcaagaaactgataaggaaattcaaggatgaattttctgtggtatattaatatgtactttaatgttggttcttgcccgctatgcatgagcccggcagtcccagtgtgcttttatatggtagtttctatttgtgcttaagtatataatataagagaaaaatatgttgtatatgagtttagaaccaacaattatggttcgaacctttatgtctgcatggttttggcatttaactatgagttagcacaatggccatagaaaccgtgaaactagagaaactggtgttttaatatagtagatagagaagataagagatggtctagtaatatgttgcagttgctgacctggttgtgtatgtgcagaagtgtagcaatctgaaacttcgaacaattcaattcaatttctgcgctctaacgtgttcatttgatgtacactcaattcttcccgcgaacaaaatcgtttcatgagcaacacaaaaatgttatatcagagttatctttattaaatttacaaaggaatttgtttgcatctacactactaaataaatatattaccaaaacatatattataatgcatttaattaaactaactcgttgttagtgtctttttcaataaaattggtcaacttatataactcgtacacacctattttgggataaagagagtatatagctgtaaaaaaacttgttgagcgggatgcattaattgacggttgatgcaaaacgaatgaatttgtaaaaatgtcaaagaaatatgtattaaaaagtgtgtcacttgagatctcgtataaaagcaaaaggtgctcacaagtcacaatagattcaatcattttctttgttagattaggcacaacctgctcaggcagtgaggcaccgtctagtaaagcctgatttggtggacagaaaattagagggatttatggggtatttctcttccatgtcccgctttttgctttttgttccgtattttgcaattcgggaagaagtcctgactgcctaatccagtgacaagctttaggcccagggcccagcgcatgagcattgagcccatccagtcttcattccccgagagcgagacgcttcaatgacctcttctgtatgacacgtgggtccctcgtaagctattctacgcgcacggcgcacccagcgcttctccttccgtccttggcaaccaggcccaggcatcgtttcaccgctattcctcctgccccatctcctcccgatccatcggagccctaaccctagtccagccagatttccgccgccgccggcgagagcacggcatcagatccgccgcg

SEQ ID NO: 9392 - DNA, 258 bp, Zea mays
tccccctgaactaggttcgttctactctgccctatgctactgtttgtctgctttgtttggactcactatgcattggtctgcttttttgcctaggcatatgttatgcattcctctctgtctgtttttatgtgactaacagatcatagatctgattcttgcatgcgtgataagtgtatgctttggcctttaagaacctcatatagtttgtggtactgccttactgaaaattctgacaatccatgcgccactcaaggtaaa

SEQ ID NO: 9393 - DNA, 552 bp, Zea mays
ctagcattcaattctagacacaccaaagagatcaaatcctctccaaattccacacaacgccatagtgactagagagagtgatttgcttgtgttctttcgagctcttgcgcttggattgctttcttctttcttgattctttcattgctatcaagctcacttgtaattgaggcaagagacaccaatcttgtggtggtccttgcggggaactttgtgttccaagtgattgagaagagaaagctcactcgatccgtgggatcgtttgagagagggaagggttgaaagagacccggcctttgtggcctcctcaacggggagtaggtttgcaagaaccgaacctcggtaaaacaaatccgcgtgtcacactcttcatttgcttgcgatttgttttgcgccctctctcgcggactcgtttctttattactaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 9394 - DNA, 623 bp, Zea mays
gagtgaaggtatatttgtaaagatgagcgccaaaatattagagtagagatatctaaattgggctgggcaagaaaactcatggttaaattttgggctctactagttgtaactgtaacgtagaaatgagtgggggagggactgagccctcactcaatttcttatttttattgggctggcattgtggcacatcttccattatccagcccagcacgtaacagcgtttggcccaccaagcgctcagcccgctgacttgataacgtaacgagctatccgccacggacatcaacactacggacggcggcgatctccccgccgacgtgggcgaacggctccacggcgatcggatggccacgagcggccgtcgcctaccctcccacagtcccactcccacactagtccttttcccctgacgtggcagcggcaagtgcacccaaacgtttcgatatcccagagtggtgtggccgccgccggcggcttctttctccccttccattccgctccccgtgacgtcaccgaccaggcaagcactccgctccaccagagccgcctcgcctgtctgtccgacccacacacctaccggagcgcgcgtcccgaggtcggcggagcagggtcgggaggagggt

SEQ ID NO: 9395 - DNA, 127 bp, Zea mays
aggcaagtccacaatcagtgtgattagcacctgccatgtattgtgattggcacctgccatgtactgtgattggcacctgccatgtactgtgattggcacctgccatgtattgtgattggcacctgcc

SEQ ID NO: 9396 - DNA, 466 bp, Zea mays
tcgtgcgggagaggcccttgccgcacaagcaggatgggaattacaggtagaagaaggggggagcacgttggtcaaggagacggacgcgaggcgacgaggagtggattattattgtggagagaggcagcggcggaggccggagaggaggccggcgacggcgagattggggagtgcgtgaacggattggggatcgattggattggggcgagggctttgtttttttttgttgctttttttgtttttttattagacaggcgagggctttgttgggacttgggaataagtccaaggctagcaccacaaatgaacgatccggatcgcgtaaacgatcaatcaacggacgagatccagccaccgtgccagatttttcaacccaacgcatgtgaagggcgcgcatcgtatcttatcttcactctccgtccaccaaagcaaaccctacccgctcccttcccgcgccgccgccgcc

SEQ ID NO: 9397 - DNA, 369 bp, Zea mays
aggggcatctttgcgggcgcgggcgccgagtcggcggccgcggaagcgagacgcgcgcccagggaaagggagacgcacacgtcgttctcgatcccagtccacgggtccgactcggattccgagccggagagggagcgaaaggcggcggggtctcgcgcgagaccgatggcgccgccggcgatgtctgcggagaaggccgcggcgaggatgcaggcggcggcgcgcgggctcctggcaaggaagtcggtgcgggcggtgcgccaggtggagcgggaggcggagcaagtccgggcgaagattgcgtgcgaggaggagtccccgctggcggaacccagcgcgcgcgtcgccgtctgggaggcgctgatgagg

SEQ ID NO: 9398 - DNA, 230 bp, Zea mays
cctgttggcgactcaggaagcgtgcaatcaaggagtttacatactcctgttggcgactcttattccctagacagtgggaaaggggaccgtgcctctgttcaggactgactaggcccagatcacaattcatatagtttgcgctcttacatcatggatccacggtgcattgtcacctacagtgcgattgaaagttccatcgtcttgcatccaacatttgaacccaccaattt

SEQ ID NO: 9399 - DNA, 574 bp, Zea mays
tatatatatatatatcaaaaactcctacctaccacgcatccgtgtctccatctctcttctggtgtaattaaacggcacttattagtaggtcttaatttctaaaatgcctgctgattttgctatggtagctaggataccggccacggcgacaggatgcgacgcgaaacatgggacggcgaagacgaagacgacaccgccgcgtgcaatcgtgtagttgtactactgccagtctactaccatgggcagccttacctacccccggctagctagctagcaacctttacccgttaaacgcccatctcgccacgccgcttcccatgcccggtcgtccgtctcctctcgttcctcctccatccaaccctgctgcctatataaaccacacccaacccatgacaccacgccacacaacacacgttacacaccttccagagcttccgttccaagcgagctagtcctcctcgccatcattgcaactagctagctctgcttcttcgtccttagctctcgcacataatctttgaagaacgaacaccaacccaccaacgatcacacactactcaatccatcgactgac

SEQ ID NO: 9400 - DNA, 1145 bp, Zea mays
atgtcactggtgctgccctaatgcacaagcgcgcttgtttcagtaagccagaaagcagcatggagaacaattgttacggaagacaaatgacatgacactattaaacaaattatttagtataagcatacatagacacaccaggcatcttcggtttatacatacgacgatacaaatgcagcacaactgaaccaaacgaaatgacatctatatatgcaaccaaacactgagcagaatgacggtgatggaggaatagcgagcggaggcgggggaggaggagcagatcgaacgcagatggaacgrgaggagcggcggcggtggaagaggagcggcagactcgacgcaggctcgagccgtcaagtgaatgggagatctccacgaacggtgtcagctacgttctgatttcgaaaaggggcaaaaaagaccaagcaggtgatcttttctctgttgatgtatcgaatggcattttgtctgtaaacagcgtgtgagaatggtgaactagcgaagatcttacagtctaagtttgataatggcactattccaaatttctcggtagggctcagggtcctacttagagaacagttgacaggggtttcaacacagaaccatgttatacatcactaagaaaaatattatagatctattgtccatggatgagcaatcaaacctatgcggttttctcgtagagctatattcacagaatccaaacacacagcagcaagggaccggaaaagagagagcactgactcttccatggccctgagccacctgggctcgggcctggcgaggcccttcaccagcttccgcatcttcgtcagcagccctccggcagcattacgacatctccctcccctccgccctcttcggagagatctgaaagtcgtagagacctcgccgccgccgccgccgccactgcggagtggaatggatgggaagtctcgctttgcagtttctctctgccgaaggacggagccgccttccgagctcgtgtgctcgcgcggtgttatgggcttagttgggccctcgacccagccgcacggcctgctagacacagtcgccgttggatcgtacagctcgtagcggacaacgcggattgcgcgactgcggcctgagcgacgtgaatccaagcgtgcaagcaagcggcggta

SEQ ID NO: 9401 - DNA, 666 bp, Zea mays
atgtcactggtgctgccctaatgcacaagcgcgcttgtttcagtaagccagaaagcagcatggagaacaattgttacggaagacaaatgacatgacactattaaacaaattatttagtataagcatacatagacacaccaggcatcttcggtttatacatacgacgatacaaatgcagcacaactgaaccaaacgaaatgacatctatatatgcaaccaaacactgagcagaatgacggtgatggaggaatagcgagcggaggcgggggaggaggagcagatcgaacgcagatggaacgrgaggagcggcggcggtggaagaggagcggcagactcgacgcaggctcgagccgtcaagtgaatgggagatctccacgaacggtgtcagctacgttctgatttcgaaaaggggcaaaaaagaccaagcaggtgatcttttctctgttgatgtatcgaatggcattttgtctgtaaacagcgtgtgagaatggtgaactagcgaagatcttacagtctaagtttgataatggcactattccaaatttctcggtagggctcagggtcctacttagagaacagttgacaggggtttcaacacagaaccatgttatacatcactaagaaaaatattatagatctattgtccatggatgagcaatcaaacct

SEQ ID NO: 9402 - DNA, 1097 bp, Zea mays
tagtctccttaaatagattgtatctcttttatctctaacaaacatactctaaatcatatcatctatacacaaatatctatattagagacattttaaatttttaattttttacatatgtatttgtcttactctcgaatgtattgtaaatattttagttttgctaaactggttgtttaaagtattcaaatggatagagaaccgtttagagaaactctatatatagaggatccaacagcgttctctaaatttagatgactatttagaggacgctgctgaagcgagtggaggacgacgacttcatcctctaaatttagagtatataactctttaagtggactcaacagatacgtagaccatatagtgataccccgtaacgtgatcggtgatcccatacaaaatcatttaatattcgaaatgaaaatgtgtttgtttttatgtgcatgcagcatgcttatattatcctcttctatttttagccatcgacgttgtttagtactttccacgtgctaaaacaacttaaagagtatctctatattctttaatatatataaatagagatttttataaaaaagtactcttcaacagcttatctaaatatctatttaagagcatcttcaagagactagctagatgactcgctaagccaaattttagttactcaatagtaaattaaatttccaacagactagctatctgactcgtaagctatctgactctgtaaattgactctctcactagctaaatttggctagccacctgactagtcaaactaaatatatagtctgttggactgagatgctatatatatagtgtaatctttatgaaaacgtaaatagatagtcaaatagagagaaaaaatgaatagtcttttgtagatgctctaatatatatatatatatccaaacgaggtacttgtgttattggcacgtatgaatgctcagccacatgcgtatgtatacatcacggccacgttcacgcttcccccttctgcaagcaaacctaaccaagcctctgcggctcttcttcgaatccaactcctcccctgatcgatcccaatcgaacccaccaagccgataccctaaccctcgcccttctcg

SEQ ID NO: 9403 - DNA, 1320 bp, Zea mays
gtatattgtgatatttgttgatgacttggttatatttgtggtgtttgtttgaatttatctgactataagcaacaatttcaatattttttgttttaatgtgctgacacactcacagtggatttgtgcacataatatccatcaaaagaagatgcttgtataattttatatttgatactgttgccatgagtacacctcttttcagtttttagttggagctttttttccctacatacacttagctcatgtttagattgccaggatcctagcacatttcatgtgaattggtgctgatttgatgcatctaaacaagcattaaaagtgtgtatttatgatttttattagtttttgctagcagaccttcaggctgctgaaatttcttcaatgtataggttctgttttctacttttcttccacattggtcaggcaatatgtttttgtgtcacactcaaaaaacacttctgaattttataaacagtgatttctgtataattctgattccaaacaatggtggtatgtcttcttgtactcttataatgtactgatgatatcgggttttatcttctattatggttgtaaggcttgatgcctgaaactgctgattattaaatcactttcaagtttcaacacacctaaatttgggatatgggatagattacattatgctagggtaatcgaattttctttttttctaccctttcgctgttggtggttaaatgattcttaacatgatctgatacccacattttattttgggaaaataacattttttgttcgtctaattcagtttaagtgtttttagggcaattcggtttcagtatctttttcaatcttccgtgaacagttaaaaattgaagttatttaactaatttggtactctagcctgtcaaaaaaaatacttgtgttgattccttctctgaaaatttttccatttagtttctcgggctgtattcccgtctgatttgaatattcgttcaccaaacctttcaggccggagtctgatgaagaaagaaatttgaaagaagaaatcaacctcctgaaggtggatcttaaagaaatcgagggaaagatgagtaatggttctgagcagacatcggtagatgcaaaagatttgtctgagaagatatctatgttggaaagccagcttgagcagctttcaagggagttggatgacaagattcgatttgggcaaaggccacgttctggtgcaggcagggttacaacacttgcacccactagtttaggggaggaaccacaggctacagtggtggacagaccacgttctcgtggtggtatggaaccacccccaaggcaggaagaaag

SEQ ID NO: 9404 - DNA, 72 bp, Zea mays
tttgctatcttgtcaggcttgctgactatacagttctggttcaaggaacgcctttctgaggtctcttggatt

SEQ ID NO: 9405 - DNA, 1500 bp, Zea mays
agagcgaaatccaatccacgctaatggatggcgacgaccgctacgctaccgccagtgcgtctgcgtggtggcgtcactactgttgcgtcatcgtgggtagcgtcagcggcgtgacgtaatcaaccttccattgttttctctcccactgcctcaccctcatggcggtcggtggtggtcgtcgaggctatatgatcagatcagatcagatcagatcaggtttgaagccgtgtggacgacggtatatgtttaatctgatgctgacgagtttgcagggaatgaatccggccggccggttgcatctgcgtcacatggtttcacgcaacgcaaagctccagcctccagctccaggtgcctgcgtacagccctgtcaattgtcatatggcacaagctagcgcggtcggctcaccatggtgcttgccgacaaccatgcaaaaacaatttttttaggggggccagcagtgtgcgttgttttaggcttaattaaggccacctttcgatattattgtccctttttttaaaaaaagaacgtggaataagtaattcttcgttgctaattaacgggagttccaaccatttgcttatcgccggtatgacttttattacaagaaataaccaaaatcaaaccccacgtccccacccaccgagacctgcagcttgtgattgatccgtaaaatgagcgcgagaataattaaatgcctgcgattggatcgatctggtgggtacgtactagggatggcaatgagtacgtgtatgagtaaataactgtagataattatccattgaatatgrgtatggtgaaatttgatatccgcgggtacagttatgaatataataaggtatccgcggatatttttttcgcgggtatggatatccagtatccatacccgttacccaatggatatctaacaagtggccatccagatttatatattatcataaattcttatttttcaatttttatccataatatgttgtttggtgctgaaattatcatttgatgctattggaatgataattattttgaaatgtaataaaattgttgtttggtgtttaatactaaaattgtagtgggcggacgggtaacgtgtatccactggatagcggatacccgacgggtacgggtacggatacaaatccatacccacaaacatttatgggtacggatatggrttgagttttatctcgtgggtatggattcgcgaactatatatccatatactacccgcccgattgccatccctagtacgtacattgaaatccttaatcaaaaactgcttcaaatgcaacatgcatgcatgccagggctactaaaactcttaattattgccgcgagaatctgcctggctgctgcttggaaactcggaatgtataatgataataatccctgctgctgagtgcgcggagctcatctgccgacatcatcgtgggcaacgaattgaagacgactagcttagctagctagtagtactcatcatccgaacacgaaatctgtcttcttcc

SEQ ID NO: 9406 - DNA, 466 bp, Zea mays
tggcggcggcggcgcgggaagggagcgggtagggtttgctttggtggacggagagtgaagataagatacgatgcgcgcccttcacatgcgttgggttgaaaaatctggcacggtggctggatctcgtccgttgattgatcgtttacgcgatccggatcgttcatttgtggtgctagccttggacttattcccaagtcccaacaaagccctcgcctgtctaataaaaaaacaaaaaaagcaacaaaaaaaaacaaagccctcgccccaatccaatcgatccccaatccgttcacgcactccccaatctcgccgtcgccggcctcctctccggcctccgccgctgcctctctccacaataataatccactcctcgtcgcctcgcgtccgtctccttgaccaacgtgctccccccttcttctacctgtaattcccatcctgcttgtgcggcaagggcctctcccgcacg

SEQ ID NO: 9407 - DNA, 1500 bp, Zea mays
tggtcgtttcccgaaggattcgacggggggttggggaggattggacggagcacggaggagttcttcccgtggcccgtggtctggctgtctgacggcgcggccggtgcgctgtggcctgcagataacgctttttctagtcggtcccggtacgctagaggctagatagacgcgacggccggggccacgcgtccaggcgaggggaggggaggcttcgcgaatcgaatcgcgcgataaaacctgcggcccgccgcccatcccgccatcctgatccgctcgctcccaaatcctactgccgtgcgcgtcccgctcctgcggctgcgccccccgcgaggagaaagccggttagccacagccccacacgcgcgcatcacgccacaaccacaccacacggcaccagcctcctccgtcgtcaccgcctcgggcctcggccgatcgatcgggtctggcggcggccacaagcgtcgctgtttaataaatagccctgagcggcctccccctgcccctcagttcagcctcggctggacatcgagtttgtaccgggtgagctctctctctctctctcctttttgggatccttttccccgttcaatcctcctattgttttggcgccgagatcgaatcgctgggaggcccaatcgtcctcgggagcacgaaagctgtagttgtagctagtgttggcctgcgcaaccaatcgccaggtccccgccctcttcgttctaagcgcggcgcttctccgcccggttgctcctcctacggagtcggctccgtcctactacaccgtttcccccccaaattttctggcttttctgggcgatgatggccttaccgcccgccgccgcctcttgcgttggctggttacccgcgccctgagttcctgcaatttttttcttttgtatttctgattgctcaccttctttgttgtttgcgacgaccgtccggaaacacgacggaacgggggcttctacctcgagaaagctccccatgttcccatcgccttgtacttgcggctgcctagttagtacttcccctcgaacatgtttggcgcagttctctcagctgcaaatcacagatacgctagtgtgtgtcgagtacccagagttttcccttctctagaaaacatctctatctcgagtatgttgcgagtccttcatgccgtgggttctcggatcaactttaggctgaacacgggtattgtgggtgggtttgtcacaagacatgtcaggtcaggtgcctagtcctggtccacacggtctgttgtgggctcattcctgttgttgccgtttggattatctttttttttttttgacgagactagttttttttatatatgttcccttgctaaggactatatgcctatccgatccgcattagtccttctagatttatctaccattctcgggcacagttgttgtactgcaaggcttgatgattcaaaagctgtcgtcttatgtaagctgccatgtcattgcaggaaacagcttggtagtataaccactgaag

SEQ ID NO: 9408 - DNA, 259 bp, Zea mays
tctaaaaccgggtgtgacatccgaaaaaacattttccctttgctagaatagcaataaacaatgacagatggggccctccactttgtagcacgctgggcgtataaataagaactcacaccagctgcatttgatacgttgtttatgccatttgcattattttctcaattttatagctcttgctcactagcacttgctagattttcaagctctctgagcttcggtttaaaaagacgtgttttcaacatgtctggagaaaaaa

SEQ ID NO: 9409 - DNA, 1500 bp, Zea mays
acgtccgtcgatttaggcgtctctcttgtcttcgctcgattccgccgtggcttccgtgtcggtagatcggttgcgtgggatggccgtggtggtaagtgctatgtccgctgcgatcggggttgtttatcataacctgtcccttctcgtcgatttgggtgcgtaggatttcaattcggggaggcgctgccgatccggttggttcgtgatccttgacgcggtagttgggggattgctagtcgttggtcctgacggctgaccgtcgcggtaggacaaaactgtcgggatgctggtgattgttcatcgtcgggccgcgaatctggaatctgttaggatcaagcgaaatgcatgtactttaattgatgttcattggataggcatcttcgcactagcttcctgtttagtatatccagagcagagcttggtgttaaatgggatgcaatttccatcgacaatatgctaattaacctgtgtttcattttgattgggggcgtaaggaaaaatccttttccagcctacgaatgccccatgctttttctaagatttacctaactgtcaactgcttaattttgtctgcaagttagatgaaatgcgtgtcaatatctgtgttcgatcctagaaacaaaattttatgaggggctcaatagtcaaaaactcaaaatcatatacttgttcctcctccctacttgaagcaaaaggttatggactgcttagatggtttactgttcttatgaccaaaactactcttaatcctgtactgtacatgtaaggttcacattgagaattatgggtcaattgtagacacattaaaaccctttatatgttgaaatgtgatttcctgtttcgtgaaacgagtaatgcatttttgtagtaagcgaatacataatgtagttctgctcatgggagacgaccaagtagacatcgctacattggcaacctgcaggctgtagatgaaatgccatggcagtagcccattgatggcctgactgtgaacaataatccaaagtaagtcaaaagccttgaggtgactggccaatgtcaagtatgaagactcaatttggtagagaaagaggtcaggattatttgagtcacaaatactgtgaaagggactgtcagctacaaaatataattaggatcaatcgctagaaggattctcatttttgaattattcttttcatcatccaaacgccaccatacagtgctccgttcagcgcctaccttttcttctacccgtccaccatgcgcgaggcgctctctcgtgtagctagctactagacgaccgccactgccgtctggtcttcgtcgggtccttcgccgatcaacacccaccatgtatgtgcatccgttctctccccttcctgctgtgtgaaactaaccaccgaaccctaagtttgtctatttgtattcggatctgatctaattagaaatttatatgtatacctaataaatttgaattttccttttctttttgcaaaaagttattgggtgtacatttgtacaccc

SEQ ID NO: 9410 - DNA, 693 bp, Zea mays
caagcgatctcctcccctggatcgctcgccgatcgcctctgctgcagcgcgatccgccacgggtacgcgcacgcgtggcgcggagacgcacgacggtggcagcagcagcagcgacgcggatgcgggtgggctggtggggtggtggtggaaggcgacgcgaccgcggacaggggagagagagagagagagagagagagagaggtgaggggtgccacggccaggcgaagccagccgggcgcgactgtcatgtaacgcaattagaaaaaaatggggaataatctgcgccgcccgctcgcgccaacgtgcgatcgggttctcaccacgagcgcaccagcgcggcgcggagattttcgctagtcgctactccgtttctcttttattatcgtatcttagtttaaaaataaaaactagccggtgataaatatttaagaactattatgaaaagacacactatgggtttcatcaaaatgaaatagaagacgagacaattgtcaaagaaaaaagaattgtgtctcctcgtcgttagaatagaaaactttcatcaattatcgtcattagcyttcgttaaggacattcagtctctgtccacggagaataccacgatgtcattacgttgcctcctcggcgtcgagagcgcgctccttttccctcgcaccctccacttgctgttgaaccctagctgccgtggtctcc

SEQ ID NO: 9411 - DNA, 166 bp, Zea mays
gcgtgcgtggcgtgcacagattgtggttcggatcgagatgtaaatgaatcgtggcttagattttggaacctactacacgtgagatggaattcttcgatgacgagcttatttagttccataggttgttcctggaatcctgagtttagttggtttgctccttcgtgta

SEQ ID NO: 9412 - DNA, 1500 bp, Zea mays
gccccttctccgatctctcggaccgggatgccggcgattccggcgagacaagcagtagaagcccaaagctttgcattgatccgatcgacaggatctcgccatcctttcctgcgtgctgccccggcccgcgtgcgccatgtcccatgcatgtctctgtctcgtccatgcgtacacatccattcatctgcacacacacacacctctgtgtagtagcctgtttgtctcgtcttgtttagagctatactacacacaccatggcatgccatgttccagctctgcctgttgttaattaattggtttacagctctagtagattattacgtcgacagtcttgggttaataacagacagtagtgcacctccatagtagtagcttgcatgtgagctgagagttgtcgtcactagcgtttctgcattgtatgttggttaccaatgcaaataaagggctagatctaattacacgggctctcggtagctagttgttagagcatgtataatggagagacactaaaacagttctaaaaataagagactctattatataatagagtttctatacaacggttcataaatatatgacaccgttaaaatatttcaaaataactttgacaagtcgtcttattcaaacaaataatgagttatcatttattttttgcgatttgttttatcacttaaagtagtttatgcttaacttagaattttacaagtttaataaatattttgaataatacgatgatcaatgtttttgacaaaaaaatagtgatgttatatatttgtaaacgtaggtagtaccatttacgaggatcctcctacctccctaaatagcaagagccggcagcatcaggaaaaaaggacccggcaaaatgtgcgtacgcccactaattagatggcatgtgcagctgcactgcatgctagctagtggcagcaagacgatggatctctgtccccccgatctgacgatcgatcgcgtgcttgcattggcttgcaggcaccatatatgtacgtcgttctaacgaaggacaggcccagtgtggcttttagcggcccagctgcctagcccatatatgcgacaatatacacatgaatcaaaaacctactacacccaagatccagcgtgaagttactagggccggcccgttttctttgtctcttggatctacattgcatgaattttttatatataataggttgttgaagggtgttcaacaacgtagttgtcgcagatcctcgatccggactctgaaccctcccagacgtgagaagttgtagaagcccgctccttttccagtaatccaacacagattgtatggtacctattatactttcggcccatatgtttggacggaataccggtgtgggctttctccagtgacgaagagcttattgggctcttggccttcgtggaacgcgacgctttcccttgcgctccaccgctccgcgcctgcagccgcattctattcactcacggcgtcggcagcgccacctgatagtaaattgatca

SEQ ID NO: 9413 - DNA, 992 bp, Zea mays
tcttaccagctcgcacctctcctctctctctttccgccgcgagatgggagtttttttgggaataaaaaaaggggcaggccgcaggcagcagagccgcagaggggcagaagcgagaaagggaaaggggcgcggcgcgggtgtacagaggaaacggcgcatgtgaatatcgtgagcaggactggacgaaaaagtcgtagcttgctaactcgacttaatagtggctcgactcgactcgattcatttataatttgtaaagagttgagcttatatttcaacttgttacgataatgagccagctcaagctggctcgcgcgctgactcgcgagccaaacgagttggagtaattagtcaaattacaataatttcggattcaaaatagttaatcttgtactctactatagttaatcttgttttttgttgagtgtagaatcttaagttgcaaactctattcttttttctaaatagatcttcttcttttcttttgctacatgtttttatatccgttcgtagacactagatatggtattatccaagctggctcgcgagctaaacgagccagctcgagttggcaaacgagtcgagccgagttggatcttcagctcgttaacataacgagtcgagtcgagccagctcgttatcttaacgagccaactcgagttgagtcgagccgagccgagccagctcgatatccactcctattcgaagccatgggcggtgggccggtggccagcgccacaggccacagggtcaagtcgacaagtcgtcactgttcgcaagcctcttgcctaggcagtaggcacaccgcacacagcagctgagcagcaagtatcaggcacagagcccacattgcaacactgatgtctggaccccgtaagtatcaggcccattgtcagtgactatgaacagttgctctcgttgtggggcgagtgacagtggactcccctggctccccgtcacagcggcgtcgttaaatagcggccacccattgtcgc

SEQ ID NO: 9414 - DNA, 849 bp, Zea mays
atccctgtctagcctgtgcgtgacgtcttgtgcaagtactatgaacgctgcgtgacgggacggcaaatattcgcacaagattgatggccccggcccggagcatgcagtcatgcacccactatagctggcctggatctacccgccagaacactagcacggtggccgttcgattgttggggaataattatgagctacattgtttttctaatttatttaagttttgaccaacctgaaaaattacagggccattactggataaacgaatagggcctaaataatttggaccaatggctgaagcctaccacggtccacggcagctcttgttccgtgggcgcaagtcgaccgatcggcatattcgccagcagcgcaggcttccattttgatgcctccctccgtccccttccgctccaatcagcggccgagctgctcctctcgcccacgcccgagaccgagaggccgcgccggcgcacccaaataaacccgaggagtgcctacctggcctgggcgcctggttgagcggtaaacaaatccgtgggcgtcctgcggctgcgattagaatagagtagaattcatcagcgggtcgccgtcgccattggcgcggtgcgtgtgcgagcccgagccgtgcgaagcaggtgaggcgaggggacagacgggacacgggagcgaagcaaagcgaaggaaggagtttccagtgagcgcggatcgcggaggcggtttatatagccggagggcgcgcgctccggtccgctaacgtcctgcagggagggaagggcaggattaggcagggcagcgccgcgccggccggaccgcccgcccgcccgcccgtccacgagccacggactttcggcc

SEQ ID NO: 9415 - DNA, 89 bp, Zea mays
agtaggatctggaacctttttattactttaggataagtaattataaaatatgtttgtgtttgctaaagataaacaaatggtacaattag

SEQ ID NO: 9416 - DNA, 591 bp, Zea mays
actccaagcacccaagcatactgaatagtgcattcaatacaagggcaatacacttcactccaaagacataatcaaagtgatcgatccgctcaaagtccccaattcaactctagcacattacgacttgtgagaggatcccttgtgtttctagttgttcttgtggcttggctttcttttcttttcatttgtcactctcaagtgctttgtaagcaaggcaagagacaccaattgtgtggtggtccttgcgtggtctaagtgacccgtgagaagtaaagaagaaagctcactcggtctaggtgaccgtttgagagagggaaagggttgaaagagacccgatctttgtgaccacctcaatgggcactaggttctttagaaccaaacctcggtaaaacaaatcaccgtgttcatccgctttacttcttggttgattttttccccactctcttggactcaaattcatttctaacgctaaccccggcttgtagtgtgtgcttaagtttataattttcagattccgcctattcacccccctaggtgattttcaattggtatcaagcccggtgcttcattagagtctaacaactcgaaatg

SEQ ID NO: 9417 - DNA, 974 bp, Zea mays
ccgaggttcgagtggattactgaaaataatccgctcgaaggtcttcatctcaagcttttttagaaatcattttcatcttcatctcgtgctttagaaatcaggattgtcttgtcttcatctcaggctttagaaatcagcatttttatcattagttcatgctttagagatcagcattctgtcttttggggttgatgattcattgggtgtagcccccgagctttgagtggattactgaaaataatccactcaaaggtcttcatctcatgtttttttagaaatcagccttttatctttgtcggatgccttagaattcagcattatatcatcagccttatgctttagagattagcatacggttttgcctttgagatcaacaatgcggtctatccatgtcttgttaggtttggaatttatttgatctgcgacagatttgacatctggtagatggcccttggctagtcttcatttcgttttgtgcttcaatgctcctgttgattagacttgtacttcatcagctatttttggctttcctctgatctccatcgatatctttcttctgtcttgattgcattgcgtatactgtgtggatgtgactgcttgggaaaatctattgaaaattcctggacgtcccctccccaatgggtgtagccaagggatggcttggtgcactgagcgtttagcaaactacccttgagtagtaacttgacgtgaccgcggggtgtaatcatatcgtccaagcagttgacctcagtcccaatggtgtcgtgttacgcgaaacagcgtctgtcgcctgacttgtttccagacgatttgaatggcttattgaatacttgcgactgttcagtcgccgtggtaggagatgagcggttgcctcccgcccttataaatagactgcctgcttcgctggtgtcttcacacatctttcggccgtttgttgcttattctcctacctttctcttctctttcaatcaacc

SEQ ID NO: 9418 - DNA, 435 bp, Zea mays
tgtgagggagtgtgacaggggcgacaaatctagacctccacgcatgtattttttcttgtgtttatgtgatgctaattactaggattgagctaagattgtgtgcacttcggtttgcacattcacattatcatataggatgagcagagcaattgaaagaaatttaaccaatttctcccttggaacatagtaatgcatctttggatttcctggagtcaacaacgtactatgttttgttgttgtatatttatgttaagtcaccacttcctcttatgataaatacattcttttaagatttttgtgtccacatttactgtgatcttttttggaccctgaagcacgatctacgtgcagtttcttgaatcctagaataacaaactacattatacttgaacagatgcaattataagtgagaatgatgatgcattgctccagcag

SEQ ID NO: 9419 - DNA, 67 bp, Zea mays
atagatagttcatagctagactgctagactagataattccatctccgtcgtgacgacgcaaggcctc

SEQ ID NO: 9420 - DNA, 456 bp, Zea mays
gatgtccggtgcacgccacgtcagccgaccgttggcgccagtagcagtcgaccgttggatccgaccgttgtcgtctgcccgttggcacaccggacagtccggtgcacaccggacagtccggtgctacagccagagagcgcctatccgtggcctctctgcgcagactgtccggtgcctcaccggacagtccggtgcacaccggacaccagtgtccggtgcgccaccaggcgctggctgacagcccttatctcggatttcttcgctgatttcttcgggcttctttgttcttgagtattggactcctatgcatctttttatgtcttcttttgaggtgttgcatcctcattgccttggtccaattctcttcgcatcctgtgaactacaaacacaaacactagaaaccttattagttcacggattgtgtcgttcatcaaacaccaaaacccaattagccaa

SEQ ID NO: 9421 - DNA, 398 bp, Zea mays
ctgtggagggctccgcgcgtcacgcggaagtgcgctcgctagcgcgaagcacgggcgtgcgtcgaaaaggagtcaggttttaatagaagagatgattcactatttggttgtataaataaggttatagtttctcacaattatggtatgtcattacaacttggcaacttggaacaatgaacaagtgcagctgatttgaataagcttgttcaaaagattatagcaataaagttgcactttgtctggaattctttataaatatcacactgcaatatcatatgtgatatttaattttatttttctctcatggtagccctaacagaaagggaagtttttttactgctcgaaggttcaaccaaggaacacatacataatatatcatctcttatgactatgatgat

SEQ ID NO: 9422 - DNA, 1500 bp, Zea mays
ttccaacggttctccgagaatacagtatgacatcagtcacagaaggcattgacgcaatcgcgacaactcgggttgttgtcactggagatgtgagcaacaacgccaaacatgccctgactggccagtccttcaaccgctccttcaggttatatagcagttgtttgaaatctgtttcaatttctgctattctgttcttctttctcactgtgtcttcgtgtttgtcgtatggcttcagcgggagcggggcatccatggacattgtggtgtccagtgtcagagcttacctgagcgccctgaacaagatctgcagtttcgctggcgccgtgaaagccagcagcgatgtagctgagaccgcaagcgtcccgagcacagaatgagcttccgtttagttcacagtgacatgttcaaaatttctggaaggatcttccattgagcttaggacaggcaggaagtcttggggcctatgtagtgtacaatttatgtgtgtcatatcccgtgctcgttgccagtttgtattgtaccatatataaaccatagaatatgttgccatttagaagtctggccaaggtcagctgtaatgattcacatgcttatagcctggaaacattagacattgaaaacccgagcggtgaataaaggatgcccaaggtagaaactgtgatgaatcatccatatcagtgttgtgatgccagcatgaatattcattcggcgaaccttacatgcggtcagccggacaacaccagaatcggaggcatgcatgatccacgtagcctagaatcttgttgctgtaaataataaatcgattgatcgatcgattgcaagcaagtggccagagggcagcaaataataaatccaggttctttagtagcagcaaatcggcatactttaccagatcgccacaacgatccgtatctctgagactttgagcaggccgggtcagcacgatcacacggcaatctactcctcccctacttgctagaggacagaaaaccacccccaagaactaaaaaactaaccgagccatatcatatgatatgatatgatgtgatatggtagtagcactagcagcagtatgaaaaaggcagagggaacaaaagaaaatggtggtggatcctttcgggcccctgctctagaatactagcgcaactgatatggggtcaattcgtggcaagatttggagcaaatctgctccaggatcttgctttccatgcgctgggactttcttttagtcaccgcacctttttccccttcgctttgctttccacgattccacacatcatatctcctcgaatcgtttcatgtgcttactgcttatatatatatatgtgtgtgtgtctgtcgactcaagcacacacacacacatcctccaccaccattcatcagaaagcgaagcaccagcctctgatgccaagccaaagcacacacacctcctccagcctttcttcctctacaaccccaattcttccctgcagctctgctgctgccttgtttcgatcggtc

SEQ ID NO: 9423 - DNA, 1111 bp, Zea mays
gtgtaagcaattagaatgaacaacaacaaaaaaacattcaacatgttccttgcaagaaaaaacttttaccatgtcatcacttatctgtgtgggtttttgataaatgataacagcagtaagcacctgccaaaagtccccaaggacagaagattgccaactgttttttgaccatcacccccattgggtaactgagcgtgcatgttgtagttttttttaagtaggcttccacgtcaccagataagcctagtcacctaaccaccaccggtgttagattaaggaatattatcatcaacaggtgcggtgataatgcttgcgaggagggcccaccgagcccaacgagtcaacacaagagttggcgtgcggcaacaagaaaccattagctgcatattgcccccccatgcttatgattgtacttcgactctaatttagtgagtgtaccatgctaaatgaactcttttgagaacacaactaaaatctatctttttggggaaaaaacgaaacaaagttgaagtatgttggcaaaaaaagttggagttgaagtgcaaggaagattatgtcaactgtgttaaggttcatattaagaacatagtgtggatatagtagttagaagttagcaaacttcatagacatttgtaacatatccatctgtatacatgaatgtacgcacacgcgtaagtttatataaacgatcgattctacacatacatgtctccctcgacatgttagcactggttcgttaaaataatcggtttctggaactgatactaaaaactttagagcatttagttccggatgcaggaaatccggtactgtagccgcttccccaatcggtacccctttccgcagcagcggtgagactgacatcaccaatgatagtcgttggagtgtgcaccgtgactatgaatacgattgacacattttggctctttcctgcatatgaattgccatctcctgcccccatctatgctgcttagctctctctcctctttcaccagcgaaatgatgtgctacatgtactaccaacccattcattctcgagtcttattaaaataaaatgtggctgtagtagccggttcacggcccctttctgccatgtccatcccccctataa

SEQ ID NO: 9424 - DNA, 1500 bp, Zea mays
aaacgatgagatacaactcatcaacaaaagagcacctagtggaactaatccctacatactatcatactagataagcaaggaccagcctccactaacatcagtccaggctgaacccacagtttttaagcagagcttatatacaacagctaaaggcaaacgagcagctacgaagctaacacgtcagataaacctagttcaccaaaaggacattccagcacttgagcggcaaccaactacagacatgcgccaaaatcacccttcaaccagaaatacggcggtctctcggacaccacccaaacgaccggctcatcacttcacttgctatctttctgattagtcggctttcttggatcaccatcctttttttcctactctctctgaccaatagcccaagaatccagccaaaagcaacagagaaatattatgttagcaggatcaaggagaattttttcacaaaaaaaccaatcatttctggttctccatatagcccaaaacaaagccccacaaccaaaaatcagaagatttgacattttgtttttaggatttttcatccagctatcacaaacttcatcaatattttttggaatgtaatccaaattaagggcaatttgaaccactctccagacaaatctggcaacagagcatttaaaaaataaatgatcaattgattccatgccaccacagaagcaacactcatcagaacctttccaatttctttttttcagattgtcttttgtaagaattttgtttctaatcaccagccatagaaaaactttaattttttgtggcaatttagatttccatagaaatctgtaaggaactttgatctgatccaaagaatttctcttatacaaagaattgacagtgaaccctttattgcccaatctccaaataggtttatcttcataacttgacaagttaaaatcaaaacataaagccactaactcatcaaaaagcccctgaaggttgccagtcattcttcttctgaaagaaagagcctcaaaatccgaagacagaactttaaacactgtaatgtctttgtctgaagataaatcaaacagaatgggaaaactcaaagccagaggctcatcaccaatccagaaatttttccaaaaactagtacgacgaccattaccaacagccatcttacaatgtttaaagaaactctccctaagctttaagagttttttccaaaaatgagagtcagtctgtctttgattaacagaaataaggggttttcccttaatatatttttcagcaattattctctgccataaactattagtattttccaaattccaaagccatttggatagcagcgcatcattcatagaacccaaattcaacacacctaaaccacctaagcttttggaggagcaaactgtctgccaattaaccaaatgcatcttttttgcctgggaaccaccttgccaaaggagactttttctgaataaatccaactttctaataaccgatttaggagccggataaatcgataac

SEQ ID NO: 9425 - DNA, 382 bp, Zea mays
caatcaacatccagtaatgtttccatctctttttctatcttgttctcatttgctaacattggatcaagtttttgacacgccccctacacaggatgcaagtgttcattctttttctattggagtgacagaagttattaatagcaatttacggatagagctgagtgctgatgacatagaatacatgtatcagaggtatatttgttggccacggccctactaatttgaaattagcaagtacagacagatttatgtttatcaggtgttcatactcattggtgttcatactcatttcaatttagctattacaaccatatttatatttgttgaccacggccctactcttaaattagatgctatccaaatacaagtgttcctttaatct

SEQ ID NO: 9426 - DNA, 227 bp, Zea mays
ccccctgcatatatgctgcattgatacagatttgcgcttgagagccacggccaccacaacaccagcactaacaaatcccaaaaaaaaagtctagccacagcccacagcacttcttctccacaacgaccccacagagggccagagcaagacatccgcaccgcatcgcatatacccagagctgtgatcgctgccattaattctcccctcataggcctccaacaaggtcg

SEQ ID NO: 9427 - DNA, 368 bp, Zea mays
tgtgatatgtgagtgatgagtcaattgactgctctgctagtcactgccagtgctaggcttaaagcttaaacggagctaataaaatttccttttgtgtaaaatgaaatgttcccttttgtcttattattgttagcaagtgaatagaatacgtagcacatgccttgcattcagtggccaatctttcttagtgtacatataagctatacaaattattgatcagtaacactagctagggaaaaattgatccacgatgtacgtttggttaagtcaactcattgaaacggttatgctgtccattaccatgcattaataggattactcctcacaatgaaccaaggacggaactgaaggaaagaaaaaggccaccc

SEQ ID NO: 9428 - DNA, 224 bp, Zea mays
tgcagcagacgcgtttgctcctcatcggacatcacgcgaaacgcttcattggtgggatgcgccatgttatccgccagctcaaacagatagttaagcagcggcgccagcggcgcggaagtcagggtgttcatcatcggggttcctgcatcagaagatggattttgcgtcaggaacagaatacgatgaattactcgcatttcactattcgcgttcaggagcagacg

SEQ ID NO: 9429 - DNA, 111 bp, Zea mays
agtgcaggctgctgtcatcttttcgtcatcccttcgcgatgtcactgtcacagttcgccgttagtttaggcgccaatgagatcgatctcatcggcactttacgaggcgaac

SEQ ID NO: 9430 - DNA, 333 bp, Zea mays
ggtaatttcttcagggcccccttgcctgcctcttttcatcctatattcaatggcgccactgctctgaccatgtggtggctgttggagataccactggcatggcttaaaaagtttataaagctctgcgtacttgcgtagctcattgctaatgaatgatcctgtatttgagatgtaaaacattgctagtgcagtggtatctattgagcttcttgatctccacacagtacgaacccgctccaatgcccgaatccctttcatttatctctcccttctttttaattttgtccacagagtgctccgatctcgatcctggagcagcacgagctcgcgagc

SEQ ID NO: 9431 - DNA, 420 bp, Zea mays
ggtagggttcttatatgcttgttttttcattgtgtatatgttaagtattgcagttgggagcagcttcgattttagctgatgtgcctgttccatctatcaatgaccttgtagatcagattgctgatgtcatcaatttttttcaggtagcatttcagacttttgtttcttatgtataccacatttatattttgtcaaaaaatggtcctgtacttgtcctaatgaaaatataaattgccaagatcaagatcaggatgaatgttgagtttgcatcctccgatctgagttgtgatgtataatgtatttgagttacgccggccttgtgggttttgatcgcctttttttgttggtgccrggtttggcaagatcagaaggctggtggccaaggtggccctgcagtgcgatgatgacgagctcgtcgct

SEQ ID NO: 9432 - DNA, 484 bp, Zea mays
atatcgtcagacctctcctaagctaccctgtaaatagtatcactctgttttagttctactacgtttgtcctagtcgcacaacgtatcgatgaaggaagacatgaaaaagaaatctaaaaagaaaaagaaaaaaaagaggagcagtagaattttgatttctgaagcagcaccaattggatatgtccttcctgagggtcccaggttattctactcttgccaagcaaggcgaaagctgagctgcacaaactgcgcgccgtcgagaatgattttgccgtcctgatatgtgctgagtgctaacacgtagagatgaactgctattccattgttaatttgtcccatttgcttggcgacctcggattctactgcctgtacagtgttcttgcagtgtatatagtcttgcgcaggactactgcagttgcgcgatttttcagtgtgtgttggtgcgtgtgtcctattcttgtacatgggaattgtattctgatga

SEQ ID NO: 9433 - DNA, 1449 bp, Zea mays
cacataagaacgtgtccgagctgtagatttgacacataataccaacacaaatatggcacggttaaggccggcacaacggcctaactgttcttttactattaattggccttcaaaaaaaatttaggataattgaacaaataataatatgcatgtgctaaactccaactctaactaactcaaccagccacaatagaccacttctccctccaccgtataacatagttctccaacggttgataaaaaagctagagtgttatctcaactaattttagccactaactattatctctcgtgcattcaaacatctttataatattgatcttcaaaattagatgtaacggacatgaatgggagaatgttttttttaaacaatcacacactgttagatatgattttgaagaccaggactctattatgcatatgtgcatgagaccttcggatttactaataaatagttagttaactatttactaatttgctaaaaagtagccgatagtattattagctagatagtttaaatcttttaattaattttagcagctatattcaaacaccccttgtatcgccacctagcagcgggactcgacacgtgggcatgcttgcggcgggatgattggcctgtgtgggcccgcgccgcatgaacggctgagatctcgtccagggtaacatcggtgcagctccggccgtgcggtcacggggttatttattcggccgtgtggccgcggggctcgctctagttaccatccattggtgtggacgtgtggtggactggtggttgcgttgcgttgcgttgcttcgagttggaggttggagttggagtgggccgcgtgcgagaggatctgagcggataggccatggagtggagtgattagcggttgctgggtcaggagaaggcggcgtgtgttttgatcctactcgcgtttgaggggccccgatttcgagcgggtgttcagttttggtgccggatttcgagcgggtgtttagttttggttttggggacaatggttttggactgcctgatattcgattcataggttggtcaaacgctttggagtagagatttttttcccggaaaacaagagccatttttctagttgtgctactcgtcaatcaatccatggaagctgaactctggaagaagaaactttcctaattagacccggtatttcgtggttggccgttggcgtctaaagcgcgttttagtttaaatatatgaacacattttcctgtttactccgcccaaaatctttccgctggatctacttgtgaatcgggtttgtttgttttttacctgagctattcttgttgatttaggatttcgagtcggcagatccaagggaacgccgaattttgcctgatttcttcgcaatttttggtccgatcaagaggctcctagccttttttttttcctcgcgagaagcaagggggtctcccttttcttctttcgct

SEQ ID NO: 9434 - DNA, 516 bp, Zea mays
ggtatgctgatgagatctcgacaaccttttgtcacgacagtgaattcaaactaatggttcttgttcatctgtaatgtgttttctctttgggaatcttcgtatgttctgcatatgattgtgctattttcatatattttgcatctgggtgtgctattgattggtagacaagcatcatgaactggatagatgactgattgaagagtctgatactctgatgatttatgactagttctgcattgcagttttccacacacgaagaaggtccgtgtaaataaaacatggagtaggtagcaatattgatactttgataataacttgttcatctgtcatgatccataatcacagaaagaaccaagaacactgaacaatttgctgaatgtcctttgcagtggtgtgagggcattctgccgtgggaactggaggaatcaggaagtccttgctgagcaggaagacaacattccagctgtgtccttcagctcggctggctcatcatcttccttcaacgatgaagtagtc

SEQ ID NO: 9435 - DNA, 590 bp, Zea mays
ttgtgatatttcggtgctctcttgtaagatgttaacccctgtaatcatattattaagatttgaatgcaagctgggccataagcctttcgtctaaaaatgagtgaatcgatgaaatctactgtcatgtatactttcccaatgtatgtagtacatgttgaccaagagagatttttactcattgactatgtgccaggctcaatattttgaaagcatcaatttcatctggttcgtcagatataatggttagtgtccccatagatgtgtagccaaataaagacataattatctttaggcaaataatgtttataaggtaaaacatgccatggtaaatgctcacggatactgcagtattggaaattcatatattcatgcatatcttgttgctcttatatttataggtaataacttttcataggcattatctttttctttgccttttagtaaaagatcatatctatattacaatgactttttaggtgaggaactgcccttgtcagcattctatataattattgtgtccacaatattatgactaggatgagaaaaagcagaaagcagagagcaatatactacttgcatctattgagaat

SEQ ID NO: 9436 - DNA, 254 bp, Zea mays
tgcagcagcactactcagtaaaacctgtagaaattaagcagcatcagccgccacaactgttttcagttgtcaggaaatcacagtgttgtttttaataactggctatgtgtttgactaaatcttcagggactggtgtcattccttgtgctattgcacaaatcgtttgcatgtattggagctttggtgtcagtcttagtaaatgttgctcatggtaactttttttattcatgcagattgcagatcatttaacataa

SEQ ID NO: 9437 - DNA, 158 bp, Zea mays
gattagtctcactgcatttatttatttcttattatgagtatatatatcgttaaaaccggtggggcaaatgtcactgcacctgctggctgctgttgccgtgccgtgccgcgcctgcgttgcgtaccatcgcgccgcggcaggcacctcaacccctggcg

SEQ ID NO: 9438 - DNA, 1500 bp, Zea mays
ttgaaaaccaaaaatcactttaacattatttggctgaccatggtttgggttgagaaacctagagtgttcttgctgaaaaacagctgaacttcttcaactgcagctgagctttccagctgaacttaacttcagctgtgatgagcttcttcagctgcagctgagcttttcagctgagctggacttcagctgagttgaactttcaactccagctgaacttcaacttcagctgtggacctctctgaccatacccagctgaacttgccccagggcagctgagctggggttttctctccaaaactctctggtctagaccagctgaactggtcctggggggcagctcaactggtctctgaccctctgacctctgatctgcagtctgccagtcagactggcagtcaggtcgccaggggtgtcagggggcggttcaaccgccctagggggcggttcaaccggtcctggcctgtctgacccgcctgcaggtcagtctgccagtcagtctgccagtcagactggcagacagtctgctgacctgtcagggggcgcggttcaaccgccctagggggcggttcaaccggttttcaacggggtttttggtcaaacggctagtttttgagccgtgactataaatagacccccctctctctcttcttcaatacggctgaacactcactcatttattgctcacctaacttgagacaaagcactcatctctccatctctctcacacttaaatcttcctcaagattcaaccttgttggaggagctcttgggtgtgaggtttgtgcttgtgctcacgatttggttttcctctcccatctctctttcaaagacttgagcttgtgcaaacccctcttgtgcgttcttggtgttcttgaaaccctaggtttcaagatctttgaggttgcttgggagtctccaaatttgtggacgaccctaagaagtttgtatcacccgctctttgagctaagataagaagagattgccttgacctttgtggtcggcttttggaggattagggttgaaaaagacccggccctttgtgggctcctcaacggggagtaggacacctttgtggtgtggccgaacctcggattaaatcttgtgtcttgtgttcttgcttgtttcaacttgagatatttttacttgcaagattgacataaagatttctccgtagagtttatctagaagtaaaatagcctttacatattcatcttttcatcctcacttagctatatcttacttctctcaagaacttgcgaaatacttttcgagtagattttagtctaaagtttttaaaacagttggattggttcagagtggttcaacttgcgcacgtagctgttgaaccggcctgcaccagtcgaactgtgtatctaacaatctttcgaagtttgttgtgaaaattttcagattagcctattcaccccccctctaggctactttcaattggtatcagagcttcatacctcgttttacgcttaaccgcgtgaggaaacgatc

SEQ ID NO: 9439 - DNA, 840 bp, Zea mays
gcctggccgtggatagaggctctcgtccgacgttcctacaactacaactccctctccaattcctcaatcccattgtagtccataacagagcaataattattttatttaattgtgttaaccaggattcgagacctctagatctggtatcatattaaattgtatgcaccaactagttcaaccaaaaaacgtaagatgatggagagagttgagcaattcacttattctaacacatatatgatatatgagccatcccactattataattgtttatatgggtttgtgtagtgaccccaagagtagctcaggactgcagttgaaagctgatgtatgggctcatgtatctaacactatctgttctgttcagacaatatatgtttcagtacctgtcatttatattcatgttactgatagaaccatgatatatactgggtagatccctggctaaccaaacaaatggtggagacatggattagtgcttatgggaaaatcatccccaacagggattgaagtgacagccagggatccactcatcccctgggtggaaaaattcaggttgtggattggattgctagctaccgaacaagccctcagcgtgctaatttcaatggaatcttggtagacaccactgaacttcttggtttccaattaaggtgcgcctacatttcatttccatattgtttattcttcaaataggtcaaaaaattctgattctccatgcctccctcctgttattctgagttctgaacagattctttttcgatatgcagttcgagcatagagatcgtcttctctcacactgagttgccagtttattccgaaggtccttcaagctaagttctg

SEQ ID NO: 9440 - DNA, 278 bp, Zea mays
ggtacgtcgggtgccgggagatggggctcgtgcaggagctgttcgacgaaatgccacagagagacgcgttctcttgggagtctcgatcgatgggtatggttggaagcaaggtggtgctggtgtggaccgtgcacgcgagttgtctgatcaaatgcccaagaggaatttcgtgtgctggaacttgatgatcgatggtgatgccggacaaggaaggatgcattaagggaggccgctgtttgaggaaacagtgatcttgtggaccattttcattgaagggc

SEQ ID NO: 9441 - DNA, 49 bp, Zea mays
gcggtacgaggagcgagccgccaggaggacgacggccgccgccgccgcc

SEQ ID NO: 9442 - DNA, 733 bp, Zea mays
catttagtacagtggttagctcttcaatgttgatgcatgacctcatttgtctctcactcaaagccttcttggttttcatgtcaaagtcgactgtaagcttatagcccgtttcttttgatattttaagatgttatatgatttgtatatttcttatttctaagatgttagatggttgcaagaccttttttagttgaccataatgtatttaataaattttttatttatatgtcgatgtgttgtattttatatagttaaaaaaaattaaaccgaaccacttatctactaaaatcagacgcgcctcggcggccgcggcagggggccatccccatctgtcactcgcgccgggggcgggcgggtcccggtcatctcttgcaacaatttttgtcgtcgtcctctgtccatggaccatggctgctggcccccgcctgtggaaggaaggacgacgatgagccatcaatcaggtggactggcacgcctaccaaagtaccaagagggcgccggggagaagcggctgcctggggccaccgcccttcctcgacgtttctttctttccttccacgtctctccacctcctcctcctcctttctctctcagtctctctccagcctccgcccgcttccttcttctcctgagagtcctgttgctgtctatctcccccgcgcgctattcctccgcctcgcgatagcaatccgcgcattggacgtcgccgcctcaccggacggagccggtcgaa

SEQ ID NO: 9443 - DNA, 978 bp, Zea mays
aatagaactggattttaattcgatttgatacttaaaatttatagaataaaatttggagaccatttactaccccaacgtgttatttgtccaaaatgattgacgctcccgtgcaacaatacgtctcatctccggacaagccttagaaaaattaatcatttgttattcttagcgaatgactaactaaatgttataccccttttgttcataaatatatgacatgattattcttttaaaaaatttgaccatttattttattcaaaaaactaataagttatagtttatttttaatttattttatcattataagctagtttgtgtttgacttaaaattttatatttttaaataaatattttgaataatacgagtagttaaagttttcaaaaaagttaacgctatcaatgtgaatggaagtagtattagcgaatgtcgactagttagtgactgatcatttggtgtcaaaggataaaatcggacccaaacgcggagacgctggccggagccgtccacgccgccacgggccacggcctactacgatggtagggattccctagaggccttgaccggttgaccccgcaacggctatttttttctcctccctgacctaatgggcgtactagccgttggtcctgcggtgcggcgggcgttccggcttcgctcttgcctcttgctacaaataaccattcacggccgatccctaaaccccacaaagcaaagcagcctctctctctctgtctctctctctcgcctccctctcgcctccctctcgacgacgatctcaggcgctcgcggggagtcgagtcgagaccagcttcgttccttcataaaaagctcacttagttgttgtccccgcctctttttttcgctgttcttgtttgattacatcatcttattttgtgcttgaatctaacctgccattaagtttttatcgcttcgttatttctctgttgtgcttgtcttgttcttttgttgctctaacc

SEQ ID NO: 9444 - DNA, 440 bp, Zea mays
ttgcatgcctgcagatctaccgccgatccatccgctaccgagctatgccaatctatatatgcagctcatgcatctaacctactgcatgtcacacagccccagccccatgcccgctgtaccgtgccgccgtgttgttgcttttgcttctctgcctgcgcgcaccttctgcttctgcgccagcttttttcttactcccaagatctctatttgtttttttttccgttgttgctgtaggagaggatcagctagctagctgctaggaggccggagggagagaaagatcggaggaggagctgcaaaggctagcttttctttggtgcggctggtgctggtggtgaactactgaactggtgctcggtgctcggtggtgcgtggtgcacactgcacactctccctctcgcgttcgtcttgatggtgggtggtggtggctgctgcctcgc

SEQ ID NO: 9445 - DNA, 269 bp, Zea mays
ggtaacccgctctccatgtacttattgatttgtagttattattggtaaattgttagtagttaatagtttgttattattggtaaattgttactccaccgtgtggtagtattttgtagttagatattagttagttattatcttgtattaggttacaattatttatttggtactaggtagtttatagttagttattagttagtcatagtggatggggttatgcactaaccatcacaattggttattcaacgttgaattcgtatttcaaatag

SEQ ID NO: 9446 - DNA, 1423 bp, Zea mays
agtgtcagcgagagtgggataattatgttaaatcagctatgaagacacaaaagcaagtcatggaggtactggtacgtcgtttgttagttgcctctcgccctgaagatggaaactatgatcgtggtgtcgaggtcgtgccaatcgtgcctgatgctcaatctgcccgtaatatgatcccattaagtgagcctacaaatgattgtggcaccaactcgaatggcaaaacagtatattcaccaacacactcacctgaatagtgtccaaggaattcatgttctagtggttgtggtgtcgtcatatcgcaaaagtactgcatacttctgtttatattcatcctcctccaagtgatccagttcattgtaggaatgtacaacatctagtagatatatatattaacatctagtagatatatatattaccgtatatgtactataatggagcatcgacgtatgttgaaataaacatggacatctgtatccgcggctgtctcgcggatgccgactgaaaaaaatctacatcaccaaacagatcgacccgtgggcctgtggctctacataattatttactatacctctcaaatagattaactaacacaccatctaattatttactatacctctcaaatagatattaattgttagctgctctaacctaaataaaaccagctaataacttattagttaactaacaattagttctagaggtttaaaataatatgacctaataaacatgttgcctttataattcttacacatttagagccaaaataagacttctttttggaaaagaaatatcatggtatttggaactcgattaagtattcgaaggaatctaatgaaaataatatcttacactaaaaaatcagttttcgtttaaggtacttcctaactatgacttttttatctagcaccaaactaaaaattttcttattgcaacgtgtccacctaaatgaaagccatacgtacgcctggtttttgattagttattttttagtgataaataaaagtgcaggtgtaaatgataacttcgttcggcttattctcttgttaaaatgtttgtctatcggtgagggtcctgattaatacagtatttgaaaaacaattcagggcccagtttgaagcaatatgaaaatggcgaggaaaatcacccgccgcagaacacggttctttttctgtcggagctccttgccatttgaacccagctgggacagctgctctactttaaaatggacgcgcacctccacctgggtctgtctgcgcagggagccagggacgcggacgcggcggcaccggcaagcggcaagcaattgtctcatctgctccactccatctccatttaacgcactctccactccttcgcggcgggggtttaggcgcacggcggcaggccaattaacgccgctgcggcgagcaccgggggggaa

SEQ ID NO: 9447 - DNA, 978 bp, Zea mays
  unsure (1)..(978): unsure at all n locations
tgagcgatgaggagggagcaccaagtgaccgtgagcactctcagattactaaaatgctcatcacagggatatgcagaaattacatggacagcttgcaagacccacaaatggagaacgaaacccaaatttagcatcagaccatttcatcgtaacgaatggaggacgaaacccacaaacatataagaaaataatggggggggaaatgttgtacgaaacctncctcccctccgccgctccgctcggctgcggagattccctcccgtacgagggatctggaagacgcagaggcctcgccgccgccgccagtgagagagaaccgcgacaaagttggaacggcaaatttctccacttgctgggttgggtatcagggtatggatatatacatacatgtaaatgggccgtggaaggtagcccattgcaggcgagcccatcgagaaagctcgcgtggaaagcacaaaacttctctgccccgtcctcttcccgaaaaaaattaggtgcagccacacgtaaatcagaatgtttgcagcccttctcacaaaaaaaagatagactccacctacgttgtgttgttgtacctgcaggtgagacttatcctcttttttgtgaggggctgcaaacattctgatttgtagccggatgcgcccaatttttatccgtaaaactaatacatgacccgataaacctgcactgtgaaaacagaaatgaacggtgctactttttcccccgctggtgtgaacgtcctcggtgtatccagcttctgttgttaagaaatgtatgtaaacacttattatactaattattgagcatcaggtgagaagggcaaggtggtgtacaacacgaagggatcctactccgaaacctgcgaagtcgatggcgacgtccgcatcaacagcacagccctgtcggtgaccctggtgccggcgatcgatctcttcggagcgccgcgagtggaggatctggccatactctcgcaagaac

SEQ ID NO: 9448 - DNA, 232 bp, Zea mays
aactcgatcgtagctcatatatactacactacatgcataattgtatgcctcgatcgtatatgtacgtacttcttagcttaatttgttatataattgctcctgctcctgatcgatcggacacgtattaattgtggttttggagcgaggtgtgcatgcaatgcaatgcattcagtgtacctaattcataagcagtgcgctgtctgctgctccaacaatatatatacacatatgc

SEQ ID NO: 9449 - DNA, 847 bp, Zea mays
acctgcacgctcatcagctagccgccagcaagggagctagcgagagggacagcgagtggcagcggcactcacatgtcacgagagggaagagaagagaagagaagagtgacacacacgcacacgcactctccccttctctctcctcacaaaatcccaaatcccagtcttatcatcctgtcttgctgcctcccttgtgcctcctgcgctcggagctcccacactcccgaggaggaaaaagaaagcgagaaagcttctagctttgcctcccccgtccccccacccccaccccccaagggtaaaatgtgatgttgccatccatccgaatccgagaatccgattgcttctagtttgtccccccaactcctcgcctcgcctctcctcctgggtcagtgtccgtccatccatccctggccaccacttcgcctgatgtccatctccatgccgccaccgccgccttcttctccactcttttgactgttttcttttctgtgtttcttgtcgtcctagttatgggcgccggcgagttggatggacgcgccttgtcggacgcggagcagcagtagcggcgggcaaccaggcgggggatctggatccgaggcaccaccaccgggctcctcacggcggcgacgcaggcggcggcggagaaggaggaggaggcggaggagcgcagcaagaagcagatgagcagcagcggcaccacaacaaccggctgctgcagttccaccagcaagtgcagcagaaccaagacccgccgccggtccccctctttcagctccagcacctgcaggccgcggcggccgtgaggcagcggggcggcttgtccgccgagtatgcccttctcgacccc

SEQ ID NO: 9450 - DNA, 1131 bp, Zea mays
gtttttaaaatcattcatattataaatgtagtttagagacaatatatacacagaaaatcgagtagaggctggctatccgagaagagaaagtctcctgtatttttgtcatttagtctctaaagcaatgttgtacatgtcttaaaaaggactgcaattttagttacgagacatgagtttgtctagattcgtagatagaattggcaagataatgaaactttggatattgtaacgtgctcgttctgtaaaaagaaatgatattatcattagctgccaccagccgtgaatctcatacgttgggctgttgcatcaggtagggtcattgcttctctgtcggatgatacgagtgacccatcgaggcctgttttattagatctgaaatcctcttctgagaaaagtggagctgctaaacagatcctcggcgctcgccatgatttcaccgacgccgcatcatgatggttttgcactgttgagctcgtcgtcagcggaggcggactcgcaaaccaccaccggagaagattgagaagggtccaacggcaacggcaacgagaccaagatcaccataacgccgtccgtgatcctacttcctaccctactgttccgtcccaccccacggcggcgtccctagcttaaaccccgaaccatgtgggcctgggacccacgtcgcagtcaaacaaggcccacctattaaaccccaacagcgtccttcctcccctgctctcccgtttctctctctctctcaaccccacgcccccttctctgccattattgcccgcgcagccatcctctctctctctccctcccgctcagtaatcagtatatggggacgtcctgctcctcgcttcctcatccaatcctcccacttcctcttcttcctctcatcctgcttcccctcgcgtgcgcagacacgagcgcgcgtgtccgtcactcccgtgcgtgcgatatcctccacccgcctcagcccgctgtccccctgctcatcgcccgatcgccgcgacttataccaccatcagccagccaccactccctcctcaacattccgcttctctagtcccgaacaccggccggcactcgttagggggaggtgtgccggtgtgggaggtactctgctagccgccagtacatgtgaggtcc

SEQ ID NO: 9451 - DNA, 1500 bp, Zea mays
ccgaccacttaatcgtgttgtgcttgtgtgcgtccatcattttagggtgatagccaaggtacgacactagacctatgtcataccgactcgagcactatatgagttgtgtcgtgctgtgccaaagtactataaatcgtgttgtgtttaatatcggtctatttagtgtgacccactagcaatacatttgtgtatctatactcttccctagtatgccattaaaatttatgagttccattcgttgcccttcgttttaactttttctcccgcttttgccattgtcgttaagttttatgtgtaatcagtcaaatcaccgttgccattagctgggacgcaaaaggcccgctggaaccatacagggctgggcaaaaaacccgtaacccgaaatccgaactcagaatactcgaacccgaaatacccgaaacccgaattttgttcgggaatttcgggtagcaacttataaaacccgaatttatttcgggtaattcgggtatcacaatcgggtacccgaaatacccgaactttcatgtgtcatgtattcatgtcatgtttaattattaatttgtacatctataattatgtgtaagtgtgcataacttgtgattgtagattgcttgtgttttatatgtccatgtatatcattattcaaactatatttttatactaatttaatagggtgtatgtgtttttattaagccaacacaacaattcgggtagtttgggaatactcgaacccgaacccgaaattccgagtacccgatttttcgggtattgtaaaacccgttgtaatttcgggtatcgattctcgaaacccgaaatttaaaatacccgaattacccgacccgaaattttcgggtaacccgaacacccacccctatttgcaatccaggaggtaaaacttttttaggactagtttgaaaacccattttttccaagagaaaatgaactaatttcccttgggaaaataaaaacaccgtagaaaaatgaggttcccaaactagtctttataaggaacatatttatggctagtttgataattcaatttttcgaaggaatttctattttctcaagaaaaaataaactatttttttagaaaatgaaaatactttggaaaaatgggttccccgactagcgggcgaaattttgaatggttttaagagctggtgggcgaaaattacgtgaagtcgctagagcaagcccaaagacagccggcccatccagtgacattacgaaggctagacagtacggatcggcccaactcgcatctaaaccctagcccctcaccgttctcaatctcttctcccttgatcggcacagccacaacctccttctccaatactctctccctcgccgccggccacctccgcctcctcccacgcgccacctccgcctcctcccacgcgccacctccgcctcctcccacgcgccacctccgcgacaaaccactgaaggagggagaggactcgctcatatcgtccgatggaggaggactcgatcaagggg

SEQ ID NO: 9452 - DNA, 565 bp, Zea mays
cctgcacgcaccaaaccccaaacccatcagagtcaagcaaatcgccgagaggggcgccaagagcacgaaaaagaagagggaaaatccggacaggagtggacgagtgcggtgataggggggatccagcgagctcacctctcgatcgattcgcgtcggatcggtgcggattgggattcgcagcgctgcgagaagccgcaaaggggaggaggaaaaggaatgctacgcgcttcgccgacgcgagattacacacgtagcgtgtaactgccatgtgggccagaatctgggtaaagccattgggacccaccggcatcaagacaagaggagcctctggtcgctgtcgtccgtccgtttggagaggtgacgtggcgcgttccgatcggacggtcggcgtcgactcgacgcgagctcgtccctcgtcttctccttttctttttctttccgagaggcgggatttccttcgccgccgccgcccccagtgaccaccttgccgaccggagcgtgtgaaccgtacggagtcgcccgcgtgagatgacggccacctccgcgttcgggtcgtcccccggag

SEQ ID NO: 9453 - DNA, 1490 bp, Zea mays
gttggttttagctgccgcgctctagctgcttgatgaaatgtccgtttagaacgaatacgaagaatgttgctggtatggagttcgttgaccaatggaaaaggaagagacaggtaaagaatatgcatccgacgtcaaaatttgttttctcctaattaacttatgagggcactaatctcgaattttaaataattattttgttcatttaattccaatatatacgcacatgatttccaaacgaaatacaatgcaattttgaggaaaaataaagtattttaagaattatgttagcactgtagatataaaggacactgctggagatagaaaagatatataatatgtaatcttttagagtgtgtcgtaaacacagagaatatattcttttaaaagattaaatttataggatattgctggagacagctttagagatgggagaccaaaaagtggtactagagaatgaaatatccttagtaactaataattttcttgaggagcaaaactgaaccctcaagaatacgttattaacttgggcgattgtattaaaaaaaactcgaaggaggtgcatattcctgtagcgctatatctcaaaccacttatcaaggtaattccatattttctcgggttcgatctatatgaaaccgccaaggtaatttcaggtttgctcaagtcttgttacaaactaccaaagtagtctcacattttcttgaatgttattcggaacctcgaaagtaattattccatatttccttgagagttactactagggatggcaacggggatttccccgtcggggaatggctctccatccctgtcyccgcggggaggaaaattccccatccccgtccccgcgaaggctcacgaggaagcttttttctcccatccccgtccccgtcggggaatttatccccgtgaggaaccccgcggggaatctgcccccactaaaagtacaatatttaaagataaatttaaattaattgtatcaaattaatataaatttaacaaacaagattgaaaattataagagacatctactttagagtttagtttgctattttataacatgtcatacattgagtttttactgtaattctaacaaataaattgactaacttgaataaaaaagtttcatggggtgggtacacggggaacggggatgggggatggtttctcgtccccgcgaacccgacggggattaaatttcccccatttagatcccgcggggactaaattagttccatacccgtcccctaatagtggaattcctcgcggggaatcggggatcggtccctattgccatctctaaacagatatagtaaaactgtgtgacctttatgcggcctgtatatgggctaaataaaacagtgtatcagacgcgttagcccattgctctttgtctactctatatatatgcgtctccttgagcaaatcacaacaccccacgccttgtctctgaactctgatcagagatcaaagaggtagccgttaagttaacg

SEQ ID NO: 9454 - DNA, 343 bp, Zea mays
tgggcgtgtagttatatatatgaaggttgatcggttcctatagccctggacgatcaggatgtctgattgaccgatcagagcccggttaatcgggctggtcgtcgactaatcctgattagtcggctgatcgcccctctggcgatcaggattcaggagcgatcagccgatctgaaaacattgtgtgctagtctatttaaacagaaaattatgttgcttgttcagatgagtagggtcctgccatcctgtggcatagaattgccgtttatatacaaagtaagcatgttgtaaaacttctctatgtttccttgttgcagaaccatagcaacactttggtgcgcttaag

SEQ ID NO: 9455 - DNA, 1500 bp, Zea mays
aataaaaacttagttttagatatgccaatactaataataatgcagtaatctaaaaaaataatgcagtgtgttgcttaaaaaatattcatgtaatatgtgtgattcgacaatacatgaaaaatcgatatagaccgcgtcaatgccttttaatccatagtttcagttttagcttacaaaacattatattagtagtcattgccatagttagagcaactaaaaaactcactatattcttcctaatctctaataatagagattttgatatttttagaaaaaaaaaaatcctccaatgacttctttaattggttatatctaaatatagtcgtgctctattttgaatttctcacaggccaaagatagagtacgggaacaagtttttagcgtgcgcacaagatataaaaaagatgttagagagtggaaagataaaaaaaagagattttgtgcaaatgactctccaaatgatgatttaaagagtgaattgtagaaaaactcatagagatgatattagcattttgtactctacaattgttaccattggtgtaccttgtgagaaaaagtattttccttattattattattatcatttattttgttttgttttgttttgttgtttaggagatttctttatttttttaggaaaggagattgtaacaccaaaaattttattttgggrwtttaaataaaattctccaaaggtttgaaattcaaatatcttttaataagaattttctcacccttgaaattacttctcctaaaataaatacagcttctaataaaagattaagtaagaagattcctatatgaattaagtcatcccttgtttaattttatatttgtaaatgttctttaaggatttaagattaaaagcatctcttaataacggttatacactagaaaatatttttccttgaaataactatgttgcgtgtgtgaatttcatatctagaagtatgtacttacggcttgttcgtctgcccttgttgcggctgcaatccggctgcgrcttctacagtatttttgtctctatggattgcagctgctacagtgttttgcagccactacagtaccccaaataagggcagccgaacaacaccgaataaatctctggttgcttgaataaatcggagaatctagtcacgggcttcttcgtcaccgagccttctcgtcctcgcggacttgtgacttgtgactccagtcccttccaatcaacaagttgctatagtagtcccttccaaaatccacactggaaccggaacctccatctccaatccaatccaactccagatccgcctccctgctgcatccccatcccgcacgagcaccaccccttgtcctctccgcctctacatctcatcggctggtgcacctcctccctcctctgctcggcccctccctcccttctcgtgctacggcagcgtggatgcacgagactacagctgtggcaaagcggagatccggcgggagtgcagcggccggcgtgcctctacgtggtatggtgac

SEQ ID NO: 9456 - DNA, 172 bp, Zea mays
cgtggctgaaccttgatttgtggcttctgttgggtttcaactctaacctacctcaacttgcttgggactaaaaggcattgctgttttttttttaattctgacaagcattttgtaacttcaactgcaggcatacatatacatatttgtagtggtaccatcataacaagtaaag

SEQ ID NO: 9457 - DNA, 350 bp, Zea mays
atttttaatagtagatattaaaaaataatatttataatacatgatagatttattaaattaataatgaattttttacaataaatatatgtggatttggaggcgcatatggttaatgtttaggaattaacttctccaaatatgagatctgcatgcatgtaacggagggagtacgtccatctttgtttttaacggagggagtacgtccatcagcccatccgacgttccaacgacaacgaccctccgatcctctcatctaataactacataaaaatgcgcccccttcatcaatacgatcgacgaagcacagataaaccgagctagcttgtgcagaagatcgtggaggagctagc

SEQ ID NO: 9458 - DNA, 610 bp, Zea mays
ggtagccaatttaaaactatgtttagttgtaggtcatacgtcttaacaaaataggttttgttgtgttctttaaactattctagtttgttgtggcaattcaagtgacaggtccagaaattcattctgctgtaactcagttcatctgatgtaaattagtggcagcagagttcaataatgcctggtctctgacgcacatactcagttttctatcgactgtgttgcagacgaatgacttattgccacagagctaaggatgacagtgtgagtatcccagattagtcgtgttactggtatgatggtgatgctgaattcagagtttcagtgatctttgagccatgaaaaggacacgagaggtatggccagtaagttcagtcatcttcaccatcaatgggtacttccacaaagtcagttggttctgtgtgaatccatgacaactcagcagctccctctcattcttgttctagagaagagcgcacacctgtcatcccgtgtcaactgagttcaggtactcaccggtgtgtgtgtctgtgtgctagaatttgatgcaccgatcgctgccaccaccgccagtggcgagcaggttgctctgcaccacgtgagtgccttcacg

SEQ ID NO: 9459 - DNA, 977 bp, Zea mays
tgccccttggccatagctcgaggcctccaccacccctcctgccctccattccgccgctgggctgctgcgcgcaggcgcgcagcgcgcccccctgctggcctgctgctgccggcgacccagtgtccgatggatgcgacctgcggcaaacgggagaggcgctgacctgccgactggcgaccgccgagacaccctagcggctgaagttgcctcttgcgtgacacacacgacacagtttatgatgtcaatcgccttccacgtgattgtcttgctacatacattgagagagatattttctttgaagtggatgaagaagatataattaagactttcatggcgttaagaaagcgtaggccaaataagtagcattacaatatctttatgtttaatgtatgcaacttacattttaattgttgaatgttaaactttatttctatatatcgatatgtttatcaaatttactatgaaattatatattttgttgcggcacaccctatataaaaattctaggtccgccactgactctagttgaaactgatgatgtgctggttggaaagtatttattttctcgggatgtggttttatttaaataacgtgttggaagatatttagtactgattgatattaagacagatatagaagtagatcgagataaaagaggtgctttaattttgggccaattaaaaaatccgagcttggtgtgagtcacattctacaaaatttaaataccgtgtgacatctcattctacaaaattggcgtactctttggccgtgcttgcattggaaccaagcgatgcatgcatggcgtcagcttgcattgcattggttcctctatttatagccggcgtctctcctgcagtctgaagcagctagctcatcagttcagttgtttgcgagaagagaataggatatctatcgatcggagctgctgagctagctgcatactacacttgtgccactgcagtgactatcgatcgatc

SEQ ID NO: 9460 - DNA, 221 bp, Zea mays
acgcgcattggtggctcctcacttctgcgccgccacccactacaggtgaatgaatataacgaatccgccgccggcgtcatctcctcctcccacctcgactcgccttggtcgccgtcggcggccatttcgtcgccgcgcggcgagccgcccatgttgagctcgcggcggatctgatgggcttgttgtgatctcctgcaggtaaggaagaggaggagggcagg

SEQ ID NO: 9461 - DNA, 570 bp, Zea mays
atatcattaataaagtgagccattaatattgactgctgaatattaatttggaccaaactcacattaatctattaacaatagattcatcttcattaatttgtatatagacatataaatcaagagctaaaactactactattttagaggaatattttaaaacagcttcttacaagagagtagcaaatttactatgagagaaacaatttgacagcagcacgaaagccattgcacgtttttgaatgggtcaaagtcaaactctatttactatgaggggttttgcgtagcacaaataatcacctgtattgaattgtaagcattgtccatctaactatttcaagcggtgtctattcaagggctatcacttttggcgggatgccagaaaaagaaacccatccgaaattagcctggcctctacttgatcgatgcttacatctatcgatcatgccccactaacaatacgatcccgggctgcatgcatcgtctatctggatcaattcgaaacatcggagagagagtagcaaataaacaacaaagagattgttgattatccaattggatcgttcaagcagg

SEQ ID NO: 9462 - DNA, 813 bp, Zea mays
tcgcgctgccctggggtgggccgcgggcgcatcccaaaaggtttttttcagcccacaccggcgacgtgctccgccctcaaccctagatgtgtcgcacactcgctctcaatccaggcgctagacctcgtcgaccgactcgatgtcaccttcgccttcggtccacgccccgccactaactccaggcctccagcagtctgcttgcttgcttcgggcctccggacgttcgtgtgcccctggctccaccgctccagccacccatgcacaaccttcttcagctacccgcgtgccgcctagtgctggcctgctctgctaagtgcggagccatggcttgtcaggactgaaatgacaagcaaccaacccattgctgcttctactaccagggaggtgaggagcacgagaccgacaattagatttcaaaggcaggctgcgggcagaagctttcaactaggcaggctcagtcttgtgttgttcgtgcaggtttttgtcatgggaggaagcagtcgcacaactgcaaatagaagagcatggctggcgagcactagattgggtggtgacgtcattgtatttggtgatatttcttacactttcgttgtctcaatccccattttaaagtgaaatgagctggagggaaaagcttatgtcactataacatagatgtggttttcctacgtcctggttgaagtgaaatagtccatagatgtttactgatttagaaatgagttgctatgttagaaatgagctgctatgttacttggcactcctagctggtacaatctttttggtgtcactttcactacctgaattgttgggttg

SEQ ID NO: 9463 - DNA, 733 bp, Zea mays
taccaactttaaaacggagtaaaaacgaaatcacatctccagataggggtaaccatgtaatagccaaaaaaaatatgatcatgcatgttgtgcgttggcgaaagaaacggagctcttgatttgaccgacaccattgatgcacttcacgttgcagtgacctggtggtcgctgcaggaaagtatggaacgtataaacggaatacagtaagacaaatatatttttaaaaataaataaaataaatggaaacgggccgtgggcgtgcggccataggggcccgtggacctgatccatgtgactcacgtcgtcgtcgacacgctcgcgcaggcgcacccttcctttcctagttcctactgccatcggccatcgcgcaccgccgccgctctgcagggctgcgactcctgcctctggcagtctggcaccctgtctacgtttccgtccggcgtccgcccgcccgcccgcccgccaccatcgtgcctgcgtcaagcactcaagccgcccctgccctcggagccccgcgccgctgatccactccggaactcaagcatctatataaaagcagcacctcaccaagcacaggaaccaacgctcaacttgaaagtcacaggacagcacacaccccacccacaactaccaaccttctccggaaggccaaatccccccgggccaagggaaacgagggagagagaccctccgcccctctcctctccctctccttccggtgaggcggtgagct

SEQ ID NO: 9464 - DNA, 742 bp, Zea mays
cagtgggtttcctctgctcgtctcgatcggtcggatcgaaggtcgttggctcgtgaaaagggctttcttccccaccgagtcaccagaccttttccccccttccctaccactactactagtactactattccgttcctctcacggcgtctcctgctgccctgakcactgcccctctctgtggttccctgctgccactactacccactcctcctcctcctctcccttggcgctacgcttctactttaaactctgcctgcctctgcgccgagacctttcctgcccttttggcctctctctgttctgttcactccccatgcttcttggcccgcaggcctctggaaaaagcttctgcccttttttccttccggtgaactagttagtgaagcttcttttctcgctctgttcctaaagttccaagttcctcgtcggcctgtgtgttcctgcccttgtattgtatctcagattgcaagccagaccctttcgtttcaaaaatcctgtttccataaagctgcagccctttttgcttcgaccaaggggcttccggtcctctgcatccgcacggcaccggcaccggcaccgtgtgttagctttcaggaaatcccgagctgatctccgcgagttcccattcccacgctgtagctgtagcttgtagtaggactctgtagccctgccctgcccaacccaacgcttgcatcgcaaccgttcctgaagcagtgcagtgcagctctacgaaaaccacgcc

SEQ ID NO: 9465 - DNA, 963 bp, Zea mays
actaaataagacaaggcagccaaaattagtaaagaaaagtgaaacgaattctaaattaggacagatggagcaatatttttaatttgtaggacactattttaaagcatcttgttggagatgctagaaattagacaaaaactaacttgtttatactcaatccagttttcgaaagccagattcttaaaaaaaactcgagggttccgtccttagctttggatctgtttttttccccgtaaattggacgtggtcgagctgtcgctgcagcacagagtgcgggagtgcgtcgcaatcagcgggcattaggggcgagcacgaatccacggcacgctgagtcagacgcaccggggctgcccgacacgcgaatccacgcacccgtctctgtcccatccgcagccccaccccacggaaaagcaagcaggcccatccagccgcaggcatgcgggggcagcagaagcggcaaaccgcgcgcccgcccacgacgcgacgcgacgagcggcggacggggcgaacgcgcggcgccccggaacgcgtggtggaaccgttccgcacaccctagggccaggaggaggacgcgatccgacggcccgcgggtgcccgaccggccgcggagacacggagccgccccccgcgcacccgaggaccttggaacttcctcgcacgacacacacacaccctcaccgcaccgcaccacctggcggggcccgcctctctgtctgaccccggtccaagcctctggttacctaacctaaccaaccatggttgctcgtgcagctccagcactctccaggggcctatatatctccttccccggcagcgaaccagccgttctcttcgttccgtctcgcagtggtagcaccgcagcagagagaagagagatcttctagcctagtagtagcatctacttactagtgagtgagtaggagtacttggctaggacgggggggccgtgacgacggtagcagc

SEQ ID NO: 9466 - DNA, 1190 bp, Zea mays
atgatcaagcttgatgagatgggctattggtagggttgttgcgattgcaattgggggaaaatcgtgattattatttttttactgttgaagagtgccatagttaacattgtaaaaatgtgtgtattatttgttctgatttttccccccgttgaagggggtttattcattgtcagcagttgctgccacacggactccctcaccctgctctttattaaccgtgtaaaatgttgtgagcttaaggtgaaccttagtgtcaaggggagtctataccaatacaatattctgcgtttctggtggcgtatttttctgtctatctatccaaggggcttgtttggccctagccaaaatttcttcgtgcctacagctttgaaacatgagctcggcacgctgtcaacgacacaacaggaacgtgataaatccagcattccgttccattacgcttgactcaggctatccgcaaccgttacccctaaatttttccctctatatcactttttcccgctattttcccccctatttttccatctcccgcagcggttccccctaaatactccccctataccccactaccactataaaatatcattttctataccaactatcaattttttatctactaacaattactcgtggacccacaacacagtgtttagggtgatgaacagtgacacgctatatctggggggagagagaaggggaccgacacgtagggggcgctgtagggggcaccgctgcggccgtagggtgccccctacgcgccgcatgcaaggggagggggaggtgtagagtccacccctgcggctagtctctaaagccggatgtgcataaggacgagccgcaatgcagctcatcgacggcaggatgaggtcgaggccggcatggcatgggtgcgggcggctaacgatgcatgcatgtacgcactggcgatctcttgggcagtgacacgtgtgcgtaataagtctcgacgcataggtgcgcgcgcgcacgagcgagagacacaatagctatcttctatagctctctctatatacgtatgcttttgcttgtccacaactctcccttatcactgccgatcagatcatctctctctctctctctatcacacacacacacacacagttcttcgtcctgcagctataggactataggagagtagtaggatcgtcctgcaactatatatagtagcggcg

SEQ ID NO: 9467 - DNA, 1070 bp, Zea mays
tagtgcctggccggcctgaagaagaaggaagatctgagtccaacttgtccgatgcatgcactgcatgcctagaaagcgattggtcactgcaaattaaacacgcgcattgctgtgcctgtaactaagcagctacacatacacacgcatgaacaaacatgacgtaacgcggcaacgacgacgacggcggcggcggcggcggcggcggcgacatgcacgcgccggctggccgggacgacgtagctgcacagcctgcactgcacyttagcagaaacgatcaaacaggcactagtggctgatgcatggcctgaatattcctagcgatcgggccacgaccactccaaatgggactcctcgtcgtctcgtcttcccggcgcccccctttagttcttcttttggcaatctttcttctcgtggtggtgcgtgcccgcgctcgtgcacccagcgtacgcacgctcgaccacattgtgctgaaaaagctagggggggctggccggccgtggtccgatccgtggccaccggtggagcgggagcgctcggtcggtcgccgccattagaaaaaccgggactcccttcggcgcgggtggccaagaggcaagagcagccacataacaaggctctctgatgaggcctccactaccactaccaccaccgccctcctcctgctcctgctctctgttcccgcgcacacggccgcccgtgctggcgtgctctcggcctctggctcgctcgcgccacctataaatccgtgcgcccgcactcgccaccgtctccaacccaaccactgcagccgactgccccgcctcaccggcctctccagcaccagcactctagcttgctagctagctcctgtacgtgctatagcttgttgctagatccccgcgacagcgaccgcacacgccgtagcacacactctcgctgccctgtctaggcccgcgtgtatataaggctataagcacgcctagcgacccaagcaagattcaccattccggggcctcccatcattttgcccgcaatccagagtttagctcctcctcagcagcttaattgaacggcctctagtaatacataca

SEQ ID NO: 9468 - DNA, 1500 bp, Zea mays
gtacatgcatgcattccatcagcaacgttgttcgtcgtccaatccagtttcccggtcgtcgtcgtatggctatcgggaaaaaaagaagtcattgtgcatgcatgtacgtacgtatatgtatgtctctgcgctgtttcatgacacatgcatgcccaggatcaccgtgctgcgcgtatagtacagaacaaaggacccttttttgtatttatagggtcgtgcgcgagatcatcactaatacatatgaatcgtgctttatacaactagacggaagaagttggaatgaataggcgctagaacaaaatttgctgcacaagcccgcggtgagagaaaagtccggtgacagattcagaatatatatgctatcagctattgggagaagtttacgcgcatcaaacttggccaagaatctctggacaagggacctgctactgcaactgcaaggaggaagacagaggcgtactaaaatacttttgcgcggcatgtggtcgccgtgcctcagtagaaatgacagaaagcatggaaatgccaccgcccccccccgtccgtccacacacaagggtcgaatcgaggagctgtactagtactgcttggctgcttgctacagcagtctgcaagcaaccgctgttctaaaagaaaggaaaggaaaggaacgaaccgcccaaacgtgtgtaggcccgccttttgcagactggctggcccgtcaaaggcctgtggcactacatggtttgggccttcttttttttgtgttgctagccgccggggtcaagttccgtctctttctccttccaatccccccccccgctagtgtgtagcgattctgcttcgtgcttacgtcatcgatgacccattcccggtgcaagaacaaatgcgccgttggcctggcccgcatgacttcgagctgattatcgtgcgtgagtcatgacctgcccgggcggagggaggcgcggcgcaacggacttcatgctgccacccgccgacccgcacctcaccggctcacctacaccctcctcttcgttcgtctcttatccatgcaatgcatcgtctgaccttgccttttgtcttttacaaacactgccatcagcaaatcatgctatttttatgccgtcacgtttcatgcagctatgtgtaaataaataaaacgtatataacgcattttaatcatagatccccgacgcaacaacaattgcagccacacccccgcggagccatcacctttcactctaattagaaacatcgacctgctcaacccaccgaggaatatagactgtttttttttctatgtggaaataccaagtagtagtgccaaacgctaaaagggtatgcatcttaattgatgagctgtgagggtgcaatctacaagagtgcgggttcgcgttcagtccaagctgaacataaacgcaacgcaaggcccctcgacgcagataccgcgctcaggagcattcgagaagccgaagaaaattcgaagacgaggaccagctacactgcggacggacttcgggc

SEQ ID NO: 9469 - DNA, 310 bp, Zea mays
ctcagtgttaaactgaccctcaaatgaaggcacttgtttgttactgtatttttacgttcagtagatcgataaggaaatgtacgaatacttgtacctcgtaaacaaaactgaagcaacccaacataagggcatttatgacacgataaggaatggaaaattcagtgctcatacctcctatcatactacagatttatagcagtggcagtgtggcttgtcgttttctcatcctgctctatttagccttcagcacctctgaactcagctgtcagctcgagttcagaaaaaaaaattaacaaatcacactgcttta

SEQ ID NO: 9470 - DNA, 1500 bp, Zea mays
ttggaatgactctctttatgcttcaacatgtgtgtttgacttagagatagagatttgagtttgatttgcaaaaacaaaccaagtggtggcaaaggatgatccatatatgccaaattgaatcaaaatcaatttgagttttatttgaagtgattttgcactcgttctagttgttttatgttgtgttggcataaatcaccaaaaagggggagattgaaagggaaatgtgcccttgggccatttctaagtattttggtgattgagtgccaacacaagtgcttaaatgtgaattcatgtttatggatgaataaagtgcaaatcaagagcaaaggtatgtttctaagtcttagtacattggttttgtgtactaatatacttgtataagtattggaaacaggaagaaaaagaaaagaaaagagttggctgtgtacagccaagaggctgtttcggtctggggcaccggactgtccgttggtgcaccggacagtgtccggtgcgccaggctgcctcggcgcgaagtagccgctctcgggaattcgccgacgacgtacggctataattcaccggactgtccggtgagccaacggtcggccgggccaacggtcggccgcgcgatctgcgtaggacacgtggccgagccaacggctagaagggggcaccggactgtccggtgtgcaccggacatgtccggtgtgccaacggctctctggcggccaacggtcggctgcgccgtttaaggaaaggaatcgggcaccggacagtgtccggtgtgcaccggactgtccggtgcgcccgacgacagaaggcaaggatggccttccagatttgttctcaacggcacctagctgccttggggctataaaagggacccctaggcgcatggaggagaacaccaagcattcctacaacattcctaagcaccaagacatcgattccgcgcatttgattcattgtgatagcatctagagctcttgttgagttgtgaactcattgagttgtgttgcgagctcttgttgcaacttgtgtgcgtgttgttgctctgatcttttgaagtcttgtgtgcgttgctcwttcccccttgctctgtgtttctttgtgaacttcaattgtaagggcgagaggctccaagttgtggagattcctcgcaagcgggattgagaaaaagcaagcaaaacaccgtggtattcaagtgggtctttggaccgcttgagaggggttgattgcaaccctcgtccgttgggacgccacaacgtggagtaggcaagcgttggtcttggccgaaccacgggataattcactgtgtcatctctgtgattgatctcttgtggtattgcggtgttgagactcctttatagccacttggcaactattgtgctaacacttaacaagtttttgtgactataagtttaagtttcacaggatcacctattcaccccccctctaggtgctctcaattggtatcagagccgttctcttcaagaaagggactaaccgcccgaagag

SEQ ID NO: 9471 - DNA, 436 bp, Zea mays
tttaacattcttttggagttgctctcagacgtctaacacctacctaccatgcctaccaaccatccagcaccgtagtcctcgtctgacgattgtacactactcgtcagatgacaactcaaacaacgtcagtcccactgctgctaaagctgagcccccagacccccagcagctagcagccgcctcctcgtcaggcccttcctccttcaccctcgccaaacccgcctcctccggtccgaactccgtctgcttcatctggtgagcagccatctcagcaaagtgtccatcagatacacgttcgttcgttttttgccgcgatcggttggttgcttccgtttcttggatctgaatgagtgaacttaccggggaactgttcgcttccatggatggctgcgtccgcagagcgtccgggaggacaaaacacgcggcgaggaccagg

SEQ ID NO: 9472 - DNA, 92 bp, Zea mays
tcctctctctcgtatctgctgggctcgctgacgacgatctcactctgctcttgtcggttgttgctctgctctagtgctctggtgactgtgga

SEQ ID NO: 9473 - DNA, 1449 bp, Zea mays
ggtgaaggggagtgaascctacaggcaacacgccgaagagtttgtacgtctcatgtttgatacttgtagaaaattaggaatgtataactatgacctgatgttgctccggtgaatttgtaacgccatctgaagacatgtgtcgggatcttcgttgtatgtgagtaccaggtcttatgaaacgttgacttgcgagctgtaccaatggggagtgatttcctgggcttcattttctctgtgtgtgtgtgtgtgtttattacagggaagggcagcgtcacggcgacccgtgcttcggtgtacattggagattactgaggccttcgtttcagccgtaaatcacatggatcgaagagtactttaacttggaaatgatttagtctccctcaatcccactcattatgatcttaattccgacccccagaccagagtagagagagtgttgatcttgctctggcgtgcacgtatgaggttcaggtcacgcctgttgaaggaggcaaggacaaccatgagtcagctaagatatgggacaaccatgagtcagctaagatagggatatatatcatccgcgatggaccggtgtttaaaaaaaataataaagtatattcgtttagctttaatctgtatcagctttaaagaaccaactttaattcgaaacaaacaaccccgaccctctaggataccagcgcgtagtaccttgtttgtgattgattgaagcacaaggtacggcgtggggtggcgtggctctggtcggtgcaactgctacactagcgcacctaagggcttcttgacttataaaatcaagtgtttttatggtgtcagataaggatatttttctatatgttcagtaacatctacaactttttgtttcagtttttttttgtatatttaagattattaaaacgctaaacaaatagtgatgtcatcagcgtgtttgcttgcatcacagtagattagcagaacatccacaaaaccatcggcaatctatagacagccagacttgtttgaatgtatgtaacaataattaatatattgtaataaaaaatcatcgagacaggacgtgctggtactgctagagaacgtgcaacacgccggcccacgggrattaagaccacagaaagagacagggttcgccatcaagcgaagaaacgaaaccagcgacggaccaaaccgtcgacgcggcagcagaattgaaaaaggcaacgcgcgatgcttatccggagctcgagcagacccaagcgcctgacgtactgttcaccaatcaccaccgaaccgacccaggcgcggcgcggggctatatatatgccacacaagcccatccgaccccgatcatcggccatcgcagtttcacagacagcatccattccacagtcaccagagcactagagcagagcaacaaccgacaagagcagagtgagatcgtcgtcagcgagcccagcagatacgagagagagg

SEQ ID NO: 9474 - DNA, 110 bp, Zea mays
gttcaaatcccagctgattagcaccatttggaattctgaagcattcttgtttaggtttatattcggagtattctctcactgggcttgctgacagggcatgctactcgaag

SEQ ID NO: 9475 - DNA, 160 bp, Zea mays
aattcccttgcgctctttgctgttccaaattccaataaatctgcctgcgcatggcagcatgggcttcttcttcttcctgctgtagattcaaaagcccaccaatgtaggaactggtaaatttttctattgggcctttcggcggcctagtctcgtgtcagtt

SEQ ID NO: 9476 - DNA, 1500 bp, Zea mays
aattaagtttatatatttatatatataatatatttgtatattatcctaaattatatcagagagatagttatatactatatttatgttatagcgaagcaagtagaatagtatgctataagttgtacattggaaaaatagcatgtaaatctataaaatcaattttcatctctcaccccatgaatttgaaataggcttatatatgataactttggaaagtagtggaatgtcacattctaaaaaaatagcctattccattagtaagattttaatttctcaaaatgaaaggaaacaaacgggacataaaagattttgacttgttcgaaatcgaaactcactcaatctcacacaatccatatggattgagagcaaaacgaacaagacctgggtacgtcaacttgtcttgaggtcgatttgtattataaggtcttattcgtttattcctattacatatggattagatgtgattagaaaaaaaaaataagaagaagtttgacttttttgggatttaaactcatttaattccactcaatctacttgaattgagagcgaaccgaaagcactggaagaaatactcttcttattttattattgaaagaaatactccatataatgtgcccataagcttatcttcatcttatagtcctgcatagaaatactccactggaagtttattatctgataaaatatatgttcataatatgtttgtctaattttcattacaaggttgctgatggtgttttgagtatgtagatttatatatactaatattttcaccatcaacacttgctcttcacaaaaccatggatactcgtgtgaataatttccaaagagagactacttcaaagttgcttttttttaatttcgaattacgacttgctgtcaaaaggcacgtcgatcgtctaaccactagatcgaaaataaatgcgagcaaccacatcaaatcgagggcttgaacttgggtgagtaggtagtttctacgataagaaatccaatcctatatgctcagttcgttactacaaagttggttttattcgaagaagaggacctattattgctctatgtgcttaatctcctttttttgtattaaaagtagacgaaagtctacgtgagccttgctctgcccagcagccttgatgtgacccaggcacccagctgggcgatcactttcgaggcagtttcaggtttaaacttgaatgcctcaatgtaaacacctgcttccctttataaattgtcccctaacgcgtgttgtttgaatggaaataaaaaattacgattgaacaggtcacttggttgctaccaaatcagaaagaaacaaagctgctactagcctactagtatatatatgtgtgtacatatgcaacacaggcataacagcacctctcgagtctcgacacatagcagctgcttgcctctgcacacgcgctcagtaaggcacattaggcatccccataagtcataggatcgagctcctgcgcggctccacactgcgtggatccggcc

SEQ ID NO: 9477 - DNA, 227 bp, Zea mays
ggtgtttccctattattttacagcgaatggaagttctgtttcgtcatcttctatgttgctgtatatttacagaatagttttataataatttagtgaatttcgttctaactgttttctttcccgaagtgcaggcaagtcgtctgaattattggttccgagggctctgtagttgcttatccacgctcgcctatgcctttgcgctgatcttgacaactcaaagcttggat

SEQ ID NO: 9478 - DNA, 859 bp, Zea mays
tacaatcctctatatttagatgatgttgttaaagtgaatagaagagaaaatcttctctgcatttaggaccccttacagggccacactgaggctctagattagcgtgcgtgcgtatgttatgtaagattatgactaatttagttataacaatactaaatactctaaatggtatcttttaaaatcaaaatattcctatttatttagacatataagtttatcgtgtgtctagatatgttcaaagctaatgtgtgtagagaagataaaacgttctataatttagaacacaggaaacattatatttttctaatatatttgttgactacaaggtgattaaaaacgggcttacagaccaccaccataccgtgaggagtctcggatgaggtacgacaggaccactctcagtcacacgatacgatgaccaaggatggtaaagtacgaagccgcagcctccaaaactttatagccccttgatttgatccgcgccgcacgaacaacgtgccgcgacctgacgcggtagatgatttcttttagccaacaaaccaggcaaggaccgggcaacagcagctgctaatcagcctctgtcaccataattaagacgctctcttggctgccttggtttggttcctgctcctccttactctacctgaccagctcggcagctccccagccgcgacagagtccacgacgacgatctttcttcccacccccgtctgcctccggatcccagctcccctgcccgctcggtcgactccctcgtcgccgagtccagctccgactccgagaaaaaatcaaatcgaccgagtccgcccgtgaagccgccgacagaaggagagagcacagagcgggcgaggcaggcagc

SEQ ID NO: 9479 - DNA, 653 bp, Zea mays
gattggttttcacatcgatttaattatctaatatgcttattgtatatcatttatatgcatatcctcagtactttttatgcccattcaattaaatcatttgtgtacacatctgttttattatatataaaatatacccattggagttgatatatatgcatattggcagtatgtgtatgctcattcatacacaagtttgtgaacatatattaagcatatttgaattgttctatttacttgcataattagtttacactcctgttcattatatataaatacatacagatactgttatttaagcaaatgttatttaaatattcatgttatttgagctaaatgtttttattactatgaaccagttattaaaatatgttgtatagttagttgatgcaaaaaggctcttattttatcctgtttcatttacaattatatgaaatattaaatcaatctttatgcttgtatataactattgttcattaaatgctatcgcataaatgtaaaaggtagtttaagttatgtaattccacttagcattatatagtatgcatttcagatagttatagtaaaaattagttctttttttggcatatattcatgcataaatcaatgtatttaaaaacaacttttttttctacagatttattcagtatttaatc

SEQ ID NO: 9480 - DNA, 1500 bp, Zea mays
ctagctatacagagtcctccatcttggcagccaccagcgacaagcacgcccctgctgctcgccctcgccccccggggcatttgaccacgctgacaatagcacagtctgagcacaccgcgcaagcctgcacctgctccggctccgagacccaccacctgcttggtgctcttgtgggcttgtgccgtcagccccggcggggacgacgcgtccaaagcgacggtacgttgcgtcgccctctccctctcgccgacgacgacgaccggcgcgcgatcccatctggaacgaacctttgggcagacacgcacacgcggccaggcccaggccactactgtgccggccgagccgcgattattgtactgccgccgctgcagcctgcagccccctgcacgagatgaaacatattagttacagttggggaggcgaggtagagcttggcgctggcgcggcgtgggtttattccctggccgcccatcgatcgatcggcagggcggmarcggcagcagcgcaggtgcagacgtgcaatgcagcagccggttcttgtcttgttcgcttgttgatttgccgctgcatttagccattagcgcccaaagtggacgagctgtcgcggctggcgcgcatctcggggacacgacaggcgcatgcatcatgcacgagaataaatagctttgaggtccatccatggcgatgcgaccacgccatgcggtctcgtgggggccggccgacgtgccgctgccatcgttttctactactgcgatgcgactaccaaaccaacgcgaggttcctgaccaaaacaagcagcgaaaaggaagccaccgggtattaagaaagagaacatatctaatgcacatggaagattggtgcacatggtgcacatattaaatcatcatcactcatcttagatataatgtttctagttgtttggtatattttgctaaagacatcctccgatgtggtggagtgtagtggtggaaggtgttatttgtaaattgaaatgatcaaccaaagacgttagatctaatatggatagtgatgatttagggcccgtttggcacagttccagctcctgattctaagcgaggatctaaaggagccatgccaaacgggtatttttttaaactgattctcgtgtggagcctaaatattgggagtcgtttttgtgaagaaaggtgggatctaaaaaaacctgctccaccctcccttaaaacagctcctcaaccaaccaaatatggaccttcccttaaagtttgatcgaaattacccgcaattgccattggacaaaaacataacgagccaatttatggattaaacatttgagaccattttatgcactattatgatgggaatattttatatgttattgtttcataatttttttccgtatatgcatcctacttattggtttgtaacaaagttgaactgcaaagggtaaaatagacaatcaccacagaccaccaactctcagcagacaagaatcagtttacttgccaaacggttttaaaa

SEQ ID NO: 9481 - DNA, 1500 bp, Zea mays
atgagcacattttttttctgttacaaaacgaaggaaaacataggatgcataatttctttgcatatctttaatgtcattgacacctactctctttttaccaaggttattaacacgataaaacgctgtcatgggtgaaattttgacttttaaatgtttaaacaaagtttaaatgtagatttaaacaacataggaaaaatatcaatacatcataattttagacaataacatgaagttaaatattaagatagagaggttaatggcttaccaaaacttcacccatgagctggattggaccccaaaagtaactaatagactaggcccaaaagtagctaatggtctaaaattcataaaactttgcgttttacagtttaaaacgccaaaacgctaaaacatggtctcaacctctaattagagttatgatgtttaaacgtcgtttaaatttagttttaataacactgcgcctgagcatgcggatccatgcccttcgcggtgcgcctccggcggccagccaccgtcaccgtgctctaactctccggtgcacggtaatggcctccctagcaatcattacaccaggtggtctcccttcctcagtcgcccatcccaccttctaggctgctaggtcaggtcaccatcgaagccagtaacatttatgtttctacatttctttcgacccgatatgctgcgtctgcattgttgtttgcactggatattgttattcatcagccccaaaccaattgcagtttaactttggtcatgtcatgtctaatttccctgcaatttccgcactccatttcatatatatgtatcaaatatgaacccctgaaactgaagcaggtgttccttttcatatatttggaatttttgttgttccttttaatagatgtgctatctgattttgtaaaatagaaagtaagctatcccttgatttttattagccatatatagctaatcatgggtgttgctatgtaactttgcaaaatagcaaggctgttgtggacctcttccttttcgagggattttattttacaaaatgacaaaatactaggatttagctattaattatagccaatctgttggagtttctctcacttcctttatcagtaaggacccgtttagatccgttagcactaaaaattagcaactaaaattaaaactagttgatccaaacagacctgctaataatctgataattgttaacggaagggctgctaaatattactagttccattagcaggatttggagttgctaatgattcatatgcaccttcaactcactatctaactacctattagcacatggatgcaaacagcttcccgctaaaagttagcaactattagctagctaatttttattgccaatgaatccaaacatgccctaactaatctgaacatgtgcacaaatctcggctgttgtatattcagaatctaatctaaccatgtgccttttttttgtttgtgtggtgcagggaccttccttcctgatacaggaaggcagggttc

SEQ ID NO: 9482 - DNA, 215 bp, Zea mays
ccttcaaccccaacatcaactgcgccaagatcttcgtcggccagtgggtctgcctcgacgctactacatccgcctgagtgctatgccatgcctgcctcttgctagctttgaataaggagctcgatcggtttcgttctctatctgtcgttgcgttcctctccagatcgtcggctggttttgtctgccgcaacttttctgtattcccgcagtgatag

SEQ ID NO: 9483 - DNA, 229 bp, Zea mays
cctaggtgaagaagtgtgtgagggtggtgaatgtgtccgacttcaaccgaagcgggaaggtccagagaaaatgggaaaaatcatccaaaatcaccaaatagtatttataaccagaaagactgagtacaggggaggtccaaaggtcacaatgaaccagatcaaaagcctgctcagcccgagaagaagaagtagtaaatgggagacgagtatgtcggcctaactgacaagc

SEQ ID NO: 9484 - DNA, 433 bp, Zea mays
ggtatgatgttcttctgttatttccgttcttctaaacccagcctgatgcttcgaccaggatctgctgatcctaacaaccaatcacatggacattgaccgtaaccacgctgacacgctgcaggctgtagcaacatagaaacagggctgtagcaacccttcgcgtacacagcgccgcttcctctccctttaaatcgagcgccgcttcctctccgccgctttctctccccttcactcgagcgccgcttcctctccccttccatcgagcgcagcgcctgcgccgccgccaccactccgcaccgccgccagttccccacttcctccccacacccgaatcggattgaagccagaaggcaaggtgaagagtgggcttgggtaacggttgcaaagagatatccccaacagttgcagtcactcgcatccagtcggctcagct

SEQ ID NO: 9485 - DNA, 175 bp, Zea mays
tacttcgagaaattatgttgagttccaaatctatgcttggtaggagaatacaactaacaacttgttgggtgaatcaatagctcattttatcattattaaaatacaaaaagtaagaaataaccatatgagtgctttggatatctaggtgaatctatcaagaccaaacaagaaataa

SEQ ID NO: 9486 - DNA, 161 bp, Zea mays
gcgccgtcaccycgcgacgcgcaaaggtgagcttcgacccgaagccgaaccgatcgagaggcccagccgccgcaaccggaggagagagagaggcggatacacaaacacgaaaccctagcaagcaagccctccacgcacagtcaagaagggagggggaggcg

SEQ ID NO: 9487 - DNA, 1187 bp, Zea mays
tggccacgaactcctctcccaccacgatggaagcgcacaacctggagacgccgacgtcggacagcaggctgcacacggcggcgctggcctcggacgagccggtctccgccctgcccacgatcggctatttgacccaatagcctggccacgattgcctgccccgcggccatggaagtcgtaccaccatccactgcgattgcgctagcgaggtctttattgtcccacacttatccttcgatagtacagtataatcaacctgtacttactacccaaaggtgattattattttttacattgtttttgctattgttatcaccgttttaatggttattaggttatgtatagtatttgccatttgttagtatacaatatagtaagtatgaagaaagcatatggttgttcgatgtcgagctgttcgaatccaatgagcaacaaacgctcaataaagaaaatatcaaacgaattactaatgacctctagcccttgcaattgatccgcctcgcacacgactctcttcttatggaaagacttggagacaagtgaccacttgctagaacttgacatcgctctcttgcacggtgttgcagaggtcaagctgaacaagggagcgctcaagctcttcctccactgcattcctcttgctggtgggcaagcttgatcagaccatcgaccatggttttgatgttcactgcgcgacgaccaccaccacaccggacatcgccacagaggagcagtccgcgcgcgtccgccgggctcggcgagagaagagcagagagaaacgcagttgaaccagaagatagagacgaacgatagaaagtagaaacccagggcaggggcaattttgacccttagatgataaatacatgcaaacaaattataaaaaaggtataatacacgttaaatggtagtataatcaattagaacatatttatagtcccttttttacgaagaaaatcttttgaatggcatttgtgcgaagcgcaatgtttcgagtcccaaatatgcaattatctccctgggctctagctatacacgggatactgtcaaaccagcccttaagagggaattgagggaacctgccgacacaaatgaaagatagagcagcgaccacgactctatgattgcttcggtgcttcctccccgttccgttctcccaatcgcggctaagtctccgcctccagagacag

SEQ ID NO: 9488 - DNA, 1158 bp, Zea mays
aaatagtcatgaatgacattttcataataccgaaggctaacacctacagattttttaccaagaaatagtctccacctgaaacccaataatgttacctgtagcaaggaaacatatgtggggtgacgtgtacaagcctctggtcgataatcaagggcacaaaacccccattttgtcgaaaatagccataaacgacaaattttaataataccgaaggctaaaacctacagacttttgaccaagaaatggtctctaccgcaaatccaagcacatgattgtaacacccaaaattctattttggggttcataaaggtttcccagaaagatttgagttaaaatatgatttaatagattccttacaattcaaagtatatctcccaaataaatagtgatatcaagagcttggtagtttaaaacttagatccaaatcttgaaactaaaagttcaagttaaaactatggaacaataagtaaaagaaacactttcaatctatttattataacttcataattaaaacactccttaaaaagaatatttgaatcaaatcatggtgaagatttcatatttctcctaacgccccgtttggatcattggaattgaattccattctaataatagtaatttaggaatatatcaattaagctaattcggttttatgcaaaatatatttgtatactattattagcaagatgtcggagatatttatgtgctacatttttactatagggttgtgagacgaatattgtcatgtaagttatagattagaaaccaattcttgtaatgcataaaatcatttcccaccctctactccatgaatttgagatagacttatatctgaactttagaaagtggtggaatgtcaaattccaaactaaataagttactttattgagtgaattccaatttctctaaaatgaagggatctaaacgccccgtaatttgatttcggttccgataaatttgattcggttcttcggtttcgatttattttgttgagacctagatacgggcccttgctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacg

SEQ ID NO: 9489 - DNA, 1500 bp, Zea mays
ccccaacctaatctcagccgttaacttgggatgaacggccaggaactgttctcccacaacaccggccgacccaggacggcgctgccctgccgcacggtggcccaccataggtgagcaccaggaactaagtacccacccaaatccggccgctacctggtgtaaacgaacgcggggattcaatcgagcatcagagaggtttcataccgtgcttcgaagggtgatagaaccagtcacaacgacgcacagcaccctggtcaccaagtgcggcagagcccaacgctcggcgagaaattcgaccagcgcccccaaaatttcccctatggcgctagagctgtagtgaggccggacgacgggctccgcgtaacagccatagcacgagctcccccaagttcttcgcgtggcgcccctctaatttctctctctccctcactcggatctctagcaacacccaggctatagtccgacatggaggtcgaccgcaccacaacaacacagcgacgggattccagatttatagtccgggcgcaaggtcaacgaatacccgacgaaatcgcagcaaaccaggaggtagcgctagcggtccggtttgttcgggcttcagttaggtgaagaaggaaagtgatgacatgcgggtcccacatgtcagtgtgacgccaagagaggaggagctgggctgctagaggaacaaatgggaaattgggccggcgtgagagcaagggagatgggccgcatgcggcaatttcggcccaggtgaggtctttctgtttctctttttcttccagttcatttctccaatttcaaacttcaaattcaatttaaatctagctttaaaattcaaactcttactcaaaagcaccaacaaaattccagtatgcaaatgcaaaaatatatatttgcttattattactcttcattaagtagatgttccaaatcatataaatttattgtttgttttagaagaaagaaatatgatgagtggtcgttaattcaaaaatgaatatttgtttcttacttactttgagtggaagatatatatatatatatatattatatttatttactcttatgtttactcaattccttagtattacttcctataaaagacacagaagaaataaatgaactcataacttatttttagggtttacattaggccagcaaaccctcgcaccatgaccatcgtcattgtcaaaccacagaaataaattactctgctcataaacaatggaaaattgagagagcgagagagaggaagctagcgagaaggtcaagccgcgaagagaagagacgcacgtcacagatccctctccactgtctcaccctttctctctcctcgaccctcccgacgcggcaaagcaaaaacaaagggaggagaggagggagagaagggagaagacgaggccaaaaatcccctccccctccccaaatcctagcccaataatctctcaatcaggggattcttaggtctgatcaggtcgaaggattcggcagggcgcagcc

SEQ ID NO: 9490 - DNA, 610 bp, Zea mays
tgtggtatactgtagtggatataattctgatataggttcgaatcctatggggtgcttcaatttagtttcggcatctcctgtttaattcgctccactgccagactcactcacatagcctgctaggcaatatctgtctgtgtattcttggtttagatacatcatgtttgcttgcctacttatatttattagcatggcatcttgtatagcttggttaattagtatattatattatttgttcctgctgcatctatctttatgtattcattcggcagttgtgttgaatgctctgatttgtcttgctcggttgcttttcattggtatgaattactagttacagatgggtgaacactgactgcacggtctctgttttcttgatgactgactatgttgtctttgctattctaaacaaaagaacaattaatctaccagtctgcttacgtacatatgtgtttctaatttgatgttagtcaatgaatcgccgcaactgttctaaaaaaaataccaacctctcaactgctaattgtagtatatcttaacttttgcctgactgcgtgctatatatatccttttttttgtgaatacagctttctagtcagctgctcccgttgcc

SEQ ID NO: 9491 - DNA, 500 bp, Zea mays
cgtaagttttctgctcaaaagtcgttcctaagggaatgcagagcttacagcgaaaagtcaacgctgattccgccaaagtataaggcgaagcgcgaaaagtcaacgcgataccgcccaaagtaaaaggcgaagaagttcaaaagacgttcctaagggattgcagaacttagcggattgggctaggtgttgttttgttacaagaaggaaaaccagtttcttattttagtgaaaaattaagtggtgctagtctgaaatattctacttatgataaggagctttacgctttagtgcgcactttgcatacatggcagcactatctttggcattgtgagttcataattcattctgatcattaagctttaaaacatattcgtacccaaacaaatctgaaccgtcgtcatgctaaattggtagaattcattgagtcttttccttacattattaaacacaagaacgggaaggacaatgttattgttgatgctttgtctcgtcgctatacc

SEQ ID NO: 9492 - DNA, 157 bp, Zea mays
ttaatggtttgcaggaaccgccgagaggcggttcttttttgtctgcgttttggcgcagcaattttcagtctcatcccaatagcttttctcacgcgctaagcggatgatcgatcagatttaacttctcattcatcttatcttccaggaagaattgacc

SEQ ID NO: 9493 - DNA, 104 bp, Zea mays
ctcacttagtcacgcaccctgttcgggctggcggggcaagtaaattttccgcaacaagtttctgacagtgtgaaagcactgcgagacgaatcgaggattctgga

SEQ ID NO: 9494 - DNA, 97 bp, Zea mays
gccgtcgcctgtgccatatcgagtaatggtagggtagttggaagaacatgaagagggcttgtgacgtatatttcattttttttactattttactgtg

SEQ ID NO: 9495 - DNA, 322 bp, Zea mays
caatccataattaatgaggtccgttagtgtgtacgaaaaattgaacactagcagcaacattcagtttacaaggtcatatgatattttagcacgcaacgtcatgccttaacccaggccgagtccagctagcgacccaactgcaaatctatcatgcactttgcatgcggcgcacacacaacccctttcatgcctccgtttagtctcacgtcaaccaaagctcaatgatttgatcggctcctagtgacatgtctctgaaatcatctttataccaggtcatcggaatcggacgttcccgttggagcagcagcgcgaagcagcagcc

SEQ ID NO: 9496 - DNA, 371 bp, Zea mays
tcgtcttcggccttttgtcacaaggacaatcattggagctgctcgttggaagcaatggctcgatgcagatcgacccagagagagatgtgagtgtgtggggaaaagaaggcaagccatgtgcagtgacaaccgcaaaaggacatcacacatcataaagtttcgacgacgccgagtccgctgcattcaccgtgaactcggacaatgtcatcgtcttcggcgttagcttcaaggtccgtccgtgcacttgacttgaccgtacccccggccctccctccgtttgtacgtccgtctaactagaacgccaaacttgacgacagaacagcgcccgcgtcggcctggtgaacgacccggagatccgttccgtggcggcg

SEQ ID NO: 9497 - DNA, 1010 bp, Zea mays
ctcggtatccctggtaggataatagcccagtttcatttggattttgaatttacttgcgggccatcatcgattggttgctggatctaattggcacgcacgtcacccccaccggatgcatgccacagatctgtgcatgtgctcaccatgctgagggaggtcaggattggtgcctgcacgcatggggttcctacgcccagaccaaaaggatctggttgctatctttcgcccatacacggatgctcttcttcagatctggttaagcgggcaatgattgcattgcgggggcaccagcaccagaaacaaactgtaggaggttgctgcggtggtccctgtggggttctactgctttaggattattttctgggatctgttttttttccagcccgagtatgcatgccgtcgaggttcaggttcctcctctcttagcaaagttttatgaagcttctttttggcttctggttgctgcctgcacaactttatcaagctaccaaacgtactagttgtactgcttcctttggattatagaggagttactaaataaactgtgttgggtgtgcatattctctgttttaacgataatatacaaggctgtggtcttaggaattgctttcagttatgcaagagatacttacttggcatacaactactggcgctccgaatgccctgccacccccctggcctgatagattctttgatctggaccttatatggttagtttattcagtgttgctgcactgtctctctacatgtttcctgaaacatcagtagattgtggaatagcagtgtgatggtgtagctttatggttacagctaactcagctgttggtgagatagctccttgcagttgcagataacaatgtgcttccttcagctgtttcttccatctagtgtacttgtacaagttcttccatgatatgataaatgtgtatttttttgttaacttcactgtttatctaactctgctgtgtcatgctttttcaattgtgttttttcagtagcaaccaccaccc

SEQ ID NO: 9498 - DNA, 141 bp, Zea mays
cgacttcatttctaacgttaactcggctcgtagttgtgattaaagtttataaatttcagatttgcctattcacccccctctaggcaacttttaattggtatcagagcccagtgcttcattagaggctaaccactcaaagtg

SEQ ID NO: 9499 - DNA, 1500 bp, Zea mays
gctatggtcaattcatatggagagtctggcgctctccatacaggggcaaccaaacacatggtctttttctcaaaaccacaatttataatatcatgatttattttgtcatgacataactatagtatattttacatcaatctaattcacacctgcttggagacacaatacttcagtagtagtataggagaagagaataatggagctacgtgcaagcaaaaaactttggttcagaccaaagtttttttgaccttaaaaataccgcaatattagtcaaatcaaggtttaaaacatatagttttttagatgtgctactaaacactttttggtataaaataccattgtatgctcaaatatcatggtattgttttagtaaaaagaatattatattcccaaacatgactttcgtattagaaccacgtggatacgtgagctccgagcggaggataattcgtataagacgtgggtacgcaaggagtgagatttaggtcctgtttgggagagtttcacttcaaaaatttcaactttgttctaacttctttcacccagacaagtccagctccatgagctatagctttgaaaaaatgaaactagagatcaacttcataaaattcatgaagctcctcaaagagtgctttaaaaacattgttttcataccttatcatgaatttgtacgaaaattatccaccataccactggttacgcaacatgcaacttctgttctctctcgtgatagcccattaatcatcaagtgtaatcaagaaaactcagagaaactcacataaatcaattgtattgctgaagttgaagtccatgtacaagtcaaacactcatcgaacccacaacaacaatttattggagttattttatagtgaagctggaaaactaaagctgaattttttttaattaaggccctaccaaacatgcttttaaagtagtagagatagagataaagagtcgatccaatttatcaatttatgtactttatatacgattcaatttacatatcctataagtacatacggacatgtgtcaaatctcaatacatccctaaaatcgagccatttgtaattttaatttgccatcagatctataaatgatagatacaaattctaacatatagccaaaagcgagagctgtaaaataacaaattttttccctaaaaccccatgcgccaaaccggggaacgtagaagaaaaaaaggttccaccaaccggcgacggctgccaaaaacctactccaccttatcgcccctataaaccctacgaagaaggtaaaaaggagggcagccagcggaagaaacacccggaggaagcgcccgattttgacatctcgtatgcgcgattgctggaatcctcctcccctgattttaccgcacagcagaaaaggagataaaacacgacaaaaattgaaggaaaacgcattcacatcttctcttcgtccgctgccgtcgcctctcttcattggtagcagcttaatccaaccccagtccaacccgccgcc

SEQ ID NO: 9500 - DNA, 1500 bp, Zea mays
gaactttgaaaaggatttacaaaagaatttgcaaaaacaaaacatgtggtgcaagcgtggtccaaaatattaaaaatgaagaaacaatccatgcatatctcataagtaattatattggctcaattccaagtaacctgtgcacttaaattatgcaaactagttcaattatacacttctatatttgctttggtttgtgttggcatcaatcaccaaaaagggggagattgaaagggaattaggcttacaccttttttcctaattaattttggtggttgaatagtccaacacaaataattggactaactagtttgctctaatctataagttatacaggtgccaaaggttcacacttagccaataaaaagaccaagaaatgggttcaacaaagagagcaagggataactgaaggcagccctggtctggcgcaccggactgtccggtgcaccaccggacagtgtccggtgcaccagggaactccaagccaaactcttcagcttcggggaaactcagaggtgctccaaggaagagcgactctgaactcgccagcttcgggaaaccgctccgctataattcaccggacatgtccggtgcacactggactgtccggtgagccagcggagcaaccgctacttcgcgccaacggtcacctgcatacgcattaaatgcgcgccagcgcgcgcagaggagcagagcacgcgtgggtggcacaccggacagtctacaggacttgtccggtgcaccactggacagccaggcgggcccacacgtcagagctccaacggtcggaacccaacggcctggtgacatggctagcgcaccggacagtgtccggtgcgccatgcgacatcagcctccaccaaacggctagtttggtggttagggttataaatacccccaaccaccccacattcaagatatccaagtttttacacttccaaccacttaaaagagctaggcattcaatacaagacacacccaagtgatcaaatcctctcttaattccacaaaagctttagtgataagtgagagtgatttgttgtgttcttttgagctcttgcgcttggattgctttcttctttctcattcttttcttgtgatcaaaactcaattgtaaccaaggcaagagacaccaattgtgtggtggtccttgcgggaacgttgtgttccgtttgattgagaagaaaagctcactcggtctaagtgaccgtttgagagagggaaagggttgaaagagacccggtctttttgaccaccttaacggggagtaggtttgcaagaaccggacctcggtaaaacaaatcatcgtgtctcactctttatttgcccgcgatttgttttttcaccctctctctcggactcgtttatatttctaacgctaacccggcttgtagttgtgcttaagtttataaatttcagattcgccctattcaccccccctctaggcaactttcaattggtatcaaagcccggtgcttcattagagcttaaccgctcgaagtg

SEQ ID NO: 9501 - DNA, 95 bp, Zea mays
gcaggagatgtccgccccggcgacgtcgtcctcgtcaagtcctcgaagtccgccgaactgcgattcctcggcgaccgcctcggaggtgtcaccga

SEQ ID NO: 9502 - DNA, 553 bp, Zea mays
ggtaattgcatttcatgtgacctctaaagtggagtgatcttatcatggctagaaaatgtagctactttttagttgcataaagtcacgcagaagagttgtgcatcattaatattataaagaaaaagggtaagaacccttacaacaccacacacaccttcaattcacttaggttcctagaacatgcgcaccacacaaacacatagattgaccacaaactctaacaccgacaaactatccttcaggaggcgctaggcaaggaggtgagtaatacctattacctcgtgctccatccaaatcccaaaagtgtaactcctctacagctagcaccaacacatgattgttttgtgcaaatgtttaggtgtgttaaatgattatgagcaatagtctgatttgatggttgagttattttcagatattaagatagtttaccttttaacgttatcaacacattgatatgctacatgatctctgtccgtgcaataatatgaaatgttacagaatgcactattcctaattgcttagttgaagcatcctgtatatcattgtagaggat

SEQ ID NO: 9503 - DNA, 862 bp, Zea mays
tgattaagtatgtattatcaatattttcaactgctcgttatccgaacactaattattaatcatgtacatgagttggtccagtaaagtacgtgttccaaagtgcaacaatcctttcaatcttcgaaacagagatccgaagtggtcgacaattaactcggtttgggagaaaagtcgtgaaaagaggttgagtttctaatttattttacgataaagtcggacaaaacccggacacattatttagtgtgacaacataattcaagtcacacaagatctctgatatcatctagatagataaagataaatacgacatagagtttattatacttcaataaactccagcttaggttcacgaccgctatttagcacgtgacgaacatctgggtgttaatcttcgacatcctatttggttgcttacacccgcagctgctgttcgaactactgcagctctaatatatagagacaaaatattgtagaatattatagagggcaacatcagccggataaaagtcacaacaaacatggtgcgaaactggcagtgggcgaggcagcacgttttttaaaaaaaaacaatagcggcgctgctgcgctggcagaggaatcgagcggtcatgaaacggccagggccagccatacacgaacgtgatgtgacgaacaaatccatagctgcacgcggtgctttcgaatcccgggaccagagatgcagtttagctcaaacagtccttctcaacgcaacaccatatcagtcaggacaaacgacagcgctcgacgaaacctgagcgccgctggaccgaaagcgctaaaaatacgagcggcatcatcataaacatcacacacacacaggtctcatagccgaccagtttcg

SEQ ID NO: 9504 - DNA, 1145 bp, Zea mays
gttagatcccaatgactcttccaagaccacacacatctgggccagcatttcatcatcgtcatccgagtcactaactcggatcattactttcttcctcttcttagaggaggaaggaggattggttttcattgtgaaagatggaccaacagaagccctttcggctaattgctctagaaaatggtttggtctggattcttcatagtttttggcgacccatgcgggttcctcctacggagtacaatgcacaccaacatttatattgaagtatgagctagataactcggaacacaagatgaagtgacagagttctgagatataccttcgagcgaggggctgccagcgaatatgcctctacatagcaaccctctaccaattttcgatggagctaaatatttgggataagagtacctctaccatatcagacacgggggctattaaatatatgtaccaagggcactcgagagcacttcaacaaataagagcctgacaggtgggttcgagaatcgagaactcagcaacgttatccaaggactcaacccatatgtcaaagagatgccagactcgtccgagaaaaatgaaggcgcgtgatcttattagatcagtaaggtcgatatcgatgtaaggccttgttcggttattcccaatacacatggattgaatgagattggaaaaaattgagaagaaatttgacttgtctgggattcaaacccatccaatcccacccaatccatatgaattgagagctaaccaaacaagccctaacacttgcctaactatgaataatcgcaaagtccgcaggaccaatctgcaaaactagcatgagtcccgacaacgagggagacgcacggctcacgggctcaggaacataaaattctccaaacgggccccgccacacacgatcaccatcacccccgggctcccgtccccccgtacaaatagaataggcacrcacactccgaacttcccaccccatctccgccgcgcacaccgcccaatcagccaatctcctcctcctcctccgctctcagacgagcagcggttgccatcactctccacttcccacgcccgctgcgggctcgcaggcggcagagaattgtctgtgccgccgggtgggaatttgattcggtcggattcgctgcgccgcg

SEQ ID NO: 9505 - DNA, 1054 bp, Zea mays
ccgagaggccgccatggagctcgctggggaccacctccctgggggcacaccagatctggccttgggcacgccggattcggccatgggctcgccggatatacacggttgtacgcgcatttggccatgggcccacaacgacgacatagttgtacgcggcagccacgccaccgccgtgatttttgcgtggccattagcacaaccaccatctccctgcatgtgaccaacacgacctcgaactgacgacgacaaccacggacacagcaaaatgtggccaccctgaccacgaatctactcacctcgaccacaaatccaaccacagcggcagcgacccgaaggaacgacaacctctttcgacctcttctcgtgccacgtgcgtgcctcccgacctcaggaaggagataaagcctcgccaaccgcacgactctccggtgactcgctctggcggtggtgtgggaggggaaggggtgcaaagggtgtggcggcgcaggggtcacccacgtgtcgcccaggagagagcgagggtggtgaatattcaaactagtattgacaaattcagtttaataaaaacaaaatacttgttaaacttaaaaatcaataaagaaatcagttgcgacatgtcaagaggctgcagataagatygtgctatcaagattgcctccaacaaacacagactgtgtgtccaaacaatcgtgtcgtcccaaacctgtcaagatagctaaaaaacaaataaaggcggccaagtgactgactacayaagaactayaatgttcggccaatcggccggcagaggttgttaatatctcatccctgcggcctgcccatcacgcgataattctttatttcgtctcgaggggcaacaccaagacgctccgcaaatgcagccaaatgacagacagcgttgctctggccacatcacctcttggagatcctaagcatctttttcagtatactggcttgtctatatatgcacgcagaccgggagcacacctaacacaggcaccacagctgagagacgatagaagcacgcagcagctgaaagggaggggaactagga

SEQ ID NO: 9506 - DNA, 323 bp, Zea mays
ggtttactttaatacactacatgaggaagttcatgtattgtattcacaactgcaccctaacgtacctgaggatcctatcgggatgggagccagaccttctggagcagcgggtgaagcccttggtggggaactggaccttttcaggccccctccttcaatgaatctggtcgacgaatggtctcctacacccgacagtgaagctaccaaaactgataagaagctagaatagtgtagtatagaaatagtgataatgtgtaataggtaatgtaatcctgttgtaaattcgagtctgtattattacccttttaagtaatgtaaaatgg

SEQ ID NO: 9507 - DNA, 366 bp, Zea mays
gcactattatgttaccaagcatgatgtggtcaccgtattcaatgattataaaattcctattgagaatgacccagttatcaaagtgtcgtgattcgtagtatgttatcaacaaggctgcacgcacgtacaacatctgcaccagattcctttcgtgcatcgtgcatgcattctctagggactttgcacggcgtgcctttgccttcccacaaagccatgccatgttctctttgtgtcaaggccaggccaggattccaacgattggtagtttatttgcttcgcatgcacattgcatggggaacgaaccaagagcttcttctcgaccagcagcgagcccactagctaagatcgagcgacgtagttgatgcc

SEQ ID NO: 9508 - DNA, 726 bp, Zea mays
ggtatgttcaatcttttacttgaactcaatttcacactacaatctaatgtctgaacacagtgttgcggtgtcacttcaatattgttcaccattgtgcctttgtcattttcatggtattgatgctgccaagctagtggcgaattgttttgctgaaacatgtatataagattcgacaaaaaacagttcaaaaatcaaaacattatgtttattgtctagattagtgttgacagtcacttttggttcatgagatatctgttcttaaggcgtcgcctaggcgtccgggcggtggtctaacgcctaggcgccttgcccgcctacctcgcctaggcgccgcctaggcgtccaggcggtgctccaacgccttggaccgccttaccgctttaaaaaccatgcatgagatgaataaaatatattcatcggtactatcaaagtatcgctatcgccttcatttccaatgaatggtgcttgctttcatccccagtgagtatatttcttctgaaaatagctgtcctttatacatatatctaatagggtgtttgacctagaataacttttattgacagggatggtggtattgtgggatttgcaatggcatgctcaaatacctttggattggtgactggtgcttttcttcttggttttgggttaagcgaaattccaagaaacatttggaaaaatgcatactggtctcaccgccaaaaagtactttctcatagagttgccaaa

SEQ ID NO: 9509 - DNA, 843 bp, Zea mays
ggttctcagagctctcttgaatcttggtggaagacacgtaaccataagcacaaagctaggtctttcgatgatgctgcagataaggatggtaatgggtcgggttcgggttaggtggagcaaaaacccactcgcgatcgcacccgtgaagtctaactaaactcgtccccgatcgcacccacgggtacaattttaagcccgcacctgaacccgtcgggtttcgggtcactcgcgggtttttacctagtgtcacttttaaataacaattagctataaacaattaagtatcaacaataattaagttatatctacatattttaagccttcacatattgagtagcaacaaaacgtttcatgaatcagtagccatgttacttattcaaaacaattaccgttgtatcttaattatttttgcacaaaaataaagaataaaccaacatttcgggcgagatgcggatcaccgccggttgaaatagaaacccgcacccacacccgcgaaacttcggatcggatacgagttgcacctgcagatcaaaatcttcaccgaataggtcacgtacctatcgaatttcgggtttgctgattaaactgccatgccgccaatttattatcttttctacccagcgtgtactagaaaaggatgaaaaaagaaggaaaaaaaaagaaaagaaagaaaaactccaacgaagccttctgggtctgaacgtccacgtccaattgtgtcctactccttcggtccgtccccatttcttcctttccttggcctcgactcctcccgacgtgatcgctccagagaaaatttcgcgggtttagacaaacagcgattgggatcgagatcggggcaac

SEQ ID NO: 9510 - DNA, 1500 bp, Zea mays
tccttaataatcaagagatgggatatttttatcaatataatgctagtgttcatcactataaaagtataatggtgattaatggcttatggaactacgacttaaaaggtgttttttataaaaaaaacatggaaatgagggcttgagcacgtccaggtttggttttgctcaagttactcaccctaaggaccgattcgttgagtaaccatccaaaataacagtgcaaccgcaagggatcgcatgagacatccctgattattaattaaatgaactagagattggcagcttgttcgctgcggcttgctgcggctgcaatccggctgcgaacaagctggtgattattttgtactagcgcatatgacgtggtagagtagtattgtcacatatcttcaacaacttacctatttttatacacatatttaaactccactctgaacagtgcagggtacaatgcaaaacagtgttttgagtggctagtgctggacacggtctcacaccactcgccctttgcaactaaaagtcaaatatacaatattaattttgtaacagttaatattaaaatattaattaaaagggaataaaaataaattcccaagtttrcctcttgcctaattcaggagtcaaccctcgaatccttggtacatagtcgtgtctcgagtcagacagagacactacaccagctaactagggtcgtagggacgagcagccgcgacccgcgagcctgcgaccggcgaccgctactccacccaggtcacggcgatggggctcctcacgacgtgcctcccctgccccccgctctgcttccacaccaggtacccctccgcgctgtccttcgccgccggaggggacggcgcgtccacggtcacctggaagctccgctgctcgccgaactccacgaacgacagcgtcatgggcgccaccgtgaccttcactcccggtggcgctgacacctgcacggcgtacgtcgagttgggcgcgccgacgttggtcaccgtacgccgcagcaccgccgacctggcgccgttcctgagcgccacagcgatcgacgggtagttgaggctgaagaagcccctgttcctgtcctcgtggagcgccgcgctgcagttgacgccagtgtgggtgatcttgaagatctccatgtggctgtacccgagcgtgcacaggtgcgtcacgtagtcggcgggctggatatcgtagacgaggcccgggtcgacggcgcgcgcggggctcacgtgccccgcgcccatggcgaacacgctggcgcgcccgccgccgccgccgccgtccatgatcgccttcccctgccggtcgattatgtcagccgtggtcatgatcgcggaccggaccatcgctgggctccaggacgggtgcgccgaccggatcagcgccgcgatgccactcacatgaggcgccgccatcgatgtccccgagagcacggtgaagttggaccggcgggcgtcgctctccagccccgacgggcccaggttcccgggccacgccgcg

SEQ ID NO: 9511 - DNA, 124 bp, Zea mays
ccactgcacgaccgcttcaatacgacgccaaacgaacccagctgcctcgtcttccttccaccaaccgtcgcaatcgcaattcgcaaacaagaccagttggcgcgagcagcagctagcagagaag

SEQ ID NO: 9512 - DNA, 415 bp, Zea mays
ggttcggcccttcggcttcttcgcttctcctcgtccgtctctctacgcctctcccgctcgcgcgcggattactgagctggttagatccgtcgcccccatcgcccttctgattcaacggagttcggagagctgcgatggtgcttccgctccgggtgcttccgttgcgcgctgacaaatgcggtccccgtttgattggtactgtcagtatcggtggctccagtgcagagtcggtgccttctagttttggtcctactgcagtccaattcagatcgacctttcgagcttgcctcagctacgaatccaattacgtaggcttactggcttagcttcctgcagctatacatggagatggagatgccatctcaggcttattaacgagtgccactgtcttctaaaactcagctgtatttctgtt

SEQ ID NO: 9513 - DNA, 389 bp, Zea mays
ggtaagtatcccggcacagattcacaattgagaacttgaactatacagactagtgggtttcttattatttgggtatatcctttcttgcataagggctttggtttaatgcttaattgtaaattgtagtggaagatggaacagaaggaaaatggtttcttctcccttcagtagccagtgtccattttcagaattgagttcttaagtagcaagtgtactctttcatactagtgctgattattaggaaacaattgcaaagatctcaagtaatgtgatttcttatgagcttttttaatgacaaaaagaatcttgcactaaattcatttgtgtttacatctttttggaaatgctcatgttttcatgttctaatgtgctcaatattttgatacagg

SEQ ID NO: 9514 - DNA, 1405 bp, Zea mays
tccatttcactcggtgccatgcaggccccacccatcatgcatcggtcttcccagctactaacaagctggactcgtttctcggccccgttccaccagctggagatgttggtgccgataccgattaattattagggaacaaaataaagtaaagatttaatagtatcgttgtttctgttattaatttctttctcgcatggtctccactggttgttggtacgtgtacgtccaggttgcagcacctaccgtcgcgatggcgacggggctctacagtgctagtagttgatgcaattttgcgtggtgcgtcgctggtgattgatgaactaatactagtggcgctgctgttctttgttcgtttcgtcttctttctcctttggcacaccgctactattagaacacgaatctacgccaaaattggtaaagcttgccactgattgatcgttccggttttgcccctggtgcctgggaactcgctgggcgctggctgcagctgactccatgctcatctggaggtttttaaaagtaataatataatctagactaatttaaacattcgaatgcgtccatctccatgctcaagatatatatacggcgctccttttgttttggagtgaccaacgatggcaactcttccgaccgagcctctcttgttcctgatgttttgctagatttaaggattcatacatatattcagaccaaggatttgaaccctatcaaacatcaaacgtgcaccctcgcactatgttctgagcccacccctgctatgcaaaatcagtcacgtgtgattttcagtttccacttgccgttaggttaatcacctgtccctgcccagagtagctgcaaaactaggcctaaattttcggttttcagtttctcactaccgttaatcacgtatccttgtcccgagcgaacatcaccaacaggcaacagctgtgtgtcaccactcacgaggggcattaccgtaaatgcaagctggatgttgaggtgtcacatcacatctactcccctcgcggcaagaaaccggccccgatatatcccacattcccccaccacccacaccgagccaccgaggcgcggcaggaaggaaagcagcgctgcggagcagagtgtgtcgcttcgctgtaaaaacaggggagagggagacgcgcccgctgccagtgcctgccgcacacgcgtttagcgtttaagttccactcctcgccgccccagatctccgccctcctcaccactgcccctcattccccggcgcccagcacccggcggccgcaaccgccgcagtccggagcaagatcggcgggtagacggacggacggacgggcgacaggcgggcgggcgcggctctgtctgtatctatctgttggtgggagaccggttgtgtcggttaggcggcggcgggtgggaaggaaga

SEQ ID NO: 9515 - DNA, 1500 bp, Zea mays
tacagagaagctgagccagccagggcgtttcaccaagtctatttttatagtaaaactaggtatgtgttggtgcgttgacacgagacataggagtgtgagaaacgaggtctaaactataaatataattattttttatttttaaatactaaagtatatgtgggttgatggttagctccaaaattgtagaggacgtgagaaaaataaagctgtggtagtattagttgcccacattaaatttttaatagagtagtataaattatttgaatctatttgagtagtaaaattatttgaatcatcaaatagatatttgagtctattttttatagtaaaattatttgaagatataatattgctaatatattatatgaatctagttaaatttaagaaagtttaaatgacacggactcccctatatcttctcctacacacgaacacccacgtctctctttcgatcctagaggctagaccctctctcgcgcacacgctctctcctctcttcacacggtttttgcctcgcaaacgaaaagacaccaacccgggcccggagggtcaagtggagagcaggggaggaggggagaggaaagggaaaagcgggtcgcgagtcgcgactcgcgagtgcccgcttttgctccaatccaatcggtgccgcctcgggcgagatccgctccgcgtgccccgccgctgccgaggtgagctccgaacgcccgccctccgccgctgatccgcgccggggctccgctcctgcgcacgcgcgatttgccactcggtttcgggcccgggattcccctccgcctgctgtccgcgcctgcggtttgggtcggggccgtgctgtagcggtgggtctccggtggcgaattacagctccgcgcggcgtgcctctggttctggtctcagggagttacttgggcggggctggtctccgactccgctgctgctttttaggcactgcttttttaaggtgtcgcgccacgagccgcggcaatgcgattcccgtaccgaactccgcggctccgggtgtggaaatggaattgttgggggtttttttagtgggggggtccatgttcggagctgacatttaagttccttcttcctggttggaaccagtgcttttgctactccttttgacggacaattcgagttcggaatcgttgttctgaaacttggagtgggtttacatgcgccgtggccaaacggggtttgagttattaataaagccagactgtaccgctgacattttcagttccatctagtcgtgccgtggatgccacaacttggtctaacgactctgatcgggttttttttttttttggtttcagatagagggtgtcgtccccactccccagcatctggttccacggagagttgttgatcttggatacctgatccgcaatttggggctgattgagtcacttgaccttttcaacatctgccccgttcctgctgccttgctcactataagaggctggcctggttccagagatgattctattgtgagtggag

SEQ ID NO: 9516 - DNA, 127 bp, Zea mays
gtgaccgcggttggaggtgagcggttgtctttcccttctataaataacgcccttgctcctctggttttttcacatctcttcgctgttctttactgcatccttctcttctctcccgtctgcttccgcc

SEQ ID NO: 9517 - DNA, 1500 bp, Zea mays
cctcccgttttcccgtccccgcatccggacttccggagaagccaagaagcgcaaacaagcgggataaaaatcccggtcccggtcgccagccgactccacgcgcacacgtgcccgggcagcccggccccgccacccgcacgccacgtaacccccgtccccctcctcgagcctcccgtcgcgtgtcctgcgttgcgcttgctatttatcacccccgtcctcctccgtcccaaggcagtcgcagttcacaactgcgactaaaaaccatctttggggcccttcgccgcgatttgcttcgcttctcggactaggtaagccgaaagttagcgtcttttttttctgtactgcataaatggaagttcagatcgcttggtttcgattcgggattcctgagcgcgctgtcctgctcctggtaccgacatcgccttctgaggctatagattctttttgtggttcttagggtttccccgttgaatctcggggccttttcacccgtagtatcgtcgtcttttctgtggctgtctgtgcgcgaaagctactgcagctcccgggtgatctggagttattttctcggatattccttccaacccgatacttgcagtgggtgtgggtcccttcaatgagtagatgcatactacccgcgccggatttttcaccattcatcccatccccagagatttgggatttatcgatgccatggaggatttacttcaccatgcctctcgattcatcggaacgttggtttgcagtttgctatgtgctggtttgttaagctttgcgttgtaaagcacgcctccgatgtttttgccggaaattccgatgctttaccaaaaaagaaatgttcggcacctagtataggtcgtgctgcttttatacttgccgcttcttccgcattttactagatgcgtttcatacttcttcgaagtagtttggctgttacaaatccatccaaagaagaaaaagattgccgactgcgacgaaacacacactctgtgtgcgtttcgtttgggtacttttggtatttctctcctgatgatctaaagaagtagttgtttatattcttgatcttgtccttaacctgtagtgctgttaacttgcatctgcgtgtttgcgctgtgcctttttggtttgtgttgtagataggcgttaattgccaccttaacaatgaaatgatgtattgatgttcacgttcccattgcctcgatttcagagttgggaattttactatgatctcctgtgcgtattgctgattgtataaatgtttctatgacaagttcagttctaattactagacagacttttacagctgtacaaagacattatttgtaaatgattctatgagacttacaagtcagtgtatgtctattcattcgtattctaatgattgcaggttaagttgccttttcgattctcagaaaaagactggctctgcactcggataattttaaaatggatagtgcacagcagcccactggggaattgaacaattcgttcgatactctt

SEQ ID NO: 9518 - DNA, 1500 bp, Zea mays
cgttttcctccagaccaggtcgaatcgcgcggctgcgggtccggacggcgcactcctcccgttttcccgtccccgcatccggacttccggagaagccaagaagcgcaaacaagcgggataaaaatcccggtcccggtcgccagccgactccacgcgcacacgtgcccgggcagcccggccccgccacccgcacgccacgtaacccccgtccccctcctcgagcctcccgtcgcgtgtcctgcgttgcgcttgctatttatcacccccgtcctcctccgtcccaaggcagtcgcagttcacaactgcgactaaaaaccatctttggggcccttcgccgcgatttgcttcgcttctcggactaggtaagccgaaagttagcgtcttttttttctgtactgcataaatggaagttcagatcgcttggtttcgattcgggattcctgagcgcgctgtcctgctcctggtaccgacatcgccttctgaggctatagattctttttgtggttcttagggtttccccgttgaatctcggggccttttcacccgtagtatcgtcgtcttttctgtggctgtctgtgcgcgaaagctactgcagctcccgggtgatctggagttattttctcggatattccttccaacccgatacttgcagtgggtgtgggtcccttcaatgagtagatgcatactacccgcgccggatttttcaccattcatcccatccccagagatttgggatttatcgatgccatggaggatttacttcaccatgcctctcgattcatcggaacgttggtttgcagtttgctatgtgctggtttgttaagctttgcgttgtaaagcacgcctccgatgtttttgccggaaattccgatgctttaccaaaaaagaaatgttcggcacctagtataggtcgtgctgcttttatacttgccgcttcttccgcattttactagatgcgtttcatacttcttcgaagtagtttggctgttacaaatccatccaaagaagaaaaagattgccgactgcgacgaaacacacactctgtgtgcgtttcgtttgggtacttttggtatttctctcctgatgatctaaagaagtagttgtttatattcttgatcttgtccttaacctgtagtgctgttaacttgcatctgcgtgtttgcgctgtgcctttttggtttgtgttgtagataggcgttaattgccaccttaacaatgaaatgatgtattgatgttcacgttcccattgcctcgatttcagagttgggaattttactatgatctcctgtgcgtattgctgattgtataaatgtttctatgacaagttcagttctaattactagacagacttttacagctgtacaaagacattatttgtaaatgattctatgagacttacaagtcagtgtatgtctattcattcgtattctaatgattgcaggttaagttgccttttcgattctcagaaaaagactggctctgcactcggataattttaaa

SEQ ID NO: 9519 - DNA, 940 bp, Zea mays
gtatatatcctattagttgcaacgtaaattaaagtgatacttggaaaagtttctttgaagcatcttggaaaccaaactttaggccgtggaaggctcgaagaaaagaagcaatgccgttgttgtgttatggtgctggtctatggagcatgtatgagtcacgtgggcttggagctgctggaccggccgctgggcctgctggtcggcacgtcacctacccgccttcggcccctctcccctgccccgccgcgccccctcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcaggtcagaatattcctcccctctcccggtcctccccacccccatccctcctcacggtcacggcacgggactcgcctccccccctcctcttcctcccctcccgcccacggctggaggtgctcacagcgagcggagcggaggcgagggattcggccgcgcgcatggcgacgcctctctgaccgaagctgctccacccactcggccaggcgcgccgtcctctcctctcccctccccttatcctctcgtgtgagtggaaatcttccgcgttttctccttcgttcgctttctgtctgtattgtctgctatggtttgcgctccgacgaccgaccgaccgtccgttcgtgtccggacatgaccgatctcgctccccggcagctggaggcgtcatctcgtgccctcgatctgggtcgcccgggctctggtctcgagctcggaattggcgcctgcaygcgcagctgactgtgatttggcaccgacctatctatcccgccactctgcaagcggattcgtggtggggggattctgtcttccccaacgcggccatgatcagggaatgtg

SEQ ID NO: 9520 - DNA, 286 bp, Zea mays
atgtagaccgatatattcattcccaaagctagcacggcatcccaagtccttgctcggttattaccagatcttaacttgttaagaatttaaactcacttaatcttcttcaatatgtataatttaaattaaaacgaacagaacttaatatgattttctatgaaaaacaacttatgttgccttggtattgaagccgggtctttatctgaagtacgtcagtcagccgtattatttaatctttactaagctgagaagtctgatcagttgatctgcccaatttttctgcagc

SEQ ID NO: 9521 - DNA, 1500 bp, Zea mays
taatggtcggaaccaccatcaatggcgtggtctgtggggaggagtgaaaaatgacagataagtgggggaaggtgaagggggagaggcgagctggggttgcagtgatgttccacgggcacggggcagctcgacgcggaggagggccggcggcggtcagcaattccacgatgtttcccacgggaagaagaaagtgagatgaaaaggtgagagagaaaatgacgtgtgggacccatatgcaagggagagtaggagatgtggggaaaggggacgtgtgggcttcaaaggctgagccaaaaaggctaggcaatcgtcggccattttccttttgttttattttttgattttttttaattaagacggtatacacatataactatatatttaaatattaaaaatattataataaattcacacataatttgttttacaaataaagtacctaagttaaaaatacataattttaaggcaaattccattaaataaaatgtgcttcaccaaaatcaataaaagtgatattcttgcaaatacaaaatgattaaccatattaaaatacatgttttcctaaatatatctatctttaacaattcaacattattttataaaatgagatttttctcacaaaactatatccaaaaattggatttgtaaatcaaatcaaacaaaatatatgcctcgatatgaatgcatcaaacacttggtaatattttatttattcaaacttgtttaatttatttctatcaccaattttattaattgaaaacataagtatttctcttatatattggtagttaataattcaaactaagttgttttcatttgatggatttagggtgttacataggcattggccgaaccacagtaaaaattgttgtattacttgtccatttactttttgcgattactgtcttttttaagttctttgctttcttacaatattgcttctaagtttaatacttatcttaaaggagcaatcaaaagaagagttctcgctccatctgtcgtctcatcctaacttggttctgactaacacttattacaaactaaatttgtgttgtttacagttaatttttgcagaatcatctattcgccaatagtattggcgctgaccgcgtggccatctcatcggtacagacgacatctagtctccagtgcaattgacgctagatgtgtgatgacatcgacctttgaaacacgaaagaacatatttgtgaataaaaacccaaaaaaaccaaattgcagagagagagacggaggaaggatcaaacaccaccccctccgtggccgcttcctattccgcgcgatctcatcccaccctctcttatccacttcctcctcccgcccgcgacgcccgcctctctccgcgcccatgctcgtccacgcgttcacttccaccgccacgccgcaaagaagagagctaactcctgagctaggaatgctcgtttggccgcgacccctgcgacgcgcatttgttgagaggcggcctactacgaactaccgtcg

SEQ ID NO: 9522 - DNA, 106 bp, Zea mays
ggtgtgtgcactaacatcatccatatgcagaacaagaagctaaagttatatactagggaattatgaccaatacattcagacacgctccgagcttgaagaaaatcag

SEQ ID NO: 9523 - DNA, 146 bp, Zea mays
tgcatgcctgcagctgtctcgctcatcctttctccgtcctccttcgtccccggccattgctccgagctcgccaagaccgccaggaggcatccgtagcataggcccatccagcctatcccagcagcttccccacaggcgccgcgcat

SEQ ID NO: 9524 - DNA, 486 bp, Zea mays
cccttgttggcctcccttgcgtttaagagcaagttccaacagtggtgttgagttggtttaaatccattataagtcaaaatctattctaataaattccaattcacatggaattagaacaaccgaagaagtagtttcagtgtccatccaatcaatcaatagtctacaggagcaaattagaagagcgtgatggatctccgctggtgcctggttgtgcctggctcgtgggcggtgtgagggcgcacatcactagctccgatccggcaaaaacgctcagcagcgcccgcgcgggtcgcgtggcaccgcctctagagctcgaaccccaccgacatcgtcgcgggacggagcgaccatttcctccgcgcatgcatgcacgtcttggcccgtcgtccgtgtccctatatacggcaaacgcacaagagataactagcgagcgagagcgtgagatcgaggagaagaaggcaagcaggcagagaaagagagagagag

SEQ ID NO: 9525 - DNA, 169 bp, Zea mays
atctatcgaccgtcactgctggctcatagcatctagttgaccaaagttcattcctttccttcaattgttttccccctttgtttgcttaattcgattcatatgagatgttttttactagtacatatatataggacgttctataatatttgttcatcaccaagaagcatgg

SEQ ID NO: 9526 - DNA, 243 bp, Zea mays
tggcagtgctccgaattcgtgcaccatgcgagtttcactcgtcccttatggagccgaggtctacatccgcctctatatatacacacatgtgtcggccctagagatgagtagagttagatgaagatgaagttgaaaatttggagggtgagccaggaaaaggatgaaagattctaagagcgctaggaataggaacatgaaggaaagcattattgtgcatggagatttaggcctgatgttttcctg

SEQ ID NO: 9527 - DNA, 355 bp, Zea mays
cttagtgttcttccttttccatgcatatatacagatggtggcatggcatgctagctgcaccctagctacatctccaccccctgctaccttcactcttcatggatccaatttcacttctcactcaacatactcctcaaatcattgctttggtattcttttccattcttttgtttccctcgtttctgttcctctgaggggtctttgattcgtgtacgtccttcctcttgggattgcaggcaaagccagaagcttgtgatctcgcactcatcaagctgttactagtcgaggagaatttcgtgcacgagagccgagagccaagaattttgggggcgtgggcgtcgtcgacctatagacg

SEQ ID NO: 9528 - DNA, 449 bp, Zea mays
gcatgcctgcagctagttaggttaatacttccggattgccatgccataatcggttcagtttagcctttccgtgacaggagattccatttgattgtaacaatgtactgtcaactattttgacgaaagcatatgagcatataatctcttgatgctataatcataggagtaattgactgacgttgatgttttcttttggtctttgacactttgaacttataaggtaagctcgtcatagttcatctttctgtgttcaataattaaactgacttcccgtttctcagatgtgttgtatttgtcatactacatgaagccacatatgtgttcttcatgtaaacgtgattgtgaaaaggtcattgttcaaattgcctgatcatctgatctcagaactgacgggtctgtcgaaacttgtaacttcatctccgcaggagaatgttttggctgagtcaagg

SEQ ID NO: 9529 - DNA, 625 bp, Zea mays
ctgcgacaagaactttagccaaattatgtataaaatggagaggtcatgttcaattgaaatccacccaaaccttgaatccagctaatgaaaatctggggtcaaatcagagtgtgtacgctgtggtcaggatgagtacgttgtcatatgtagtaaagttatactgcagaaatctgaaatctttgactgatagtgttccaacaaggaggttaaattgtgatttcttgtaaccttaataataaacacaaatccctttcccttttcagtgccatatgttcaaacggagaagtcatggtaagaaatccatgtaaggattaagggaatcttgcaggtcagggatgtgttcgttggttttcatgcctttcttgccttggatgtttcttcagcataagttctcccaacccaagcaaatcaatgtgctttctcccctgcgcgccatctcccatttaattttccagctggcgtccacacaaagaaaactctgccagtaggccaaagttttgtttcatcatgcgcccttccttctataaattgttgcccatggacagacccagccagtcacagcattcttcttcctccgcacataaaccataacattcttctccaccttgtttctttccaagccacc

SEQ ID NO: 9530 - DNA, 985 bp, Zea mays
atggcttgtggcccgacacttaaaccagcgggccaagcctgccataaagcccactcagccgagcggcctatgcatttattgctgaaaggacgcgccgcctgccaccatgccagcgggcgacgcgccctcccagcatttaatgcatcctgtccaatccaatggcaggcggcatcagggtcacccagcaggcagcacgtctgatcagtcagctggcaaacagtgtgcccgtgccgagcggtgcctcatcccttgtacaagaagcttccctgcatgccgaggatatgaagatctcatgtgtcagagcgctagaagatcgcctcagcagcacacgatcgtggatccaagtacaatattcattaagcccctgggcccacatgtcggggctcagtacctctgtgcatgcccccttcggctatagaaggggaggcatgcgacgttacacataagctcaatcttctagacccaactttagcctcacaagttcatacaagctctcaagcaatacatcacacagtggagtagggtgttatgctccggcggcccgaaccactctaaatccttgtgtgttcttgtgttcttcccacctttccaactaacaagcaaatcacttaggaccctcctcatcttaggatttagggcgggtgcactccaccacccggccggagatttgctctccgacatttggcgcgccaggtagggggctaggcattaggtttttgcttcgtttcgttgtccaagcatgatggtgcagatcattgagcaccgcgccgagactttggtagattttgcggtggagggagaagctgcttcctccacaccgtaggttcccaattccctagtaccaggcactactgctgtgcacaccgcacggcagtacacggctgcgcgaacatcccggactccatcgagggcatctctgggggcgttgtcgacagccagggagctgttgcaacaccctccaagctacacggcctcaccaggggcc

SEQ ID NO: 9531 - DNA, 681 bp, Zea mays
gtcactcatgtgacttatttagagtgccgatcttttgtttttatgcgctcatgtcttacatgtacgagtcatattcatgggtcgtgtccagtgtcctacgctgctgcgtgtgtccttttactccaagtacggcaaaacgtagatcaggcattgcgccatatttgcccattcgcgtgtcgtcatatagatttggacttgtgcacgatcgaccaatgagcctccgatctgattttgaggtcgcgaaagggacactttcatttcgttccggcgttcacggttcgtctctccgccttgtaatctgagcaaccggcctgttgctttcagccgcactggttcggcccgccaagagacgtcggcgagagacggcgacactctgcgttgactccagttgttgctaaggcattccgatagctagctatactccagttgcttgctccagcagagaattatgtgcgcaccataatacggagtacgtagcaatcgaatactccacaaaatgcacaccagatttgacttctgccaaatactgtcggatttactaatcgtgtttcctcccgaacgaaaatgaaaaaaagaacaagttgcatgcggcgtgcatgtcatgtcatgtcagcgatggttccaaagcgtaataacacgacgcggcgcaacttgttgcggccacacacacacacaggcatc

SEQ ID NO: 9532 - DNA, 103 bp, Zea mays
actacttaagcccaacagtttcctcagccatgaagaagaggaactccatggaacagcagcaggccacaaagcctcgacggagcaccatacagtcttctccaaa

SEQ ID NO: 9533 - DNA, 66 bp, Zea mays
tccccaaaccacttcctcctccactacctccatcagctagaccaccaagaagccgccgccgccgcc

SEQ ID NO: 9534 - DNA, 467 bp, Zea mays
gctgaatacaataaacattatttcccaatgcatgtccagaacggtaaatgatacaaactgcacctcctatacttttgatgtctgcatatcaaatacatgggcgtctgtgcctgtaaagcctgttatgaacttatgattgttttagtgctgtcatcgagtaattgttgtgtaggtgttccgtattctgtgcctgttctgttcgcggctaactgtgccacactttggctaaagttagtcgctcgtattgaagaactaaccttaggcagaaaaagttagttaaagtgtggcaagttaggcaacaaaccaaacagtccttctgtttccatttggtatttgtcataacaactggtagattgggtgttcatgtaagtatgtaacaaatatgaaatgatcgccgtgaacttgtgatatttgttgatgaatgctttttttccagggtccactgtgcagaaagtggtgaggagagc

SEQ ID NO: 9535 - DNA, 1500 bp, Zea mays
ttatactagtagaatataatccaaccgtatgtcacatttaacacttaaayctttccaccactagctcacaccgctttaccagaaaaccccgtgacaaactacaactagatctacggttggattatgatctaaagatacaaaaggcttgcttgcacgcttgtatctaaggtccgcttgcataatagtcgttctcgttaatcattatacatcactacaacacatgtggccttttatgacgaacatcccatgacaatgaatattttcgtcattggctattttgttttatgacggttttttttgtggcaagacaactttatgacgaattttgggaagcgtcgctgataacattgaaaaaacgtcataacactagtcaatcgctatatcatgacgaatatcttgttgtcataagacactaacagtaaatgtcataactatatgacagttccatatcgtcataagatattacaaataagtaattatttaaaatgtcaattgtagttattaacaaaaatcaatatacatgttgaaaaatgcctataatttagaactcacgcccatactacgctacaaaaccgagggaaaaaattatataaaaatcaaaatgtttaaatcagaaaaaagataaaaaaactgtgcttcaaggatttgaactctcgagctcctatgtagtgcaaaagaacatcttttctccactagactaaacaaggtatctattaaatttggacatataaacactataacgtatatcaccaaattatttacatcctctacacaatcttcatccattagttctgttcgactgcgccattatttgtacgagttcggcattgtggtcgccccggctgggattcctcctccacgtagctctcctcttcacatcacacaacgccggaggcctgtcgtgcagccgccgctagagacctgtcgcgcagccaccaccgaaggcctgtcgcgcagccaccaccgaaggcctgtcgcgcagccgccgccgccggagacctgtcgcacagcagctgccgccgggcttgggcgctgctagggggacgaggactccataggtgatccgcgggggatgggtcgtgggcgctgccaggggacgaggactccgtaggcgatctgcgggggacgacaagaattgctctgctttgcacgtgctgccagtctgcctgtgctaccaaatttcaacctcgacatcgacgcgcatcaccaatttgttgcgcctggtaaggattactctaaccatgtagatccatttatatgaaatagatactacaattagcaatatggtgcactggttgaggagatatgaggataatggcgcttgttgttctatgcagttgttgtattctgggtactccgtagatagaaaagacagattatttgatagtggtaagtgtggcgtaacaataatatgattattatttaccaagtttttcacttctattaccttgctgcaacatcgatttattttgggcactaaaataattttgctttcctcag

SEQ ID NO: 9536 - DNA, 1500 bp, Zea mays
agaagagatggtggacaaatttgcataacttatctcttcatgtgcattttacctgtgtgctggagacataaattgtgctgcagtatcgtgcgatggatatttttacattttgcctaccttgctggaagtatggatattttcacattttacctgtcttgttagaggtaggctaaacaatgtttaaatacactagagctaatagttaatgactaaaattaattaaagacattcaaacaatctaactaataattcaactattagctatttttagtaaattagttaattgtagctagctaattctattagcaattttttttagctaattaactattagtctagtacgttcaaacaccccctaaatgttttagtttttgctcataattagcaaaatatatttcatatgctgcaagcatgcttataagtcatttttaacttttttagagagccaaaacaccttaactttaaataaaactacggaaacatcacgatgatttatattatcgaatagacatgctataaaacataatcaataaaaaaatataactgtacttattttaatttattaatgttattgtacaaatttagttgaacttaagatactttcattccaataaggtttaaatgacttataatttagaccgaaaagagcatattgttactaaatacagttatcctgatttatatgagtacaagttgtgagtttgaatcacacacaagatatgtaaaaaaaatggacacctcagaaataaaagtcaggttaataaaattattcactctctatcattattattggtagataaatacatagatgtagagtagaacaccctttttgttttaaaattttatctatatatagatagatagttagatagataaaagtagtctatatagtagaatagataaatagataatttatttataccgaaaagagtatattgttactaaatacaattattttaatttatatgagtacaagttgtgagtttgaatcacacataagatatgtaaaaaaatagacacttcagaaataaaagtcaggttaatataattcttcactctctatcattgttattggtagataaatacatagatatagagtagaacaccttttttgtttttaaaattttatctatatatatagatagatagttagatagataaaggtagtccatatagtagaatagataaatagataatttatatatatcttatatatataataagaagatatatagagatagagatagaaagatacctatacctcttttttaaggtaaaacgtacaagaaaattccatgtggcagtaggggccacatgtcatcgtgaatactggccggcaggcctcatgtctcacatgagaggccacaaacctcactccgcctgtgttatcatttgcaccttctcttccttcctcttcctctgcaagaagccaaatacaatttagaagcgcccttcctcctctcccccatccgtacccaatctaatcgacacccggccgag

SEQ ID NO: 9537 - DNA, 422 bp, Zea mays
tgagtctgtgcttcgtatctcaattcctakcttggatactctgatccaccatttgaagtgagtccgcgcttgcatactggatataaatgaacaacaaactaatccagaaggattagaaaaataagataaagagcaataaaaaacgaaccttgggctgcaaaatttcaacagtcccggacgaccttccgttcattgggcttaattcatcgcactactggattgggcctgctccagctccaaatggtccgttgtcagaagtgtcaagtgtgacgcggaaccgaaacccgatacatccaggcgtacagccctccgcctcgtgaaggcaaagcacgcgcaaagccaccacagcgtcttcatcttcgtctccagtccaagcaagcgaagagcacccctcgagatcttctctccctccccgcgccgct

SEQ ID NO: 9538 - DNA, 936 bp, Zea mays
cgctgccgtgttcgcgattcagcgccgtgctcgacgcccctcctctcctcagaagtcagcgccgcatctccggttgcagagacttgcgctgccacatctccgcttttcgtccttcagttgctcgacgcccctcctcccctcagaagtcagcgcagcgtctccactctccacgccggcgcgtcggcgacgcgggtccttcgaataagacggtttgttctcgcatcgggcgtcagccggattcgagggacatagatgatggaagtcgatcttgggtgccaccacgtcgaagcggcttgtgctgtgtagatccggcgaaagcgcgcaggcaaagcccgggtctgcgtcgtcattggcctcatgatcttcgtattgccatcgcgctaaaggttggctgattggctccttctttctcggccccacctctctctcatttatcgtgtttgaaattgcacgtcatcttcgaattgaagaattatatgtttaattatctagattccatcttcctgtgatccctttttgcgtcccaaccgaagaactgcgtaatatggttttcagtgctacgtctaagcgacctgatcttaatctagatttggtcgagaggtatttttattgggaaatcgctaaacgatggccaactatgcttttgcttgtgtcagttatttcaaatttgctgatcacagtgctaggacatttacctaggcctgaactttgacatagtctttagagactacagattgatattactaaataggagtaattggcagtacatgctaattatcagtgccgttctgcagggaacgaaggcgacgaggtcttaaactttgattgatatatgcggatatgaaaatgcatgcaactacatgctagaagtctgtcttggttgtgttggagaaaaattctttgttacgtttttgttgatagcgttgagtgccaaaa

SEQ ID NO: 9539 - DNA, 1500 bp, Zea mays
atgcagggacaatctggggtggcatccaacaaccctcatggatcgcccagcccattaccgcaccagtccaaccgcccacctcgctgataatctcttagcttagtggtgatagtgagacttgtgtcataaacttgtcctgaacttatatttgagagttggtaatacttatgttggtgaaacttgatatgaacatagacatgttcgtgaaaaacttgttagatttgtggtttttgtgaaatatgtggtctctattatgtatgtgatggttatgtgatatatgctatgtatatatgatgattatgtgatatctgtgatgtatatctgatatatattttgtttgtttggatggaatagaaaaacaaataaaaaaggtacatacttggtcactttgtcgagtgtaacactcggcaaagcaggtgttttaccgagtgtcagggtcataacactcggcaaagagcaaaaacctgggcaccggtttagggactttgccgagtgttatgtcgctggcactcggcaaagaggcacgctttgccgaatgccgcgcagagcactcggcaaagaacctaacatggggaccctccctggtgggctctttgtcgagtgtcccagggggcactcggcaaaggttgaatctttgccgagtgctactgggcagacactcggcaaagttaactcctttatcgagtgtcatccttgacacttggcaaagaagtcgtctccgttacctcgtcgccgtaacgaccacttttctttgtcgagtgctccctggcactcggcaaacctctttgccgagtgcccgagaaaaagtactcggcaaagaaggctttgccgatgtactgtttgccgagccttctttgccgagtgcgacactcggcaaagcctttgccgagtgtttttacggctttgccgagtgcttcagatactcggcaaagcgctcgtttccggtagtgccaagtgtttaggaattttttaaactatgaaagacatgaattctatccatagctcattatgtatggaacaaatccataaagatatggcacaagtttatgttaaaatctatggatcaaaataataactaattttgagagatacatgaattaaatgatggatttaatcatgagattgagtgtgacatatggattcacctaattcagatccggattaaatcgatagtgagatttattcccggacggcaacgccgcgcaaggaatggtcatgacgccggactgcgccatcacggcaggcgtcgctgcgcggcgcgccgcggactgcagcgtgcgtgacagtggatacaattatatgtcagtttttcatataggcgaattgtaacaaaattttaaaatagtaatgacataggtaaaaaaacctatcattagaatcaaaccctagctcgtcgtccgcatcgatttcccctatccatcggatccccaccagcaccaggcgactcgccggaaccctagctagccgcagatcctacgcgccgtgcgcgcggccgcctcc

SEQ ID NO: 9540 - DNA, 725 bp, Zea mays
cttccacattcaatcttcatgcgtcaccaccatttaggcttgtttgttttgtttttagggcttttgattcacatattagtaacgtaacgagtaaccgataatgttatattatgtttgtttaagtttaaccgtaatcratatcacactacaaatgaatactttcttattcaaacttgttaccgtcgttatttgagtgtgaatcattaccattaccatttacgttacatttcgtgaaccaaacgacacctagatggaattgaatttaaatcctaaacaaatcaaaatctttaataattttttctaatcatccatggaccgaacaaagtcttaaatagtaaaaaagcttaaattatacacataggaatttgaactatagtttccaaactcacatttacatccacctagccaatataacaaaaaaaactattacaacgtacaatgaagaacatcagcacatgcgagtacgytgcgtacggcacgtaactagtacacaacacaccacatgtcaattgattgcaagcttcaaaaaatggtggcaagctcatgccagcgacagcaacgggtgcaatgcattacattaccgcaggcaatatcaatcagcatatgcagaataattgaggaaagaaaacaatcccaagtagtttttccagaagtaacatgaaaacagtgaaataaaaataacgccggagttcgggagggggcaaggttgcatatggtagcaacga

SEQ ID NO: 9541 - DNA, 735 bp, Zea mays
agtgagattaattaaaaataatattggtacacctgaatttacgaacacgtagacaccttcgaacttaatcctgaaaacctaaatccaatcccacgcgcggctctctctctcacctgtctcattcccgcccacgcgcttctctctctcaccagcagaccacgccgccgccgcgccaccgctctccggatcatcggccgtccacctcctcctcctcctcgcccgctcaccggtcgtccctgctgcggtgccatccacttcctctccatgccgtcatagctcgcacaacccccatctcgccctcttccttcttgccacaccgtcgctaccaccgccgcgcgctgagagggaccgacgccatggacctcctcaagaagatgatggcgcgaagagtgctctcggacctgtagaagttctccggcctgatggagcacctgcggctctgcggctctggggttagtgacttataagttttcaaaaatagttttcaatgcatatgcgtgcttcttacttgtacaagtcagggggtgtagtaccacagtgaggcaaactgactttataaaatgttaaatctgtgatatgttccttatactggagggatcatctggtcaatatatccgtgctactctaccttatattcgtgcggacattcccattatcattgtattttgagcattaggatttgttgctgacaaggatatactggagcatatatgttatgacttttctgatacacaa

SEQ ID NO: 9542 - DNA, 639 bp, Zea mays
ccttcgcatggaggaagttgggataagagtctgccttatgctgagttctcgtataataatagttaccaggccagtctgaagatgtcaccttttgaagctttatatgggaggaagtgcaggactcctctatattgggatcagactggagagagacagttctttgggcctgaactgattcaagaagcagaagaacaagtccgtgtaattcgagagaatttgagggtggctcaaaccaggcaaaagagttatgctgataatagaagaagaccactggaatttgaagaaggagattatgtgtacctcaaggtgtcaccacttcgtggaatgagaagattcaaagttaagggcaaattgtccctcgctatattggaccattcttgatctttagaagagttggggagatggcataccaactcgagttacctgatagtctatcggatgtgcataatgtgttccacgtatctcaactaaagaagtgtctccgtgtccctgaggaacagttaccaatggaagagctcagtgttcagggtgatttgacttacacggagtacccgatcaagattcttgacacattgactcgtgttacaagaaataaggtgatacaaatgtgtaaagtgcaatggagtcaccacggtcaag

SEQ ID NO: 9543 - DNA, 528 bp, Zea mays
tgccatgccacctaacccagttgtttgttaccttgcttttggcgctggtttttggtatgtatggtgacgaggctaatctgctcatctagcgcatttgatggtgatgtgcgcctaaacatcagcagatgcaggcgccatcagctggtctggacaaacaaaattaggtctaattagggctcttttggattgaagggttttttttctaaatcctatgtttttcctgtgtatttaaccatttttttttgtaaaattcatatattatttctatgaaattccagcgttgctaagaagactttctgtccaccttggtcagacttgacgccacgtgaatgaaacgatgggctcaatgaaacatctacatgtacttgcgcgcgtctttactgttagagaacaagggtgccctctctgtttcggtttctttctcttcagggtccgggggaggggggaattagagatagaattaaccatcagtggccgtttgctgcaacgattcactgaacgacgaactgcaatggccaggaggagaac

SEQ ID NO: 9544 - DNA, 707 bp, Zea mays
tctggtttaggatctcacatttagggttttcaagattagggattttgcacactgcactaaggataataaaatagaatcgctattttcaattaaaatgcattacattttcagttacttcttgtactcaaccttcatttcattgtggtttggccgaagatacatttagttcttgtactaaaccttcaaatcatggtggtttggccgaccagacattgagttgttgtactcaaccttcatttcattatggtttggccgaatacacattgagttgtatgagctactagattttcctagaaataaaggatggctcattgctgtcaagtttggttgaaacacgacacaattctagggattcaactaacaacgaaatttatttatgcagtgtaattccgtatgttcatttgaacgcgtggactactaagcattgaggttctacctccttttcattctctttccgatgcttgattcattgttctatctttggatatattatttactctacatacttcaagcgtgttgtttttgattctgccatggtactgcagagtcaggttttatagccttgaagtcttatttcataactatgcatatagtagttctttcacaacatacttgaaatggtagttggcgtcctattcagaccttaatactttgcattgtgatatgtaactagcaaactagtcactatcctaaacatttaactacag

SEQ ID NO: 9545 - DNA, 653 bp, Zea mays
ggtattacaaaccgacttaaagatagaatgaccttttagtccataaaggtctgagttaatgttgtaaacttttatgaggggcataattgtaattcctcacaggctgtgtcctgtgcctataaatagtgaacagtattcctttactgttcacgcattctggtaattgcaatcgcatcattccggaatcaatctttgccaaggcagaggtataactgtattcaatgattcgctatagtaaataaatataatatgattcgtttatgatttatttacttttgataccctttattttatgttatcttatacaatttatcaaaatccaattacgaaggcttaaccttcgtaatcatattctcattaaccttcgtccaaggtacattatcctcaagggaataatgtttcgtggacgaaggacgttaacatttaacattttatgttgccttgttcttatttcagagcatttgagaacaagtctccaacattggcgcccacctccggtgaactcacttccactttttttgagctgatggcttcgttcaacgatcaagctggagctgcttcggctccgaagctgctactcccgataacaggcggttcatgttcagagccagccaacaagaaacagaagaaggaagcgcagagaagggtacaac

SEQ ID NO: 9546 - DNA, 862 bp, Zea mays
ggtctcccctccgctatttttactccaaaacaagcgttttatggggagatgatagagttttatgggaattaaactctagcaccgttttcaagataaatgttgacattacactcttgaaaaacagtgggatgaaactatccattaaggctctattctaaacctataaagctaattgttaattgttaaaattagttaagaggctaaaacaaatcaactaatggaccaactaattattagttataccttttaagttgctactagttgttagatgtctcaatctagctaacagctaattagctagctaataattaactctagaggtttggaagggagcctaaaaatgacctaactatgaatggaaagtgaccattgcgaggagtgtaaacgtgagacgcggttggaggaccattaggacagcccaacgttggcgtgccccacctccagacaccatgtctacgtcccaatcttgtactacacacctggtccacggttccacgattatgaactgaatcacagctttcacttgccgaaatgcatggaacggaatggaaacaggcaagcagcagcagcagcagcgaaaactgtagatatacacctggtcctgcacaaccgatggtggtgaagataacctacagagacagacaggtggacccagaccacgttctccccctccaaaccggggtggccaactggctaatataactgaccgccccgcacgacgccctccgtcccacccgcttcggcctctccctcctcctcgctcgctcgatcgctcccacgtcctcgcctccctccacaaaccaccaccaccatccaggatcgcagcgcggcgcgcgagagaggggtgagcaggtcgggcaag

SEQ ID NO: 9547 - DNA, 60 bp, Zea mays
atccagcgacccgaacccggtgttcctcgtgcaccgattggtccactacctgctggccca

SEQ ID NO: 9548 - DNA, 175 bp, Zea mays
cctgaacagacacacatcacactccatcatcatctcgtcaatcagtcggatgggaatctatcttaagtgctctgaagattggctgaatcaattactagcagaagcggagaagaagaatggaacagccgagaccaactgaagattcagataagagcggagcaaccacgaaagctga

SEQ ID NO: 9549 - DNA, 691 bp, Zea mays
ctgcagtttcattttcttctgtggtcgggtttgcagaaaattagcaaaatgcacttgagcaagctgatcactcatatgtataaaaggaacacatgatatgaccttgaaaactaacatttcccttctccaaagcttctaagtctatctcattcttccatgtgcacttatgtaatttgattggccggtttcctacatattttcctgcatgattctttgttctgtaagttgcagtacctctaatagccaaaggatatatcaaagaagcgagtattcattcataccattcacctccttcaaggcagaagtaagatcaattgcattagcaaaactaaaaaaacgtatcattcagttttaccagtacacttgtcctgtataacgtgggtaaaaaagaaataagcattcacttaatgaaaaaaatataagtttaaaactattagaaagagtagaaaataagaacaatggaaccatgtgtagagccaagccaaggcccgggcaggtgagtgcgcaaaacaattgtcgtctgtcgtctcgctctccacatccgtggatccatcccttccaactacaatcaactccgtcccaaactacaatacgtggcaacagaaaaaggtgtatcttttaccagaaacagaagctagattcccagattgctccgcttgatcgctggtgaatcgaccgaaccgagtggccc

SEQ ID NO: 9550 - DNA, 474 bp, Zea mays
atgtgctacagattgaagctctagaaactggagatgtgctagctcttttgtttaaaactgtgatgtgctagctcttttgtaaggcccttttgtaatagccaaactggtgtggcctagatagcttaaaactgaaactaatattctgatgtggcctagatagctcttttgcatgtcatatcaatgtgtaactgatgtgttatggcaagtagtggcacgtaaggaaactgaacttttatatctcatcgaacattctgagggcaaaatcgtactgttgccgtccagtttgcatccgttacaaaggaaatagacggcagttgtatttaagaataagaataaaaaattattttctaatgacaccgaagccgtgacaactttttgagtagttcgtctgcaattcagatcttttataatggcttccaaggaattgtctgaaaaaatcgcaaatcccttccctccaccatcgatcgggcttcc

SEQ ID NO: 9551 - DNA, 133 bp, Zea mays
gtaaaggtctctgctatcttttgttttagtgtaatgagtagacgtgctgtcattaggttaatgtgggaccaagaaccttcttttggggtactggaaaactcttatctgttaactagttagttgcttagctttg

SEQ ID NO: 9552 - DNA, 358 bp, Zea mays
gtacttttggagcgcgcctctgggccactagctgacccctatcgaacggggcacgggcgtccactcggatcacccgttagcaactcactggagacacctgttagaaatatgccctagagataatcatagagatgagcatatttctttgtatccatgatatatatattgcttaattgaatatccatggaaggcaccttgtattgattagcaattatgtgaattgtttgtgagattctttacttatatggttattctaaatgatgtccctagtcagagtcgatgactagcacatgtattagttgatgactacatttcacaagtcatgaacatggagatgttaaactgataatgtgggcgc

SEQ ID NO: 9553 - DNA, 1500 bp, Zea mays
gtatgccatggtatgtggtctaaaaaacttagtttagaggatagtttgtacaaactgactcacgcttgtggctcttcttcggttgaggctaagagaggtctctcggtcatgggtccctagagcaacggtccctctattatgggcgaggaagtcagtctcctgagcgcgccttggcaacaaccaaggtatgtccttctataggcgcggacaactttctagatttttataatcataaaacatccaaccaaggtgtaaggttttatgacatgtggggttcaatatagtgaaaaatagttcttgttactattttttaaaattgttggtgaggcaccccctgctatgaatatagctccgacccttctgtgaaatgttccgagtggtaatctactaatattgtcaccattgtcgcataattaattgacagaacgacgaattgttgaagaccaactcattaggcttatctaatccctatagaatggaattccttttaattctcaattctatgtacatattcatgccttttggatttattgtagaatttaataacactatttttagtaataaataacatatcatcgataaccaatcgtatacggtcgttttcttctcaagatctctcggctccttagctcaactttttaagtgctcagtgatatatgacacattcttgttttgttcattgaaataatttgaagatgggctcagctgtgattgtgtaatcagacacgtggatccttaactaatatagaaaacaataagagggctatttcgcaaaactaccactccatttgccttaccttccggtaaagcaatgcaactacaacgagctgacagcaaagcaaagcttgagaggcttttctcaaaaacgcgccgtcgccgtttcttccccctttttctttgagaaaattcgcccgcgagatctttagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaaagaaagctccgagttcttcagttctggatcgatagagaggcggttcctttgcgggctctgaggttggaaccttattcttctttcactatacagcgtctcttccttcctggatccgaggcatgttatgatgtggctctgtttggggattagagttgtttctttcgtcctgttgtctgaattttgcttgcagatccagtgtcgaataccgtgtcttgaatcatggccttgtgaattccaatataaacgttcctgcttggcttgctttgttttgacacaagcgttgtactccttggggttttccctccaggttcagctctcgctcttgatttgtctcatcgacgcatcagttgggctgcaggcttagagctggaaggaataatttgactagagaa

SEQ ID NO: 9554 - DNA, 1150 bp, Zea mays
tttttgccgttagcttgcttggcacttggcagagtgaatgccacaagctttattattaccgcgcgcttggtgggtcagctgttaaaatcagtccgcaacgagaggggaaatgctgaaatatgtccatcattcgatctcttctgtcaacaaaactgtgtgccatccttgtccagttgccggcagcacttgcagtacggctggctcgtggagcaaggagactccagcaccagccaccacttgacacaccagcagcttcattatttcttgtagcctagcactaccagacactagcacccttggtcgcgctcgcgcgccatggcgagttggcacctggacagccggcgatctgttcagaagatctctctgtcgttcgaccgccagcaggctgttgcagcctgacacgtgtgctggtgcgagtacgcgacacacagcgagcagagacgccaattcggtgattcctcctacgtggggtgctcacatgcatctgcggcttgtcgccgattgtaacgccgccgccgccgccgccgccgtcggactcggatcaaggccgaggcagacgcggagcggagcaggcaggccgcccaattattcgcgcatcccaggggtaccgccagatttagcatctgtccgggcaggcaaacagccgagcacggtgatccgccgcttggatcggcagtccgcagtccccacccaaaggcggtagcgcttgccgatcgcggtaaccccgccatgtcgcgtgtggtttggaacgcccagctcgcgtcgcatccattgatcgatcgggcgcatcctacataccgtgtcccaggacggacactgggaaccacacgcacgcccacagcgcgacggcgagcacggaatcggagtcgtgtgtgtgagcacatggagcccttcacggctttgccgaaacgagccggggctcggccggtatagattgcgtagaggcggcaggcagccatgagcctgtctacgtgcaacgtttcttgtcccggcagagccatagccaccatctgccggccacttaaaacgcctgtgctgctgccgtctcccgcccggcctactaactgccacggtgccaccgcatcgcacttgattgggccggggcgttgcgctctctggtctggtcaaggcgtcgagcgtccgtcctcca

SEQ ID NO: 9555 - DNA, 200 bp, Zea mays
gattctcttgttgtactgtgttttgttgagattgttgagacttcaccttagccacttggcaataatcgtgctaacacttaacaagtttttgtggcttaagtttgaagtttttacaggatcacctattcaccccccctctaggtgctctcaattggtatcggagccgttctcttcaagaaagggactaaccgcccgaagag

SEQ ID NO: 9556 - DNA, 215 bp, Zea mays
gctcgctaccctgtcattattttgttctagatgaatgcgatttccctagccggtgcttttggctttttgaacctcatcaagaagcatccatcggtttgacagcaccgtctacgtgcccatcttccggagacggaagaatattgtagagcagtgcgacagagttccccgatcgaagcagattgaggtccactgtgctgtactgctgtgcgtcaatc

SEQ ID NO: 9557 - DNA, 1305 bp, Zea mays
ggtcttgccgttgggcggagtaagatcctaaggttgtcttgtggtcggcgggtcacccaagacggatctagacgatatagagtcgaatagagctgaaggtggagatgtggaaagctacaactaaagctatgctacatttactcctaggacaggaatgataaagaaaggtaaataaagtagattgattcttttggaatgtgttcggggttctcaatcggacgtacccctttatatttatagattaataggtctagacctgtttataagctagatctaacatatccttatagttaggataaccaagcatggaatatgtactctgccccgtgcttatttagtggcgaggacgcagaccgtccggacgatagggccaaactatccgaccgtgcgccatctataagcttgtttggtttgaagtggattgagagaattaaattgttgtataggagatgatttaattttccctaatctaggagatgatttaatttcccctaatccaccttaaaccgaacatgcactaacttggattttgtttttgcaatattatatagcgaacycgaacgtttgattttctgcgaaggggctaaataagaaacaaaataacaaccgctcgccgtgaacacaaacatggggcatcttacagccggcagcagagacgtggggcaacaattacctcatcaaattctactccccaccaccagaagaatcaaacaaaaagctgatacataaggcattgttcagccctgctcccagatgatggtatgtttagagattttgtttttcaaaaccacaatttataatattatagtttaatgtatgttataacatatctctcgtatattttatattagtttaatccaacacttgtttgaagacatattattttaattatagtataagagaagaaaagattgtagctagatgtaagaaaaaaaaattggtctagacaaaaggttttttaccttaaaaatactctagtattggtaaaccataatttaaaatatagagttattgtatatgttttccaaacgacttttggtttaaaataacatagtttgttcaaatatcacggtattatattgaaattaaaaaaaataccgtgttgtcaaacaggccctcctgagatgctatttagacaatccagacacccctgccatttttcctttcgcagggccggacactacactaccatttttcctttcgcagcgtcccgtctgtctgtctgtctgcctccctccgctcacctcctctgcttcttctcgctttcttccatcttggtccagcctccactcttcctgctgagcc

SEQ ID NO: 9558 - DNA, 885 bp, Zea mays
ttgatgtacatataacgattttttacatctaacaatatataagtgataatattttatattaataacatataaagtatgtcctaattataatttaaatggtgacagagataccgacggagatttatccccgtgtggaacggaaatggaaaaaattataaccccgcaaacattcgtaggatcccacagagaaatttttctataggatgagaagctaaaaccagaagatgatgaattctgtattgccatctctaaccttacgctacgctgtataattcctaaacgaagagcacaaatgcacaatacgagccgcaattccagcgccttttgcttttggcggggagcacaatacgaccataggttatagcgctccccgacgctcagctatgcctataccacatctttgtcgcctagacgacgcctcgtaaaccgtgcttgtgaaaaaatatccatggagcctgcaattcacggtgctttcatgtagccgtttctttttttaaagatctttgaagtagcttcgagaactaataaacacaagccccacttataattctttacgcgacagattgacagtacatgaagaaagggagaccaaggcatcttttacgccagacaagacaactacacaaagcagatcaaaaaagcgagagacatccagttaactgaagtctccccccgagcccgaccttgttcacccgttcaatggacagggcagccagcaatacggaggaggccctgatgatccacacccactctgcatcctcaactcctactgccctccactccaagtgcccctgaaggactgatgaaaacaagcgtaccgaagctaaaaacacaaacagccactctctctgcttgtttacggtggctaactgtttgcccaactcc

SEQ ID NO: 9559 - DNA, 1500 bp, Zea mays
atgcacaaataaagcatctgctaggattcaaactcaagacatttgacttcaatactatgttaagtgaatgcattaaccagttgaacccaaaagcttaagatgatgagagaaggtagtcattctatttatacacttcaacaaagctaatagttagacagctaacaaattgttggatgggttgagccaactaatgaactaattgtaacatgtgagttagctaacaattagttaaagtatttggaacctctacaactagttttaacgactaactatcaactctagagattgcaaacagggccttatgaatcatcatactagttttatttccaactttctatctatataaataaaattttttattgaatcaatatgtatgcaaactatacacaagatactttctaacatgtttgttttgggtaggctagtcgcgcatgccgacaagactaaggccctgtttaaattcattaaagctaataattagctgctaaaattagttactaacatccaaactagccagctaataatttagctaccagctacttttagcaaaatttactaatagttagccaactaatacatttaaacaaagcctaagcaaacaaggaggccctatatgtcatccataggggtgggtaatagatcacgattcaaatacttcttcacaataaattagaacctttaattaattttagttcaaaataaatatgaatagattcagatcataatctgattcgatacttaaattttagtataatataaaatatagagcctattatcatctctagtcatacgttgccttttgccaggaccagtagtagctacttgtcacctgctgcatacctattcaagtcacgaaatttttcccatcttccgctttgatgagtactcctactattcacggtgttgataaatttttttctctttctcacggctcacggcacaagagaatgaagtttgtggccgttgattcagggccagcattctcttctttcggcgaggttgtggcgggccagccaactgccagcccttcacttcaccgacgccccccgtcttgtcctttgtgcgtgagcaggagccctggagcagccatggaaacagctgcgggacacggcatgacgccatcggccatagtaaacagcagccgtggtcatctttctcaaagacacggacccgtgctactgccaccgagcagttgggcctccgttccatccatgcgccgctgacctgcccggctgccgccactgccggtgcggcggtgcgtgcccgtgccagctgacggacggacggacggccgccgtgatcgataacgcaattagtgcactattaaagcgttccgtgttatttccaaccgtcgtacgtttggccaacgactggaaaagccggcgcgctcagagcaggcaaacaaaaccccactgccggcccgcgtccggggttccgggcgaaccacttcactgcagcccgcccggagccgcgccgcgagaggagggagggaatcagtga

SEQ ID NO: 9560 - DNA, 142 bp, Zea mays
cgtctgctcggctgcagtggattaggtgagcggggttccggtagaggattgtttagtttgggattctaggttcctcgctcccgtgccggagacgacgctagacgatgaggtcagtgccgcggcggcgcggcgcgtcgcagag

SEQ ID NO: 9561 - DNA, 158 bp, Zea mays
tttctttgcccaagcgtggagcatggaccctaagcaaggcaggcgggccgcccttctctgacgcggagcaagcctatttatacggtggccgagactgagctagaacagactgtgccactcaagcaagcgagcaagcttaagccccacctcctagcaac

SEQ ID NO: 9562 - DNA, 1500 bp, Zea mays
acgccgataacatacgaatagctagcgcttgcgtatagtcgttgcggtgtcttacaattaaatgttagtttgctaccatgtatttatatagcttgtgatatttttcattgtattcatacatatgcatcctgcatctcaattagtaccgagaggtgacgaccgtgcatgtgacgtggtgccaaccacaagatgcagttggtggacgtactgaaggatggtggacttaaccagtggatgctcgccgagcgagtatctcccccagcaaacactgtctaagtgttaaatwaaaggcaagccccggttttatgcataaccgttatatatgctattttactatacttaatgtttgtaggcttgtactgtgcacttaagtgtaggagttgactgaaaccttagttgcatgaactcaggataccttttgagatggatactagtatgctaggtcgagtagctgctttattaattagggatctcggtagaagtcgagtgatttttctagcactcgcgcgaggtcaggaattggttgtatccactttcatagtataatgatgttggtctgtggacaacaatccatggggatgcgttgtctacgagatggaaattggaataaggattaaggtgtggtactgtgtgtcaagcgtttgaacgtactaagcacatgccgagaaatatggtaaatcggtaagcctagtacctaattgaacctagcagcagattgccctcctcacgcgacctgagacgtggtctcccattccggttatggtgggtacaagtgcggtcactgcacgacggcagtcggggtcagtgaggcattgtacgccaaggcggtgagcccctctctgctgacggggaatcgatggggacggttgatgtgtgtggggacggagtgcctcgccacgtcgtgtgtttaggtttaccttgcaaggtttaaaaactcgattcgaatcgtctgcttctcgcagctaatgagactgcttgatccatgctgctacattgagtaataagtggaaatgtgttgatttggcaaaagatgttgattgctaaatgtttgataccatgtatgattagataggtacacatttagtcttaagagagtcacactaaaacttgaaaagctaaaatttgattttagactcagctagtgcttttggcaaaccaaacccctcaaccaaacagctgcatgtctagaggtagaggagtagactcctcacacccgggtaagactagctgagtattagtatactcagccttgcttgtggcataattttgacaggttctctggaggacatggttgctggcgtgacttggccgtccatcttgccaccgggctggacagtcgagtgggaccctacctcggcagaggaggagcatgaggagtgatgggccaggcttccccatccctccgtttatttaccgttagttatattccgctgcattccgaacaatgatcactacttttggtaaactccgatgaagttgtaataaattaaatacttctta

SEQ ID NO: 9563 - DNA, 180 bp, Zea mays
ggtgagcttattatcctcctcccccctccaaggccgccgcgtagtgactctgcgtgctggtggtgtgcgtggctgactggctgatgcaggtccaagtcgaaccagtacgagactacgtcgctggtgcagatcgagggggtgaacaccaaggaggacgtcgcgtggtactgcgggaagcgg

SEQ ID NO: 9564 - DNA, 614 bp, Zea mays
caactgtaatcaataaagataaaaatactgtagaaatctgtaagaattaaagccaaccaaactggaatttaactaattttaaacaaggtcacaaaaaaggcggtcacaaaaaaggcgtgaatgagccccgttcatccccatccttccatcattcgattacacacacccgaccaaaggtccaaagcacacgagacaatcgcaagacaacaacagcagcagaggaaccaagaggaaagcaaacctcgccggccgcacccctccatctctgatcgcccgctcattctcattcattcattcattcccctcgcgtcgcgtgattcgattggattccgttcccccgccccgttccgttccttcagcgccgctgccgctgccgctgcggctgcgccgaggccccagcgagtccccgaggcccgaccccaaaggctgcggcctgcggccgtcgcagtcccatcgattcctcccgcttggctttcccacccctcgaagccgaatccgatggttccacccgttgaccgcctccgccatcggaggccgcgccgcctcctccccgccttcttcctcggtccccgcgcccgcctcctcctatagatataccgcccgcgcatcgctcc

SEQ ID NO: 9565 - DNA, 1500 bp, Zea mays
ctgtgtctcgtggccccttccaaatctcatagatcgtagcaccactgacgactagcccttccaagctctagtgctcctaaccaaggctcgcaagcctataataattcttttattaagttttaattgtgtatgatggtgaattggaaagaaatttgactaattatgctattgaattattgaataaatgattgtatctgtcatatccgacgaatatccgaaacccgtccaaaatccgatgaacacgagcatagatataaatttctacccgcgggtatggtagcgggcagatattgatagcaaccgcggatatggttgcggacggatatttgcaatattcgatccgaatccgacccgttgccacccccttattcgtgtaaatagtgttgtaaaaactatatttaatacttctaactagcatccaaacattcgatgtgatagggactaaagtttagtcgagggaaccaaacagggcctaagggggtgtttgggtttcccgactaaagtttattccgggggtgtttggttttcctgactaaagtttagtttgtgtcacatccgatgtttgaatgtcaattatgagtattaaatatagtctaactataaaactaattacatagatgaagactaaatgatgagacaaatttattaagtctaattaatctatgattagcaatgatttactgtagcatcaaatgatctaatcatggactaattaagtttaatagatttgtcttactgtttagtcctcatctatgtaattagttctataattagactacatttaatacttctatttagtgttcaacatcatatccaaacgggtagggcatctccaaccacgccttaaatgctctatcttaaaatatatatctcaacttataaaaatagctccaataattttatattttataaatatttataaaaaatatagaacacactatgaagtgatctacatatatatcacaccctatattagtgtcatatccttgtttttatatcatttttaatattttattttctaataatattgtttacttactaaattatatgatatagggattaattattggagattaatttatttttagtgccctaaataatttaaataatacaatattttatttttgagcactattttgtaggtgtttttagaaaaccaaaaaacagaaggacctaagtcaaaatcgtcattcgtcaacagctttctattttcttcgtaatgctaacaaacccaataaaaaataaaaatcgcagccaaaaacacgcttctcccttcccatcttttcctttcccctcctccctcctcggctcgtctctgttcccctttccctcctgcgcaccccgtcttctcctccccgcgtcaaaccccagcacaaaaagcaaccgcccgccgcctcctcgctcctctcccgaatcagccgtcgaggtgcctaatccggccgatcccccctccgatccgcgggtgcccgccgcagaggcggcgcctccgggcctcccccg

SEQ ID NO: 9566 - DNA, 1500 bp, Zea mays
atcaccagaagtagcaagtccgctcaagtgcaatgctgtttagggcatgttcttttgcaccccatagctcagcagagtggtgcttcagcgtgcctcgcttttttacctcaagagaaaaagatgctagctcctgggtgcagttgtgctccagctttgagaatacccaagctaagctcactctccagctgcaaaaagaaaaactaaaatatgtgttgaaacgcaaaataaaatacatgtaaaaataaagggataatcaatcaatggagagagaattcacattaacgttgtatgcttctttatataaagggacaggcaaagaatacaagctaaagaactagcataatcaagctgccatctttgacaccgttcctacattcactaccacacattatgtctctaagaatttctgaagaaaatgaaataattaatgcacgtttagtgaagattctctatggtacactactaataatgtcttcaattaactcctcagtgctaaatatatacaaattcatactatcatttttgtacacaaaacataaattgtgatgtgatttgtttcagtaaatcacaatcaatacgtcgattagatacaaaaattgtcacctcacttctggcttctgcgctcacatagcatgaacaaaaaaaaaacctggcacactaataataatcaaacctaagactagatcatcacccatgttccagagaaaaatactgtgaccgcctctatagggaataaaataatccatgtgggaagccagtgcaaaaccgaatgtactaggcgaaaaaaaaatactaaaccatttctgcattaccaagtcaaccaacaagtagctgcagctccgaacggaagtcaagattttacatgcatcccttataaaccacgaagctaactcccaaaacacctgagaaatgctacgatcttttatatttcaatgtgctcgcttggcttgatcgatgtctgaaggaagtacgttatcagtggatctctgtcgtcgttcaccggagaaactttaatgatatggatgtaacaaagagctttttcctattttgccaaatgtggattctaggcacttaactatttcggcctgaacgcccatgcatatataataatataaatattgtgaagggaataaatatctttgagatagatgtggaaattggaatatatcggataataaggaacttgtatatctgctgcaagtgcccctattctatatattgtgaagaaacaatctgacatgttaagctatatatgatagtagccaccgtacgagccgatagagacgctcaaacctgaactttttaagagctgtaatatatgatgatgatcggtccatcacactcagctcgatcgatcggaatatatagctggccttgacgtctataaatagaggccaaacgccctggtctcttggcaacacacacaagcacacgcacatagggaacagaagctactagctccagcacaaaacacctactgcttcaactgtaccgttagac

SEQ ID NO: 9567 - DNA, 426 bp, Zea mays
ggtccgcgcagccggtcgcactcaagctattcgcggacggggacacctcggcggcgcgcgaggccgagatactgatgctcgccgcggacgcgccccacgtcgggcgcctacacgcggtgatcccgtcggccgccggggaggctcccgcggcgctggcgctggagctcatgcccgggggctccctctccggcctgctgcgccggctggaccggccgatggagggagcgccccatcgccgccgaggcgctgcaggagctcctcgacctcgccgcgggccacgcgctccgcgtcgtgcaccgcgacctgaagccgtcgaacctgctcgtcggcgccgacggcgaggtgaagatcgccgacttcggcgcgggcaaggtgctgcgccggcggctggatccctgcgcgtcctacgtcggcacggcggcgtac

SEQ ID NO: 9568 - DNA, 1457 bp, Zea mays
tccaggaatttttttcacctgaagatgttttgcagaaattagtcttcgaggcagtggtggagaaaaagcttcagagtcgcagaaacttttggcagaaagtgggtgagggcagtaaatgtgactcactcacacccgctccgctgcttttatactgagaattgggtgcgaaagggcgcgagcagcgaaaaaaaatctgcacacgtggacgttggccttcccaccttctctcagtctggtggacgagtcgggcttggcttcatttgtaccaaagtattcatttaaccttttccataacgagctttgggaaggtgttcttcggacatttagctcaaggactactagatatatttttgtgtttcgagctcgttatgaaaaaatgaatttatcccgcaagaggctactgttgggggcctagttgcccgaagatcctcaaaatagctaaccttcgacataaaaagatgtatttcaggcacataaggaagggtggcgaagatgaagactgaagtcaccagcttcggcgtgccaaaggcttcgtgtgcggaagcgacgaaggagaaaaggttgaagacttgtgcagcaagaaagagagaaaaaactttgatgccccatgatatttgtaaatcataattgttaactttgtgggcatacttataatttcatacaaagctgtacctctcccctataaatagatgaacagtgtcatgcataaatgctccttttggagggcttcaagcttcatctctcttacccttcgaagtacattctagttgtttttttgtgtaaaaccgaatgtatgcttgtacatttaattcataagaagggtgaaataagagaatgccaaggcatacaaggtgactagcttgcttcgtccttaatcacacttttatacatccttacttcgcctgtgtccttcgtttattccttctcccttagacgaagaaagtttcaatcctctaacttgtgttgccttgtttttgatatcatataacaatttaaaacaagtgaccaacaattatatattccatcctatccaaagtataattcgttacactaattacacattctttaagtaatatataaatttagtttgtatgtatgtctatattcattatcatttaaatgagtgtgtacagaaaaaataagctagaaagaactatattttaggaggcaggaagtatatttttttataagaactgaatgaatagtttaccgataaacaccgcgtcataagcagagcgcgggcgcgtgccacagccactgcccgcagcttcgacatgtgcatgtggtggacgcagtccggtgggcggtggctgcgcatcaaccaatcaccggccgccttcctcgccacacggggcagagatatagttaggctaggccccgggcggctcatccgcaagccagtggacgccagtgagtgaacaccagccgtcttggcccgctccttccctgctgcggcc

SEQ ID NO: 9569 - DNA, 1153 bp, Zea mays
gccataccagcgtgagggtctgacttcctttttgcgaccccggcaccacaggaataaactatagtaaacaacccggggaaaacgaaaaagaaatcgaggttcctaatcgaaccctctgccacgcgggtcccggcagcctcctgtcccacgcggcagtggcgggtacgggtgtcctacgggtcggcggccgccgctcttaatcaaatccaatggaattctgacgtccgcaggracaaagtcgctgcgttttctcccatcatcatctctctccctctcgtcttcctctctcctctcggcgcttcgggccttcggcgcctccccctcctcttcgctttcctccctcccccacacagagtgacagcgcgcaccaaaccaaatcccatcgcgagataacaaaaccaggccaacggattcttttggctgcggtggcgttgccggtgccggtggtgcagcagctgctgttggtgccctgtcgctgtgccgccgccgaggtcggctcgcgtgtccggcggcctaaaccctagccggcgctggagccgctgaggcgggcgccctgcagcacccctcgtctgtctcggccaggtgcgcgcccggccgcgccgctcgaatcgccggattcgagcttcggcgcgacgtggaacgggccggcgccgcggaggtgagtgtgttagcagtggagcagctgctgcggcgctctgtcgcgtggtggggacgccgggacggcgtgtgagtcgggggctgccgcttaatttgccgcctcgggggttgctggtgtgctcggagcctcggagtgcccgcaatttggttggtttctggtgctcgggggagttcaagcctggatttcgtggctgttgctttgcttggtcgtgggttgagtttgggggaggacaagtccgctcttgtctcgctgctgcttcgtgctgttcgtcccagctggccccatgcagttttgcgcggtggggggtaatggcgcagatcccacattcgcgtcactaactcgcaatctctacatgttcgcaggggatgctcccccgtcccttctagattcccgcggatctcgcgggcgtgcttgggggtggggtgaaacgatgcccaggtgagtacatgccgcgcgcgatcttctagtggttggtgcgagtggtggacgaccaag

SEQ ID NO: 9570 - DNA, 1500 bp, Zea mays
tcctccctcccccacacagagtgacagcgcgcaccaaaccaaatcccatcgcgagataacaaaaccaggccaacggattcttttggctgcggtggcgttgccggtgccggtggtgcagcagctgctgttggtgccctgtcgctgtgccgccgccgaggtcggctcgcgtgtccggcggcctaaaccctagccggcgctggagccgctgaggcgggcgccctgcagcacccctcgtctgtctcggccaggtgcgcgcccggccgcgccgctcgaatcgccggattcgagcttcggcgcgacgtggaacgggccggcgccgcggaggtgagtgtgttagcagtggagcagctgctgcggcgctctgtcgcgtggtggggacgccgggacggcgtgtgagtcgggggctgccgcttaatttgccgcctcgggggttgctggtgtgctcggagcctcggagtgcccgcaatttggttggtttctggtgctcgggggagttcaagcctggatttcgtggctgttgctttgcttggtcgtgggttgagtttgggggaggacaagtccgctcttgtctcgctgctgcttcgtgctgttcgtcccagctggccccatgcagttttgcgcggtggggggtaatggcgcagatcccacattcgcgtcactaactcgcaatctctacatgttcgcaggggatgctcccccgtcccttctagattcccgcggatctcgcgggcgtgcttgggggtggggtgaaacgatgcccaggtgagtacatgccgcgcgcgatcttctagtggttggtgcgagtggtggacgaccaagatgatgccgtcgggtccgccgaacccgatggggcacgggcagccagtgggcggcgctgccccgtcgctactccggacgagttcttccctgctcagtggcggtggtcagccgggtatgggcggaggtggtggtggcatgctttcttcacagtcgcccttctcttcccttgtctccccacgcacacagtttggtggcaacggtcttctgggaggtgcctctctgctgaaccggccgccattcgggaatggtggccctatgccaggtccagggtcaatgcaggctgttgggatgcagatgagtacactccagcagagagctgggctggatggtgccagcgatttcattagcgcggaagggtcggatcctctatcattcccgtcttcttcacaggtcaatttgggcaatcagatgggatcagataatctgcaggcgacttcgcagcagcagcagcagcagatggatgccatgcaggatatgcaacagcagctaccaatgtcttacaaccagcaacagttgccaccacaacactcgcagcagctccagcagccacaggctacagtcaagttagagaatggaggaagcatgattagcatcaaaccagagcagcagatggcacaacctgaccagatgatgcgaagtgctagtggtgtgaaacttgagccacagcagctgcaagcctag

SEQ ID NO: 9571 - DNA, 318 bp, Zea mays
tccgagaagaaaaggaaactgaagaagagacctcgtcgtctcgtgcagccgcaagcacgaggctgtgagcgagacagccaaggtgctcatcgactccagccagccgcccaaagccagccgcccaaaaagccaggcgcaaatcacaacctcgcctcctgtcycctccccggctcctcgttcccctctcgccgctcgcctccccgccgagatcgaggaggcgccaatagcgagagggtttcctcttccctccacggctccaacgagcccccggcccctccgcctcaaatcccacgcgcccggttggccgccgcccccgcc

SEQ ID NO: 9572 - DNA, 932 bp, Zea mays
ggtctgctggagttggtcttagaccacgtacaggaccggcgcccgtcgctctcgtgtgtggacctccatgtctcacgacccgtgagagcaacgtgcataactccatactatgtattatccaaaacataacaccatacgttgctattaagttgtatgtactaaccagttcaacataaaaatttaagctgataaaaaagatgacaattcacttatccctcacgtggagtctctcttaggtctcagacgtgagtaagcaacaattattatattttatgtaattgcactagccaggattcgaactcgtggtctctgactctgataccatattaagttgtatgtaccaaccagttaaatctaaaagtttaagccggtaaaaaaggtgtataattcacttatattatatttaaaggtagtcgtaccggtgactcacgatcacgtttatatgaaaaacactttaataaaaaaaatatataaaattaacgtgagtatagaatcgatcgacgatagtagacacggcaccgcaccacctgagtggaagcgttttgctgctaccagcttacagttcccgctgctgctataaaactagtcctcttggtgagtctgtccatgctctagtgcagctagctgctgctggctcactctgatctcaagttacagtcgcatagctagcagagccagcagctacctcgtcaatttcattcggcaaccagggcagaaatactcgtggataagagctcagagcccaagccaatttcggttagcccaagccaaatgccattttcattcacgccggccgggttatattatgagaatcttcttcaattcctggaagggtggttccatccgtccaccatggtttcggaattcgtacgcgtcacctaacctagggaatttcctaataactttcagggtctccagcagctgctggagcc

SEQ ID NO: 9573 - DNA, 1369 bp, Zea mays
gtggtggatctagagggtatgccaggtatgccctgccatacctcgcgtacgaagtgtatacacggtatatgcatagaaaaaataaaaaattaacatataaaggatgttgcgctaataatcttgcaaattgtgctttctttatgttcagacttatagccttaggatctatctaataaaaatcttgagatggtctattagacagacaatacgattataaaatcagcaatctaacgctcgattgctcggattctttattgaatgtgactcacgagatgacgctggagactagactgctaggtgtaggctcgtgaaaacaacaaaacgcacaaacaactttatggtgggtcttaagctttcagcactcgagagccagaaaaggatcgatgttgatcaacaactcgatatatattatgtgactatttgtataatcatatgtgagagctgaggatttaagctgtccaagtataatttatttcatcgtttggtattatgtgtttttatgtggataaagatagcataattaaaatattgattgtgtctcttagaaagtcttagctaaaaatcatataaattatcagtataacttttcatatatttatattatagtttattccaaatttaagagttattatttaagtttttaatttaacctttaagtttaaaatttaccggtaatttgatttaaaaatagtttctaagttgttagagggtttgatcgaatatatatgaaaattttagatgatatactctacagtgaaattctagattagccactgtgtatgcgtcaccaaaatgagccaaaagaggacgaacacttcggaggacgtacggagaagaaaatatggcattcgagaatacctcgaacttgtgctgcggagtggggaagcttggagggaaactaatgcgcaacttcctatcaccaccatgtggtataaacaaacaaagtgcgtgccaatataccatatgaaaaatgcatgcatgcatggccaatatacgaagtatatccatattccatgcatgcacgtgtgccaaatgattgaaccctaaataatccctaatatatgttcactcaagtacggatgcaatgcacatgtccatatcgattattcgcgtctaagtccgccctcgtgctaatttgacccatcacttctcaagcttttcggccacccattcctcgatccatcatacatatcatataaaaacaccacttgcgcctaccttggccagcatccatccatgtactacatrtatatacagacgctcactaacgtggttagctcatcgatcgaacttgctaaaccagcggaaacctaaccagctagcagcattagcttttcaacaagcctcgctcgcgcgccgtgaccgatag

SEQ ID NO: 9574 - DNA, 964 bp, Zea mays
ggtttcttacatatgataatgtgtataagtgataatgttttacattaataatatatgaagtatgtattaattataatttaaacggagatgagattttcaatgggaatttatcgccgcgagaaatggggatagagaagaagtgtcttctgtagacgtttgtggaatccatatgacgaatttttttcgtgggggagacgaagatgaggagttaaaacctaatgagacattccacgttaccatccctaaaccaaacaaacaccgttccttgcacgcgtggcgtggatgcagctgcaccacccagcaggcaaccaaacgcgcccacactgcccgggagcgaggcgcaacgcaacacaagcgcgcgcggggcggcggacgaaactccgttcygtggggatggtccatcgccccgctcccgcccgccggcccggccaatcatgcatgcatgctgccaccttctctcgctcccggcaaggccaacggcgaggcagcacgtgcagccactgcgcggcgctcaacgtggccgcgcacgcagcttgtcccccgcggatcttggcttcccaagaccccaatcctctcctcaccaatcacctctcgtcgtcgtgacgctgtgcgctcagctctcccacacattcgcatctcctccccggcccgtcgccatgatatatactcgcctcgcatgatgcccagcgccgcccggcgcccgcccgtgcatgattaattaggtcgcgcgctagctgtgcggactgctaggagctagctccatcgtcgtccggttgttattcctccttctcaacacacattgcccgttgccaacatcatccttcyagcttcctggccgacgagcagtgccttcatatatacaaacgtacaccagctacactacacatctctctagctagctctctctctctctgctccggcagggcttcacctcacctgtgctgttgtgtgcgtgcgtgcttat

SEQ ID NO: 9575 - DNA, 473 bp, Zea mays
tcgccagcgtcggacgttcatgcgctcgtgtgcagcctatttaggcgggcacctcgctctcaaaacctaggctgagagaggagggaggcccgcccttataagtgcaacacggcccccttggctaggcgaggtggtactaacccagggcgtgcatatcggtctctcacatcccacccccctaagaggcccaaagctctcccaggcagcagcggcagtgtgggctccgataccaattgtaacgcacccactgggccagtccgcctaaagcccaccatcaccagcgtcgggcgttcatgcgctcgcgcgcagcctattcagacaggcacctcgctctcaaaacctaggctgagagaggagggaggcccgcccttataagtgcaacacggcccccttggctaggcgaggtggtactaacccagggcatgcataccggccccttacaagagagtatctagctgggagcgtcgccggcg

SEQ ID NO: 9576 - DNA, 517 bp, Zea mays
cctttggaaagatcatgatacaaatgtagtggtcactatatatagggatggcaacgggtttgaaacccgcgggtagatggttttcaaacccgcctccgcgggtttaatattaaacccgcacccgtacccgttacccgcgacgggtacaatatgctacccatacccgcgacccgcaggtgccacaaacccgcgggcacataattatacacatatatttatacatatatcatctatatatacatatatttatacacacatataactatacatatacaaatatgtatatatataatatacacacatataaaattacatatatacacatatatatatacatacacacacacatatatatccattgcgggtacgcgggtttgcgggcacgggtataacattttcatacccgcgagaaaaaacccgtcgggttgagaatcaaacccgcacccgtacccgcgggtacaaactcacacccaaacccgcaccctatagggtttttacccgcgggcacgcgggtaaa

SEQ ID NO: 9577 - DNA, 1500 bp, Zea mays
caagcgtggtccaaaatgttaaaattaaagaaacaatccatgcatatcttataagtatttatattggctcaattctaagtaacctttgcacttacattatgcaaactagttcaattatgcacttttatacttgctttggtttgtgttggcatcaatcaccaaaaagggggagattgaaagggaattaggcttacacctatttcctaaatgattttggtggttgaattgcccaacacaaataattggactaactagtttgctctagtctataagttatataggtgccaaagattcatactaagccaataaaaagaccaagaaaagggttcaacaaagagagcaagggataaccgaaggttgtcctggtctggcgcaccggactgtccgatgcaccaccggacaatgtccggtgcaccagggaactccaagctgaactcttcaccttcgggaattctcagaggcgcttcgctataattcaccggactgtccggtgcaccaccggacagtgtccggtgctccaggagagagcgactctgaactcgccagcttcgggaatccgctccgctataattcaccggacatgtccggtgcacaccggactgtccggtgagccagcagagcaacggctacttcgcgcgcaacggtcgactgcaacgcattaaatgcgcgccagcgcgcgcagaggacagagcacgcgcgggtggcacaccggacagtctacaggacttgtccggtgcgccaccggacagccaggcgagcccacaagacagagctccaacggtcagaacccaacggctttggtgacgtggctggcgcaccggactgtccggtgcaccatgcgacagacagccccaccaaacggctagtttggtggttggggctataaataaccccaaccacccaccattcattgcatccaagttttccacttctcaaccacttacaagagctaggcattcaattctagacacaccaaagagatcaaatcctctccaattccacacaaggctttagtgattagcgagagagatttgtcgtgttcttttgagctcttgcgcttggattgcttcttttctttctcacttgttcttgtgatcaaaactccattgtaatcaaggcaagaggcaccaattgtgtggtggcccttgcggggaagttttgttcccggttttgatttgagaagagaagctcactcggtccgagggaccgtttgagagagggtaagggttgaaagagacccggcctttgtggcctcctcaacggggagtaggtttgcgagaaccgaacctcggtaaaacaaatccgcgtgtcacactcttcatttgcttgcgatttgttttgcgccctctctctcggactcgttattatttctaacgctaacccggcttgtagttgtgtttatatttgtaaatttcagtttcgccctattcacccccctctaggcgactatcaattggtatcagagcccggtgcttcattagagcctaaccgctcgaagtg

SEQ ID NO: 9578 - DNA, 1007 bp, Zea mays
ttgagcatgcgccagcctcatgatgccacaagcaggtgtcgaccctgtcctaaatcccgaaataaaaagaaatcgcctgtaaaattaactgtgtattccccgatctgtgccgtacgatgttgttctgaatttcatttttaactgttcgattttttttactggtagtggtacactaccggtacgaagcacgaggagaggaagccaaaaaagggcaccccatgctacacccagatctggttgggaccatgcttccgtgaatgcgcgcctaccccgcgcacctgcccactgacacccacctaggccaactgatgcctcggccccatgccgtcctggtccactccccggagtcacagccgcggcggcgcccgcagcggtggcggcctcgtgggtgactcttgttcttgtcgggggttaaaaaatggctgccaacggaggcgctgccccccacgtctcgcgctctgattggcccggcgtcgcctctaccggctcgagcctcggtgccgccacgtagtactcctacgcccccccgagctccactgcctatcccaccttccccggatcctctgcgacctgcgacaggtacggcgtggcagtggccagtgggtgtgcgggcgcgtgcaccggcgcagacgatccgggcgagctcggcacttttttatacgtacgcagcggcgctggtaggggacacctgtccgccgccgcactctgacccccgcccccgccgcagcgagacgagatcgcccgcaccaaagcaagccgaggcggcgagcgggacaggtagcggctgcctaccaccgccagcctccgcccacccaacaacagcaccaccaccaccaccacagtccggtcccgtgccttccaattcggtcgtcccacgcatcgattgcgcccgcgcacgcgcccgtcgctttgccgtcttcgaccacccgcaagcaacctatatagcgcgccgcgaattccgcccggcttcctcgtcgcccgccgcagtgagtgagaggaggaggtcg

SEQ ID NO: 9579 - DNA, 726 bp, Zea mays
tctagattagtttttcaattcaaacgacaaatcttagacaaagtatatcatagttagccacgaactaaacagaccctatattcttccaatcactcatcacagatttatttaacgtacgtacgtacaatacaatggcgcatgttgagcttgtgttaacacgtatgtgttccgaggtgtcgtcaacccctcttatcatttctcctcccttttttccccaagcattgagtggtgcaataaatacgcgaatccactgtagaaataaataaataaataaataaataaataaatagcatacattgagtaagcagcaaaatagtaaataaaataacacaaacagtaggcaattggtggatgtggatttggatctctgtttcacacggaacggaatcacaagacgcgtgctccactccatcctctctctatatatgagctccaaaatccatatccatggcacacgccaacatatatcaccatatctgtttgtctcccttcccttcccttggatccatacagtacgtgtgcgtgccgtgccaagcttctccctcacctacctaaatccaatccacttcctttctttcatctgcatgcacacttcctctctctctctctctctctctctctctctctctctctctctctctctccttcctgggagccgtgttaattgctctcttgttgtggagcagcaggagccgaggaggacggcggcggcggcggcgagaagag

SEQ ID NO: 9580 - DNA, 565 bp, Zea mays
cgacgacaccggccgtctgccggcgaccgccacacgccactagaactctggtgcctcggtcccttcattggcaccgacctagatctggacacgggcgaccgggcgtgacgaccaccggctgccggcgcgccgcacgcggttgatcggccagctcccagcttctccaatctctaggctccggcgacaagcacaccaggttagtgcttactgctctccttctttccttgccttgactgcttgtctcctttcccttctattattctatctttcattgaattagtacgaaatcgagcatctgacccaaaaatcataaccctaacttaagcagttaagctatttagttatagcttctgtccttcaatgaatatatcattcatccttcaatgtttaatgaaccagatctgatataattaaaagtatttgacactaggcaaactgaaaaatagtagtgcacccctgtaggctgtacatttcactaaaattcacttgcacacattctattattcacaggtacaataaattacagtgtcttggtaatttggtattgtttgcagattgctaagtg

SEQ ID NO: 9581 - DNA, 1500 bp, Zea mays
ataatcttttggaacatggaatcccaaagctttgaatttctaacattccttttttatcactgacgagtgcgagtgtacattgtacaacatgtgtttttcttctgacaacgcgcggtactagtatagtgatagtggtagcaatacgtacatcaaacaaattaaaccaaacatgaaagttagggtagaccttgggaggcgttgagaacggctacttatctgcagatactggaacaacgctctagagtaagagtagagtccagatagtagtgttgcagactgatgaagcccaccaccaccttcgaattcgaagcaaacctccagaaccagaaaaatgccggcgagggcagtgacaatcccgacggcggtacctgggtggtgctccagccgtcccggatagtctacatcgtcatgatctccaccgccttctgggcctttgtcttatactactacatgcaaaatggcgacggcggcgtggcgtccgtcctgttcaagccgtctgcgttctcgctccccctgctgcccagcatcaccggggcccagagcccgcgacccgtgcaacccgagcagaagcacgccggaccgggacaggcgcccccgccgccggtgctggccgatcgctgccacgggcggtacgtctacatgtacgaccttccgccgcgcttcaacgacgacctcgtccgcaactgcaggaacctccagatytggatggatatgtgcccgtacgtggtcaactgcggcatgggcccggcgatgggcgacgaggggggcgccttctccggccgcggctggttcgccaccgaccagttctcgctcgacatcatcttccacggccggatgaagcgctacgactgcctcaccgacgacccgtcccgcgccgccgccgtgtacgtgccgttctacgccagcctggacggcgggcggtaccagtggaacagcacgtcgatccgggacgcgctcggcctggacctcgtcgactggctggcgcggcggccggagtggcgcgccatgggcggccgcgaccacttcttggtggctggccggaccgcggtggacttcggccggaactccgacctcgaccacgagtggggcaccaagctcctcaacttcccggccgtcgagaacatgacggcgctggtcctggagaccaaccagtggaagcccaagaagcggcgcaatttggctgtcccctacccgacgtacttccaccccgagtcggcggccgacgtggtcgcctggcaggagaaggtgcgcaacaccgagcgcaactggctcttctccttcgccggcgggcygcgcccagggaacaccgagaccgtccgcgccgacatcatccagcagtgcgccgcgtccacccgctgcagactcttccactgcggcgccggccctgacgccggcgccaactgcagctcgccaggcggcgtcatgcgcgtgttcgagagctcggtcttctgcctccagccgcgcggggacacgctgacgcggcggtccacgttcgacacc

SEQ ID NO: 9582 - DNA, 1500 bp, Zea mays
agccagagttctcagaacctccccggccggcccagtgtccagcgtgctgctcacaatctacgggatcaggcgatcagctatagtagcccttcacatcggggtgcatttatgtgtcttaatttgctcagcagtcaaccatccatcatgcacttgcacttgttcatcgccatggttggcagggaaccaatattaggcccggaatttctctttcgtcgatatggcccagtgacagccttaaaccagctctgtttttccagtgattcattttcgcacacacgcacgcctcagagataaatcttgtgtttattcactttgtcaatttggtttgatcaaaattacacttggatttacattgatatcattgttttgtgcgatagttgcttaagtaactatagagaagctcacatttctaattaagatgtattcatttccctagtgtgattaagtagttgctagattgtgtgcttgagtcaagtcaacctagagatttagcagctagatttgttcatgctgtttagtctaatttctttgtaaatggaaggtgtactgtacacacttgcatggtgatctaatgtgtgcatgatgtttaatctgactagtatatgatgagcaatgtctatagtagtatatgcttgtttatgttacataatttggctcatatatcagcgatactcatgctaatacttattgtgttcattattattattattattattatttcaatctaactaatatatgagcagtgttcgtacctcggaccaatacttgagtttgtcatgtttcatattctgattttacccacttttgaaaaaacaacaacccctgccaccgctttagtgctagctgtgacaaacacacgaatgtgaatacatggtcagtataccttctatgcatggtctatgcatggtcgaggtggtggaccaggacgcatcctgatgccaaactctgacctctgtggtgacaaatgagaaaaccggcgtctcatctgatggtgctggaagccgcactgctcactgccccggcgcacaccacgtccacgcgtctgcactactactccggccgggcactcgtcgtcctcagtggtggtcaagataagaacgcaatcaatgaatcaatgggtgcaggcagcaggcagcaggctttggcttgacacaccagagagaagatgccctcctccctccaactcttcctatatatatacacatgaaaccgtcatccatgtatccatccatccacacacacaaacagacaagcatacaacaccgttgccatttagctgttcttgctaggcagttgcgcgcttacattgagccgcagctagctgtctactacggcacaactatctcctgcgcgcgtgctcgatcgatctgaaggccagacctgtgcctgtccaattttgccttgttctacccaccacaccagtagtcgagaaggttccatataagcgcaagcagacagcagcaaaagagctaaggagagtctgagacaaggttcgaacag

SEQ ID NO: 9583 - DNA, 381 bp, Zea mays
tcccacttatcaccgtgctcctcacccacctaccgcgccacagcccgcctcaaatccccggctcggaaacaaccaccgatcacaccaccacattgccgtcaccgtcaccgccggcccgccgccaccgcttcccaagctatctcatggcggcctccgcgtcctccctgcttgcagacgccgcatcctcatcctgcggggccatctctccgcgtccccggttgcttcgtggagctccggccgccgccttcgtcccctcgccgtcgcgtcactcctgctgttccctccgcgcttcccccgcgaggcgccatcggagtcgcttcgtagccaacgccgctcccaccatgcagcctccggcggagtccagggtctccacggtagtcg

SEQ ID NO: 9584 - DNA, 223 bp, Zea mays
tgtagtactgaagttggcttaatgaaaatcctctgagaataatttgccagctaattctgttacatatcatattttcaatgcaatcagggaaatcaacagttgatatcaatcaaacatgcaatcgcacctcagtcttttgcgatatgtgtttttatgcagaaactttaacctgcgtgctgatacaagtaagatataactcattctcttcatcagggatgtgaag

SEQ ID NO: 9585 - DNA, 131 bp, Zea mays
ggtagacttggaggttgcggtccagcgaatgtcgggggtgtggaaggagatatccacagctggagggctctccacgcccatcctccctccccatacccgctgctagctctgatgctgacggtgccacagag

SEQ ID NO: 9586 - DNA, 807 bp, Zea mays
gtgtgaaggattagttttcagagtaacttcccttactttttggtatgcgcctcatgttcttattttgtaagactgttgctggtttggaaccttttaaatttgcaataggagctcaaactcctactgtttcaatttttttaaaaaagaggttctagcttgacatgccataaatcattgcctggcccaagctgccgtccaagcactccttatatacatgtgcatgctggagaaaaaaagggtaattttatgtctctgctaaactatttgaaaatttctaggatgtctttgttttagagacagagggagtagccagtggacactaagcaagcacagtgctgaaagttctcagcaacagcagtcagcagataacggatagacatagagaggagcacagggtaaggatccaccggatccgtccccgtggactttcccgtgcgtcgcgcgtgaacgagatgggttttgatttcacgccctcttccaaagtccattgcttgcttctcgcgggcggggcgaccccacccgcacgacgtcgcgaatgacccgtctccacttgtcggccgtgaccacttggtcctgcgcccaacgcccttccaagttccaacacctgtcccgccgcccccgctataaaaacccgcgacgccggccgagggcgccccaagccaacacggtcacacgactgcataattgtgctcgctcgccgggccccgggacgtgacacatcgcacggccgaagcagcttgccggctgccgcgtttcgcctcccgcctgccgtgccgcccgtgaccgcgagaaggccggcagctttgc

SEQ ID NO: 9587 - DNA, 1500 bp, Zea mays
ggcggaagaagagagagaagacgtctctctcctctcggcgtccccgttccccaacctctcgtctgctgcctgcctgcctgcctgcctgcaaaaaggtgagaagaaagaagccgtgtccgcgtgattttctgggtgaatttttcccggcctccgctccggccagatcggcgcgggtgaaccccagcccctaccgatccggatccgtccccatcgcctcgtgtgttttccgtcgagtattttagcgtgtgtgtccccccctcttcgcttcggttggtgcgtgcggctgtctcgggtagatctggtggtttagttcgccttgaaggcgcgcggcggcggtgtcgcggcttgtagcttgcgatttcacggtggagcttgtcggctgttggggtcggatttggtgcgtggctgcttcggcgctaggcgatccttgtgctgtttccgtgggatatttgtcgttgaatagataggtgaagttgctgtaaacattgcttaccgtgtaggggactgtaaagaatcgttcacgctcgtgcagactgtgacgaattcgctcgatggttcgggctgatctctgagatgaccccgagctgacgtacccatttcacaacggcaccggttgtgaagcgactcatcatgggcaggcttagcttgttctgttgttagctgttggtgcttaggtcgtgcatatttctgaaacatgatcggttaagagtatttggctatctgcatgggtgttggggcacttcatcatctgtctgcatacggggtggagatttacgtaaaaccaactgtgacctgtgaggcattatgtcttttttttaacagaaaattaggttatctgctacctaaagttgctagatttgcatgctagatcatcatatcacttagctaaagtatcaaatgtaatgttaaatcatcacgagtttgtgattgaatatgatatttggttgagatctaagtgcattaagagtgataattgagccgaacctgacttaatcattggatggtgcctaatgttgattggccttcatgttggacttggctgccaagtgatattatgccaaaatgatcaagcatgcaaatcttagcaagcatgagagcacgaaacccattgttcaagcttaggcactagctgcacaaccatccaagtatattgaactaatgtgaaaactgaaaagttgtctgtctagagtagttgattgacatcataaactgaaaactgcagtttgaatcagccatatatgttaaaatgtatgataccaggactgtcatgtaacaccttgtttcatctgatttaattaatgggcttgacatttgcttcttgtttcttgtgaggccagtttgctgagttctctgcacacaacaaactttcaaatctgttgttcctcgtttacaccctttcttccaaatatacaaatagatatggctgactacagtcttttttactatgtgtttcattgtctaacccatctttgaatgtatatgaaaatacaggagtttgtc

SEQ ID NO: 9588 - DNA, 277 bp, Zea mays
tccccggccgatgtttggaagtttgcaacggcgtcctcatgctgcaccttcccgagaaagaattggaggagtattggcggccaccgtcgtaccaggaggacgtttgaagttccagctcctcgaaagcgctgcaaactaaatgcacgaaagaccaatcatttatattgaaaattgaaattatcactgcttcaacctccgcacaaactctccctctcccagtctcagttccaaagcctaaccctgtgctgctgtgcatctgtgctcttaccgagcggca

SEQ ID NO: 9589 - DNA, 610 bp, Zea mays
tatcggggaccataattaggggtaccctcaagacgcctaattctcagctggtaacccccatcagcatgaagctgcaaaggcctgatgggtgcgattaagtcagggatcagtccacacgagtgactcgatcgcgcttcacccgagcctagcctcggccaaaggcagccgacctcgagagacttccgtctcgcccgaggcccccctttttacggcggacacatcaccggctcgcccgaggccttggcttcgctcagaagcgaccctgactaaatcgccacaccgactgaccgagttgcaggagcatttaatgcaaagggtgagtcagacagacagtcaggccttgccaaaggcgccacggcgaactccgctccgcccgaccccagggctcggactcgggctaagacccggaagacggcaaactccgctccgcccgaccccagggctcggactcgggctaaaagacccggaagacggcgaactccgctccgcccgaccctagggctcggactcgggctaagacccggaagacgacgaaactccgcctcgcccgaccccagggctcggactccgccctggcctcggccaaacggcctccgcctcgcccgtcccc

SEQ ID NO: 9590 - DNA, 55 bp, Zea mays
gcctgaaaagagatcatagtccctggcgttttgctctagcttctgctttgcctcc

SEQ ID NO: 9591 - DNA, 460 bp, Zea mays
cgccattttttctttggttcctcgcgtcatttcgccccttcccattcctctccactgcgctgccatcgtctcgcgccggccccccgtggggaactagaactgactccctcgatcccagcggcagcggcggaagcgaacggtgaccgcgacctcccctgaggctgcatatactcggtaaggtgccctctcctcatcctcatgctgcctccgatttgttcgagtgagggggaccctcgcactctcagatccatccggctagtattagggcatttctttgttcccggttgatttatcgattggttcgttaatcaatctccgtttcccccaatctaatcggcgcgcaatctgtgtggcaggatcgggtttcacatctccggttttggattggttggttgcccgcggcgatgggaggagagctgtggtggtatccataggggatcctcggttgcgtccttgtgcg

SEQ ID NO: 9592 - DNA, 615 bp, Zea mays
tctatatatgaaaggaaacataaactgggagcaacaagagttgcaacgtcactagaaagaagggttgtgaaaggaggcaaagaacacagggagggctgtcagttgtgagcaaattaaagaacacatgagaatgcacaaacacagaccacccgatcaaacatatctgcgtaccgatggccccagaatcacggaccacacgggtcacaggaaaaacaagaggcgtgcatcgtcccgatcaatcaaatcgaaatggcaagaaaagaaaagagattagcggacaagaaacttaacaaccagcaacagcgacgcacacagcgtggcccgtgggagagatattagccgctctcctgccgccgcgcccgcaagccgccacacatcggatatcgcccgcccgaaygggtggctgcggcgcatgcaatcgccttatccccccggcccgccgccccgcggccacaagcgcaagcagtgaacacggcgcctcctcgctcgcgcggccacgcccccgtcgtcgtcttctcccggcaggtactacagcgcataaatacgcagcaccgccgcccggctcggttcccgtctggccacccatccgatcccacccggcagcggcgctgcgca

SEQ ID NO: 9593 - DNA, 375 bp, Zea mays
caagatttgcaaatcttttctgtcttctattattatatttatgacaaaaaaaaaacaaatccaaatcccgcagtggccgccggccgcgcgaggtgcaagggttccacagccgccccgctagatcggcgggcgcgtcgttcgctgcggacgcttcgcttcgtgcccagccagtaacttccgcatgcaagcgtgaacgcgcactggcacaggcgcagctcaccgcgccaccacgaccttccttttctgcgcctcgacgtggggaccaggaccaccacgaccacgatatatacagaccgatcgggagagagagaggagggatcgtgagaggtggcggcgaaggagatctgcagagagacaacgcgacgccggaacgga

SEQ ID NO: 9594 - DNA, 306 bp, Zea mays
tgtacagccacagcccttttacagtttacacccacaaagtgaaaaacatccggtgcgaatgctgtttgaaaacctaggtttttctcgcggttaagccgttaagctcgtgcttgctcactgctgatccctcgactgtgtcttttcgctttggagctcgaggaagcttgccttgccatccgccacagcaggctcatccatcaggatctactaatttggtttcgaattatgcccccattttcgtgttttgcccaaaatactcttattagggcatatattcatttggtgatttttcacatactcaggtaa

SEQ ID NO: 9595 - DNA, 1500 bp, Zea mays
ggggttgcacagaggatccagagacgatgatgatgattagtgaataaatttgctatggtttctgccctcggtgtgctaatgctgtgttaaatgagctcgagttgacaacaactgctgggccactgttgagctttagaactcggttatgtcattccagtaacttttgggggcatctttgttttatatggcccctggtggttaactatgcccacccctatctctatcttcgatccctgctcgcctaggggacccctccctgatctcattcccagagcgaggacatcacagaagctgccatggaaatttcacaggcgtgctgctctccgtgccaaccagaccaagaccggccctggcccacgtgtccgcctgcatttcttgcagatccggcagcttgcgccccttatcatctacgcgcaacgcagctgacgtgccgttcgaaacggtcgatggataggtggtggatcgcgcggcaggaacggttcgccgctccgtgcccccctgccccccggcctcgtgactccatgccgtcccaacccaacgctgcaccgcaccgcaccgcaccggtagtggttgccggtcaatgcgacgcgacccaaacaggtgcagtgcaggagaggtgctacgcacgaacacggctacgctacgctagcagcgagagggagggaggccgccgtatctagcgcacggtgcacgtacactgcgctcagcgagaatcgaccacgtcatctctttttttcttctaactctgcaaagtcaacgcggttatatgataacaagcctcttaaactatctactatactagggtccggatccatcaacaccaaggaaagaggagaaccagcagaaaacaagaaggtaaaaacaccgacaaaaccaaaccaggcccccttcccaaccctaattaaaaaaaaaggtaggagggggagtcgatctcaattctcaacacatcaacgaacatcagcacgaattgtttgtttcgtctgacctcagcagagtggcccacactcgcgcaggtcacaggtcagggcggcgctccgctgctaacccacaccacacctaaacgctgccaatctctagtcctaattgtatcccccgctgtggcttctcacacaaagcttcccttccctctccccttccaacctgcacagcaactgcaagtacttggagagccaggactagtccactagtgctctttcttttgttgcgtcgccatccactccaccacaccaccacctgcccccgaccaccgaaaaaaggtccaagaattcgaggacacctcctcctcctcctcctcctcctccacgatggccatgccaagatccttccccaaatcgtagcctttgtttgttcccccaaaaggaaggatttcattccttcccgttccatcgttccgatttgccgtcaagcaaatgcgaagcgtctcccctgtgatcttctttcaccttggcgagctgtgcgactgactggttgatccaggctgtatatacatagggttaatta

SEQ ID NO: 9596 - DNA, 1040 bp, Zea mays
aacacatcaaaatattgtcaactgtggagtagagatactcctgacaaagtcagttgaacagagctagaaaacatggagtggagtcgcaaacaccatctaaaagattagaattttgttctagacaactgagtaaataatctatatctagtaagggatgtttagatacaccaactaaaattttatcggcgacaccggatgtttgaatgctagttagaagtattaaatatactgtaactataaactagtgctgtgatatagtaaacattttctaattatagactaattatgtttaataaactttcttctatgattaattttataattaaattatatataaacgctggatgtgatatatactaaacctttgtttgggggaattaaacacccttggatcattttctcgtaggctctctactagagagagcattacccatgggcacttggcccaggaagagaagaagctaaaaaatccagaggaattgtctgacagcttctgccatttcctgggaggctggtaccatttctctccggattctcagctttaatcacggtgcggcgtcagctcctcacagataggagcggcgggcggctgccggctgccggctttgtcgcgttaggcagtggccggactgccggaggagggcagaggtggtcaggtggagttcgccagttcggagtcgccgattgagtcgggatcgggagccagaggccgagaacggatgcttcctgttgcttgctgcgtgcacctcgtgggctggaagttgggcgtcagctaattttccgctccgcaccgactgcagccccgggcaccgtatccgctctttagcaatcataacaaacatacccgaaggaagccaacagatttcagtatttcacggtcaccatcaccactcaccagtccctcctacccgcttcccataaaatcttctgatctgtaacgcattcgtcgacgcccacctccgcttcgctctcttgctcctttagtcccatctcccatcccacctggaggcgaatttcgtctggggaaaaagtcggcggcc

SEQ ID NO: 9597 - DNA, 497 bp, Zea mays
gctggatggtggtggtggtggcgactctcgtccgcggcggcagagagggcaccaaccgaggcgaggccaacaagcccagcccgatcccgcggcgacgaacgcggtgttgttggcgtcggttgggtccggcgtgtcagtgcgtgggtcaccatagtcaaactcgctgcactgcgggagtagctagctcacgggctaaaagcctaaaatagtcttgggaggaagagatcttgggccaagcctcaacattgagcccattgtcttgtcgttaagccttgctgggctatatcttatttcgggaccgaactagactagattgttatatggactgaagcccaagaacttatagcccgccctgcccgccggaagtatcacagaaaattgtattcaagtggcatcacatactatatatatatatatgtatatgtgttgctgcagtgcagagtgcagatggccaacgcaattcaccagtagtagtagttgtagcggcataactagct

SEQ ID NO: 9598 - DNA, 539 bp, Zea mays
tagctagttatgccgctacaactactactactggtgaattgcgttggccatctgcactctgcactgcagcaacacatatacatatatatatatatagtatgtgatgccacttgaatacaattttctgtgatacttccggcgggcagggcgggctataagttcttgggcttcagtccatataacaatctagtctagttcggtcccgaaataagatatagcccagcaaggcttaacgacaagacaatgggctcaatgttgaggcttggcccaagatctcttcctcccaagactattttaggcttttagcccgtgagctagctactcccgcagtgcagcgagtttgactatggtgacccacgcactgacacgccggacccaaccgacgccaacaacaccgcgttcgtcgccgcgggatcgggctgggcttgttggcctcgcctcggttggtgccctctctgccgccgcggacgagagtcgccaccaccaccaccatccagccagccccttcccttccccagcagcagtctccagccgcagcc

SEQ ID NO: 9599 - DNA, 208 bp, Zea mays
ggaggtatttgtttgtgaatataatatgtccagattaaataatccaataaattttatattaacacttcattcaaaatttattggattatttaatctaggcatattataatcctaaacaaacaacgtgaaatttatctctttgattagtaaaccttgctccaagctccatttttactagtgtggtgctgtgcttgattattatctggat

SEQ ID NO: 9600 - DNA, 1500 bp, Zea mays
atatctgaggtagatccttcggaagtatcaggaacaacatctccaaaactgccttcaaaatcggaagaagttcatagtatttccaatgggtcacctgtttctaaggcagatgtttctgagcaatccataacaccacaaactccaacacatccttcagtagcagaagaaaagcttgatagctctactgaggcacctgcatctaaggtgggtgatgctgaagcatcagaaacatcacaatctgcaggacatccttcaacagtggaagaaaaccagcaccatcaagttagcaaacattctgatcctagtgatgaagcagagccgaatcagcttagagagtctgttcgagacttacctgatggtagtgcatcttcttcgcctactaaaatacatcaatcaggtgacaccgaaacaggtgaatctattgatacaggaaaggaagacacatctgatgggaatgcctctcagtcacaaccagcagaatccatgctagctagttccgataatataactgaagttgaggacaagattgctcaagaatacaatgtcccaaaagaacttagtagcccacaggagaattgcgatacagtagacaaagttactcgtcttgaagtcaaattacatgatggcaatattgataccaaaaaaagtgaggaagaaagcaataagatggaggcaggggaagtatctgttgttgtacaggaggataatgtaatggagcaacctgaagatttaatgtcaaagtccataactgcagctcatgattcacattcgcagaatgagtcagtggtcagtttgaccgatgtacctgctggactagggggagtaggccccgcagataattttacaaaagaagaaaagattctagaatctgttagaggcacagattctcagactctggactctgttgtttctgtcgatgagctagagaaattaagacgtgaattgaagatgatggaagctgcattgcaaggtgctgcaagacagtcacaggtatgatttcttcatgctcaaatctctgtggtagcaatccagttaaagcttgtgaagttatactctataaaatgtaccccatgcgggagtgaaccttttaaatctatgcattcgtactatgttaataatggaagcacttagtagttctgtacagttcatgctttacaattgttgcatggacattagtacagtcgaaacgtttaatagatccctgtcccatctgtcacttggtcatggttattaaagcggtaaaacgttaaaacgttatgaaccaacttttcaacgtttaaacgtttaaacgaacgttgaaacgtcttttcagacttgacatagaatttcaaatatagaataagttcatacataagttgagttcacaaaccaaataacattagcataaaaagaaataggtcaagttcaacaacacaagttcaaccacacaagttaggtctggagcttggccgcctggccgggcaactggatgtagcaagtggagcttggctgggcaagtgg

SEQ ID NO: 9601 - DNA, 295 bp, Zea mays
ctcctcccacctcgccagtcgccaccgcgcggtgggagctcgctgaagtgcttccccccgctttgcggcagcgtcagctcagaccccttgcccgcgctctcgttgtctggcgggctcagctggtttggtcagcgtggcgaggttgtcctggccagatcctgctcccgcccgcgcacgactgggtgtgggcggtggattggctgcgcgggtcatcagatctatgccggagatctagggcgccaggtgccgaggtggaggccgtgagccggtggcgatcggagggccgaggacaggg

SEQ ID NO: 9602 - DNA, 1279 bp, Zea mays
tggctaagataaagtgcaattctacagtttaatatctgataagtgggccatatacccacctttaattttttttggtgaggtttcacttttattttaaatttatttttgtggggagggtttaacatcaaatacacacagttttcattaaattgctagctagttctgctctccggcgtttggtgcattattaagcatgcattattacatctttctccacgggtctatgtctttctacaaataaaccacacacacagccaaagttgaagtaatcctgtctacttgcgattggcaggtgaaaaaaagacacggcactttatatagcccacttttcacacgcgtcaaatgccagaaaaaagtcctttgagtgcagtgtacatatattatttttgtttcggaaaaataaattattgagcttgtagttagttagcagcgcatttgttgcgtaccaagatctttgtaggaggttatatatatatatatgcatatttcagcaaaccaatcatgtatatatacaacaactatagctgtaacacactttctgctacttgtgagacaagtgaaaaacccatatatacaccgtacacttgtttaatttttgacatatttcagacgttaaaaaatatattatgtatggactagtgccatctcttattaatcttaattaccatggcatacagtcatctatatattctgagagtggagaaatatataggagagaggggcagagaaataaaagaggtagctttattagcatatgcacaaatgacttcccctcgaaatctactgcaaggaaagtgcagattagatacacccattgtattgtatgccactgtgcgatcgacctgcatgctgtgctggttggtacacgcatgcatgcatgcatgtaccactgcacaccatgcattattctcttctctcgccaacaatgccgaactggacagcaccactgcaatcaacaggccgcggcctcccagaacggcagaaagggcagcgcggccggctatataaatccatgcccgtgctcgggtccaaaccacacacaaacacatcagcattcagcaatagctaatcgagcatcgtcgccttagctcctctcctctcctctccgtcgtcgtggaacttctctccgccggctgtcatatatataaaggagaagaagagaacagcaactctagctagccggccggcctccgtcgtcgccggcgtcgtcgactagctagctaactctcgatctccagttcctgcccccgcgccccacgcccggccgtcgtcgtcagca

SEQ ID NO: 9603 - DNA, 131 bp, Zea mays
tgtaagccttgtgacccctaagcagtctgcgtcttgtgcctgctgctgtagcggtagagcagagagagagatcaaatgtaaattacattttttagctcaaattcacgacaaattggttgtcctacctgcgt

SEQ ID NO: 9604 - DNA, 935 bp, Zea mays
agtcatggcatgtcggtagctcataagagaactcacgacatgagtgcatgacatgcaacaacaaactgaaaagtacatctcacaaactcacagcataagcctagatcggcaaaaggagagcctacgctcatcgttgtgcgagtggagacatcggtgtgtcgtccacggccttgtttgtttcaactttttacaacttcttgccactaaaagatgttgcgaactgccaaacgtttaatttttcagccagcttctataaaaatcgatttgttaaaaaccatccgaaatcaacaaaaacacataattggtcaagtcgttgcaatagtagcaattcgtccctttctagatcctgaaccatatggataccttcatcttcctccgcacgtaatcccaacaatactcagattctcttcacaactagattctccccataaccagattctcagaaaaacttgtcagaaaaagctaaaccaaacaggcatgcagtagcgtctgcccatgattcaaagaccacaccacctgtccgaccggacgtcctcatgccatagcctgcaacagcgtgaggcaggccataatgccgccgctgacggaggtgagaggtgggcattttacagggaggtttcctctatgttgacgagcatgtggaagtggcaacaaatgcagagtggatgacggagaagcagagcgtcattttgcagttgttcctaggcccgtgtgcgagagccacgacatcacaggaggacagagggagaccaaagatagccagataagactatctccagtagactccctatctcactccctatctcactccctatttcaaactccactctacaaacagagtaatctatagttcaaaatggtactttgcacgaccgtttacacggcctgctagagacggactgcctcacgtgtgtgactgctgstggtgatcaatc

SEQ ID NO: 9605 - DNA, 666 bp, Zea mays
ctagcggctagggttcggaggagatcattagggaggagaaggagaggtcaagtctaagttgggctaggtgagaacgatcatgggtagatggatggcagtaccgggtaattttcatcaacttacgattaatagtgggtcttttattaaaaataagctgatataagcatcttttgagaagcttatagggttatcataatctcaagtactagattatataattttatcacataagttgcttcatacttagtttgtctatcactagcttatttacatagaatttagattatataataccaaaccctaaatgacctgaaccaaagatacccagattgcttcacatcatttgtgtggcactgtggctacatgaggacgtgggaatgggcgaatggcgcggaacgacccccgataggtttccgatattgccctccccacgcgcacgatttaaccgatccgcccccgtttctttctttttctccacgagaacgagattacgagacaagagacaagtagacaacccagctctccagcggtccagcggtccagcctctcctagccgaggccaaaacccccataccaacacacacttcgcttctcgctgcctccgcggcggcgcgccgctccgctccgagccctcttcctcctcctcctctgcccgttcggtcgaga

SEQ ID NO: 9606 - DNA, 796 bp, Zea mays
cgcctttcttcgcatctcttaggtcatattcgattgcaggtggattaattggaggggtttaggggattaaatttcttcgtgcttaaaattaaatagacagaaatttaatctctccattatattctggcctcctcaattcgctcctaacggaactaagcttttagggttagtttggaaacctaatttttctaatgaatttatattttgctaagaaaaattagttcattttccaataaaaaaatagagtttcgaaactaactcttagtgggttgagaagttcacccatctcacattgtctagtgtcaagtgtttttgccagtagtgttcagatgctcgtacaaccatatggatggatatacatgttcctgcatcgtttttatcctttcatttttctttttttttttgcattattactggctgtatgcagaccagggccacctcgtgtgcctcgtgcgtgtatatataattacatatacgcatgcattattgttgagcggtggagcatgcagcctgtgttatcctgatgagcgatgacacacacacatgctgccttgttggctgcagcagcagcagcagctctataaatacctcaccaccgcgcatactcgcttcacacaaagaagctccataattaattattgcccgtaagtactgtgcctctctctcttaatatatattatcacgctttggattttttgcaataacatagtaggagctaccagtagtttgttagttttcgtttaacgccatcatcgattgatttgcagtttcagttcgccatcggcagccgagcacc

SEQ ID NO: 9607 - DNA, 743 bp, Zea mays
tagagcctagctaccaatcacgtctttagtctcggttgtatgaaccgtaattaaagatgagcatttagtatcagttcacaatacaacctgctacaaatagccgagggaacggatgaaagcgctcttccgagttgacgaccagaaaaacatcaaaacgcaaaaaacgctcttcctgaaatgagtcccgccggcatcagtgaaagtacaagtcctctttctagcttgttccgttgcttttgtcatagttgtcaacttttatgtgatatcaaaaactatattgatttgctaggatggttcaattgacggatgtaatcctattgatctctcggcacgttcgtcaaatatttctacccattgcatattcaagagtgttagagaaaatgctaattttagatcccctgagattctcaaagattgagtgagaaattagcttatttttctctaaatctctagaaatccgagaaaaattaagttttcaaacaagcctttaacaaaaaaaaatccgcgaacaccaactggtcacgttctccccactaattcggccggcaggatccccaaatttcttgacacgtacgtctgcatccccaccaaagttgcctataaatacccctctgggtgctaactcctgcaactcaccaaacaaacactcgagctaagctcagcctcacacagcctctcctctcgagctagctagagtgctactagcttagaagaagaagcagcttacagctgaagctgcagca

SEQ ID NO: 9608 - DNA, 1147 bp, Zea mays
tatgtagtattattttagaaattaattaaatttgaaacgtgtgtactcttttgacaagaagatgatcgatatgaggccatgcatgtcgcggcaagggatgttgaaggcgatgtagtcgaatcgccacgtactgctttggcttgcttcaagaacagattcgccatcgatttcagcgtgtttgatttttctccttcctgcattagcagagtataggaggttgggttcgaggcaactggcagctgcgtgcgcctctgcgtggaagcgatttcggacttgtgttgcaccggatggaggcgcagcaggctctttctggcgcgggtttcgttcaggaaacttcctgcttcccaagtcacagaccatatgttaaattcctctacgaagggaaaacaattcaatactagcaatcttaagagttgactcatttacctaaagtagttttgagtttggaatcaataaagataatgtaaaagcaattaattttgattaattgtatgtactaatatttaataattaattaatgtaatgttgagcatagtttgataggctagtaaaaaaatgagttctatattgcagatgttgaagtattttcttttgaacttgttcaacgaagttctaccctgtgacaaacaaccacgctatacacctgacgttaaagaaatattgatggagtgatttctgcctctttggaagcatcaacaaaattgatatttgcctctctggtatttggtaaccttaaccggaataacggctatccatttgactcttctctggacgcacgcactcgcgtgtttttctaatataagcacgtgttatctccatttgggaggctaggagcagtaagtatgccgttcttctgttacgtacgtggatcgatactggccggtgaatgagcctcctgcttccttccttatagacgtcgctgccttgccttgccttgccttgcgcgcaactagctcagcacttgccaagaagcagcccctcgtagacgtcgctgtcgtcgcatcgtataagtaggagcgcgcgtgcctcttcccggttcaacctggttcaaacacctcgcttcactagaggaataatctagcagcttctgttgcctccaaattgtccggagaaaggagttgaagcagtgtgagagggccctgagacg

SEQ ID NO: 9609 - DNA, 1459 bp, Zea mays
tgtcgattttgtgatccaaattctgaagaagacggctaaattgacgagcgaagcggaggctcccccgtcttcgggaggcttatcttttttttcctaataagattttattatattattactttgtgtgtgcatgcatgtgcactgtatatatatgtcatttgtactttgatgcgagtgacaccaacagctggtccatccatatgggagaagaagaagaagctagtgccacacatatgcattgatcagctctgtaccaggctagctagctgcttcttatgtatgcaggcagatagtagccaggggtagtaattataattattatatgaagcagccagagaagaggacacaaataaaataatagagacgagatgggatggatatatatatatatatatatatatataaagaacacgaatattagaccaccatcctcaaaagattccaaggctaggcgtgtcaatatctatagttaagttgtgtgtgtgtgtatatatataaattctactaattccttatatatacacacacatatgtatatgagactatgtacgcaggtacgtatatatatatgggtacgtccgcacgagagcaacatagcgcatgcagccagacaaatgtaaaaccgtcggctgtgtcctctccccttctctctgcttaatatctactgctcgcagagcgcactagcgaggaggcagtgcaccacccgtcatctgtctctctctctctgtgtctctctctctctctcctgcgtctctctcaggagtgggtggcaaaactaacccccactgctactagcagctaggagctctgcagcagggctagctagcctgcagtgcactgaccgacgactcttatctactagaagatgtggtcgtaccagtattgtattgtgtagagagagagagaaagagctagcagccagcagcagcagcagatacgtacaggtacaacaagcagagctatctaggtaggtagcaacagagagagagagagagtgaagcaggcagaggcagcagcatggaaatggaatggtggccatatgattcatggatgatgggtgcatggtggacgcgatcgaatcgaacgcgatcccctcccccctcaccccctaatttcactcggatccatgcctgtgtgtgctagctgccgtcgtcggccttgcctcgcaaaagtacccccaaccccccactatatataagtgcagcgcctttcctcccctgccaccaccagcttccctcctagctcttctctttcctcatcatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatca

SEQ ID NO: 9610 - DNA, 377 bp, Zea mays
agccagacaaaatcacccaatgccgacgttaacctcgtaaagatctccaaattcaagcttggtccctgctactctgctgtatcgtgcaaaaaaaaaaggtatagcaatgttttacgcgtctataaatgaaaacgatgacctttttctgaaaaaataaaataacacctacccctaacgcaaacgcgagagcgaaacggaacaccattgttggaaataaaataaaagaacaccacatcgacatcctctcacctccctcgcactccattggatttgggggagctcggggggcgcgggccactgatgatccccggaacgagcaccgatccgtggcgaggaaactccaccgggtagccggcccgggagcgcggggcacggcg

SEQ ID NO: 9611 - DNA, 711 bp, Zea mays
agaagaaaaggtgatattagaatcataaaagacaaaagagtacagaaatagcagcaggtgaaatgacttggaacaatataaaattggcaaactttatcaacataggtagtaaaccaccaacaagattaagtaatacgtacaaacaaccagaaagatcagcatggccactagaggacagaaaaaaactcttgataaaacaaatagatacaagagatatcgataatattttattaaaggaaaaggtatatataaccccctgacgtattcaggatatagtctacataacccctgaactataaaaccaggtattgtacacattaaactttgatacaaccagacaaataacccccttggctggtttggttagtggttttgcatatgtggaactccacactggctcgtttcaatggcatggtgtcaagtcccacctatcagcccacaccgccgccgccaaccgggtggtgtgcacacgctgctgctgtccccatcgctcgcactcgtgtcatcttgtggacgccccacgtcctggcactagctaccgcaccacaactgccgcagcgcagcgtcaaagagggaygctgacctcgccacgcagaacttacactagacatccatccttcacctcagcatcgagctctccaccacatccccggtgcctgcatcctcgccgatatcaagctgctcgcaccgacctcaggcagatagagcagc

SEQ ID NO: 9612 - DNA, 404 bp, Zea mays
aagaggaaaagggaaagaatatgaaatcgagatgatgtggcgcaccttttttgacgcggtcattatggcgaaggcgaagcgtcgctcgcttatcctgccaagggcgccgcctgtcccgccgcggagttaatgcgacggggcgagtggttcacggggcagccgttgcgcgtgcgcgagccgttcgaggaacggccgtttcgctttgagttttgaatccagcggcgggttcgggcgacgcgttgaacgggtctcgtcggggtctttatatactcgggggagagtccggtgacggttctttgctctgctacttgcctccttcttagggtttcgcgacctgagggattagccagagaaaaggaatccgcccacccagtcctttctgccgccacctcctctgcttggtg

SEQ ID NO: 9613 - DNA, 598 bp, Zea mays
tcggtacccctgcgctgttctttctgtggggagggtgagtccgcgcccgggccttaacctgggctcgggtcacggatttggcccatgcgaccgctgccccgcctgtcttcctatcagccgttggattacatccgatggaccagaatcgacagagtactgtagcactggatatttaaagcggggacaaagaaagctgtcactcaccaccgctgacgtaccacaaggattcgtaaacaaggtccagggctccaggctacacctactaatggtgttttttgtcagctaactaattactattaaattccattctatttcaatttctttactccatgaaaaaaatactattctagtttatttgatcaatttttttgaattgacctaacatagtttgaacttgcatcaaggtgcattggacaaatgcagagtttgtggcaactcatttttaactgacggtatctctgaactgtcacagaatgctaggcttggcaccagcttcccaactgataaccagtcaatgctccggtagaactagaagagagactaacccagctgcggcccgatccgagtccgggggcccaaggcgcgggaggcgacggcg

SEQ ID NO: 9614 - DNA, 563 bp, Zea mays
tcttcctataatcctatctccaggctacgtacaagtcaaaaacacagaggggaaatcggagtttccgagtcagcacaatggacaacgctccgctgcagctgccacgtcaccctctggttcctgtgtcgctcactctagaagctcaaccttaaaaaaaaccgcgagacgccgattttgctgggaggcacgaaacgactgtggtgggcgcgagcacgcagaaccagcccacagctttgccaaagcatatcagggtccccgccaccaatccggctccggctacggccgcgggtcccggatcccttcagtccatcaccacaccaggcaccagcgatgatttaaaaaggaaagcacaggcgctcaccagaatcgataaaccacagagccaccccactaactactttcaccattgtttccagaaaaatctccgcgcataatatttctctagagcaaacgctctgtcatcacacaacactagttcgtccgcacgacactcccgcagttcctcgacagggggggtttggggtttccattccaggcggttgcggttgcggttggcggcggag

SEQ ID NO: 9615 - DNA, 1500 bp, Zea mays
ttatataataggacagaatgattatgctctaaactttacgcgactgtatgcatcgttattaattaattcttagattagatgtgcgtaataatttagcactgaaattactagtagattgtgctacagcaacaggcctcgaattgtgatgtggactcgggcaacaaacatcagtctcgagaaaatttacctggttcggtgaccgtctctttccttgtcggtgatgcggactcgatgagtcgaccacgtccgggaccggaagggagctgctgcctgcaccgccgtcaaagcacggacggacggagcagactgcaccaccaaacacctcccctcccctcccaggctcccaccccccgggccccgacctacacacacaggtggtgccggggccgggcataaaaatgcctctgccttgcgtctctctcttcttcctccccaccccacgaggcgctagctgcggcacggaaccagcgccattagaggccacaagcccgcaccacgcctccctcgttctcgcgcgcgcgcacgcatgcacgaggagctgctgcagagaagaggaggcctgtcgatttgattgaactttccaagtgagtactctgcactctttccagtgtcgtctcaggttgttcttgagttctgaaccgggtttctgacgggttttgttttcgagctcgagttccgcgacactgctctaacatgtgttggaggattttggccttggtcccgtgcgcgtgcgtttcgctgcacgtagtcaacggaccaaagtggtcaggttttatcatcaagctttgcgtagggttttctcttttctacgctctctgtttcaccatccaatatttatgttcatattttttttaaaaaaaaacagcacagaacgatctagttcttcttctggtcatctgtttattacggtatcctgctcaaataaatttgtttccggtatatgaatttagaccaaaagctccacctgattgatacacagggctaagcgtggtcatttcttatatcaaccattcgctttaagcgctttactttaaccattttttttactttaacaaaaaaaagatcattaaatagcgtgtatgcaaacgtgatcaatcatttcgcaacacaggtaggattccgttggatcatattgtaccacctcgggccagagcgaacccaccggtctgtacgtcctcgttcctggctcgcgtgctacgatactcaaagtagatcagagatgcgcagttgttgtacgcttggatgccccaaatgccatgctttttttttccaagtcgtacatgaccgtctgctgtgccggacggcggaacagcaggcaccccagagatgcgcagttgttgtacgcttcgtcgcacgccgtttggcagtagcctgctagtttgggatgcgtcaccacggcccaagacatcattgtgtcttacctgctgttactaaacgccaacgtttttttttatgtatatattcctggtcctgcagattcagattcagaagctggccaag

SEQ ID NO: 9616 - DNA, 124 bp, Zea mays
gtgctagaatggcttgttacctagaggtcgttgatctaggtgtttcgagagtcactcgtgatgggatgaaaccacccaaaaatcccgcgaaacccaccacgagtgaggaaaaaaattcatttga

SEQ ID NO: 9617 - DNA, 1469 bp, Zea mays
gtgttgtggttttaaccccatgacaagtgaatttgtatgttaggatgaggtaagagggtcgttgccctgacgactttgctattaacgaatctaagaaatagagtttagactagtttatagagaacctctacatttagtatggggctaaagtctttgttgttggctttcgtgtgttataagacgcacgttggctctcgtgctcgttggatgatttaaagacactcgtgtcaataatacatatacatcaaagtttgatttataattgttcaaagacatataatatttttcactatggaaattagtagattatcgtggcttcaagcattctagaagcccttgtgttgcacatgtatataagtattcaatacataaatcagttctggtaaagagtgaattaagttaatggacgtgctgaaaatggtttggcttagtcttgttgtgttttatggaaaaattgtgtaggtcacgattacttctcaatgcaattgagaaaagttttaattgcaagccatttatggttatttattaaaaaaacaaggagtaacacgtcattgttcaaggcgccaagctaccacatcactatgattcaaagaaccacttcagattttactcaagattggaaattgaatggttttgatatttaaggttactttttaccgaaaaatattggaaacgatcagactgaaatcgacttgatctagaaattatgatagaatctcttgtttcatagcgggtccggtgggaagacaaaatgtgtaatcccgtcgatatgtgctttctaaatgctaaaaacgatccaatatacgacgtgtgctttctagcctgtttgtttgtctttaatctgtactagtttctatgttttttttctcattgaattacagctacagtagtctaaacaacagcgggctttaattcgaagcgaacaacacctgctgagtaagcaaacccacgctgaatagtttcagaaatgttttctggatgaatagcaaaattgtagtagcaacaggatagacggcgggaaagccaagtctcggttggtccggccgtccggacgcagcctgacaagggcagcagcatagcaatagcatcaggcgcaagccagcgcaggcggctttcgcttcacttagcggcaacggggacgcagcgcccgcacccaaccaacacgagctcctctcctcacccgccgcgacacgcgcgcggctccaacgcctccatctccatcgcgcgcaccaaatcgcactccgtccgccccgtcgatcgaacagccaccgctcacctctctcacccgccaaaacctcctcccctggcctcctctcatactcatatagctgagcagcccctgccacaaggtagagcatcgctcacacctgcgtcgccctgccttgccatcgcgatcgagcacctgagggatcgatcggaggccaagagctagctagcacgccggcctccgctcgccggtgccgcgcgcg

SEQ ID NO: 9618 - DNA, 76 bp, Zea mays
ggtacctgccgtggccgctgtgcatcttctaatcgtttcttccgcgtcgatcgtcggtctgctggatcgtattcgg

SEQ ID NO: 9619 - DNA, 149 bp, Zea mays
tgtgcgacttcatggaccggcagcgactcgcgatgcaggatcccgacagccagttccccggcaagctcgtgtaacacgcccgcgccggcctcgcagcgccgacgcgtcgagccggtgctatgatgaaacgtcaggattctctgcttccc

SEQ ID NO: 9620 - DNA, 1500 bp, Zea mays
tccacatgatgattttattggaatgccctttggtacaactatatgctgttatagaatagtatctttttttaacttcataatttatatatggagaaggcagccttctgataataagacttgctcccttgccactattgtcgttaagatcctctgttccagaacatgaatagcaactgcctggctggaagttgtgtcatatgcatgatgcatcttcccttaaagcctttcctggttgttaaggttgtcgtgaagcaccacactgattactgatgtcctcattcaccttcacttacaagttaaaaccaggccttgaagtctgtgttgttgattcatataatctcattttacttttaggacgccctctagataatctatcattctgatggcaaatgatgacagtcatcagtaaccatatcaaatatataggagtttctaaactgcagttataattgatttggtctcatactgctgctgccttcaaaagtcccatcgtttgtttagttttccgacctctccaccgttaccttcaattgaaacaagacattcatgtcctatgactgatcccttgacatttactctgatcccttgacatttactctgatcccttgacataacactagttaattaccaacggcggaaattgtggggatcagcatggttaatttttggttcattgttgcaattgcgggcacttaacatgcattacctatttcaaacttcattctacaaaaacaatggcatctaaagtgttgcatctcctattttatgtgattcatcaaagacggcccaacaatttgtagcgaagggatatgttttttagtagtttaattgtatggcgatcgaacgagatgcttttttaccgacttattgatgtcaaagaagtgtcgacttagtttcgtcttcgagcctaagcgagctcgagccgactggcgagcctcgcgttttcttcctttccccatttcgattttttgttccaaaccagcgccgtcagaactgaaataaacacgtgctgatacgaggcatatcagctgagaaataataatgtttgatcgacatttttttttgcaagttctggttcaaaaaaaaacatttccaaaccatatcagataataacaagtacttctacaagcctgtaagcagaaccaagacaatttctaatgttttattttatacaacacaaacacagaaagcaaaagaaagattttcgggaaaaaaaacacagaagaaagaaattccatcacagaaggcttcagatgacgcatactgggccgtaacgtcccgagcgcaagggcgtagcccaaccaacggcccatatctaaacggcgcagccccagcggaaaccctcagcgtcgccgttcagtataaagtagcgcccccaaaccctaccggcacctctctgctaacgccgctcgcgcatcctattgccctcgcgccaccgtcgccgccgctgcagcgagccaccgccctgccgtcgcctgaggtagacaccaagccaccgcc

SEQ ID NO: 9621 - DNA, 109 bp, Zea mays
tgcaggcaggctttttgcttgcttccgcgggcctcgcatgccataggctcaataacctcgccagcggatcccttccttgcgaggccggaactgagctgccgccggcgct

SEQ ID NO: 9622 - DNA, 1500 bp, Zea mays
cccctargccttatatactcgaccgtggggcagtacacgtggacatgataacaacaagtagctgaaaggtagtgaacctcttgagtttatccctacgtaaccctcgccgacttatcctcgcatggctccgttgcatgggggcttcagcgcgggaaagtcgggtctctgttgcgattcattcgttcgacgttgtgggccgtccgggtttgcaccaatccggtctcacgtcttctcttctttgttgattgtctttccccaggcccacgaaagaatgaccttacgaattattgggtccttgggcctttcgtgaggtcttttacttctttagtggacccaggggatatctatcccccacaagcccccgatctttgggttgatttagaggtaatcaactcaaagatccaaggtccaaaaaatgacttcctgctgtcttatcttgctccgatcactcgttcgaccaaagtttagttttgtgcttgtgccttagaggtcggcattttgaattgtaggattctgaacttcattgggtgcaccggaggtgcacccaatgggtgtagcccccgacctttgagtagattttagaagataatctactcgaaggtcttccccaaagattatctccattcgcgctcctgcatctcggttgaggattggtcttttcaatcttgtcccacgccttagaagtcggcactatatcggtttagaatgataatccatggggtgcaccgaaggtgcacccaatgggtgtagcccccgaccttcaaatggattttttaaggataatccgttcgaaggtcttccttttgcttgtaaaagttggcatgaagctattcgcattatgctttggaggtcagcattatgtcatccggattttgctgccgaggtcagcatatattttgtctctagcagccgagtttgcaatccatccatatcttgctaggtaatgcaatttatttgcttctgcagcttgattggacgtttgatggacgttctctgtctagtcctcacatcgcttctgtcggtcatatcttgtactttgctggctatatttggctttcctctgatccttactgatatctcatttttgtcttgaggtatttactgcgtgccctgcacggatgtgaccgttttgaaaaatatactgataattcctgggcgtccccccccaatgggtgtgggcaagggacggcttggtacgctgagtgttttagccggctacttctgagtagtaatgtgatgggacggctagtgtaatcatatcctttgcgctgttgactggagtcccaatgggtgtagtgttgcatgaaacggcgtccgccgtctgacgtgtcttcagatgggtgggagtgcttattgaatgctttgcgactgttcagtgaccgcggttggaagtgagcggttgcctttcctttctataaataacgcccttgctcctctggttttttcacatcctttgctgttctctgtttcttccctttcttctctcccaaagcttcaacc

SEQ ID NO: 9623 - DNA, 340 bp, Zea mays
agtgcatgggcaaaccggtaaccggccacagccggtctaccctgttcccctacaaaaacctcccgcacgcatctacctcccagtctcccacccaccagacgaccccccttgcattctcagtttctcacgcccctgcgctgtcccgtcgcgagatagataaccctagctcccttccattgcttgccctcttccccaacctctctccagatctctataaaagaccagaatttcgaattccccctcgaacccgtgacacgcgcgctcctttcccgcccatttaggcctctgattcggcgcggattcgcggcgcggagccgccgaggttgcgtgcgtgattggg

SEQ ID NO: 9624 - DNA, 94 bp, Zea mays
ggtacgtaccagctgctgcatgtccaggccttcttaaggccaactttcttgtgtttgtcgaaacttaggctgtgcttgggagagttgagctcac

SEQ ID NO: 9625 - DNA, 1500 bp, Zea mays
cggagtgcgatggtgaacctcgccccacttcccccctcctgcaactgcaagcgccgcagcaacctgtggtttgcttttcctccacagtgcgccgggattactaggtaggagcggtggctgcaaaggcttttccctgcaacgatgaccaggtttatagaggtaggcgaagctggttggcatcccgcagagcccggcggcggttggagctgtttgacgagtcgcgtgaagcgctaaaatcgcgcggcacacacggagaagctgctacgagcgctgaccgggaagatctacaggactccgtctgacgagcgggaccgcggtgcagcgaaacacgcgagccgcgcgtagaaaccagagaggcagacggcgggccccgcctgtcgggtacgtgagcgcggaagaagtggcgtgggctgcgtagagggaaatgggtagtgggccgagtaggatagccgctggcccatacgaggttttgtccttttcttttatttattcattttttttcctatttcctttcctccctttccaattcaaatttaatcctagtttaaacttaaacttatgacaaacttatcctaaaattatattgtgagattagaagtaataattttaaaaatataactatacatatattatttatatttttatatcctttcttttcctctcctttttcctcaaatcctcttcattattattttatttttattcatattactattgttttaaatgcacaaacaaaaatccaatattatgcaatggtttatttgtgtctcagtaatgatttactcatttttacacatgagtagccacatgtgatgataaatagagattcacacacatataaaggagagcagttttctacttttgttcttacttacactttgggtattacatgtaaacagaggaggccatatctagagatggcaacgggtacaaacccgctgggttttgccgtcccaaacccgtacccgtgaaaaatatctgtgcccattaaaaaacccgtacccgtgacgggtttgagattttgcccmaacccatacccatcgggttaacgggtacccatgggttacccgcgggtttcatctccaatataattatcttctcataatcaataagtatcgtaatgattaatgatatcatgatccaaaatctatgtaatgaacaacgagttcatgatttggtataaaattattagtagagagaatgaaatacaaataataagttgtataattaagtgaccttgcactaagttatccatccaccacatatataacgctagtaaaaactataatagcaagcaagcaacactctcaccgattactgatacattgaccgattgataaaaaattacgaagtaaataaggaataacaagtttgttgttcgtttataaaataaaatgacaatatgcactaggtttggtcgggtttaaaaaacccacgggttcacgggtttgggtactataggaacaaacccgtacccataaacccgtcgggtatagattt

SEQ ID NO: 9626 - DNA, 1500 bp, Zea mays
gtttaagctttttagttgaactggttagtatttccactctaacatggtatcaaagccggtggtctcgagtttgaatcctagcagaggctttctttgtgcctccacccatttattttcacgtttacatctttctctctggctgcacgtgagtgggagtgttgaagtgtataagtggattgactaccttcttccattagcttaagtttttgagttgaacgtgttagtgcgttcactctaataatattaatgatcggagagagtacattattagcatgtaggtggcttctagccgtttcggcttaaccaattttttgtgtgattcagaaagttgacctatctttggaggtccttgtatctaattatgcccctttcggtttactatggcatgtgttgctgacctctgtacgccacacatctgccaaatgtatcctgtgttttttcccttccaaccttgtgatttggatttcttgaattcaagatttctgaaacttctagctttgttttcatcagacgaagatttcttaacttgcatatttatgaacatcaccctaagataagcacaatcattatggttgcaccgccaatgttataattatattagattgtacaaaggcacctgatatttacattttattatcctaatatataaaaaatcttataattatattaaattgtacaaagacacctgatatttacattttattatcctaatttattagattgcagaaagacacttgattttatcaatactggaccatgaaacctttcagtttgccccctgcctctgcccctcattaaacaggtgaaaccgcgattgccatacttggatatcatccgacttgttctggataattcagccctaccaattgctgcttgcctggtcatttcattggctcacacactcagttttgaaatcttccccttggttggtcaaaatgtccatgttctttgtttgaagtggaagtatggtgccaactgccaatgctattggtctatccaatcgtctatcatctagcattggcactgtgctgcatatcaaaattctgtctttacaattgctggacaccagctggcttttcaatcacgtattcattatcttagaacctctcttgttatcttttcccggtcagattgcaggtgttgcgatggattgcggtccccccatcccccactagcataatagctagccaagtactgtactacggattgctgatttccctgccccgtcatgataccttgcagcatggagtactggcctgacccacagcgggggatcaaggaagcatacagggtcttgaggctcgttgggctagctagcttacgtgattggcccgatgtacccacccttctggctaccccgcttcttcgccgacatgtgggtgctcttccccaaggaggaagagtacatcgagtcgttcaagaaggctgggtttaaggatgtcaagctgaaaaaggatcggaccgaagtggtaccgtggtgtctgaaggcatggcctcatc

SEQ ID NO: 9627 - DNA, 960 bp, Zea mays
ccgttcatcctacgggccagagcgtccgcatgcccatttgaggactcaacacggaagctttggaaaatagcaatcgccaataatgttagcactatccccgttctatctgctatcacaattctctatgctggcagagcaggtgacccctggcccttccgattcctcattcctgcacatacatggtccgcaacggaggcgcccggagtcttctttctttgcgaactgcaatgttgagagacattccgtacgtgtacgtggacctcccgggggccagggccagggccagggggctcccccaatgcaactacagccgttgaacgatcctttaatttttcccgggaatagtggtagctttttgtagttaaattattcggtcaatcaatcggggcccattccctcctccggcggagcccggccattcccaagtcccactcgagttcacttcctcccagcttccttcacttcaccaccccacgcacgaattactcgcttcccccgcgtccattttttgtatccgcacgggtcgcggctgcggaccccatccgccaagtcatcacctaccctctccctccatcgctcgctctcgcagtctcgcttacatataagggctgcgcgcacgacgttccccccggccgcagactggacagcccaccacactctttcactcccctcccccgccccgccaccgatccccaccgccgaacaaccgacgggtgctgctgctcctgctcctgccgccacctgctacgtagcatacgcggacggacgtaccaccaaacccccaccgaactagctgccggtccatcgcgctacgccgctacctacgacgatcgggcaagcgaagcgcgcgagttcgacgtcgtcgtcctctggcatcatctctatccgccgtcctgtggtatcgtcagcagcaccggtgtcgtcgtcgtcgatcgtttccggttgtgaggagaggcggcg

SEQ ID NO: 9628 - DNA, 939 bp, Zea mays
tgaatgctatgttaacattattatacctttgatgaaaatatattatattctccatttcagaaacatataagcctgtgattttgtaatcattcaaaattttacaaaatagtgctatccgcaattatagactataccaaaagaaaggtacaataaaaataaaacgatgtgcatagcaacgtcgtgcgaaaattctagttagcattctatagcccgaaagatgcaaatgcattgtactgcatgtctgcctatttcacagcaacgaagcccagttactcccttaccacaatcatgcaattggtgtggtgcatcaagacaagggactctcctagccctagtgacagagggttctagggcctctcattagcccctttggaagggagtctcctcgtgtatgtaccaagaaagcctcaagaaggttcacctaggcgagaccatgcagtgacaaataacaccatgtagttaagcatcatgctacatgcatagaagtaagagggagtggttgtgacactattgacaccctcctacatgacaaatgagttcctaaagatgctaagacaaaagaaccaaaatcaccatatagagaagccctagattcaaatccctaagacaaaagaaccataatcaccatatagagaagccctaggttcaaatctacacgacttgtatacctcgtttccttcttaatatagaagtaaacaaatgtataataaatttgtctcgtatatgtaattgctttataataattagattatatatttaaatattcgatgtgatatatgctaaataagtgggtggaaacacccttatacgttgccctcgctgcgccgcgtctgcgttctgtctgtcttcacttatccgaggttccgtgcagcagtggaaaagagcagattttagcagagcagcgagggtcggagaagcctccccaagcttcgaatcgct

SEQ ID NO: 9629 - DNA, 1500 bp, Zea mays
catgtttggttcgtgactaaatgtgacacgctttgtctaagagtagtcgttcgaattaaataactaatcttagagttagacaaagtgtgataaattaggtagtgagccaaacgctgcatcttccccgcctttccggcattcaggttcgctattgccatcgcgtgaaaaagatgatatcgacctggcaagatgcacgggacgggagtgcccgtgcgagcgcaggcggcacaggactcctgatgagcgtgggcagagattgccccaaatatctcgtgtcattgtcgaatccaaatggatgccatgccatgccatgctcacaactcacaagggcgacctggttttgttttgctatcatggtgacggggcggggcgaggggtgaaacctttcgctccttgcaagttccgtggtctccgcggttggaccaaggcggggtcagggtcagggtcacgcccttggatccaactccaaccgtacgccgccgccgcttttgccgacaattgtacacactggtaccggggcgcgggtgcatcacctgatgacgtttcttctcctgctgcaaatcactgggcaatggcacgggctcggacatcatgcaatgcaaccacctgctcctgacgctgcagtcaatagctgtggttgccaaacactagtcaccagttcaccaccccgacccagacagaggttggttagctcgacacctaaaaaatcatacgtacggagtatggtagtagattggtagtagaaccgtcgtgctgacacccagtcactgcaagtgcaaacacatcacaagtcttgcgttgtccccttgtacaaacccaaaggctgatgatgctccgactccgagagacgaggcggcagccgggcaaccatcccatcccactcccagcaccaccagagtggtggggccttgtctcttctcctctcccactcttcgacacagccagagccagccacggccaagtcctttctctccccttccctcttctgcctactctccaactccaggcgcgattcgaagcatacaacacctccaccgcttctcaactcccctctgcgccctcgcctcttctcttttgttttacctgctgcggaatgcggtccacgactatggatcttcgagagattacttaaaaaaacacacacacacaaatcttgcagcagcctccacacctgggattctcctccatagcgtgtgccgtcagccgtgtactactggcctccacggctccacccgcctttggttggattcctgttgccgcttcctcctcccgtgatcggccgcattgcgctgagggattctcgttcgctttttcccgacgccgcctgcggcagcggtactatttactgctccgctctttcggcggtttcttcgtctgctgccttcccagtttgctagctcttatccggaatggatgccggagcggggggagctatatgagtgattccttctccttcccgtctcttggattgcctccgttttggttctttggtgggcggcc

SEQ ID NO: 9630 - DNA, 639 bp, Zea mays
tgcaggatcatggcgaccacggcctttgcctcgatcattgcgaagttctgaccgatgcacgaccttggcccgctggagaaggacagcagcgcgttggggtgcttggccgccctcgtcaccccgttctcgaacctctccggcctgaactcgccggcgtcctcgccccagacctccttgtcgcggtggatcgtggcgatcggaatggtcaggatcgcgccctcgggtacccggatgccgccgaggtcgagatctgagcccgccttcctctggatcagggacaccgggccgtacagcctcagggtctccaggaggaacatgttgacaagcttcagcctgttgagggcgtcgccggtggggacctcgtcgtcgccgcactcccgccggacctcgtcccgtagcctgtgctgccactccgggtgcgtgctcagcaggaaggaggcccaggtgagcaggtgcgacgtggtgtcgtggccggcgaagaagaaggtcttgcactcgtcgacgatctcgtccatgctcagcgtggtcggcgccatctcgccatggtgctccggtggcggcgcgcacgcctccagcatgagcccgagcaggtcgttcccgtagccgccggcggtgtccttgctggcgaggcgggcctcg

SEQ ID NO: 9631 - DNA, 512 bp, Zea mays
tggtcgctagcgaggccgcaagagcggacgggggtgcggcctcgcgccacggcgcccactttgccgggcgcgcccacgtgcccgcgccagcagccacacgtacggccgcgcgccgccgtggccgtggccgtgccggcccgctagctactcgctctcgctccgctccccccacttaccgtccgcccaggtaacggagcatccggtcggttacgtgtacgcgctagcgtactctactccgtgtacccgcgagcccggccgctgctactatattatggccggccgtggcgtggcctcgctattagccagcgagctgaggcctgaggagcgagcacagccgagtcacccggccggccgcccgcacgcacggacaccaacaactcccttggacgcacccgatcgaccctgctgcctgctagccgtgcgcagtagtgggagcgagcacgagtgagagtgggcagcgagaacatacgccgcccccggccggtgtgactggtggtggcgtcgcgcgcgcg

SEQ ID NO: 9632 - DNA, 400 bp, Zea mays
gtaacggtacaaagctgccagttttggcaccgtgtttactactaccatttttgccatgctcttaaaaccacaggcaaatgcacgcattcgatacagccaggaatgacagaaaatccaacgcaaagccaccacaagattcaagacatttttggcaatggtaatgtcatgcggggccaccgcggcggtggtccttctacagtcgggcgcggaccacgccacgccacctgaggcgcctccgccgctccaccaaccctctcctcgtcttccatatagatatagtcagagcctcagaggtgaagcatccgactaaaaagggccagggccagggccttcgcttgcttactactcctgcttaccacactctaccttgtctcttcacgtgcacacgacgcctccccca

SEQ ID NO: 9633 - DNA, 162 bp, Zea mays
ggtttgctcaggcgtctgtgccatttcctttcagcccattttactgcctcaacgcttatacttgtttgccttgccttgtagtatgtttcttctttcacagccaaggccggctcggagggcaacctgcatggcttaagggagctccagttgctcacgttcggg

SEQ ID NO: 9634 - DNA, 633 bp, Zea mays
cagctgcttatgtttcctttttcgtgtttctttttttttttgaaaaatcatgtgcacctactcctatactctgctccactcgtcctcataaaacataaaggaaagaactattccaacattcaaatttgtcttgagttataagagataaagtgtaatcctttttaaaaccgagtttaaaaaatgattagatcggcatacatatataaccaaagtatcaagtatggttatatcacgaatgtcttcctatgatcaagaggtagttaaatacatcatttgtttcgcgccctagaatttctaaagacaccttgtgttccacaaacaacaaggaggcaagacattagggccaattttagctcacctgcgtctctcaaatgctgctatgctaatgtttcgaaagattctactgaaaatgatggtgtagacagcccgtgtgctcccaccatttcggcctcgcaacgctggctgctcacagtataaattcccgctggccgccgtcgcctcccgctacccgcctcacctttcctcgcctacgcctacccccaccacctgtcaccccaatccaattccaagctgcgagctgtcgagctgctgcacctcccctctctcgctagtcgcttccattcccttcgtcac

SEQ ID NO: 9635 - DNA, 67 bp, Zea mays
ggtcagtaatggcgcctccatctttttcggcaactttgggggcgccaatgacgccggggctggagcg

SEQ ID NO: 9636 - DNA, 375 bp, Zea mays
actgcactgcactgcgcgcttgcatgctcaacccaagctccccggcgcgcgcggcctcgatggcgactggtcggggcgggaccgcgggagcgggcgcgggcctttataaaatggcacgtcgtgctcgcagccaggcagccagccacgcagcaggagcagcagcagcagatctggcaggagctagtgatcactgacagtgacaggtcagggcatcgctgcctgccgtcacgtactacaagacactacggtatgggggtgcagagtgaaccgccgcttcgattctgacctgttgcctccttggacactccgcagattgacatggcggagaacaacgtcgtggccacgtactactacccgacggcagcgccggcggcc

SEQ ID NO: 9637 - DNA, 263 bp, Zea mays
gcatacgccagtaccgctttctttcgacacggaaatgctcagtacagaattcaactaaaatcgccgcaagttttttgtttgtttgtttgtatatcctgaatattcacacagtttttctttaacaatcttccctccaatttatacaacaacgacctcttcggctcgccaacattaggtccagtccaccccctccagccaacccaagtctccatccacaagagctcgagaacctggccacgagcccatgacggcaagaagcggtc

SEQ ID NO: 9638 - DNA, 258 bp, Zea mays
cgtgcgtgccggtgcctctgcctcctcccaccccttctcacgacctccctccgggcaggacaccataacaacgaccgcccggccgcagccactgctctctctctgtctctgtctctgtctcaacaacccgccgctaccgccacccgcacgttcaactaccaactgatcgagggggcgcgccggttgatcgggagcagatcgctcgctactgggacatagctagctagcttgtagtcgctcgctgcgcgtcccgccgcc

SEQ ID NO: 9639 - DNA, 458 bp, Zea mays
ggtttggttcgtgttcagtcacttctctgctgcagctgcacacactacagcatctactagtgtgcagtgcttgactactactagtacattgcttgcgataacatgcaattttgtcgttatttggctaatggaaaaaatatatatagattatatcttgagttgtcgtttttttattcttctgccactagtttatatatggcaattctaaattttgtgtgaaaatttaaaacgcctgaaacatagcaaactccccgctttaaaaccaccccaggagttgccgtctgatctgttagaagttcagtactgctacaaaaatttatggctgctctgctacatatttccaagggcaacaggatctcatcaaatttccaagcaacgacatgaaccggtgayaggagcagtaagcgtggatcgcgaccggctgcgacgtcgacgcgcgccgggcggaggtggaggag

SEQ ID NO: 9640 - DNA, 571 bp, Zea mays
ctccgagctttattttttcttgttttgttttgttttcttggtaggagtaacaatagtttctggcagccttcttcctcctcgctctctacccgaggagagaggagaggagagaaatccggaggcaaagcttcaggtaaacatgacgcccctctcgcctgtgctctccaccccttatgtagctcagatctgtccctgttcttgcacgggttcgtcgtacctatttacgtgcctgtgcctgtgccttgctgaaagatttggttttttttggcaaggccagtggccacagatctccccaacgctggtctcatgtctaaataacatgctttctcgcacaaatctgtctgaagattcgtcatttttttgcccctcctcctgttttgtcctctccaaactcagatctgcacaactgctgaagaaacatctcaactttactcttcttcctgcccgctcaactgacgcacctaaccagttcttgcgtcgtccttttgttcctgcagggtttgtataaagggattctagatctaatcgactaaccagagagaaaaaaaaacaaaaaataacgcgagaaagc

SEQ ID NO: 9641 - DNA, 114 bp, Zea mays
gatgagaggtttaggagggagagatttgacaagccggatgtgaggcagtggaacaagcaggagaattggggaaggaacacagggaaggaagcaggggaatcatcggtgccaaag

SEQ ID NO: 9642 - DNA, 61 bp, Zea mays
aggatactttgtgattcgtgcatgtcatagttattacaattgcctaatttaatttctgcta

SEQ ID NO: 9643 - DNA, 1136 bp, Zea mays
ctctttggtgattttttctgggtgggtcttcgacatcgctataagaaaccccaagtcttctcttcatcaagactcagctttatctcagcagcagccttcttagcagcttcagacatcttcggaaacactaaaaactgttttcaaggccgaagcttcaaaactaaaagctcagcaaattttagtccaagagctaaaaattgagtgagcagaaacaaatggcaagaaagcgtgccaaatgagtttgcggtatgactgtatttatacgctcggtgcgttgaaaactgaaagaccccacttgtcattgaatgttgctattctagcaaagggaaggtgttttttcggaccttcggcgtaaagccttcgtccatatcgcaatctaaatttattatttcgaacaaattaatattgcgaggggctactgttggggaccttcggcatccgaaggtcctcaaaaacaggatttaacagtatttctagagtacaatgtgtgaacaggtatcctcgaactaaagtcggcattgcagtagaccagaataatacgaaggttgatgcagcgccgaaggtgtgagcaggaaagcttcggcgtgacagcaaagagtggaaccgacttaaagatgaaaaggctattcagacctcgatagactactataagattatcatcaaatgtaaagggcataagtgtaattttacatgggctgcgtcccgtgcctataaatagttgaacagtactcccgtactgttcacgctgacttggcattcactttttgcgtcacgcttgtattgtcattacctctcgattaaaggtacacttgtaattcaataatatttctgtttatgcccgattataatatataatcgttcatgttgtccctcatatcttttacatttcctccttcgtcgttgtttaatgagttcatgaaggtacgtccttcatgaccttcgtccgtaaaccattatatcctaagggaaataatgtttcgaaggacgaaggactttaacgactaacattttttatgttgccttgttcttaactcatagcacttgagaacaagtccccaacattggcgcccacctccggtgaactcacttccatttcttgagccttttgaacatcttcggcaagcatcaccttcgtc

SEQ ID NO: 9644 - DNA, 114 bp, Zea mays; identical to SEQ ID NO: 9641

SEQ ID NO: 9645 - DNA, 61 bp, Zea mays; identical to SEQ ID NO: 9642

SEQ ID NO: 9646 - DNA, 132 bp, Zea mays
ccgccgccctgcccgtctccttcctgtcgtctccccttctccatcgcttcccgatcccagccaatatctcagacggaatcgatccaaagctatcctagggttccgccgtcccgtccagatccgggctcgtcg

SEQ ID NO: 9647 - DNA, 148 bp, Zea mays
tagggatccctaaagcccgattccttggtcacagtgttgtacggagtactgttgttgccaatcctgttttaagataattgaacttttgtcactcacaatgtcttcttgttatgtatataaactgtgagtccagttggttctataaaat

SEQ ID NO: 9648 - DNA, 898 bp, Zea mays
cctaattaatatgtctattgcatattgaatttcagtaactgttctatttgccgaaaaaactttttaaaactaaattattgaaaaaactatttgtgacaaacaatcatgttttaaaataactttacgtataaatatatattacataaatatatagagagagatgagagcctttatgtttgctttcacttaggttcctaaaatgtcaggaccggtcctgcataaggttaccaaaaatactatttcatattatggaccatattgtttatagagtggaatatgaatatgaatatgagaatgggtaaagctgcgctgaaaatgggtaaacatgatgagctgttggaactgacgtgtacaacagagaggtcgaggtggcccgaccccgaccccgaccggtggactgtggtctgtggaacaagacgtgccgacgctgtgtgagtgtggcatcaatgacgtcgtcgtctttcgtgtgtgtcatcgacgtccagcgatcaactgccaaccaactcaattgacctgagcaatttaagcacaggttgttctaaatgcagtccaagcgtggccatggccatcaagccggcgccgtccataataatcacgctcgttaacggtacaacctagctgctggtggtgctagctgtggtatcgtgctgataggaccactgtacatactgtcgggtgaaaagaaaaacagcaagctctcaagctacaagtgtacaactttgaaccatacgtacatctgtttagcaatctgcagtggcagttgggagctagctggctgcctgcctataaatgagcgacaaactgagcagctatatatatagctccgaccaccaccacaccaacaccaactcgaccggtctgctagtgttggagagaagagaatacactacagtactac

SEQ ID NO: 9649 - DNA, 1073 bp, Zea mays
ggtaaactagttactagtacttgacattgccactgtattttttgtaattactagtaccatttgatgagaagtggtactgagttttatgtgggtagacgaacgatgtcatcgcactcccttctcagtgtcaacgatcatgggtggcatgacctgtgggctgtggagggcggtcccggtccccttcgtttggcttatctggaaaatgctggttgcgcgtcaaggccatcttgaaccttggaaaaacgctgctgtgtctatctttcctgccttcctggttccgtccgtgctgtgctgacatgcgtgtcgaattctcgctcatttggttaccggtagtggggtcatgtcggatattgatgtggaagggggagttggtagtggcaccccctccgcctcggacctggcttcttctgataccggctctggagctgggtaatagagcgcagactttgggtctggaaagcgattgtggttatcgttacgacaagtatgctaggtcaaaactgtttttgtatgtagttggttcacagatgccaagggccgatttatttgtttgtttgttgctcatgttgatgttctgagcataccatttttcagatgtttatatttcatatctgataaagtttataagtttattgtcgtcattaagatgggttaagaaggatgcctgctgtgttttaggatgaggctccatttggaagtcaatagtgcaacactgctcattccaatgatatacccccactacaaacagacacttggtcataattggctttcgcacattcatattcaatgtctcaaacttgttattacgattctgcggatggtctgacaaaaccctgggcatagtgtgattattgacactaatattagttccaaagcatttcattgagtaaaaagaaataatcattctcaatatgtccaggtgcatatttctgaattttcttgctcactagttgtctgtatccatcctctaggttttattgtttactgacctttaccagattgtcccacagactcgcagaactataggatatcacagaacagttcttgaggtacttattgcagcctaatagtac

SEQ ID NO: 9650 - DNA, 702 bp, Zea mays
tagaggacattcttgtcatggatgtctaaatataacgtcaaaagtaatgcatacacgagtataataccttttccatccatagaagaatataattacatgtaactctaattaattttatattaaataatatgaacatgtatttctcaaattatattttatataaaaatatatttcataaccaatttaatagtataaaatatgccatggatgttgttaacatacttttgtacaatattagtcgaatgtcgaatcgtttctcgagaagcattctagatagactgctagtacatacggagtattatctattaaactacgcttggatcggagacaatcccgggttctccgaaaccaatcatcggcacaccaaacgcggccacgcgcccaattcagcccggcaaaagacacgacgtgacgttgtccatatccaacacggcaaagcaccccgggcatggactcagggagggagggccgacctggtcgttacccgtagtcgccaaagcacgtcagcttgacgcggacgcatgtggatggctgccgtatccgcgagtccgtgcttccctgctcccggctatataaacaagagaggaggagcgcacagatacgcgcagtcttcttcagaattccctgatcacgttccaggcagctgagagcccgcgtactagccggacaggaggcgacagcgacaccgcgagacgtgccatc

SEQ ID NO: 9651 - DNA, 191 bp, Zea mays
ggtaagtctccgtccgtgccctgattcggccggcaaccggtactaactcaccccgccgctgccttcagtttcagcgagttctttctttatgcattgcgcccgtggtctgcaatcctgcttaacactgttacaattgcacaccaatttgttttcccaggatagtcaggaagctaattaacagtgttcgaaag

SEQ ID NO: 9652 - DNA, 349 bp, Zea mays
ccccccccccccccccccccttcggtcttcataagcgggtttaggggcttgtcggcaggttttgtcaccgagcgctttggcatccgtaatttcaggccgcttgtcctttcttgcgttttccttccttccctttcgtttccgaaaccccgcaccttccccatttcatttcccccgcagagtagtagttttttactggaatttgtaccggaaccagggcttaatggatgctgtttgcttgttagttcagcttcaccaatttctcaacagtgtgtttgttcttctccaggacagtagaaaggaaaggagaaaagcttgttgtgtctgtgtgtgagctgcagaccccgagagg

SEQ ID NO: 9653 - DNA, 433 bp, Zea mays
ctgctgcgtcgtcggaggcggcttgtcgtgtagaaggccgcccaccccgcccgtgctaggtgaggcgcgcgccgggccacgcgccggctgtggccgcgcgcgggctgccccgctcccggcacacgctcaaaattaaaatccatttttttctcctccatctatttattttattgttacatgtatgtctagaaggaacaatatagtccaattaacaaagacaataaggttatcgaccatatatccagtaggcgtgacagcgtggcatgcaaagtgccagcgcggcaccacctttccatcctttattattatatagagcggctgcaaatataatgcaatccccagcagcagcattgccaacacgccctgtaagagctgatcagcactcaacaagcgatcgatcaagcggaggcggaggaccagcagtaggagtaga

SEQ ID NO: 9654 - DNA, 108 bp, Zea mays
cctatttaacaaagttgtaattgttcatttcttattatctcgccttccacccttcaaatacctgccgcaactcgacccccatcccacgccgcctccgactccggcrag

SEQ ID NO: 9655 - DNA, 774 bp, Zea mays
ctgagctcttttttcctaaaaaaatagttttgactggggattccttctccagggcctcaacagtaatgtctggccaagaaacatcggttcaacatatcttctatagctgcccctacggctggacttccatctcaagctactgcaaatcaacaaggaaccagtggtattcaaggagcagcttcttctactgacagtaaattcagtggcaggaaagaacttccagcggtatgtcatactcgtatatgattagctgtgttttgcgtcttctaacattaatgagcattttatcaattgaatataatgtcacttagtggacttttatttgacaagcactatatatgttatgaggtagttcagtgaaatcatggtctacgttggattccagttgaaaatgggtagccaccatacagattcatggttttgttttgatgtgtttgaacacattatcttgtgtggctgactaattatatggaatgaacctttggtttctgtaaatttatgatttgaatgccataaatgtcgttaaggtttccatacttgtcacctgtcagttgttctcatgggctttcatttgcaagatcattacctattatcaattgaagacaactgtacaagtttcttatcttcaattctctgaagaatgttttggaaagaatgacatgctgatggatctgagactatgccttccaacgaagtcatttgcatgagcatatttgacacggacaaaacttattgcaggatatctttactgcactatatccaccatcaactcca

SEQ ID NO: 9656 - DNA, 442 bp, Zea mays
ggttgactggtgtggacctcacgagtcatgagcaagaacgcaactactctccccagctgcctgtacagcagaactaaaaattggccacaattgcaagccaaacacagcgctccaaattcttttcccatcactgacgacgagaggtggaggttctggccggagcagctgagaggtgcataaaaaatattgtaaaaaaataatcctccactgctagattggctattgggcaagagagagcggagaggggaagggaaggaggcataattccactcacactggccaaccacagggcacagggtagcattctctctcttcgtcctcaagaaatccagcggaagctcatcttcttcaccctcccttctctccacatctcccttcggactactactgcatccaaggagcaaagaattgtggggggtagcaaaggaattggaggtcttgc

SEQ ID NO: 9657 - DNA, 965 bp, Zea mays
ggtaggcagaatagggaccgacggacatggtccgacgaggcatcgtcggcggcgttgagagcgagagtgtgggaaggtgccgagacagagtgtggagaggaaggagagcgcggccgtgagattcaccaaaagttagggtcttagctcttggccacgcccatccacgcctggcacttgcgcgcccgcctggtgggctttcctttgcctggcggactgcggaggtaagaggtggcgccatctgccatgccctgctgcgacggagctgctgcatcacggtggcttggcgagacgacctaaccctagccgagatgtgagaggatgaagagagggagatgaggcctcggtactcgccgccggcaactgttcggctacggtaattggtggaggcagatggagaacgatttttgggattcatgagggagcgttgggagatgggatcgccgattgtgggtagtagcgacgtcgcgcaggtggatgagggagaggttgcgtctgtggtggggtgggagaaccggagaagcagccaacgcacgcgtccgtgggagcggagggaggagacgctgagaagagggaatgggaatggcagaacaggaaatggtagaaccaggaatgacagcctaccccttgctaccttaataagtagtagagattgtaaccctgattctaccaatggttatcatattactatcctctagcaaaggtgtctaacaagtagatggttcttgtatttgcacaatgtttcctaccatgaaatttatggtttcagtgtttttttttcctgaaacgtgcaggaagctgtttgttgttgtattaataggtagaaaaaacaacggtttgagtacatgtcaatcccactgcttgccctccaagccatgcacttgtatggctcagtacatatcatcaaatattcccagtatatattaatcttcttacaaatagcattaaactctacattgtatctgcag

SEQ ID NO: 9658 - DNA, 199 bp, Zea mays
ctcagtctagtggtggtcgacgtctaaccttttaactagataggaacgagggatgtgttcctctgtacttttctgggaagcaaaaataccgtgctaataattcaagcagacagctaacttgattatgtaacatcaggccctgctttggcgagggtgatctgctggggtatctttcttgcccttgcttcaaacaggaagc

SEQ ID NO: 9659 - DNA, 169 bp, Zea mays
gaatgctctgagcgaagcgagcctgtatgtgtaacgccgactcggaacaaacggtgaagatttagaagggacattctaatcgctgccaacgttgacgatccatataagtagtagatagccgatgccctgctccttttttttacgaggcgatggatggtaaatttgtagc

SEQ ID NO: 9660 - DNA, 1500 bp, Zea mays
gactttttttatgttatatcttctcgtgcagaaactagaggaaaaaaattatgtacataccgaatgtaaatattatcttttacagctcctcacacccaccactcagaggtccacaaacacatatcaaaatttacaaaataactctttagtaatttgtttttcttccatttatatgaaccagtagctggtgtatatgaggggctgtaaaaaagattctttatatctagtatgtaaatatttttttttccaaactagaaaggggtggaaagccaccctttcactctcacccgtcgtgcccaggcttcagttttatcgaggctctttaggatttgtttgggtaatctcagattagagtgtattgaggtggtatgtggtgtattgaagtgtaatataaactaaattttcttttaatcaccttcaatacaccttaatcaacttcaatccctctgtacccaaacaaagccttacagtgccgaccacgtttccccggtggtcggtggacgaagctgcagctgcaggtcaaacgcgctgacatttcacggcgcgcacgcctcgctgttcctgttcataccgcctggctttggcatttcttcatcgctctcgcgcggcgtgctaaacaagctttgtagctagtagatcgcagggtgaaaaatgtggggatccaatgttggtaggcggcgcgtcaggtgatggctgaggaggaggggcggtggccatggcgtggaagcttctccttgtgcttgcgagcgaggaagagagagagagagagacccacggacgagaaggaaaggaatgtcgtcggggcggaaaaggcagagcggacgccggacggaggcgcagcgctcgcgagcaagcaaagcccggaaaggaaccgcaccgttgccgtgcttgctgtgccttggatcccgaaaccgagagggctggcacggaactcaactcaaccaccgtcagacacgagacgtgactgccatggatgcccactccctttttcgttatcgtactactagtacagtagagattcaaattactgccggtcaaacgcaaagacaataattactaggaacaaaattattaataagtatttgactggatccagagtatttgactgcggccttgtcggagcagagaagactgctggtggtgctagtactccagaggctccacaaagagcggaaaaaagtttttattttgtgaggaggagaaaagctgaatgaataggccggcgggcacgagcatggcagttgatgagagtttggacggggttgagtccatttcacgccaccgccgctgcacctataaaacggcggagccgacgcccccctgttttccgctcctccccacgacgacgagaatccccccatcccccaccaggccacaaaaaccaggtcgccgatgccgcctaccgtctgacatcgatcacccaggcagatcgcgcgcaagccacccaaacaaatccaaaaccgaatcctgatccgatcccgtcgatcggcggcggcggcg

SEQ ID NO: 9661 - DNA, 1174 bp, Zea mays
ctgcgacagtcatttgtaaacaatgtatcctgttcgtcgtggcttatttagaaacgacttctacttttttacgatatttggtctctataaattgcagctgcaacagtctggacagctagcttaaagccagttttataggaaatattgtgaatgtatgctcaaatataacaactaatagccataatcgtgacttgatgatggagatcaccatgcatgataaaagagtcatactatcttgcatttaataggattatctatgatgttttatttttcagttttgttccatgttaaatgttgatagggtaggttcgctctgaagaatcaaaagtttattttgacgtccttacaattgttgtgtctataaatattataataatcagttggtagatctattaaagcaaagtaactttgattattttaatctaacatggtatatattggacatttatatgcatagtgttggtttgcttaacgaggctatcaaatcagatttgaccatttaagccttggacacgatgttgaaaccgaggcattgggagaatcttttgttaaatatgaatctttcttttgttaaattttgtgttaggagataactccattcttgtgtcagggttctttcgctcatgaaagagcatgctaataacatgtagatggaatgtcgcaaaggcatagagaatgatcattgcatatttatatacggtgaatggatgacaacgcatccctttagaagagagagatgaaaaggctataagctgtagatcttgttattcttcaccgctagatgcttacgatatttttttactgtatataaattgatgatgtggacgataacgtggaagtaatctatctcttcctttatttcttaacattatttgcgccctttccttcaaaaggcctactgggatcatattttgtgcagactcaaaatagcgatgctccggccagagtccgctccaaatggtccaacgaccacgtgagtcgcgctcgcgccaagaagagaagccactcctacgtggacgaacatcaaacgtggagatcattgataggtcttcacacgcgtccgtctcttcgcgaggacccagcccaggctttaaatctcagcaccacggcgaaacccgatggctagtcgccactcgccactgccgtttgatccctcccgctcccccgctccgcc

SEQ ID NO: 9662 - DNA, 505 bp, Zea mays
gtcctaaatccactccaaacaactagtgactagagagagagagagttttgctcgtgttctttgagctcttgttcttggatcgctttgttcttccccattcttgttctcaagacacttgtaatcaaagcaagagacatcaagttatggtgatccttgtaggggtctaagtgacccatttgattaaggagaaagctcactcggtctaggtgaccgtttgagagtgggaaagggttaaaagagacccggtctttgtgaccacctcaacagggactaggttctcaagaactgaacctcggtaaaacaaatcaccgtgtcatccactatatttctttggttgatttgttttcccctctctttcgggctcagatttatttctaacgctaaccccgatttgtaattgtgctttaagtttgtagatttcagttttcgcctattcaccccctctaggcgactttcaattggtatcggagcccgatgcttcattagagtttaacaactcgaagtg

SEQ ID NO: 9663 - DNA, 1037 bp, Zea mays
cgaccatatggatgatctgctagccatagcctaagaaagcaaccttagaattaatagggacccttgtaaggacatgtgtcccatcaatagccccaatacggtcctagattatataactagaacattttaagttatttaatttacctaagaaagttaaggattatgggttaactacccaaccatgaaaagaggttaactaacatgtttgttggctagtgaggtcacaggactccgtgtaaaaagccacatgtggcttgggtacaaaactacaaacaagaccaacagagggaagaaaacaatatgagaggtagagcattttcatcaagctaatagtccacttttggattcgtcgtgtttggcttagatgcatgtgtagtcaaacatgtgagattcacattacactagtctgattgacctttaaccacacatgcaaacacacctttgacacacatgttttgtagattaccctgtttttagaattatttcgtttttccctatttatcttaggatcaatttggtagagcccgctccatgattttatagctctgagacttgaatctccatactccgctagagtgattttgagtgggtttttagcaagggtaaatctatctaacaaaaacaaagcgatttctaagggattagaccgaagtgtgaataaagtgatttctaacagaaagttgtaagaagatttatatataatagatatttcacttaggacatctgcaatggtcgtcttaaatacctagctgatagaagaataaaaatagtaatttatttcatcactagtatttggttccagacataatacattcagtttcttaaaatacttgaaatcttctcatatttttaactatgtagcaaagagattgaatctagctagtcattgggacacccttagcccataccataaggcatatcttttacggtggcggaaactcccttcatttctttcacctccgattcgattccttgtcccctcttgatccgagccgccaccaaaccctaactatctaaaccccccgtctcgctgtccg

SEQ ID NO: 9664 - DNA, 391 bp, Zea mays
atgatgcttagcgccacttcctccaccttgctctgatccaacgagcttgaaacacagatttcaattagaatatttgactcatgtcttatccttcttgattggagttaaagtcaattcactttttgaattaactacccactttactgaggtcatgttcttggcataagcataaggatcaccaatacttatttgcatcagcttagacaattatcagtcgtgacgtgatgatggctgctgcagtttatcagctattgaaaacctttttatatttattggtttatttctatttttatgccaaaactgagtaaatgacggatttgattcaaatcttaagattgtctcaaaagatgtccatttagtgtttataacttatacctactggtaattgtct

SEQ ID NO: 9665 - DNA, 1500 bp, Zea mays
atcagactaaggacaaacatgatgctacacccaaagctctcatagtacctgatagggatcaggttcttgatctttcatcaggttcaaaatacctatcgatttaatggagaacaaaatacaaatctagctttagatcaaagaaccaaacctagcaaccttagcatcataacttctctagttgacctcgccaagaaggttgatcgtactattgaaagggaaatgtgcctttgggcaatttctattatgttttggtgattaagtgtccaacacatttaattgagttcttaagtgctaaatgaagaaagaagtgcaaatcaaagagaaggtatgtttctagacttagtagttggtttttgtatactaatgaagttatctgagtgctagaaacagagaaaagaaagaaatgaattggattgcaaaagtctggctgcctacagccgaagaccagctcggctgggcacaccgaacagtgtccggtgcgccaggctggagtccggtgaacagaccgctctcgagaaagtttggaggcgtacggttataattcaccggactgtccggtggtgcaccggactgtccggtgagccaacggccgccagcgcaacggtcggtcgcgcaatccgcgggcgacgcgtggcccgcgccaacggtcggcagggggaaccaaactgtccggtgtgcaccggacagtgtccgatgcgccaactgccacgtctctgcaacggtcgacttcgccagaaaaggaaggagatcgcgcaccggacatgaacacttggttgtccggtgcgccacccgacagaaggcaagaatttccttcattgttggcttccaacggctcctagctgccttggggctataaaagggacccctaggcacatagaggagtcacccaagcacactataagcattccaagacttctagtcctcactttcacgcaatcgttcatcgttcttgagattggagcacttttcgagttgtaaactccccgcgcgtgctttgtgtgctcatcttctcacttgtgtgtgcgtgtttgaggtgtggatttaattctagtgtgcgttgctcttcccaaccttactccatgctttcattgtgatctttgttgtaagggtgagaaactccaacttgtggagattcctcgcaaacgagaaaaagagataagcaaagaaaagccatggtattcaagttgatcattggatcacttgaaaggggttgagtgcaacccttgtccattaggacgccacaacgtggaagtaggcaagtgttacttggccgaacgacgagataaaatcgcatgtctcttatgattgttccttctttaattgtctgtgttcgcaagagctcgtctcattgacttgattaacccgcactaatatttttataatcaaggttgttggaatttagtgttgaattttacaggatcacctattcacccccctctaggtgctctcaattggtatcagagctgttctcttcatctaagggactaatcgcccgaagaa

SEQ ID NO: 9666 - DNA, 60 bp, Zea mays
gggttttgaggactcgctcatgtgccctggaccgctgtcgctggtgtgccagaggaggcg

SEQ ID NO: 9667 - DNA, 1251 bp, Zea mays
catttagggagttcctactgagttgctaaatgtggagagtaaatagagttgaatagcaactaagtaaatttagcaagtctatttagagaaccattggagaagcacttttctgttcacttcttaaatttaagatttagagagttgtttaaagaactattggagttgcttttagttttgaatcgtacccgtgttggtctataaaacccgacccatattctcagcgctactcacggtcacctcaccgcttccttcaaaagttcaaatgataagcgtcttgtcttctccgtccacaccaacagaagaagagaagagaacttccgtgaaaattcttccttggaagcaatgcaaggagagccacaggctcacaggcgctttatagctgatcgcacgcacacgcatcggctcactgtttttctgctaattatactcccatcaatcctaaccatcgtaacaaccacgccatcacacttgcagcagatctgggtgatgaatcctgtgcacgcaaaacgcaggtttactacctgcagacgtgcaccatgcatgatgcgcaccggaggccgattggttggtcccctgcgcaaagaaggcgcaggcacgtccctccctccctcctttccacgagccgcttttccccgcgtcgccccgccggccggccattccagctccctttcgctttcgctgagcgagcctgcgctttgccgtctcggccggcacatacaatacagctacagctacagctacgaactgcaccgccccggcccagtcccttccccttttgctttggtgaaatcatttcctccctgccccgcctatagggacactagtctttataggcggatcatgtggcctgctgctacagagtgcgtgcatgggagccagccacttccaacatgattctgggattattttttgtaccagccttgcagccttgccatcgcatcaactgtccaagagaagacgagagtgtggcagcctttctcgcggcactctttttgttcctcccactttctttcttctctctctcccactcgctagctccctccatccacattgccaccaccagatcagctgagatctcactttcggatcagctcagtcactggctttaaatagagaggcagccgagctggacgtcttcttgtaggttcttcttggcacttggcaacgacgacattcaccactgtcgtcgacctttcgtgaccatcccagtcccattctcgccttgttcgatcggttcaggactcgagacac

SEQ ID NO: 9668 - DNA, 227 bp, Zea mays
ttaaatatatgtacttctaatgctttccttgaacatttttgaccagaaattgttgttctataatttctcatttaagttccttttttactagtataatggtgtcaacatatttcaggctggtcttgtggcagctgatatagagatttctgattggttacgacgcaactacctctgacaagtgtattctacttgctgtcaataagtgtgaatctccacggaaagggcaa

SEQ ID NO: 9669 - DNA, 524 bp, Zea mays
ctgcaagcggaagagcctctaactgagttggttagatgacttgagtagcactccttagaccctgattttgattcttcgtgggatcaaatttcaggcttggattaaataatcccctcgcgtggctcacgccaaaacataggtctaagacttggcccttgtcattgtggttctcacataggttacgatgctgttgtgtataaatggggcaggggttcgagagattttccgacatgcatgagatctttttaatgcaatgcccaatggctgtcttacccccataggtcgagtttttttagtctccatcttcaaatatgataaattgataattgggtattgtagtcatgtttgtagcagctttaggtagtaacaattggttactattgcattatatagtcgtaatgaattgtttctttgtccttttttttggagctagcctccaaggtaatggtttgccattacttgatattagagctttgtccagttgatactataatgctagtttaggcaatttgggagcttaaaat

SEQ ID NO: 9670 - DNA, 1500 bp, Zea mays
tagtctctaaatatatttaaccttacaagataacaaaataagtcagcttatacagattcagaaaccagtaacttgaagctcaggggaggaaaggttaatggcaatggcacatttcttttcagcttgcaccaattatgactgaacatagtgcttatagaaaaacaatgttcaaagcatgcaatataagtgttaggcaatagaatatgccatctgtggatatcctagctgctatagatagcagatgtaaatcagggatggatatcctagctgctatagatagcagatgtaaatcagggattagttgctagatatagcagatgtaaatcagggataaatcaggggaattatccctgccttgtaaagcaggccagccagctctatataatagaaggtgccccctctcattgaggtgtggccaattgccctcaaccctgtttctctacaatcactttctccggacgctgagaatccttataattgagaatattgtcatttttagatgaatcaaatgttgcagaagaagatatatggcctgattggttgcccgcatatagtcgaaccaggctcacggtatgyaactgcgatgtgtttggttgcacggccaggatcatgctacttatcgtttgtttggtttgctacatgtataggtgagcctgattctcgtggtggcagaaaaggcctcaggctaggatctagagatgcgaccaaaatcaatgtatcttcagagccaggcccaggctgtcgcggtgtacagctgggctctcgctagcctggttagcacgaccaggttgcctaggtgcgggcaaccaatcaggtccatagtatatgcgtactcccttcggtgtcatattatttgtccttttggataaagttcgagtcaaacttataaaattctaactacaaataactgttttattatttagttttgaaacctaatattcatatgcaccgatttgtctttaaaagtacttttataaaatataaatgtattaagagtttatttggagatcgtgtcgttgtcctaaacgacaaataataggacaccggagggagtatgcttttatctttgttaggataataaaataattcacaaattcagtgacatagttgcttagatacccggaggttctttataaacaaaagaaacattggtttgtaagcacattaatttactggtcaatgaccaaatcgaatcactggacatgaactggaggaccagttatgcattttgctgcatattagggcaagatgttatgtaatgtgaacattgggcactgatactaattaacattttgagtgcttgttgttcatatatcttattaaagttcaaaccagagggaatttccccccagaaaatattcattcagaaaagttgaactgtttaaacgcctacgagaattgttctttgctagttgtctgttactgttacatttatcaagtatttacatggctgtggatatttctctgcagctgatatagggcatttacccttttgtgact

SEQ ID NO: 9671 - DNA, 1500 bp, Zea mays
gccttggtacaactatgtgtagggaggaatcttctcccgccagggcgggttggttggcgttttcgttttgggtcctgttgcttgtcggcgtagtccatgcctttgctttgcctcgtatgagcgagattgatacatgatgcactgttcactgcgactacagtctgcagcagtcaattatttagcagcccagccttcaactgttgagcgtgtagatgctggaacgggaatttagcctaagcgtttacatttaattcgtcgtctgcaactcgcgctcgtggctactataatctagaagggaaacaaacatggccttagtgtttatctgaatcggatgcttggcgattactgctcagaatgttgtggaacttgtttttttggaagatactgacatatcaaattccattctttgtattttagttcaccgaccaatttatctgttacaaacacaagtaacgatccttcagcctatccttcatatcgatatatagtctgattttttaaaggggctgtgttaaagggaatgtcgattggatcatgcctggaaatatcagcatggcagctgaatcttcccatgaaagctgttcaacagtacatggcaaccacatgattttttgggaaactgttgacaacttgacatgccaactcttatcttgctggtagtttgatctctagaataaatgttctgatttttttgtaaggcatatatgttctcatttaactcagctgtcaagaggtcacaactcatatgtcaataactatgttacattacgtctttgacgctaatgaatattgatccgctaatattttctcatgccggaatgctatgtaatcagaattcataattcatgactgcatgtatatgctcttctgttttctgaatattccattttctctgtatcatcattctcggcatcaagatgcctgcacatgattgaatacagtcattaatagctgtattcgccccacattacggcacctgtgtgtttagtggaaccacatcaccaacttcttgaatgatatttgatttatatttctgttcttttcctcwatgttctcctttgtaccatgactgcatttatctgcttgcgtaagcctgtgctttactgtatttggtcacacaggcacacaatcacattcaatatgtattttgcacttagtaaccaggttcccggatcaatgagatcgaggaacgggaacatggtacatggtacgctactaaaactaggttttaacactacgggatcgagattgttcccacgttcctggaacgaggaacgtggccgcgtttccagttcccggttactaagattttgcatgctgacacaagctyggtatttctaatttgcaataatagcaattatgacgtgatctagtgagcattgtgctaagactacaaaataacgagtagatttactttttaacgtggataatggtgcttttaccatgaggaatcaggttgtcccttgccttctttgagtgagattggtacaggaatacagg

SEQ ID NO: 9672 - DNA, 249 bp, Zea mays
gtatcatctatatatacctaatattaaagaggcaaaaattctttccatccatttttccgtccacctctttgtaactatctaggcactccgtgtcacgcatgtgacccggtcccagattcatgacccatagtcatacgagtgtaccctctttctaactatccaagcactccatgtcatgtatgttgtacccagaatgcacgatccatagtcatatgagttagaacaacccacatagtactggatgatgag

SEQ ID NO: 9673 - DNA, 853 bp, Zea mays
ggaatagttctttctctttctttttcccttctttttattgattgtaaaagtaccaggttctaaccttttcttttcgctttctaataaaatgcgcagtaggggtttccccctcctgatccttcaaaaaaaccagatgacttgcatgacatcaacactgctccatccattagagaagggttagactgttagaggatgcacgagtgcgctacactgaattgtcatgattttttgcagacaacaggagcacaacatgctctatcaaagctacaatactataaaacacgcctgtaaatcatcttgaggttgccaaaggtgttgcacgcctcaattaaacaaaaaagaatgaacaggccagcaatgctgacttcaattaaacgtatgaggacccaccagactagaatgcatgggaacctggagctgggaggcgaagtcgactgggtgttcacccctccaccggcaacttccatgctaattaatccatctcacggtctagatcagatgctaatctcgatgccgttgcatccatgcaggcgagctagccaaccatagcacagacatgacagccttgtaatcaagcccaatggccaatgcaattcttattagttggctttagttgcaacgcttgaccatgcagttggtcacacatgagaatgattctccttgtctgctgattctgctcagtgcatctgattctccctgtctgctggttcagctctgcagttgcatccacctccttcgctatataaacaaggaagccgaagcccagaagacaccaatttagcagcttgccttttatctttcttctctcccactccaagaagttccagtgtgtcagctttcacgaattccaagg

SEQ ID NO: 9674 - DNA, 1500 bp, Zea mays
tgggctgctttgcttgttgcaatcagtggctagtgtgaggtctgggaattgggatcatgggaggatctgtctaagtgtctattgtgtactgtctagtgaaaaccgctaaaacatttagctgcagatatatcccgatatatccttttgtagccgctggagaaggccggggataaatgggttagcccgttattttaaacactgctaaaaatacagtctctgttttttttacgaataaatgatgataaatataaatataaacacaaactacattcatatgttgattggtggtgaatgcgtgtttatttaaaaaacgaattatattaattttagaagtttagaatggtgagtggtaagatatatataagctgcgtaaatgaagcaaaaacacaatcggaataagaaacgtagctttttttttaaaaaaaatgtacagtatcttttaccagcttctatagccgtcttagcttgttttagccatagataagataaccaggctaagagcatcttcaagagactctttatttttggctctctatttgactttttatttgcaattttataaaaattacactttatatgtagcatttcacttcagactatttatctagttttgctagtcaggtggctagccaaatttggctagtgagagagtcaatttgaagagtcggatggcttggctagtcagatagatagtctgttggagagttattttgttattgaatagttaaaatttggcttgtcgatgcatttaactagttttttagagatgctctaagcaagactaacgacatatgctctccatcatgccgaccctgcctgtcgacacgcactgcactacaggtgtggctcacaagctaatcacacgttttttttgttttgtttttggccgcaagctaatcacacaacccggccaggccatgtgctaccgctatgctatatatagatgctacgtactacaaaatggagcctagtttagccttccatgcacgtacaccatttccgaggcgacggtcacgtcctttgtccaccgtcacggggtggggtcgttgcggccgcggagccacgccacgagtcacgacatcaaccccatgcatgcatgcgtcctctgactctgactctaggatctttggctctcttctcagttctcaacttctgagatcgactgtataaaatcctcccactcccaggtcccagcgctcgctggtggaaacatgcattctcctaggagacggccggccggcccatacaagcagcagaggacgtgcccagcctagtacaagtactctacactagcaacactactctagtttatacacatggaaaatcacggcatccacggccggaggcatcctttctccgagtccgcaatggagcacgacatgaccgccaccgcaggcgaggaagcattggaggtggagcgggaggagttgagcgactccgagtcgggctgcgagtccatcgagatctccgacctgaagcgccgcatgtgggaaggaccag

SEQ ID NO: 9675 - DNA, 1500 bp, Zea mays
gtgcgcacttaggcctagctcgataggccatgagttcgtcgtagactgaggggcgcgtgggctgttaatgcatcgcagttcgggggggtcatgagtgttatgcggcccgaggggttcataggtcatgagtgggaagcggaccgtgcccacgctgtcactcggtgccaggcctgattaatgcggccagtcatttatggcgggccagtccgaggccgggtgcgagatccactcgagtagttcctttccgacacacctgtcctcccttgtcaggctccaccatgcacggtcccaagctcggtgtcgcggggtatcgaccgagaacgagtccttccagggttggcacatctatctcttcggattgactaacgggtcccagtgattaggggctctttccttagcgcgctcattaacatgtgggtcctagggtccgggggtcattcccccgacacagatccatatatatatggagtacaattgatagtgcgcttcaccgatcgaaccaatcaaattatttatcaatgtcttactttcttgctctaggagcagcagtaattagtcttttttatctacgtctttacctctctgtgactctacgtcgtcttgagacgtcttgagtgtcctaccgactataaagcaaaccttataatcgctcctccctgacgggattatttcgagaagacgagatctaggtgttgtagacgaccgccgccgttgccttcgtgcacgcgtgggccatcagaccctagggacggatcgtccaactctaccgtgcactcttgctgcacgatcacagaccgtctagccccgtaatatgaccgtctgtcaccacagagagaccatcaaacagaacaaaccctaatgtttggtcccgattcgggtccaacataatcattccgttttctctgactctttaaagctgtgattagtttcgctaccgtaggagcgaacttgaggttgggagcgcaaataactggcggtgcgtcgagcactagctctgcagtctgcacttgcccggcgccttggtactacccccgaccccgagctctgaaatgggccataaacaactccgtgattctggacggccatgtgagagcacgcgggcgtaccaagcacgccgtccccagtcaccacccggccgaggagaggaggtcgaacggccattccttacccacaccgcgcttcaggtgtcaggagtcaggacccgccggtgatgcgctgctaaccacctcgttcgtggaagcgcccgcggatccggcgcacgtttcgctctgtcggcctgacgaggacgcgcctcggccaggccaacatcgctgccatgattgggtgttccaacgacgagacagagttctctacgccacacgtccccctataagtgcaagcttgaaaatagctatcgacacgaactcagtgtgctcataggttcctgacgtacgtatctcagttgcgttcgagcgttgtggacttgtggtggtttccttcctgcgccggagaaggtagacg

SEQ ID NO: 9676 - DNA, 364 bp, Zea mays
caggcctgcctaaccctaatcatgtaccaaaaccgacggtacggtgcatggggcaaggcaagcaaaggtctgcatgccttgctgtctcagtgtcagccgatcgattagaaatgttgatatatattttttgggggggaccgagatggagatattaattagaggataagcaccataatacatctccactgtgcctcgtggatctcattgcctactgtttgctcagtactcctatactagccgacgactatcgacagggccatatggatctgctcaatccagtacagtgatcatatgaacaagaaacaaccacgtcatccatgaatgcattatattgcatcgcattgttagctcaaaacatagatgc

SEQ ID NO: 9677 - DNA, 553 bp, Zea mays
ttgcatgcctgcagcgccacccaaccccaccaccaccagtccaccaggagcagcagcaagcgtggcaccgcacccaccgcccgcctcagtgccccgtccagaaactccacctgggaaaaaaaaactagctagcagtgtaatcatgggccgcgcgaataacctggatcgacatcggatgcgtttcagcgtggcatctgtgcagtgtgctttttattcgcaagcaggttcgaccactggtcgcacgccgcgcacgcgggccctggaacggacgggtcgcgctacagattccgtccaccccggccggcccacgcgccgccgacgcaacgcacggctactatcattcgcacgtttaccgccactatggacgtacgtacctgcggcgttggcctgatgctaggctagctagtcaggccggccctggtcttagcagtgggcggtgtcagtgtgcgccatcgccccccactcagactcagccactgctgcagtccgccggctagtacacgtacgacaggctgtaccgaggttcagttcggtagtgtagttgtaggttgcg

SEQ ID NO: 9678 - DNA, 183 bp, Zea mays
ggtatgtccttcacactcttcgtctgaagatcattatatcctaaggaatataatgctttgaaggacaaagtgttctaactaataaccattttatgttgccttgttcttaattcatagcatttgagaataagtccccaacattggcgcccacctccggtgaactcacttccactgattgagctg

SEQ ID NO: 9679 - DNA, 1058 bp, Zea mays
atttttatgggagagagaatgacgggagatagccggagaagccttttttggtttccggcttcactcggtttgtggggtggctccttcctatttttacggaggagccaacggaggagcccagtagactctttgaagaagctgttgaaggagccattgaaagagctataccaaagaggtaactcgagagcttataataactagttactctagagttattaagcaactaatcacactacccaagtaaagctataaatataaatacaagtatgatagtgaggaaaccaattgagataagagagattaacacaatgatttgtttttaaaaatagctttaggatatgcacaatatattgtgtatatgatcgtacaaaatattattttataatatagatagcattgtttgtataataaagtttgaaataagagccgagataagaaatatgatattagctgcgtggataaacttaccacatcaacagttaaaggcccaaagcaatccgacgacctctgacgattccagacttccagtcgcggtcacaggtgcgcgcttttgccttttccgtgcacttttttttcgcgcttttctctagactgccactctcgtaaataacctcaacctcaggggcgttctagctaaacggctctataaattgatctgctgagccgcttccctgcaaaattcacgctgagccgccgcctgttccacggggttccacctctcctaaccaaaaactcctaggttttctaaacgtgaattccaatcactgcacacgcggttgtttcggtaagcttctgagagtgatcccttcgcccttccattctgcaattctcgtggttcgatgagaagcaatttgaataaaataattgtagcccttgcaggatgttgtgtttaattttataagcaaggacggggagatcggtcttcaaagtctattttcgtcatgttgcaggtgtgatttgccaggaagacggggcgaattcgtggtgctacctaaaagagaccccatctggtgcggttctggggttcgaggagcggcgaggcaggtgggaaatgaggg

SEQ ID NO: 9680 - DNA, 604 bp, Zea mays
gaaacttaaataatcctgtaatcctgtagaggataagtttccaaattagccctaatactaagatgttttcccgttattatcgctgctcgtttatgttgcgacttcgctgctttttaggtagttggtaggttcgacgactcccgagtttcaacgtacggtctataacagcaacaactcatgctatatgctatctacagaaataccactcgaaccatgatcgccaacaatggcaatggtatacgagtccatgccaaactcttgaggtcgaactgttctgttatgcagagctgacagcttatgggtattattaccatcaatctcctctgttcgtgcagcttatgggtattattatcatcaagtgtggcgtactagtaggacaatcagcgttacgagcaagatgggactcactgctgactgaaacaggacaacaacatcgatctcctccaactccaatgcatggcatcggtgtgctccaacactaccacgccccaactcgctcacctgtttcactcatcacgccccttcgccctccctccaaactcaccatctcctataaatctccatctacatcgaagctcctcgctagtccaaacaccttgtaaac

SEQ ID NO: 9681 - DNA, 342 bp, Zea mays
ggtatgccatttttattcagaccttttgtaagccaaattagacaatagttaggtttcacaatcgtgtgttacaataaaaggactgggttttgtccatttgcattaagtgactttgaacatattatattggtaaatgtgacttcttaatagacagcaacagcgatactttttattactggacgtatcttgtacgcatatgtttgtttctcatgttaaccattcccgctctcacaagaactatatctttgcagtgcaagcacaaatctaatgagaaggacggtttgaagctgaaagatgtagagagaaaatctcttgttcctcgacttgtttatctttccacac

SEQ ID NO: 9682 - DNA, 710 bp, Zea mays
ggagaagaatgacacatgaaggaagaaactcctactagagatgtgatgcaaaaaataaaacaatttataattagaacgaaaagagtatttgctaagttattaaaagttactcactccgttaacctattttttccgtgaatatagatatacataaaaaatatatttatatgttacttaatatataaatatatgattagtttaaaacaaattatattttagtatgaagtgagtaatagattataatttagagcggtaaaaatatttattcagttattgtaactctcaaatctgaggggcctagacctcccaatagtttccagagaaataaagcccaacatctaaactgggccatcaaaacccggtccatacaagcgcattggttgggcctaataaaagcgccaactgcatatcatcacctatcacctgtcaggttgttagtggggattaactttagaagaagggattaacttcctctggcccacacgtcagccaccacgtgcatcgtccggccggtgagggaccaccgcggcagctatcctcggcgccgcgctcacgattccggaatcactccccacgcgattcgatcctctcgccggcccaggcatcgtagaatccccccaccgaaaaaaatcaagcgggcatacaaagagcgcgtgcgcagtgcttggaataggtgggtcgaacttcgaaggggttcgaggacttcagct

SEQ ID NO: 9683 - DNA, 180 bp, Zea mays
gctgtgcataatcaacgttggatcgaccagtgaataatatacaattatttgatgttaatttctacacaaatgttgtacgtgttgtacattcatcccatgtaactgagcagtaaatgtaagtgtgtggaactcccgttgctatttggtcttcgctcttgagttcaagagggaagtaggaca

SEQ ID NO: 9684 - DNA, 488 bp, Zea mays
acttgttctcaaatgctatgaattaagaacaaggcaacataaagtgttaaatgttaacgtccttcgtccatgaaacattattcccttgaggataatgggccttggacgaaggttgatgagagtataattacgaagcttaagtcttcgtaataaaatttcaataaatattgtaagacaacataaaataaagggtataaaaggggtaaataaatcatagacgaattatattatattatatttatttgatatattaaatcattaaatacaataatacctctgccttgataaaggttggattccgaaagatgcgattgcaattaccagaatgcgtgaacagtaaaggaatgctgttcactatttataggcacaggacgcagcctgtgaggaattacaagtatgccccttataaaagtttacaacattgactcagacctttatggactaaaaggtcattctatctttaagtcggtttgtaataccgaagcttc

SEQ ID NO: 9685 - DNA, 55 bp, Zea mays
tgcaggtaggtaggtagctagccgccatagcaagctaggccgaagcagaggagtg

SEQ ID NO: 9686 - DNA, 574 bp, Zea mays
actcccaagcatagatgttactctctgatcggtgtgaccgaacttttgttaaggctggtcctggtcactaggccggttacgtggccaaagtgaaggattttattgaatgcagcaacatcacttgctgttggtgataagatgatggctgcattgtcagcataaagggaggtgcctgtcggcccctgagctctgtaagtatccaccgcttggtggcacatttgaaaatggttacaagtggatgaccaaaacaaataggaacggcgactgaggggtcgccctatcataggcctgggcctctctaccactgctgcatagtttgattcatgcatttgatcatttcaactgctttctccaattctatgtctttaattataagttgatcaattcattctgaagtgatttggtattgaaccttgctgtcgcagagcttcagttagcctctaccactgctccatcgcttggtggcactttcttgttcttttttctgtgtggtagtgtgcatatgcatgtttgacatataatacttagtatttaatgttaaactgttaatggtcacttgtgttttcagaatgag

SEQ ID NO: 9687 - DNA, 1432 bp, Zea mays
tcaccagttcgccattccaacgcacgtccagattccaggacagcaggtccccaagattggcagatatgttgccgccgtctgcactccgcagaacattatagatggccaaatgggaagacgcggcctcatccgacacggcccatgtcaggcactgcccattttagatacgacccaccaggcccggctagtaaattgtaccgtgtcggacggacccatgtgccgtagtagcggtctaggtacgacccgtcggcctgctagccgtgtcgggtagacccgatatcacgttggcccatataagtatattgtataattcagctatgtatgtagcttgaactcacacccacttgtatgagagagttaaacacacctgattagccagtactattgtaatattattatgttatatgttgaattcttatacttaatatatgtaaactattatttttaaaataaaaaatgtaaccgtgtcgtgcccgtgccagcactacgggtcgagatagtggcccaggcacggcactggcactatactaaccggaccgggtcgtgcctggaccgtgctttttcgtgccgtgcctgggctaacccatcgtgttagtgtcaaatggccatctataataacatagtaataagaccgttttcggtatggattgttatcgaacttgctagcacggtggcctagacggtccataccgatcaaggcaatcacagtgttcgtcgggtgggctatagtccgattcatacgaacgatattatctgatttgcggcggcgggcaaaatcggttggatacgaatacgatcagaccacaattcaatatttgatttgcttattcaatttcaaccatttgagttcgaaaaaaaaatcgtgggctcaccctataaacgttggggtccttcacctatagttctcatgtttaggatagggtacatgtgtttttatatggatccaatatatattatgatatatggattgatcttgtaaccagtattataatatgtggtacaatagaaaccatttaatttattaatggaaacgtggtcgcagaactgtatttaactggggcacttggtacaggctgtacactcgaatgtactactccagttctgatagctagaaatattatatcaatcgaccctgatgggacggtacatatatacgctgtgcgttgtatccctcaaaagcgaacgtaaggatgaataaaaaaggggagaaaactcatgtcctttgtttttggcaggcttttacccccacaaaagctggcggtgaaaaaaaagggagggagccacaacagcaagcattgatgctttttagctgatggagcctgcctgcgtctgcgtgggcgcgcattggcagcactcatgcggtcagctccgcccctgcggatactgcagttggcagggcattaaaagcagtaaaaactgaacacacacccct

SEQ ID NO: 9688 - DNA, 1500 bp, Zea mays
gcggcggctgcggcggaaagactggagccgctagggtcttggcgcggcgaggcgggcgctaccgccggtggcttcccccgcgtcgggggagcagcggccggcggcggcgggctctggaaggctggggaatggacgaatgaggcggggcgcgtgtgatcgattgatttgaggggacccgatggttgcttccgtttatacattttcatcataaggctatttacaatgaaggttttgtttcatggggtgtttcatgtattaattagcctgccacatcagctattttgatgacatgtcacatcatttaagaaggaagagtttcatggagtttcatggggatgaaaccatgttaactcgtttccaagatcttggaaactgtgtgaaacctccactgagagtgttttgtttcatcttcatataattgagtaaatcctattggttatttatatgcagcatttaagaagtatgttgacatatgaaatagtgagatgaaactctctattgagagacagggtatttcattcatcctcactgtgattagcctaagctgttaggtacagtaggcgctaacccaggggacggccggagtgccatagctttcatagtcggaccaatgggacagcgatacgaggaccaatgggaaggtagtcttttgcgcgagggcgtgggtggccacaccgagagggctgcaagatcgatatgatatatgctgtagcatctatatcctgtaagctcggttctgagcctgcatgattaattagttagcggtcgcgcgactccccaaaaccagcctgtctgagagctaattaaggtccgcgctgccgctgcctgttggcgtgcaactaccgggaaaaggggggccggggagagaaatgccggcctaaagaaagagtagggggaaaaggaagtagcttgtagctatagcctttgctagtttagttatagatacataccctaaaatcagctgagaatttggtggttgacatgagaagtgccttgcctcctccctcctagctcgcagctttgtctggtacagggtagtagcggtggtggtggtgtggcgtccctctcctccctctcccacctatcattcttctaatcgagcggcagagcgtggtgagctagagcgagccagaaaagaagggggcaggacgctgtcttcctttctccatcggatccatggtctcttttctcagccctctcagtctcacacaccacaccagagcagcgcagccgagcatgcactcatcacatcagctcctcgtctcctagctttcctattcctgccttgataattggccaattgttcgatctccttctttactaccccctttgctttcgttgctgctactactactgttccatctcctaggtttcgttgttgtccctgcaggccgccactgagtgatttgttagcagataagatttagatctcccagataaaaaaaagaggttgagaggagagctagcactaggcactagcaagcctgctgtgaggtgaat

SEQ ID NO: 9689 - DNA, 1500 bp, Zea mays
cggccctgggtgcgggcgggcgtaataaagccatgccacccgcgtcgcgtgtggtgctccgttccccgtctggatttgacttgcccgggtgctgctgctgctggtcgaaacggaataaagccacggtgctggtgcaagcaagacaagcgcagacgaacctggtgctggtggtgaaaactcgttccccccggaaaggaaggaatgttttttgcttctggaaaaagtttgagcaggaggaacaggaaccttctcttttctctctctcttttgcacagcacaggtagttttcatttcgtttgggtagtagacagtagtagataaggatgacgacgaaccttacggtgcagcaccagtcgctgtcggtcgatcctcttaccgttcgtcgtctgctagctttctgttggaacatatttctttctctccgtgtcccttccttcgtttgaactggagagtagtttcttggtttgtagcgctttgccgtgaaaccgttccaacgtcattttcgttttagagaagagaaccgttgcttctttttctttctttctttctttttaaaaaaaaaagtaaggtaccgcgaacatcttaacgaatatgggccttcagttctagcaaaagcccacacagtattgtggcctcttagggaatatgggcctccagttccagcaaaatatcacgcatgcactacatgaccctatgggccttttgcatgcaagctaggcccacgatactgactgaatcgaatatatatataagtaaggtcaaatatttttttttacagtaataacacagtttctccaacgaaaatatcgtgggtctttgcttgcatttcatccgcctccacccaaaatcgggaggtcaaaaggcggccaacatgtctacaccttttcgcctccactagcaacgcatgaacgcaatgtggacagaagaaaaaaaaacagacgcctctctatcacgattcccttcgaatctttgatcctcctccgacctctcccttttgtgggtggaggtgaatggatgatccatgacatgacagtgacaagatccttatcccccccccccaaccccccccctccttctcctgcagggggcgccggcggcggcagcatactgaagcttcacgaggacgtgcagacctgtggctacagggacgtgcaggtgatgttcgacatcctgacgtcggagctggaggcgtccgcgcagcgccccgccgccaagcaccaccagcggaagcggccgccgtcgccgtcgtcgccgtggcccagatacccgtcatcctccatgatcgcggccgcgcaatagaggccgcgcgcgacgctgacggggcgtggacatggagtatagtagtccaaagctgccgcgctcgtcctgggtgatgatggcgccgcggttagttaataagcaagcagttcggttaagaacaccgggttattagtagcacgctgtctagttcgtggtggtagctagctaatagagctggcactgaacgtaaggtttggtgcc

SEQ ID NO: 9690 - DNA, 285 bp, Zea mays
ggtgcgaacattattgaagttattaattcatttttaattrtttatctagttgtataaaatactgggctattttgtgctaatttgttagcttgattcagctcttctgcatttaggtactttgcacatcttcatgttgaactactgcttcaactgcatttgataataatactcagagttggtctgtttcttgcagtgactcaaggatgtggatgtcttgctagatgttacttgttcttatgaatgcagcctttgatttgacttagttggtacttctgtttgcaggtt

SEQ ID NO: 9691 - DNA, 337 bp, Zea mays
tgacgtattaacttaacactattattattattaaaatgaaatttaattccaaggaatcaaacgcagcgtgagaggaaacataaaacatttataaaacagcatgtcgtttgttcctatccccgttgactatgatagcacaaagtccattcttctccttatccatactctcccgtaggcgcgtccaccgcaagtccgcaacgcgtgctggtctgtcacccgtatataatccccttttcaaatggccattttccgcaatcagaaaccagtcctctacttgctaggaggtggttacccgaaaacctacccccgccgccttggcccttggcctcacgtcacg

SEQ ID NO: 9692 - DNA, 953 bp, Zea mays
gtcgttgttatccattgccatagcaagattgatacaatagcacgatgctctcccaacccactacatatatgtactgctttacactgtgtatgctaagagcagctccaaaagagcactaaaaatttgttccccaaaatctcttattagcgtctattgaaaaataaaatccactaaaaatatgttatctcacagcagatcactaaaaacttgtcccgaaaaaaattaaaaagggacatgggccaacagacgttgtattgggccagtacgtacgcactattgctcttggttttgtgcatgtgcctccaccagcgttcagcaacagacaggaaaaaagcgcgtgccaggggagattgggggcacaactccgaggcgaatatttacgggagattgagttcgatatgcatggtcacgaaaaagattaggaagataaagaggagctgttagaggcatcatgagatgagttttcaccctaaaaatacttttgggattagtttccgtcacttgttggagttgctgtaacatttctggtggatcaaagtttcctaaacagaagagatgtggttataaacaaaagtttccacgtcgatcgcttgcttccacgcgtgcatcctcccctgtcctgatggcgactggcagggcaggccgccactgggcatccgcatatccctcacgcggtcacagttactccgggacccacatgtcatcacgtcaaccttcgccatgcccaaagcttagcctcgaagcgtctgtactgtgtgcgtcctctcctcaacctcaacccccaccccgcccttacctacaaccctattaaattccgccttccgacccgtagacctgattgatccccgcatcgaatccggcggatcgggagcgggagagaccactcccaaatcgcgtcgcgtcgagagcgagagcggaagaggtgcgcgcgggggaaccgaccgaaccgactg

SEQ ID NO: 9693 - DNA, 1144 bp, Zea mays
ttcatttttattattcccctctttatcgcttcatctatttcacctcatctccaacatttcccctattcaacttctctttacattttaattgagctatttaactttttatagataagtttttagagttttaaaaaatatacaatatttgtagtactgtaatacacatggttacatgttaattaaaataacaataattaattttacagttaatatcactaattagtgaagaggagggagattaaagctcccctttcaagagggttttcttatctcactcaaaagagggggacgaagtaagtgaaccattggagcaacatggcgcaaccatacaccgaaatcaggggagcgattcagggcattgttgtagtgcgcctaaggctattttcaagcttagtttcatcacatcattttaagtagttagattagaatgatataatatgtgatagttggtatagagaaaatatatactctagagggctataaatacagaatattgtgatatagaattatactaaactttactaatggagtgtttgaatgcactagaattaataattatttggctaaaaaatgttagtgaaattagctagctaacaaatagctacataactattaattaatttaataaaaaatagctaatagctgaatttttagttatgatttttggatgcagcaactaattttagacactaactattatgtctagtgcatttaaataaatagactatgaaaagcggtatagagttagaaaaaggagtagtcccactagctcacaaaacaccccagccaaaagtgccgaaccccacttctctctacgagtccacgcattccgctacccttgggccgaacagtcggccccgcggccgcgaggtagcgcccaaccaccccgcttgtcctcggctccctcttgaagagcgtgccccccgcctcataaataaacatcgggcaaaacaagcaaagtgaagaaagctgccggcctgccgctgcctgctcgcagttgccagcccccgccgccgcggaggacggaaggaagcgaatcaaccgcgactgtctccgacgggaataaagcaggcgaggccagccggtcgcggaacccccaattctcagctgcggccggcgatcgagtcggttccgtcccgcgccg

SEQ ID NO: 9694 - DNA, 1500 bp, Zea mays
ccttcatgcgcagctcctgcgatcgtcttcctgttggtgacatgtgactcccgtaaagcaatggcaaatggttgaacaaccaaattttaaagggttttagaaaaatataggaagttgttggagcattgtctttttttctggattattacttttgaggaaatccaaatttccttgttttaggagttgttcgagatgctcttgtattggtttgtttttatattcctcgatactaaatatgggaattcaaaccctgcccagagtttctaggttcacgattttattagactgtctggagtatgtaaaaactcatctatcctatataagtatgttttaatgatgatttaaaaaatattctctaagtatagataacacgactatctcattttcttttatgtattagataattaattaagcaatatatatatatatatgtatatatatatacacgatatttaaggttatgataaatatgtgtatacaaaatctgaagtaaaaaatatttttataaaagtctctaaagaataaatatggaggagagatatagtatagaattggcgacaatcttatgagaaaagcttcatcctatttagagggtgtttgatttttgtgactaaagtttagtttatgtcacatcggatgtttgaatgacaattatgagtattaaatatagtctagttataaaactaagtatatagataaagactaaacggtgagatgagtttgttaagcctaagtaatccataattatcaaatgcttattgtagcatcatatgaatgaatcatggactaattaggtttaataggtttgtcttgtcatttagtccttatttatgtaattagttttataattatactatatttgatattgacattcaaatattagatgtgacatataataaactttagtgaggtgaaccagacaaatgtgaaaacaagactatgatggagttttcatgagattgctgggagactgtgaacatcagactcctttctctctctctaaaaggaggtgaatggagagctgaagaggaacatccacatccagaaaatgtatatgtgtacaccagatacaaggaaatgaagaactctcattctgatcgcgtgcctctgttcttacgtgcaatgaacagatttctcaacaggttggagcactgcagattatttgtaccgtggagttgagcgaccgttgacaggaacgcaagtaggagtaggtgcctttctgatgggagttgccaccgctacagcagtcggcagccggccgttgagaagaaccacggaacggaacggaacggacagagaacgtgccagtgcggcggatcatcaagaccggccagaaccagaaaccaacgcccgcgcgatgcatgctcccgcactaaatgcatgcacggcggcaccatcactctccaagaacatccggaccctgtgactgtgactgtgcgtctgtgcctgcgctagctagccgttagtacaacagcaccaaaccggagacgagcagcggta

SEQ ID NO: 9695 - DNA, 884 bp, Zea mays
cactagccaaagaaacaccttgatcctctggggaattttggttttccatataaatttataaggcaccttggccaaatcacgtatacatctggtatataaagatctaacggaaaaccacttttattaagtaaccacacaactttatcatcagagtcagataagctatgattactgcaaatctctttcaattcttctaaaagttaggttatgccaattcaaactaagggctttattcacacttatctctttattaagggataaatcaaacagtctcttaaatctttcagacaaagggcaatattaggccgcttctctgtgggtctcaaatatacagctcctgagattaggccctaattttttttggatgaattccatttaaatagggtttatgttagacctccattttctggttgcggccctacatttgaaattgtttatgagttttttcagatcccgaatccattttgctagcaaactcatattcgtacatccgaatttttccttcttacatgttactcctactaggaacacgcaagcgcaaagcaaatccgagataggaatgaaacgaggccgggggaaagagaagccaaacagcaaacacacggcagcagagtgcaaagccacggcgatgagcaaatggcaaaaggcaayacatgtgactgctgaccacgacgcgacgcgcaaaccttaacaagtcagcaagcagatgggcttctcatcacatatactccgtataaagcagagaggagaggagaggagaggagacggggacggcaccggcagcgctccacaggcccaacctgccgtccacggcgcgaaagaagagccgcgaacccgggagtcctgcctgtcctcgtcctcctcccccttgccatccgccgccc

SEQ ID NO: 9696 - DNA, 1153 bp, Zea mays
tgcagtgaatatctgctgtgtgctatacaatcatgaatgatgctatgcgattgtatccatcatgacatgaatgatgctatgtgaatatgtatccatgacatgaatgatgcgtttcgtgaccataattcacgtgcagcacagaaacatatcttatatctacaatatggccaatttggcaatttccaatgaccaactagtgctaaactatttcattgacatgctactacaatttataaattcgttatgaactgcattgcatatacaagtgatagtctcaagccccttttctaaaaagtctgttctagaactctgctgaaggttttggagcaccacaagtagtttgctaagaattaaagatgcatgcagataataaatctatattttcacttgaaacattatatttattactagttctatgcctgtgcgttactacgggagcataaataaaagatagcaatatgattgcctgatttgcatcaatataatcagacatactccctcaattctttttttatttgtcacgttttaattcaaaaatgaactagccgatgacaaatatttgagaatggaggtagtatgttcataatagaggtagtaggttgtatacttcgctggggtcatggtctgaggtagttggttgtttcttcctgacgtatgctctatgcttaagaatgtatatcccttctgtgcagagggttcatgctcttctatggtttatatatatatatgtgtgtgttttcattcatgctgaaaaacaaagttgatcatgtcctaaaaataatttgtcaagaatttttctctcatcattcatgctgaaaaacaaagttaatcatttcctaaaaatactttgccaagagttttgtagcctaacaagatctggctaaacctcacgatgctggtggtctgcccagcacaaatggccaaaagacagtggatctggctaaacctcccgtggatccagcgtggcgtgattccattggctccctggatatccctcctccctctcgcgcttgcagcaaaatccaatgcttcgctctcgcttctgcagattgctcgctccccaaaaccttcacaaaaaaagccacccaaaaaaatccgtttcataactgaaaaaatcaaatagaaaaatcaagtgaagccggtaaagaaaaaa

SEQ ID NO: 9697 - DNA, 439 bp, Zea mays
cgttggacccaactgggtgtagtgctgacatatataaatagagggagagtttggtgtagggtatctatcagaaaaacttgtaaacacttctactgttaaacatctcgccgcctctgcctatcttgctacctatccctgctctgttcttctgctcttcctactgttccatagtcttgttccatagttactgttaacaaagtggtatcagaggtctgattctgttcttctagtgccaattccctaatccatcggtcgactgggcaacggattaggtcaggatcgatctcgagtgaatcagtgagctgctgattccttagggtctcctctaattcctgtccatacccggtcgatttgtggcgaattcggcctggagcctcacgagattcaccacccccacttcaccagatttcgttagaggttaggagcaatggatccgaac

SEQ ID NO: 9698 - DNA, 690 bp, Zea mays
tgttaatatattttccgtcctgagatctttagggttcggttgatttcctaggcaaggttgccttgcctggccaggcagcaatccagcctatcgatttcgagtgcctggcagctaggattactgcctgcctggctggctagctggccaggttgcttgcctgggcaaggtcgccatactttgtgctgcgattctgttgacccgattcaatcattcttaaattcattgattcattaattatctagtgttactgcacatgcatttttttatccatgtaattgtgagtttcctgtcggaataaactataaaataaactacatgttctactggtgtgacaatgctgcttctatagtgatttgttatcaaaagaaattgcatgattttggtaatgatctggtggtagaattacatttttttttattttgttgtgacatcttgttaacactctgaatggatactggaaatgtgccttgaatggatgcttatggtactattttgttcttcattaaaaatcaactcagaaatgtttatcatgcatcccattttatatatttaagattaaccttttctattagctaattaaatgacaaattgatgtcgttgtttctaataatgctacatgggcattgtgcttttttgtaggtttctgcagcccgagaagaggtgccaggtaggcgtggttatcctggatat

SEQ ID NO: 9699 - DNA, 977 bp, Zea mays
gaaaagagaatacacaggctgacatgtggggtctatatatcaaccaagacacatttagatctaactgatacgtgaacaacgattaaggaccgggttaacacattttaaaagtttatggaatagggtgacatagggcaacaagtttaatgaccaaaaatatattttactcttttttaatatcagaggagtaaaaattatattacagcttccaaaattatataaagtttaccaccagagttagagtgtttggagttttgttctcgaaaccaaacaccaggactggttcggaggaaacacgagcacaagtccaagtccagccgtgcgcacggctgggactgggaggcctctccgttccagaagatccccgctctctcgccacacacgcttggaatccaatccaacgcgaaagcaaccgagaaatttgctgttttgccactctcaaatttggctgcttgttattatgtcatcccgtgtctatgactggtgggaccatctgtgtctatgatttgtgggtccgatggcataatggcgaagcccacaaatgataatggcaaaattgccaatggctctaaaccatcgcctgacagcaaaccaagcagctctacgccaccgcggagaaaatactgtttccccactatccccagtgcgagcgagcctgaggactcccaggcacccaggccaggtctgacggtcagtgacagcatggccccagaggtaagaggaacggcgacgtgagcaagtgcggccgcaactaatccaatcccaaacagttgggcctcggggcctgctgggttaggcggcagggtacgacgacccacccggtgagtttgacccctcgtcggttcgtcggtggccaaccgagcagccgagcaggagcgctagcatgcggcgccgtatatatacaggcgcccacgcgcggtggcggagaggcggtatgagccgaagaaggacgggtccggggggtcgcggaaggagca

SEQ ID NO: 9700 - DNA, 220 bp, Zea mays
gcattttgaccatactttagggtgataattcttaccgtggaaaattttggttcattctttcattgttacggctaatgtcctcggtcctcactgagtacccccggcaggtgtgaatatttttggtcagttttatcgtgccctctggtgttcagggtgctttacaggcgattttgtaacatatctaggccattaagtttaaatttgggttcccgtagcgtag

SEQ ID NO: 9701 - DNA, 542 bp, Zea mays
cgcaggttttcccgttcggccagtgctggtacggcgcgcgatctgatccggccctttttgcacggcgccttgagctgtacccgtgcccaatcaatcatcgaagcgggtgaggaaatctcggcacattcggcttgtacttgcccgcacctaccggccgcgcccgcgcgttgctggtcagagccagcgggcagcggacgaggtcagctgcctccgcggctccctccttcggtcctttgacgcttcaaggagacatcgctccagcgcccctgagctgtccttggtcaatgggagtggctgaggctggcgtgcggacctaaaatccccactgatatcaaggcaactgcgcaagcaatctccctgcccctgctcattggtcagcaccagcagcaacagcagctgctggagtgctgttgcgttctcctcaagcgcaactgtgcaaggactgctggagtgcaagcacagttctgcttccactacttgaagtcgactccctcccactccagtctccaggggagagccgcattggcagcttgcctctgccc

SEQ ID NO: 9702 - DNA, 251 bp, Zea mays
tcatatcctttgcgctgttgactggagtcccaatgggtgtagtgttgcatgaaacggcgtccgccgcctgacgtgtcttcgggtgggtggaagtgcttattgaatgccttgcgactgttcagtgaccgcggttagaagtgagcggttgcctttcccttctataaataacccttttgcttctctggtttcttcgcatctcttcgttgcttcttactgcctcttctccttcttctctcccaaagctctcaacc

SEQ ID NO: 9703 - DNA, 663 bp, Zea mays
ccaaaaaaattcaaatacccacgctctaaatccaggacccgccactgtttgcttgtaaacatctccgttctttaccatgtaagtgtgatatcctggttgtattatcattattggtgcgtgatctaattcaatattaacattttgttaactaatttaggttatagtagatctatatccacgcatgcatatctcttatatatagaataatgttgtattagcagacttgtagaataataattatctgtggataagttctacaggctaagaatatacatcatgcatgctccaagtctcatcggactctagcaaccgctcattccctctggggctgacttagcgcgcgcctcggtgagtccaaaacgaatggatcaacaagcatgcatgtttgctgatctattattagcacgttggtgtgtgtatgcatgttcattgtgtcctgcttcctcggagcatctgatccggatcttttctatcaggcaaaccattagtgtgcttgcattggtggagcagcggataacgaggccccgaccatgtacatcatatataggtgctacagctgggtagtagaacgatccatatatcccttcctcgtatatcctttcctgagtaggagagagagttgagttaggagttgttgtgctgatcatctcggtcgaccgagag

SEQ ID NO: 9704 - DNA, 1012 bp, Zea mays
ggcgaaaagtccgccatatgtgtgcttgaactgaaagtcgatttcgttgcgaagtatttttgtgatatatagaacttagcttcatcctyttctggcttttgatattaacagccgatgatcaggactacacactgaaatgcaaaactcttttggagcggggaaattggacaggattgagagggccaaaattctttctatttttatttaaaattgaacggaaaggagattttagcccactcaattccttccatttcccttgctcccaaacaaccctaagagcttgttcggtttaagggattcgaggggattgaaggagattaaatatctttctattcaattttaactagaaagagatttaatcccctccaaaccgaacaaaccctaaaatcccttactagtgaaatatgagtagaaacggatttaaatcttctcaatcccttccgatccccatgcaaccgaaaaaagtctaaagtggttcctattacctgattgactgctttggtcctacgaagcctcaactgctaaaacttatggtgaactaattgaaaacatacaagcgatgatgtgaagggtgcacccactctagtcttgtaatctagtcgttttcatcaaataacccaaccacctttcttcatgtgttccttcatcttcatttttaagccacttgctcagttgaagaaacaaaagttgcacaagtgatggttgagaagagtagacggaacgggacccaacccaccctaacccatcattcattcattctccactagaagcacgggttactgcacccatgacctgtaggtggtggtgcaagatacttcagataaagatatatatgtgcgtgtgtgtgaaagacagagaacctggctacgcctcaatctagccgggaagaacagctccacggaagaaacaaaggcggcagagtgctagaccggccatccgcgtgccagactgccagtgccctctcctctgcagccaccaactcctgcttcccagaagctagatctggacgaac

SEQ ID NO: 9705 - DNA, 1118 bp, Zea mays
tcaaataaattcatccgaggcttatgttacagtgagtttaatgaaaataattttatcctaaaatttcacgaaggctattgtttgcttctgctactagaaacgaacagttcaaaggcagctagccacgcgccacgcgtgctttctcgaccgccacagacccacccaccggcccaagacccacgcgacagtccaaggcccacgctgcgccgcgcccgtctccccagcttgcacttcgcccgaccctaattttcaaacgcgggaattcgcgtgtgccccacctgtaagcgccccacccaccggcccaagctcccacacgtccccccctcttccggtcttccccttcccttttctctctacttgtatgtatcccccccgcccgccaagccgcggccgcagcgcagcagaaacgcaaaccggccaccccacccccactcgccgccccatcttcgctccgatccatccacgccgccgcgaccggccccagagcagcaccttctcgccgccgatacccaagcctctgcccgcgtggttgcgcctccgcggcggcgccggcgccgtctgggagcgcggctcgggcgttcgaaaggcgccctcgcgcgcgctgtttcgtctagatccgatccaggtgagctcctgtgcgggtcttagctctgggattcctcgatgtgaggggtctccgccggtgtggttcgggtgtgaggtcgatttgtgctcgtggttttctgcgtggttttgcggggtgcggaatttgcgggttttgcgttgtttctgtgacgggggagggagggaggccgggttcgtcggagccctcggtgctgtggctgcgagtaatcgagtcaagcgcggctgctgggtgctggcggcagaagcatcttcgctgctcgcgaggccacattggcctggatcgcaggctcgcagctacaagcgaagcgctcctccggagtcggccttgcccacgcgccagcaccgtgtgcccgtttcgatctcctccttctcccgccgaaccccgaagccgccgcgacgctcgtccctccagcagcgggtttagcactgcttttcacgcactttgtttgttgctcgcagcaatatttgttgagccgaaggcaaggacagttttg

SEQ ID NO: 9706 - DNA, 1054 bp, Zea mays
gttcagccaaagacagttcagtctgggagcaccggactgtccgtgcgcccaggttggctctagtgaaaaggccgctctcggaaattcgtcggcggcatacggctaaaattcaccggactgtccggtgagccaacgatcggctgagccaacggtcggccgcgcaatccgcgcgtgacgcgtggccgggccaacggtctgaagggggcaccagactgtccggtgtgcaccgtacagtgtccggtgcgccaacaactccaaaacgccaacggtcggctgcgccaaaacaggaaagaaatccgcaccggacagtgtccggtggtgcaccggactgtccggtgcgccaggcgacagaaggcaagaattgccttcctggaatgctctcaacggctcctagctgccttggggctataaaagggacccctaggcgcatggaggagtacaccaagcatcccttgagcattcctaagcaccaagacctcatttccgcgcattcgattctttgtgatagcaactagagctccatttgagtagagaactctttgagttgtgttgagagctcaagttgtgacttgtgtgcgtattgttgctctgattttgtgtcttgtgtgtgttgctcatcccatccttacttccgtgattctttgtgttaatcaaattgtaagggcgagaggctccaagttgtggagattcctcgcaagcgggatatagtgaaacaaagcaaaacaccatggtattcaagtgggtctttggaccgcttgagaggggttgagtgcaaccctcgtccgttgggacgccacaacgtggagtaggcaagtgttggacttggccgaaccacgggataaaccactgtgcctctctgtgttgatctttttgtggttattgtgtttcgcaagaactcctctctagccacttggctttattgtgctaactcctaatcaagttttgtggctttaagtttcaagtttttacaggatcacctattcacccccctctaggtgctctcaattggtatcagagtcgttctcttcaagaaagggactaatcgcccaaagag

SEQ ID NO: 9707 - DNA, 422 bp, Zea mays
ggtgcgccattgaagataggttatcatgggattgcaattgatcgtaaactaaaaaatctggttatgcctaatatatgtactctaacatccctcatggccgcggccatagtgctagcaacgtggacgctcagatattgaacagatataaaccaaggagcagaaataaaacctaaagaagacacaatgtcatagtgtttaacagcactacaatgagcgttattttaagaaatgacaaatctgacagctattcagttgttgctggtacacgtggtactacatccatgaaacggcagcaggaaagaaggaataaaaggggtacacgcatacgcatcagatggtgctttttcaattttattgatgcacagcaggggtatatgtatctacacactgcacatatattgtaagcacacaacacaattgcc

SEQ ID NO: 9708 - DNA, 1473 bp, Zea mays
ggtacttatagaccagaagagggtaagggaaggaaggaaattggccgggattgatctgatcagatcttctcgaccatggcgatgcgatggtgctcatgcagaaggaagtagagcagtgggacaaggaaaatgagtgcgtggaaaaggaaagggagctccacccgagagaggaaaaagatctcgcggtcagtcgtccacgcacgcgcacatggtagcgaggcacggcggcgacgtcggagcgaggaaggaaaggggagaagaagattagagaaagggagagaagagacttacagccaggctccatatgtcagcaaaacaggacgcagggtccgcttgttagccagggcgaggggacgtgggcatgagcgtggggtgcgggacgagtgggccgaattcgggcgtgcgcctggagggggaagacatttccctttttcttttttgtttgaattttgaaatccctttcctttttctttttgcctacacatgaccaccttatacccaaaatatgtcttgtaacctttcaaagtgtttgtgaggtattcataaataagatatctttgacaaggacaaatagtgtaaacatccaaaataatcattgcaattatttatcaagcaaaaaacatgctccaagatgaatgcatcaaataatatattcaactcttttgtttgaaaatctaccccctactctactattctcaagagatggattggggtgtcacaggatactcggctgtctacgagatctatatgagctcaagtatattaaaacgactgtcgatgcggatgttttcgtaattgtgctcttataagttggacgatactgtcacgaccgaggggacaaggcgcaacaggacgaaacatgattgtggttcatggtgcaaaggatggtttgtcgtgcgtgatcatgcgctttgttctgttgttgcacagggacatgtgaagacgtgtgcgttcttagattaratggctcctgttcatggaatcacatggttaagagctatgtcccaacatatcctaacgacatatgtcgacacactagcaagagatttgtaaatttgtccttttcaacactagccttcgaaattttatccttaggtccagaattcatggatacagatcgatccatataataaaggaggcaacaaagtcatagtcaaattctaatcatctccacgcttagttgtaccgtaaaatgaaatgctgcattgtttaggatttttttactcatcgttttatcattctagataacgtgacaattttgaaaacgctccagtgaaacaagccgactgaccgaaccgttgaattgcaatttccgctagaaagccgacgagacaatttcttccgttcgtttcagatcgggcggtggtcctgaccaaggcgctgccggccactggcctctcgcaaccggcgaccgcatctcgaagtagagggtgctggccgccgctctcggaagcgctctggaaggacacggcc

SEQ ID NO: 9709 - DNA, 320 bp, Zea mays
cacgagtgccgtgggcgaaactaaggggaccaatgtaaaaaactcatactcattaaactaaggccgactgttctgattttgaacacctatcggtggtcaactctctagataagctaacgcaaagaaatcaaacagcaacctctgaccagtccaaagtcagaccactacgtggtcaaccctcccctataaatggatctctagttctccacacgacgcctccccaaggcccaagctaccattcaacgccaattcacaatccttcacggcttcaccttcgcaacttctagaagtttctgactgtctaggctccctccctcgcc

SEQ ID NO: 9710 - DNA, 1500 bp, Zea mays
acctgtgtccgagcctacatcagcgtttggtttgaatcgcagaatgatgtcgtccgccactgtattgttctaataataaactagcatgcgggttcaactcactccacaaggaactgccggacggctccatccggagccaagccacgacggatgagcgaaaccgccggaccaaacgcgctgtaaaagaatgcagataggttaggttttgggagttgtgtgatcttcagctttctgccgataggctgtctgtaagaggtctttcagttttgtttggttctgtttctggttggaaccagttcccttggcctcaggcttcagcacaagtctaggtgtgatttaaactgcactgtattgaatactttagtcttttgacaatactgtagttaaaaggccggggggttttgccttggaactctaaaaaaatatacagtattaaccatggactctgaactctgtctgcgtccacaggcaagtcatctttcttccttgcactggttatcttattgaaacagaacggaaatcttttttggaacaagagaatttcgtcacatcttgcctgcagtaaagtttcccatctagatgcatactccctccgtccaagtttaactggcgttttagcttttctcagacataaataccagccaagagaatagacgcatgtacccctgtgatctagcgtgaagtattaattgcaattactgctgaggacacgaaacggttcacaacctccagccctccacggtggatgagaggagaccaagagtccgttggtgtgggaacgaagcgaacgggtgtgtgaaacgaggagataactataatggcatcgaggtgtagaccacgaacgacacataattctggacaaataaaatgagctaaaacgccattaaacttggacggagggagtatactatcaacatttcgatcaaaagttactatacaaaatttgcactgtccgaaaagcgatccttatcaggaaggcgcaggattcgtcccagctaagcgcaccggccacaagtattccaccacccccggtcaatagctaaagaaattgggcggcaagtgaaagtctccgggatgggaatgtgcatgagtcatgacgcgcctccgccctccggcctccgcagttgtttattcgcagcgcgcgggtggcggcccgcccgtccgtgttctctgctccctgtgttcggcacatcgtcacccccaccgtttcctgtgcctctctctcctatcttcctcggtctcctcccgtaatcctttgcctgataccccgctctaccaggccgccaccacctccctccaggctccagcagcctataaatacgcccgcgtcgcccaccaccgcacaccacttgaatactccatctcaacttcccttcctctcccgtgctgcgctgagctatatagctgctcctcgacctccaagaagcacgcgggcggagcccggagcgagtgattagtgaaaggcatagcataaggccgcccggccgggaagtggtggca

SEQ ID NO: 9711 - DNA, 675 bp, Zea mays
ggtaagtaaacagcttaggcagcccacaactgcgttctcctcgctcccttctgctctctgtcgtgtctggacctcccttcaggcgcgcgccctgatggatcaccacctgcaccgattagatagcctttaatttccctcccgtgagtcgtgtctcgatcgtgtggcaccgggaaaggaacacagggcggggcgggcagtgcatctcctcccgtggcgtgtgtcaccggcctcgctttccaactaatgaccgacccagcacaccggccggccatgcaagtggcgagcgagcgcgctgctgatccgttgaggaaagcgcccctctgccgtccgctaataaaacggctgccacatgtgtagcgtccgaaaaaagatccacgcgtagtacgtgtacgtcttgataatcgccactgtagtatccgtgggtctatctataagcagggcccccagccgcccgggccagccatggccagtccgacacatacgtacgcgtcatccggtcaggtgcatggtccacggtgcccctgctcaacgattagccgccgccgccgtgtcgtcgtcatcgagtccgcctttttctttttgtttagctcgtgggatctttcgcaagattttgttcctctgctaattaatcggcctgtaatcttagtagcagctaagaattgacgggcggaatgc

SEQ ID NO: 9712 - DNA, 182 bp, Zea mays
cgtacgtgtccgttgccgccgccttctccgtcgcctatccacagtgaaagacacgatgcggcggccgcctgtgcatgcactgaggatgagcgcgctgctgctgctcctctgcctgtgcgcgtttcccgccccggcacggtcgtagaacacgaccacgggcacggccaaatttattcaactag

SEQ ID NO: 9713 - DNA, 1319 bp, Zea mays
ggtcggtgattatacacctgtactatcattcccccatgaggattcccctttgtgaggcgtcggatggtggcaagcggagcccggatgcgctgttgggtgtttctatttgctcgaagagggatcatcgtttttcggtatgatgtggtcagcatgcttccaacctcctttagtccccatccatatctgtatggcagatggccagaaggcagcgggacgtgcgtagctacgaggggagcttaggtgtgccaacgacatgtcgttcttagtgaaggagctagtcatcgttcaactcttgtcgttttggctgttttaccctacatcgtgtggtgtttcctttgtttgtttccctgtgttgctggagttcttgctgcattgtgctagcaaccgttgtaatttgtggcatggcagaatgttatgtaggattttgtctcgtttagggccggatatcgagccagctcgactcgttcgagttcgagtcggctcggctcgttaagctaacgagcaacggagtcagctcatcactcatccattcacaattcacatacatagcagaaaaaatgtgtatataataatcaatttctacttaattctaaaataatttaacaacataaatagtaattatactcatagtttcacagaccacatcaatataacaccagattaacacaactcgtcaattcacaattcacacatgttcatcagtttaacccacacttatattcatatagaccaatttaacacatagtcacagttactcaatcactcaatcgttagtttaactcgtagcccaaagacaccacacatacatgtaacatgtttattaattattacgtaatgataatgcatatagtttcgtttttctgaaatgtgatagctcatttaccttgcgagctataattgtgaaattaattattttcaagtgtaattatctgataacaatatgtattatggtactacaaatacattattattttttaaaacttcaaaaattgatgtataaaagtcaaataactcagttaaacgataaaaggagaactgaatagggggaatagttggagaagagatgaaataaggggaaagaacagttgagaggatgttatttaaatatgaatagaaagtataaatagataaccttatcacgtgcgggcggccgtgtgtgtttatagtgtatccagtgttctgatttctaatgtaaaaagagtcatggagattcacagccgccacgtctagggattcacccacagcaatcgttttttttttcactcatggcttcgtctgcaccagcaggagggaagtcaccggcggtcggcggggaggag

SEQ ID NO: 9714 - DNA, 290 bp, Zea mays
ctgctgtatgagtagatgtcagatgcgatgttcttccagttttctgacttgagcctgtctctcgtcatactcaatgtggccctctgatttagtcccaagcaagggttgctcgtgcttcttagaggcttttacagtcagagtcctgatatctgaacttgcacactcattttctggtcgatcaggcacaggatccacaggtgaccgttcctcaacttcgcatggactgtcagcaggcgcagtggtatcctcttcaatgtgttcgtcagattcatcaatgtcctggatagcta

SEQ ID NO: 9715 - DNA, 1149 bp, Zea mays
tcagtacagggtataatcacaattgcaaagtcactcaacgttcacatcattctcgttttacataaaatcattcaaattatattttaagacatttattatcattcaagtattgatcacgtagaatctaatttaagacactttgatgattattaatacgttacctttttccctcggtcattcaatacacatttgttcaactaatctatcctattacaaattcagtcgttatagtttcagtcatttcgttgtagttttagtcatgttgttacggtttcgttataatttcaatcacccagttaccattacagttccatccgtcttggtggagcgtgggggcgcgaggggtggcacgtggtgggatggttgtagcgtgctggctgatcgaggtgcggcggtgagcacgtccggttggaacgtggtataatcagactgcgattgggtagcgcgttttggggatcgaatagttgattcaggtaataaatagcataacggtgatgattactcacccctataatgacttaacaaatcttctacgttttttaagctatagtgatctatagggtgacgaataatatatacacagacaaattcatatgatgaagtggagttggctctaatactgactccaatgatattctcagcgagccgacgtcgcgcgagcaggagattttggacttgcatactgaacccaacattctggaaggagaatgacgtcgtacccccgtgcgcatgtatgtcgctgctcgctggcgtgagtgatgaggccgctatggctgggttgccaagcatatcttccgatgctgatttccttttgactgacgagtcacatctccttctacttttattactgatcttcctgctgcgatctccacagccggtgggaaaaattttttagaaatgcgcggcacacgacaggaattttgatccgccttcctatgttggccgggcgcaaactcgtaggataacgcctactatacggaaccccgtcgggaattaatgcgcccgtcctcgccagtcgccacgaccgcagcaatccgccgcccttggccgtgccccgtgctgccgtactcgtaatccgtgagggaaagcgtccgcgctccgggccccgccgccgatagttccttcaagggagcgacgagcgcgcggtcg

SEQ ID NO: 9716 - DNA, 276 bp, Zea mays
cctcacatcttgagcttgaggtacgtgtagttggggacggccatgaacttggcgtagcacggtctccccaacaccacgtgataggtccctcggaacccgaccacctcaaaagtgagggtttcctttcggaagtaggagggagttccgaagcaaacgggcaaatcaagttgcccaaggggcaggacgcgcttaccagggacaatcccgtgaaagggtgctgcaccggcccggatcgtggacagatcgacccccaagagccctagggtctcggcgtag

SEQ ID NO: 9717 - DNA, 403 bp, Zea mays
cattcgttttgttggtcttgtgtaagtattaggaacattttaataaaataagattattgattggttgatgtgcttttggttttagcgatctctttatctccattgaagcaaagtgatcgagtttcgtttttaagcaacagaattatacttgaagaagagatatagatgatacatataaaaaaatgaagttatgtctagaatatagggaaaaatcttctgtgtattaaaatagaggagcttacgatgctgatgcgtctcctcctcctccataaatacattcgtcacgagcagcattggccattgggtgcagtcgagtagttgccacctaaccgtggcggaggcgcagtgctgttgcgagatgtggctgtgatcgagcgagataactaaaagcctccccacataa

SEQ ID NO: 9718 - DNA, 220 bp, Zea mays
cacactacctaccggttgtctcccacgtcgaaaggcggataaggttttcaaacgcacgcgattgcggagatctcggccgcccgatccgccactcctccatccgacggcaggtacgtccccggccggcctactacccggcgacctcggtcgcccatggccaccgcgaaaccttatccccagaaccacacggataaaccctagctgcgcgagccccccggcg

SEQ ID NO: 9719 - DNA, 1015 bp, Zea mays
ggtttatcctcacgacgcgctccgaggttgcgacagcgggcggaggaaggcgcgtggcgtgcggaggcggtttctgcgtgtgacgtgcgggagttcgtttcggagatgcagggaagcacgacgacgtacgacgatcactggagggggacaacacatgaaaaccatgacacacaaaaatctcctattgtagtagtagagaagagattacatgagtgcgggttgattctaaagaaatgtaggtttttttaaaaaatattgacacagaatgaccgttgaaaccagtgctttaatatagtagagattctttgtatggtacatccaaacgttttgttttttaaagtgtcgtgcaactctatttctattttttaattcctaagttttaacaattttgcattctgaaggggcttaaccttgttgtgagactttatccactgtgaggtgacaaattgacaaattttagtagatctgtggtatttgcattcaagcttatttacggtgatgtcatcgatttgtttatgcaagtgctgatctaatttcaaagtccgacaatatgtacggtcgtatatgagccgaactcggaggggagggaggggactgaccgagcgagaatcggagagccctttcggctttggctcttttagtagaagtagagatactcaggttcagttcagcacgcgtgcgctgtctccctctctcttcgcgacgactgtgcgaccgccgccgccgacctacgccaggttccccgatcttcgttgggcgcttcgccggcgacgagcacccatcaggtacgcgcaactcttctcttctcttgccgctttgcgaaaccgaggacccaaaccctaacttaagctatttggctacttgtctccggatccgatctaattacaactgaatacatgtatcatcatgaatactaaattcgacctctttttgcgaaatttgtcaggtgtatatttgtaatcctatgccctttactgggtccgcccctggttgattctagccctgttcaggagtg

SEQ ID NO: 9720 - DNA, 86 bp, Zea mays
ttgtaatttcgtcctagccagtcttcccttgccctaggattgcgccgccgccgatccgaccggcttctccccgcccgacggccgcg

SEQ ID NO: 9721 - DNA, 49 bp, Zea mays
ggtgcctgagcgttgattcgaagatgtttcatttggatatgatccagca

SEQ ID NO: 9722 - DNA, 1277 bp, Zea mays
gaggacccctctggtgttgcacagagtccgggcgttgagctgaactaatgttgtaaggcaactgtctttgttggttatgtattattattttcatacttgatactggactactaaaatagcatctgtgatttgatcctaatcaatggattgtatagatgcttatctagtatttttctatcacatagagaaaagacaatgcagtctagatatgctgcttgtaataatcttttctaaagcttggctaacttaaacgctatatatatctactacaatgtttgttatcttcaaacaaacatcatcgtttgatactattacgacaataaatgatctccaatcctttatattggaggaataataatatgtaacattggttgggtgtagagattacattatatacgtctctaaccctaataggctacatgtgctaggctaggtccatgacacacaaccatgaagaggacccagatccttcatcacgaactttggttgaagtgtgtgtgtttgtgcatatataaaatcttaggcaccataataacatgacgtatacataatggttctcttcaacttgcatctacattattgacataacataggtatcgtctagctacttggtgaataaaacttcagagaatcatattttgttgttttcatatggtaaattcatatgttctttctcttcaacttgcatctacattattggcataacataggtatcgtctagctacttggtgactaaaacttcagaaagtcatatttcgttattttcatatggtaaaatcatatgttctatcattacttgtcaggccaagttactgccataaccaaagctataaaggtttctaattcttgtattgaggtctaaaagtcagatctccaccatatatattttattttgtagcagactattatgcaagtatgatgatgattccttctctagtttaattctgtaaactacatactgtagtcaaaaagttttatgtttactttgttaattacgtcggcatggtttctagtcttcttggatatatgacgaggacttcatttgtgttgtgtgttgcaccaaagttaaataagacactggatatgatggaatatttgggttttggcactggcagctctagcctgtgtgactgtaatctcacatcttgcggttctaaggtctgaatgattctttttagtttattacagaagtctaagtatttgtggttctctgtatatattttgtttctaaatctacaagtatatttgcagctgcaacttgcttttctagaatacta

SEQ ID NO: 9723 - DNA, 1500 bp, Zea mays
agtgtaatggaaaaagaagtgcttcgaatcattgctatttgactcggacctgttctgaaaaagtcgaggtatttcgaattgtttgttgacacggacaaagtaagggaaaacctctgaaagaatttccatattgaccttggacatataagagttccgacagtccttgcaactccccttgtcggatccttattaaaagctccattttgtactggattggggcatcctattagtaaacccgtttggactgatttatcagattgggatattcttgatcgttttgtcttctagaggatttcaaagacgattattttatttacggagttggttacaaaatatccatctctcaaactggatttacggagatggtcaaaattagtacatctcccaaaatctattaaggtggtgtgactattcaaactaaaatctattttctaattggttcgcacatattgttgtatgggatcgatcaagtcgtatatttacatggctactgtcatgttctattgtttgatatgtttatcattatcattttaaaataatagttttggtaattttcgatcgttatcgattcatatacttacatgttatcgattcatatacttacatggttactgtcatgttctattgtttgatatgttaatcattatcatttcaaaaataatcgttttggtaattttcgatcgttatcgatgcaatttcgatcatatacttttgttatcgacattatcaaaatatcgatgtcgttttcgttttcgataatatcgtatcgtttttataccgtcaaaataatttgaaagtgaaagtggtggagcctttttccgatcgtttgctatcgttttcagccttagatcagacgacctgttaaacacacggcaacgactgctatgcaagcagccttctttgcaagcgtgcaagcaaattatctggttcattagatcgtgatccaaccgtaggtcacatttaacacttaaacccttccaccaccagctcaataatctttataaaaaacactctaacaaaccatggttgtatttgtaattgaatcgtaatttaatggaccagatggtttgcttgcacgtttgtaaagaaggactgcttgcataataattgttgcctaaacacatacccgccgctacggcctattactgagatgataaatctaaatacttctttataatctgttaggaccataaattatttttagtttaaaaataaataaaaatagtatccaattctaattcctaaattttatacagcgcattgtcagaggccctcctgagctgagtcccttccctttcccccggtccagtggcggacgccctagccaggcaccacaggccacagcctgggctgccccactgcccctgtcgccgtcgggcaagcgccgtccaacctgtgcgtcaccgcctccgccttcagtttcgcctccagcaggggcgccgcgtggggtattcggttcgtcgtcgaggagagagagtcacttctgccgagggagcaggg

SEQ ID NO: 9724 - DNA, 1500 bp, Zea mays
gacaccttttttatttagatatctaaatatagacatcatcatctattatggtttcttgctagataaaagataaagaccgacaacaagatatagaaaaaactgttgaagagcaaagacatatataaagtgaattctttcaaatgatgatttaaagagagtgagttttataaagactgttggaaatggaaatgctctaagagagaatattggactaggttattgagatgatggcgtacttttcttggtatatcatttgatttattattgtgttcccctctcacctagacggggaagaaaagagcctagctagatgccaccaatggtgtcagaatactataatagtaccactattataaacatacaaattaacaaggacgacctttcagagacatgaaagcaggcggcattgtaattgtacgaggtaagctggttgataggatgtcgacatccccatatactatactatatatagtactatactacatccgtttcaaaatagttgccaatgcctttttaaatttaattaaattcataaaaaaaatattactaacatttgtagctctaaataagtttatttaaaaatatgtttaaagatctatctgctggtaataatcattactgtaagtatgtatttggttataaagttaaaaacaattggctcagctatttcagaacagcgagaatattttttttcagaattaaggccggccgtctggagctgccaaaggacaccatggctttaggtgccagtacttgtagagagaaaggctagatcctttattatgtctactttcatgtacgtacgtcctctttgtcatctatatgttgaaatcgatttcttttgtcatctatatatgttgaaattgacaccgcccggctggacacagggatcagcggccttgcaataatccagttagttttggaaacctcctgctgctattcctttccggcgaacatgagttagttcctcgccgtctcagccagcaatttcttctaaccaccggatctaatagatcgatggacggctacaaaaactctcaagcacagtaaaatttctctaaacatacacatggccacgtcaatcacttggatgttttccatttatgctaccaacagaatataacacactacgtacgattagtttatctactacatcacatcagtaatagaaataacactaatgctaattaatactaggcaggtagcctccgtgagaagctataatatgtatagagaaggactactagttgcgctacttgcatctcaacttcgtgcgtgcataataaaacctaatcatcggcacttcccgttccgctctttggaaggtggctaggaatggaaccggcctctagtagctaggctatagcttccgcctttaattcccccatcagaccagtcatcgctcgtccccccggccgccggcgagctcttcgtcttcccgtgtgatccttccttcccatccggtccggcctagactagatctgagagatagaaggaggg

SEQ ID NO: 9725 - DNA, 83 bp, Zea mays
ggtatttccttctcagaaatgtggaccttgcaattataacttcgttcagcatatgaagagtagctcttctgaaagtagttctc

SEQ ID NO: 9726 - DNA, 349 bp, Zea mays
aaaaatgtccagcccttcgcagcatgtagttgacaagaagccaatttttcagaaaaaaacacgtggttgccgagcgagcccgtaccggtctacgtgtcattgtgtcagggctgtttgatgattttgcgctggggaatctgcgtcaccagtcaccactgagacggaaccgagtaaccgacccacgcaaaaagcgctcagcagctcctgcgcgccccctttcccccgtcggccgatttcgtttatctcctcaatcctggcttgaatccgtgatacgtcgaggcggcgaagagccgaatcgtgccgcaccgtagaggaggctcaggcttctgcagggttttggagcggggcg

SEQ ID NO: 9727 - DNA, 1500 bp, Zea mays
tttttggggtgggctagttgcaaaaaactggctctagccctcctgtttggctacttttgggctagtttggcacaaactagcccaaactagctctagcccttggatccaaacagggccaatgactagtgatcagctcagccaccagcccacccacggtgatgctcctgggtacgcaccacatccactatgtcgaagagtttacgggtctcgtgatcaacgcgaaatctatggcgcgtactggttcgagagacttgtgcgtcaggcggccaggggagagagagaggaaaaaaaccagagaattccatgctttatagcaaaaaggtcaaacaatgcagcgtcgtcaagcgcgaggcattgatagcgatgcgattgcgtctggataatgaggtcacttgatcacatttcccatgtgcaaactgcagcctccagcctccagggtacgaagcagacttcaatcccgaaaccagaacagaaccagaacggcgggaccggcatatgaactgatcgagcaagccacggatgcgtcgggcgcgtgaggaggaagagcagcggcaggaggaggactgaagtgcgtccatgacggctcagtgcgtccggcagtctgggcgtgcatgagtgcgtccggcagtctgtgcatgcattagggattacagattacttactggattggggcattggggacagttcgtccgtccgaggtccggcagagaggagaggaggaagacgagtcacgccgtcacaagatttaggggcacgccatggagcgttgagctgagcagtggcgactggcggtgggcggtgtcgctatgcagtgcttgctgtgccgtgcaggcgtgcggcggctgtgcctgggcgagggcaacgaaagactggaagtggactgtggtggccgacgacagatgagctgtggaggcctgctgggctgcttgctcccatgggccgtctgagttgtgaatttagattttagaaattgggctgggccatgagtttcggtaaattccgaattttgaattcggtaaattccgatccaaaacggtaaccgaacaaaacggtcggtaaagggctataccgatttcgataccgattccgatctaaaattccgatgaccgattccgattccgagaaataccgataccgacgattccgatcggaaaaaatcgaaaacggtttccggaattccgaaaaattccgaaaccgttttcatccctatctgtgtggacggtaaaggtggcgggggcaacggtgccacaagattgtgggccctcttagattggcccacatgtcagccactggctaacccatggccggttgtcgttatccatttaaccgaccaggcccatggccatccactccactagtccacttgcacttgcgacagtgcagtcaatcgcttcgtctccgcgtctcgcgcgccccgccgcataggcgccagtcctccacagaaattcccacacctccacgccgtacggccagagtcgcggtccccgtcgaatccattcc

SEQ ID NO: 9728 - DNA, 97 bp, Zea mays
gtaatttttttaatattgattaaggacttgtatgttcgtatgggacatcgtatttgtatgcagaaattaaacttattgtgatttggatgtttgattt

SEQ ID NO: 9729 - DNA, 373 bp, Zea mays
gatccaaacggggcgttagggcttttataaattatgaataaatatttggatcattacattaacgtccgtaatataagggactaatcgtttaataaacaaacaaataaataaatcggattcccaaataaaatggcccagctgtatctagcatggactcgtggggctcagtaaagtaacgctgacattttcaatccgaggtaacagtaataatcggcgtattaaacggtaaataagaagaagaggaggaagacagttgctgctactcggcacaccaaaccactccagtggagtccaacaccgcctcttctcctcttctcgattcgaaatcgagtacgtccgaatgctctagaaccttccgggcctagggatctcg

SEQ ID NO: 9730 - DNA, 1500 bp, Zea mays
aagggatggtttaggtactctagtatctacctcaatttacatgtgttgagatggattatgctaatttacaccctaatccatctcaacatatgtggatttagtgaatattagagtacccaaactagttctaaaggttagagtaaatcagtaaatgcatccatagtcacctaacttaacaagttggatactcgaacttagaaaatataaaaattgggtcctaagccgaaaaaaaatcatctcggcctaccaaaagcaggcctcgccatcttgctgggcgagaaggcgtacggtggatgaacattattcctgttacgatgattttcgcagtcggcgcgcggaacgagccggggaaaacgaccgatgcatgcatgatatatccggtgttgtgtttgtgcacactttatttaaagcagtcggtcatgcacatgcacgtactgttaggagatgctttaccttctttccgagccatccatcgccttgctttgcccttttgtttttttgagggcgtttgatttgaataattaatttattttaaataaggtgatgttttatgagtctattttatagatttgatggactggactgaactcatttctaatattattactaattattagtatataaataatgaaataatgatgaatcaacttattctatttcacataataaacaagaaagtgagcagcgactatgatgaactgtttcagtcctcaaaccaaacacgctattggtgtgtgtatgtggtggggtggtatccgatggtacggttatctttagatttagagtattagtctcaggttcaacggctaagtcatttgaaagtttaagggcaaaggcggtcgtcaagtggcgtgctgtcgatgaacatggagtggcgtgctttggtaactgaatttctgtactgcgtgcggattgttacttctccgcagagtccagatctcactactagcggtagagtactacgactgactgacagacagcactgcaatgaacagctccaattttttcctttctttctttcttcgactagcaatgatctcaacacaatcattggccagtagagtagaggctgttggatgaccggcggaagaaaagaacatgtactaaaggcgaacgttgtcgatcgagcagtttgctgtgctccgatccgtctgaaattctcaagccagaatctagcttagctagcccagccaacaccctcagaacggccacgcacgaagacacgttcctctgcaagcaaagcagcagcagcgactgcacggccaccccaccgccctaccaacggcggagacacgacgcctccgcaaatcaagtgaaaacacggcagggggccagcggctagctcgttgctaaagctgctattttggcgagcacatgcacgctttatatggctgccgttcccaaagatgccaagctagctagccgcctagcccttcttgctgctccttctccttctccttcttctcccgctccactccattccccggctcgatcgccgca

SEQ ID NO: 9731 - DNA, 319 bp, Zea mays
gggctgggcccgtcgcgtatatgggccgatccgtctgtgccttcctgcgccgtttgcttcgtgccgctggatcagcaacggagggcatcgggcggagtatgtccctctcagccacgctgccacggtccacggaggaatcgaaccgtctagactgtagcccttaatcgaaaccgtccccaacccttcttcctccacgctctcgtctccgccgcgctaggaacttccaactcccaagcccagccgcctgcctagggttaaggtcgcccctccgccccctcgctccgctcgtgaccggcagggttcgtcgccgccgttggat

SEQ ID NO: 9732 - DNA, 1500 bp, Zea mays
aggatgaataaatgacttggaataggaacgagctcgtccttggagaaatagcaacgggctttgacttaaaaatctacatttactgaacctactagtgctatactccactggtaggttcagattacccatgcgtaggagaggagattaaaaatgcaggtgcaaattttatggtgtcgtttgggtcgaaattttgtaacgtacggttaacgagaacgaaatgacagatcaatgtaaaaagctgaaggaaaaagcagaagctgccatagcaagcaagctgtccaatcaatcagatcgatcgactgtggagactagggttgaatatctttcggattgttccagtttaagctgactcatagagtcagtttagctcgggtcgtttacgggtttaagttagctcgtttaacttatgagcaaagtaaaaaaatatataaataataatcaatttttagttaattttaaactaatttaacaatagaaaataataattatactcataatttttaaaactatatcgatgtaacatcaaattaacacaactcattaattcataattcacacgcatattcatcagtttaacatatagtttaacatacagttatattcgcataaaccaatttaacacataggcattgttcatacatataacatgttcatcatttgttacgtaaatggtatgcatatagtttgttcgcgagctggcttgttaacaaactaagctaggatgtcagtccagctcgtgaaaaaaagttcaaacaagccgacgaacaacgagcattttgtccagccctattaaaggcccaaagagcgaagtagcaaggaaatagggctgaacgaaatgctcgtggctcgttagctcgctcggttcatggtcagctcggcttggcttggatcggttcatttgattttttttttcacgagctaagctgacatcttagtttggttcgttaatgaatcagcttggattgttaatgagccagctcatgagctaacacatttcagtaaaacgaaactatgcatatcatttacataataattgatacacatgttatatgtatgcgtggtgtctgatctataagttaaactaatgattaatgaactatgtttatgtgttaaattgatttatgcgaatataattatcgattaaactaataaatgtgtatgtgaattgtgaattgatgtgttatgctaatttgacgttatattgaaattgtatttgaaattataaatataatcactattttctattattaaattactttaaaattaatgagaaatttattattatatatattttctgatctagctagtgagctaaacgaaccaaatggatctttaaacgagccggggtcgcggggatgggaaatcatggagccgattagttgtggagattcgggtgcgtgatccggtcggatcttgctttcccaggggagtgggggcggggatcgaggccacgccgctgcgtgggcggctgggcgcgcgtctgacgtgccgtgccgtacc

SEQ ID NO: 9733 - DNA, 1279 bp, Zea mays
acgagtctttccagtgtactttgtcctcactcctgcacaaccgggaaaacttcttagtcggatggccgctggattgcgggctcgtgactctatatggggtggatgggtttggaattggaccaggctcagccagccgaccaaggttgtgattgttgctaaccgggttgggttaggagtagccatgtgccccatgtgcccatgtcaaagagaaaggatgaaagatcgaacgagcaagagtcaagtgcataactcaccatcattagaatagactaagggctcctttagatcaatgtcaatggctgctttgccacatttatgcaattgaatatgcttagcatggtctgtttggatggacgccaatagttggctacccaaaactcacttcatgcggccgttggttttcttgccaactgcaggcagaactcaggctaggctggcagaatcctcagccaaattttggtgagaaatcaaatttgcttgtcgagctggagccaaatacacatgaaccttaagtcatatgcaggctcacccatattcgatcaaaaatagctcataagccacgttaaaaatggcactcatatggaaagaccacctgttcagtcccttccaaaggttccagcaaacatatatgaagactgcattagtactttcgcgttttgaactatcctctcatgtacagagtacaatattccagtaacattgtgtcccttgaaatgtagcagaagaagctgcaggatttctggacaaggacggcgcctaccctatagtcagtaccactaccgactctcaagaatatgctgagatccaaacttacaagaccagtcttctgacggcatttgatcacctgaagtcatgatgtccaaatgccaatgggtatattaagcaacattttaactctgcactttgccgtggcggttaatgttctagtttcttgaatcgacgcaatttatctctagaacatgctggacctcctttgttgaccaagtgggttgctgatggaaatgcatgtctggttcatttgtttcaaacaggacagtacattctttccttctgtgggccaataacaagagctttaatttatttattttcttggtataaagtgggttgcaatccaaacagattgcatttggacagttgcaactgtacactcatttaggaaggataggcctagcggcaattgtgagaagccttttcactgagtcaaatgacctaggttcgacagtctctatgcaaaaatgtaggaataaaatttgcctcggttttttagaccgcaatcgac

SEQ ID NO: 9734 - DNA, 1500 bp, Zea mays
tagactacccattatcacccactgcttgcatggaggcaccaaagactaaaaggatcacacaaacaagtccttagagccatcatactaaaacatgtacttaagggaggttcacattaagagtaggagattcgtaaggtagtgttcgcttggctttaatccgaagcggcttctaatgtttctacagtgtttgtctatatggattatagttgcagcaatctaaaacagctggttttaattcgaagtgaaccttgtaaatcctctttgcgactatacacttagaacgaaatttctgcatgtatagaatggtttatgcatcctgtccaaatcagaatggcatctgtaaactgatagtgcctgaatctacctgcttgcttcatcgattcctgttcttgcttttgacgtcttttgaagggaatttgctgcataacgtgctataaaacttcaagtatgccttgccctggtttcgaatatgtaatgtaataataaaattccgtgaaaagctgccagttgcacatacgtctcgtgttcgatacaattaatcaattatgtaggagtatcatgtaaagaaaaataaacattcagtgctagcgtgaggatctctgatggtactatatgactgcttgcttagttcgaaaagagagatctagcctgagtcatggcgcatgaatgcatgcgtccgtaaaagtgggtgggcgccgagccacgaccatgactcccgagccctcattttggttgggtcgtagggcggcggcgcacatgtggcggtgggggcgcagtgaaaagacacagctgcaaagataggcagtgttgcagtgatgaacccccactagcgggcgaggcgataatgttgtttgccaggacctgctaaattgcggaaaatgcacgccgagcgcccgagcctatctgcctgtcctttccgtgctctgccacagcaccacttctagtcagccatttcgtccaagccactcctctcttgatggctgaggcggtgactgaggtcacagtcacaggcacttgccatgttcttgtccgttgcgatcgttatcgcggtaggtttattatttccatgtctttgacttgctctctccgtattattaggagtaactgcaatgctcaagctcaacaccagggacaccgtgtcaattgtgggacacgattgctggtaaatacattctctacagttgttacgcggtactgcactacactctgggtatccactcgtgcccctgtatgaagctggcgacgctgtacgcgtcgacgtggaccttgggaacctggctgctccacgccaccctccggcccgcggcgctgccggggccggcgctgtcgtactcgccgtagtagagcgtctggagcgcgaagtccccgttccacggcatccacccctgcggctgcacgatctccgcgagcgtgcacccgacgtacacggtgcgggagtactccttccacgggcggcccaggtagacgtggtgcacgccgggcctctcgcggtacagcgcc

SEQ ID NO: 9735 - DNA, 932 bp, Zea mays
ctatttctacttttttaatcaaacaaaaaatagagtgattccgttctacttgccaaacggagaatagaacaactcaattttcaaaaactagaatgtatcttctctattttaattgactcttaactaaatctaccttaagagactaattaaaaaaaatacaagctacattgataattcatgatttcgtagttatatcaagcaatcttttagccgtattttatatttagaaaatcgaactagtgcgttagacttctaacgaatgatggggcttaaacataggtatcacgattttacccgtcgtggagagaatgatacgtgcctcgggagtcgggaaggaggaaaaaagaagaaaagaaaacgcccaagggcgagcacagcaaagcaacaaggaggagaaagccaaaacagagtagtagtcacccaaacccgagaagagaagtgagaaccctcccaagcaagccaaagccagcaaagccaaaaggaggaagacgcaccaggacattgacgagccgcagtccgcggcagcaggcccagcttcatcccccggagccccagcactggggttggcaggcaggctcgctcgccgccgccgcgtcaagcgaagcgcgcgcccccgcggacgctgacgctgggacccgcgcctgctgggggctgggagtggacccgcccccctgatgggcgcctgcgcgccggcggcgaggggaagcgtgaggacgaggagcgccggcgggctccgcgcgaagcaagccgggcgagcgagccaccgcgccgcctagtgagggcgctcgccgcccgtcttagcttgttgccttgttgggttgctcgcacgtcctgktccagttccaggccagagagagcggggcccggggctgcaggcggcggcccgcggaggagctagggttctctctcccactcccccctgcgtcgccagg

SEQ ID NO: 9736 - DNA, 1046 bp, Zea mays
taccatagcttatatgttgtaacatcttgttggtcatggattcgaaagaaaatgaattagtcttcagatgtgtatgggctgttaccagaagttaggcaacgagcaaaatcaatgcccaaaattgtctagcaaatcttccatagaaatctcactacctttctaagtaggtgggcaatgtcaatgatgttgtgagtcacctggtctttagataggtgtttctttcctcatagaggggggttttcaattgtaaatgtactatttgttccaagcgaaaaaatcttttatgttcgaagggttgccattcttataacaaatgtatcttttatgttttaagggttgccattcttataacaaatgatctttggcgatgcctaatgtgattatcttttatgtttattggctgaaatgaaacataaggctagggatcagtgcagtcttgaaggcattttagttgcctctttacatgtgtttgagaagcttgagctcactagaaaataagcgcatttgtggggcttttgacctgtaggacttctgcaacccgctgattttatattttgattatgcatttgaagaagttataagaatgaatacaatatgtttgaggtggtgcaagttacatggaagtgagcatttttgtattatatacatgagaaaacttatgggccatgagagtagcatagaattgtgctatatggttgtgaattacgccattatattcatttctggatctagaaatttctgaaatgagtaccaggagatgccaatacagtgatactaaaaccattgaattgttgggttcgaagatttcacatgaacactttaatgaggcttctcatctagctgatcttctgatgttgttgaaaccaaacgcgtggaaggtatgcagccattattttctgggtatccatattatttctttaaatgtattattctytttaaatgctaattataaccgacatgggagttaaatggtcactttcataattctttagcagcattagtgccttcatctgttggcacggttgtcacggcagaacagaaggaca

SEQ ID NO: 9737 - DNA, 270 bp, Zea mays
gcgctttgtacgcctccgctgcaatcagcccccgcggcgagcttgccctgcccctgattgctagttctcgccgttacgtaaggtaagctcctctccatcttatttttttcttctcttccccattcatatcggcagatgagcgacgggttctgatccctttcgaaaaacaggcttcttggccttgcgtcctccgtctttcgttgctgatacatcgaggtattaaagaagctgcctggttccgggcagcagaggtcgccgccgcctgcagca

SEQ ID NO: 9738 - DNA, 867 bp, Zea mays
  unsure (1)..(867): unsure at all n locations
ctgcagatgagtatccaagattacagaatgttcttcaacaaggagaccttaatggtcagccatggagtgaagccttgcttaagttctttgtttgatcgatggatctaaagtgtttgttttgttctttctttgctcattttctttgttttctaagcttgttcttccccttgctgtcgtatatagtctgtaactctttccttgtttcttgtactctacagattgaacgtatgtatcagtttactttcattgatagccttttcaacgtttctccctttcttgttatatatatatattttttctgtagagcaccccccnccccctccccccccaagttttttttaagaaagagcaaagcaacatcggagaaactgagaattccttcgcttatctttccaaaaaaaaaaaggttcctttagttgcctctaaactgagaattcagttatactgcgagacatgatggttacagtgagcgacagaaactgagcttcgcacgcgttttgggtccaaaaccacatggtctccaagagtattttgacgatattttccagtcggaggcggcactccaaaatccaaatgccctcctcccaattgtatccctccacgtgtcccatggtccttcacgactcacgagcagcccatccattggaccatacagataagaaccggataaggcagatcgtggccgtcaaatagatcacatccgttctatggccgtccgatttgccacccagagataacaccggaatttcctacaagcactatcctatttgtagcccgtgacgagcgagccccacccccacgccacacaccaccaccggacgctagctcaccaccaacctcagcacatcgaggagaagaggagtggcc

SEQ ID NO: 9739 - DNA, 98 bp, Zea mays
ctgcagatgagtatccaagattacagaatgttcttcaacaaggagaccttaatggtcagccatggagtgaagccttgcttaagttctttgtttgatcg

SEQ ID NO: 9740 - DNA, 366 bp, Zea mays
agtgagtttgtgcatgattggttagtggttatactttttttgttacttatcctattttaaatgcttgtgacagtgcaatctatatgccttggttattgaccttggcagacccaaattacatttcgaagttcatgatgccatcaaatgctgaatgttttaccattttatgtcacggtggtacctgattccagaagcaagattctgctggaaaagtaccagttttggttgtctaattgctgttcttttattctttaggtggattctgaatacattccagacctttcagttaattctcctttgtgtgtatctggaaaataccgaggaaaattcccagacacagtgaaagctaaaggttacttagctgac

SEQ ID NO: 9741 - DNA, 645 bp, Zea mays
cctaaaccaatggtataatttagtagccaaaatagctcatattggtttatcaaatgagagagacactttctcatggaacttatgtcgcaacggtcaatttacagtttgttcgatgtatctttacctaatgaaccacaaccctcattttactcacaaaatcatttgaagtttgaaagttccgctaaaaattaagattttcctttgataccttcaacatgggatgatcctcacaaaggagaatttggcgaaacgcagtcggaaagatagtcaaaagtgttgtttatgtaattgtaatgaaacaattaaacacttattgtttgactgtcaccacgctaaaacgatttggagggtggttaatatagctatgggtttaacagcacctacgtcgattattcacatgctgggaactggctttcaggagttgctacaaaaggaaagagtattattcttgttggggtgactgccctttgctgggctatccggtggtgtcggaatgatttaatttttgacaatgtcatatatacatcttttatgtagactattttcaggggaacatattggctgtggtgttgagcattgctgcagcatgagaacgtgacaaaggagaacatccaggcggtgagccgtatcctggagattattgcc

SEQ ID NO: 9742 - DNA, 205 bp, Zea mays
ggtggcgaacgcctcggctcggcgccgcaagtaggagcgacgggaggtctgctcggtgaaggtagcggcgccggtctacctagactggtccgacaagcccatcaccttcgaccaaggcaaccaccccgactatgtgccgatcccaggaaggtacctgcttgtcgtcgaccccatcatcggcaacgctaggctcaccaaggtcctc

SEQ ID NO: 9743 - DNA, 979 bp, Zea mays
aatactgcttgatgaggagagttcggtgtggatcaggtggcttccaacatgagcagcgggaagggggcacggtaagatgcagcaaggcaccgcacaacaaggcggggatctagagcgggatcttaccttgtcgaggggaaggggactgacagtgtgatcaaattctatcgcggactatcggctcctttgggcggactgtccgtaggccagaccgtctgaccctcagtgcccgatcatccagccatgcccagtgcaacaattagtgctcaacagtcctaaaagtggtccccaaccctatttctctcttctttctctcccccaccaaattctctcctctctctgtcccctacaaccaaccaattgctccttgtgtactgctcaggcattaattagtgtaatatgcataaatttatcacttgtatccccttaagtgctagcacgatagaaacaagagtcagttcgaaacatacaacttaaattttctttaaaaaattagaaactagttcatttccatggcattaaaatgaactagccgtctaattttatataagatgattgacatgtaatcctagaaaacaaacatgcccttactattattctaatcctcatggatatttcctatatacaaacgccgacgcaaagctcgtctcacaggccatccacgtcgtccctattcttaatagtcgttagatcgtcatccaacgaacacagtcggatcaacttttcactgtctcccagcatcgcgacatttccaggctctgccaccacctctcccaatgggcggccacagtttcttcctccgacaattcgtcacgcccatgccgccctcccctccgaccacctaacttcgctccgcccatggccgtcgtcgcccatgccggcctcccacggcctcgcctctttctccctttctccttccacggaagccccatctattcatcatgcctgtcattggctctgccttcggttgctgtagatt

SEQ ID NO: 9744 - DNA, 1500 bp, Zea mays
atttttactcttttgtatcttaaaattttatgacgaatttaggcttaaaattttatacagtggtagagtagacaatgacatacatctataatatttttgatttttttgtgacttttgttagttgcacgaaaacttagtttacacgtgacatgttgctatatttgtatgcttgtagtatgtgcgtcggcggggcgtcatttagataccaagtaatgattcctgaaaatgacagccaagctccgggtgttgctagctttgtttaaatcattttaggtgaaaatttccgtaagtttaaaatcaaaatttgaggagactaacgtttctttaaataatcgtggggctaaaatcaaaatttgaagaaaacttaatacgaaatatcatcgtggggctagaatcagaagttggaggaaactaatacgaaaaaaagggaatcaaaacttgaagaaaactaaatacaaaaataagggatatgcgcaaaaatgggcgtcgtttagatacctagtaatgattcctgaaaatgacagccaagctccgggtgatgctacctttgtttaaatcatttttaggggaaaattgccgtaagtttaaaatcaaaatttgaggagactaacgcttgaagaaaactaaatacgaaatatcatcgtggggctaaaatcagatgttgaaggaaattaatacgaaaaaaagggaatcaaaattaaagaaaactaaatacaaaaataagggatatgcgaaaaaaagggcccaaccgggttcgaaccggtgacctattgatctgcagtcaattgctctaccactgagctatggaccctttgatgtgagcaaacataaataagaatattagtagcaaatgtacgcagaacagtttcgcaaacccgcggatcctgtatagtggcatactggcatgtatcggacggcggcccacaacacaataatttgccccagtaggagtatagcatagtagtgctccgccaatcaccgacgacgtagtaccttggtcacatgagcctcacagggcggcgaaataaacgcgggccccgcacctcatgtgtggaacccgtgcgcacgcctctcaattttggcaaactgcctgcattagcatgactagataaggcgagcccagcattggccagccccacctgtcattggttcaaggggaggcgggggagccacggcggcggagggaattgtttaatcccccgtcaccgtctcctatcgccatcaccccacccgtcccccttggtccaggcgcaggcgcgagcgcgacgtccggcgtccggcttcggcggcggagtggagcgatcccgatccccacaaggaattccatcgctgtcgtggcgtttggtggcgctcctcccggccggcaagcaggatcaggtaccctcccgtcccggatcctcccaaccgttccgtttcccgcggccgggctggcttagttctgcggcgctggttgccatttcgggccaaatttgttgcgtgaagcggaaggatttggattga

SEQ ID NO: 9745 - DNA, 1500 bp, Zea mays
gaaaacttagtttacacgtgacatgttgctatatttgtatgcttgtagtatgtgcgtcggcggggcgtcatttagataccaagtaatgattcctgaaaatgacagccaagctccgggtgttgctagctttgtttaaatcattttaggtgaaaatttccgtaagtttaaaatcaaaatttgaggagactaacgtttctttaaataatcgtggggctaaaatcaaaatttgaagaaaacttaatacgaaatatcatcgtggggctagaatcagaagttggaggaaactaatacgaaaaaaagggaatcaaaacttgaagaaaactaaatacaaaaataagggatatgcgcaaaaatgggcgtcgtttagatacctagtaatgattcctgaaaatgacagccaagctccgggtgatgctacctttgtttaaatcatttttaggggaaaattgccgtaagtttaaaatcaaaatttgaggagactaacgcttgaagaaaactaaatacgaaatatcatcgtggggctaaaatcagatgttgaaggaaattaatacgaaaaaaagggaatcaaaattaaagaaaactaaatacaaaaataagggatatgcgaaaaaaagggcccaaccgggttcgaaccggtgacctattgatctgcagtcaattgctctaccactgagctatggaccctttgatgtgagcaaacataaataagaatattagtagcaaatgtacgcagaacagtttcgcaaacccgcggatcctgtatagtggcatactggcatgtatcggacggcggcccacaacacaataatttgccccagtaggagtatagcatagtagtgctccgccaatcaccgacgacgtagtaccttggtcacatgagcctcacagggcggcgaaataaacgcgggccccgcacctcatgtgtggaacccgtgcgcacgcctctcaattttggcaaactgcctgcattagcatgactagataaggcgagcccagcattggccagccccacctgtcattggttcaaggggaggcgggggagccacggcggcggagggaattgtttaatcccccgtcaccgtctcctatcgccatcaccccacccgtcccccttggtccaggcgcaggcgcgagcgcgacgtccggcgtccggcttcggcggcggagtggagcgatcccgatccccacaaggaattccatcgctgtcgtggcgtttggtggcgctcctcccggccggcaagcaggatcaggtaccctcccgtcccggatcctcccaaccgttccgtttcccgcggccgggctggcttagttctgcggcgctggttgccatttcgggccaaatttgttgcgtgaagcggaaggatttggattgaatggcacgcgttgtttccagtcgacgccctcttggcttgcctttggctgtaggaaatcgcacggaggtgaggatacacgggtgcggaacgagagctaggcgaacctgtctggtacctcgcggcggag

SEQ ID NO: 9746 - DNA, 528 bp, Zea mays
tcatatccaaccagtagtggagaaaatcgaacagcgacttgccagatggaaaggctaaggagtaaggactactgcactgtggccactgaaagtcgccgcggcggcactccaaacctgctggattgggcctcttgatcgtgttctgggaccctgtagccacagcccgactaaatgagccgtatgctttatcaagaagcagtagctcgcctttagcgggcccagaaactcttgttagagaaatagtgggccatccgggggctcggcccataccagccaatgaagaacgttctagagggcacccgagaggccgggagcacgctggcacgttgcggcggcgcagagcacatccccaattccccaggaacaggctcgtaatttttccactgccatcgcaccctttcataaaaccctaaacccaggacccaggtttatcggtgaggcgagccgcgagtggaactgtggaagcgtcgagcttttttcttctttgtcttgctgcgcaagaagaagggaaacgagaggagggcggcg

SEQ ID NO: 9747 - DNA, 606 bp, Zea mays
ccaggaactggtatatgctcatgctggcgtcgacggcgattttgcggccgaagtagctctcgaacttctgctccttcatcgccttgggcgcattgtccgccagcagtttcgtcaaaccctacacacgccgaatgcgcgaaacgaggcagagcccgtcagccgattcgccaccaggcggcatcaactccggaatcaaaaggaaggtagagggagaacgagatcaccgcgcacgcaccttgatgcccatctcgtctgcggcggctgtggcgggtggcgggcggcggctgagccggagtggcgcaagaaaccgcggccgcgagctatttccgttttgttttgttttttcatcgtcactttggactagccgggtttttgtgttttcgcggcgcggcagagaatgcacacttgggccgtaacgggcggcgtgggcctgctgcacccaactcttcaacgaaaggaacaaacgcgtcggcccactgcgaagcctcgcgtctccgactccgccagcaccagcaccagcaccggcccaccggtggcgaggtcgcgcgagcgcgggcgggcgtgggactgggaagggagtaggacaaagaggaggaggtggcggcg

SEQ ID NO: 9748 - DNA, 1266 bp, Zea mays
actaggggaggatatgtaaaacccaacagacttgacaaaagagctttaacatcttctacttgttctagcactcttccatgcttatcaccttctgatgcaactggaagatcactctgcttccgaatgcaggaacttgaagtgtactcacctctgccacttgcataaaatgaatgaccacatgaaagttctgagagaacaaggcgtcgctcactagagtatgttgacatcatctcatatagctgttgctcttctgcagtcctagtttcctcaagaacatcaaataaagaagacccaggaagctgcttcaaagttctgtgatgcctcctttttctttcaacatccagcattgtatcgttcttatcagtaattccactaataattagctgcctgacataaacctgagggaaaaatataccattgcggataagctccgcgataagaacatccacccgggtaaaacctgcaacgttgctaacttcatgctgatccaaccaacacacaataatatcatgcagtggaccagggctttcaaagatatcatttgtatccttcttctcatcaacattttttgcattacttctcagtccagaagaatcatccacagcagctgctgtcaaacaagcatcggtcagtgaagaacctttggtgatattattcagggtaacgcgagtgctactcttagaacgagacaaattattcatctcatccattttattcttcaagatagacactgccatatgtatctgagacaaatctcttcttcctgtaaatttcacattccgagagggagatgctcgacaatcacgataatcacatgtcgcccattcacaaaggaaaaatatagaacagataagggatagctcaacagtcccaatccacatcagagaagactgcagactggggctgacttctttaatccatctctcttccattaacgtatcagataaatcattaaagagtgaagaatatgccactgacaaatttcctgtgacaagagctatgtccaaagcctgtaccactttggctgcaccacgtgcttgaaggttagggttagcaactgttgcgagatcatatgcacgtttttgaattgaacaaacagcataaccacaggacaaataccgataagcatcacaccttttagaacttgaaattccaccactgctagttatcttcaacaaagcacctctaccatatacatcaggaaccacaaaagatgggagaggaaagcaatccaaagaaataaatgtatctggcactgcaagtacc

SEQ ID NO: 9749 - DNA, 1500 bp, Zea mays
ttgtgtcttgtgtgcgttgctcatcccatccttacttccgtgtttctttgtgaacatcaaattgtaagggcgagaggttccaaagtgtggagattcctcgcaagcgggatatagtaaagcaagcaaaacaccgtggtattcaagtgggtctttggaccgcttgagaggggttgattgcaaccctcgtccgttgggacgccacaacgtggagtaggcaagcgttggtcttggccgaaccacgggataaaccactgtgccatctctgtgattgatctcttgtggttattgtgttttgttgagactcctctctagccacttgacattattgtgctaacgtctaatcaagtttttgtggattaagtttcaagtttcacaggatcacctattcacccccccccctctaggtgctctcagctataaaagggacccctaggcgcatggaggaggataacaagcattctctaagcattcctaagcaccaagactccaattccgcgcattcgattctttgtgatagcaactagagctccatttgagtagaaaatcgttcgagttgtgttgagagctcaagttgtgacttgtgtgcatgttgttgctctgattttgtgtcttgtgtgcgttgctcatcccatccttactttcgtgcttctttgtgaacatcaaattgtaagggcgagaggctccaagttgtggagattcctcgcaagcgggatatagtgaaacgaaagcaaaacatcgtggtattcaagtgggtctttggaccgcttgaaaggggttgagtgcaaccctcgtccgttgggacgccacaacgtggagtaggcaagtgttggacttggccgaaccatgggataaaccactgtgccatctctgtgttgatttcttcgtggttatcgtgtttaaaaagaactcctctctagccacttggcttcattattctaacacttaatcaagtttgtggccttgagttttaagtttttacaggatcacctattcacctcctctaggtgctctcagcaaatcgtacacacgttggtggagatgtgatagtatatttaaaaatgtatcagagaaaaggaaaggattgcttttaaaagctgatatataaggtaagagggttgttttgtactccttgatctcaaaatataattcgtttaaaattaattgtatatttattaattaacatccgaatgaataggtttatatttgttattattatttgaatgaatatggaaagaaaaaaacggtctgcaaataactatattttagaacggacctactaaaaatattataacggtttgcacggttccattcataaatgatctatccacaatccgtttgtcagacacaccaccagattcgcgtgtggtgaaagctactggtagatcgcttgacggaattcggaagccactgaggcgagcggcgagcgcacaccgtcacaagcaccacgccgccgctactgactgacccgaccatcactcacccaatacttggaggtgcgag

SEQ ID NO: 9750 - DNA, 1500 bp, Zea mays
tagcttattaatgtattgattgttatttacatggtgaattattttttatgttggtgttagttggtatggaaaacccgttgggtacccgaaatccccacaggtataggtttaggcaaattttatatccgtcatgggtatgagttttttagcagccgtattttttcttcgcggatataaatttgagcaagtaatacctaacgagtttttaacggttgccatctttagatggcacgccacagactctcgctcgcaaaaaagatgcttccaccagacgtatctccctcgatattggcagggcccaggcccagcccacgccttgtccacgtctaccggtttatttgtaatgggcgccgtttattattaattatcacatcgacgcagcagagctatcagggcccccacgcggggttaacgctaattccccaccgcctccgcctgcgtccgtctccgtcatgtttcacccgtcagtgcacgcggtcaatttcgtcacagcaagcccactcttctgatcgtgttcgtgtgacggtgacgtgtgttgccgcggccgaccacgtctctaattaatcccccacccataataacggaatatctatccctttctctctcttttctttctatccggctggtacgtgaataggaggaggcgtacgtcacaaaaatttgtccgccccggtcaaacgaaagtttaataagattgataacgatctgaaatcataccggcgctgtatgtggtaaagagttgtttccgctgaggtcctcctcctcttgtttgttccttatcatcagctgtggagggctacaaacccttgctcgagaggctaaaatcgactggaattcggtcagcatgcataatcaccgcagagtggctttaattcagtcgtgtgtcaatttgctcggatatgatatctccgcacactgcaccgccgctaccggaagcactggaatggtcgccaccaatgatacctgcccattgcacatcgataacgaaaacaacttgacgtgcgcgcaggcgtatctaaccgggagaagataacatgaaaactcaggcactgatcggttgtgagtcagcgcactttgcccacgccacgcgacccgtgcccctcccaccccacacacccaaaaaaaaaaacgccagtttgctccggtgccgggaaagcgagacgaaggtcacgaaaaagccgcgagaaatggacgtgaaatttgggaaataagtatccaggacggccggccaatggtcctgtaaaataacaccaatctgttcctctgttggttcgccgccctacgctagtgtggtgggcgctggccaggcaccgcctccggcttctatttaagaaggcgcgcccccgccaccatcctacccaccacacaccaccaccaccaccaccgcaccacccggcggcgccaagcccttcgaccaggtagctgaccagcatagcggcagatggtttcgcggccgctagagacttagcgtcgacgaagagggaggaagcggcgtgccac

SEQ ID NO: 9751 - DNA, 1220 bp, Zea mays
ggttggtcggttggagatctggatccacaccacaccatataggcgtagacgaaggaagaaagaggttaaacgccccaaacaaacagcacgggcgagccggcgacacgaggaaacgactggaaatgcacgtacggtcacggacaccccgttcaccaccgcagcagccagcaggggaggggctgaggggccaccagtcctgccacacagaaggcctggtccagcccaatgcgcctgaattctccgccacgcgggccgcaccccactactgtggtgttgccgcggcccgcggagggacggcccagccgacaaggagctgctgtcggcctcgtagaaaacgcgttccccggcgacaccactctctgtttttgcctatggttggtttatgtgtacaccaatcgaagttatttcacatatgcaaaaaaaatggtactgttgacttttaggttcgtgagaaagcgaaatattttcagaaaccataatctgttttagcggccattgaatggcattcattcaagctcgtgaagtggtagtcatcaaccttatggttcatccaaataagtaggcacaatttaaagttaaagttacaatacatctctaatatagatatttatttatagatgatgttcgatgagatatggagaagagaattttttttagaagaggaggtaaatgacaatccgtttaccgtgaatctgccaaacggcgcgcggcggccacacgtatcgtccagtactcacctatctgcacgggattccacggaaaccagaaatcaccttgcccgaccgccccaagacgtccatgcccggtgtccgcgtgccaccgagtgacgcgacgaaactgacgcgagggcccagctcacggacctgtcctgtgtcctccgcagcacagcacgaccccatcggcgtcaccccggcgacttctgcgtcctctgccctccacgctcccccgctctgccaggcttcccagaagatttggttgatttccccccaatccagtgattccatccctgttctccacttccaccggaacctcccagagacttccagaaggctctagcgacccccgccggtatcgacctctgcctctccttcgtggcggaagatccggcccttctccccccgtcgattaccgtcggcctcctccattgccgctggcattaaccgtctcttggtgcctgtagctttagagctacccgcggcgagattcaggagctgcctgcc

SEQ ID NO: 9752 - DNA, 1500 bp, Zea mays
tcccaatacatgagaattaggaactccctgaatcaattatacgtttggttgcaatgataagatgagataggataggacgatctcttgaataagtttgtttggttcgggatcaagggttaggacatgaatattccaatgttattctcaattaatcctcaaaaatgggagggacaagagagtcagaggacatctctgtcatagttgtcccgtaaccgttagattaatttcaatccatgggtaccttctccaacgcctcccaagattttcccaaaaactaaatgcataggccgctggtaaaatccttgagatctggtgttgaaaaaactgaacgggttcaccttatgcttccacaatctagaacacatgtacgttgcttgcctccacgcacggcggcacttcggtgctgcatactagtcccgaagtttgttggaggctggaccgagcaggattgggatattactggcggtgacgagcagaccggaacagaggcagaaggatgtcggcagcgcgcgtccggagccggagcggttgggttacttgggtgccgtttggttcaaaaaatgtaacgcaaatggtaatggtaatggtttcggctcgattactggcgctaacaaatttgaatatgctggtatcaaattttagtgtggtatttgattacggttagactaaaacaaacatgatttaacgttatccgttacccattacgttacaaatatgtaaaccaaacgccctacaggtttcttttcctcagttcagtggttggtgtcgcatggcatgaccatgacgacgccatctcgcacacaagtttgacctctgctgcatgcagattgcagacacgtagcgcgcggttggtgtcgtcgtggtcccccggtcccgcacgcaggcctctctgatgcacacggttgcaccgtgcacgactgtgcgtacacccaggccagggccagtagacgaccgtggaccaggggcacgtagtagggccaagaacagcatgcatgcattgggaacgaactcgcgggtggtcgtgctcctggcctcctgcgtcgtcctcatcaggttcaggtgacgtctccctatccgactattcctttggcaccgtttggacgatcgcggccaagcacgtcaaccattgcatgcagactgcagtgcacctctcgctccctgatctgacccctctctctgtctgtctgtatacaggcacgcatttacgaggacgcacggatcgatgcatggcgagcttgagctatttggcacaccaaccaccaccgcgcgcactccagtctccagaccagaccgaaacacatgcagggttcagttcagtgttcagacacgacgaggtttccacggcacacacacactatatatagactgccattgcctacacactgtgggcaccaccaccaccatcttttgcactctctcaagtcacaaagcttccctacgtactcacaagtcacaagggttagcagttagctacctagctcaagctcgccagccagcatc

SEQ ID NO: 9753 - DNA, 88 bp, Zea mays
caaataaaagctgtctttagctaccgttttattggagaccgtcattttgatggcttaaattcttgtgttggttggtactggaaactgc

SEQ ID NO: 9754 - DNA, 856 bp, Zea mays
tctagagtcgacctgcagcatcctttagcagagatccacccaactccaatccatggcctgtggctctaagatggggtttgaagtcttggtgaaaatattgagaaaataaatcagcaaacttgacaatatgaaataaaaagtatggtatttcattaatgaatgggaatgcaaacccatgttttgcaactctggctggccactagtaaataagctgtggctcctccatcaaagctgtttctttcttcggtgtttggtacagcttcaccatgagccagagatggagctgtttgaaatggcctacgaaacagggtctttattatatctcaatgcaaggaatgatttactggatattatgagttatgtctatgtagtgatggtcaatcattcgttatggttacgggcctgtctttatttcaacttttaagcttattattaagcttctagataatctatagtgcactatcccttcttgttggtgtcagcctacttttaaatgtaactattgtgtaaatacatcagttttacatagtctcattttaggataggcaactttctggattgacactttggttctagaagtgacaatagttgaattttggtttatgtttttgacaatacaatatagctcaacaactatatgtccatgaaaagtttatatgagttggagtacattgacagctaattttcatcttcaggtattgaaaaataattttgatatgcttatatcctatcttacttgaatatataatcttttacattttcagtggatgacatgagcacactaaatacaatcctgatgaagatggcaggattagcttcctgctgagttttgtcctacaagattgcaaagggcaga

SEQ ID NO: 9755 - DNA, 1301 bp, Zea mays
aaaaaggtctgaggttctaatgactatcaaatgtatggttagaaatgaatctgagcattggccgtctcacaactcgatccaacttgtctaaaataaactgatccgatctgatcaattcaacgaagctgcaatcatccatgctcgggccgagcacgaactatgattttttacctaaaacttaaacgaatctaaaaaacctcggcctaaagctaaaatacccgacccgacatacccaatatgaaatcacgatctaatcaaatcgagtacgggtcgtgccaaacgacccgacccattgcctttgcctgggttagtgagatggacatcggctctgccaccagccgttgccaaacgaactgcacctaagttactgtctatatcaggcgaggatgtcctccgtcgttactttactgaagagaagaacaacctcaccgtttgcgtttttttgaatgactgagtgagcactgtcccacgagaacaaaaaaaaaaactgtgttggaacagatggctgcccctgcccgagtatgtacgtaatactatcgaagtcgcggcgccggcttgtgcgatcgtctagaggggcagagggaacgaacattgacggtgccagagactggagcgcggcgacggcgtggtcagagtcaaaccggagcagggagggtgtgatcccgctgctagtcgacgcgcttctccggccaaatggggggacaaacggcgagggatgcatggccggcagtgcgccgaccgagaacgttacagtactttcagtcgagtcaccactcactaggcagcagtaggcacagagcagtgtttccaatcatctaaggcatttggggtcacggccggattctcttatcgtttgggcccagtgactaacagaaagcagtagtggactggagacggtgatcggcggccggaggtgtgcaaaaaatgtgatcgctcgccgccgcccagacaagggcatgcatgccgagacttgaatcgcgcttccgccacatgcattttttgccgccggggcgggtccccgcctccccggtgaccgtgaaggactgaaggcgctcgggatcaagaatagacgaagcgccatcaagcccaccacgtttctcaccccgacgcgccgcagccgacaggcaactaccttctgctcctccccacccgcttttaaaaacgcagtcgaggctcagtactgacacgctcgccttattcataaccacaccggcaaagcgccactgcacacgtcactcgctgtccgttctagcataccgcaccacacttcggcgccggtccgcgagcagatagatcaacag

SEQ ID NO: 9756 - DNA, 1013 bp, Zea mays
ctgcagccgcaacacaaaaagtgcagccgatcagatttgtataataaggtaccgtttagttttagagactattagtcctctattttagtctcatttagatgccgtttggtttaaatattggtaacataatgaataaccgataacgatatattatgtttgtttaaatccaaccataatagatacgacactaaaaatggataccagattattcaaacttgttaccagcagtagtcgagtgtgaatcattaccattatcatttacgttacatttcgtgaaccaaacaacaccttagttcctaaattactaagggtgggattaaaacagagactaaactattttagtctctagtctcttaagggacgactgcaatggactaaatcatatgaattccacttttttgctgctcctttatttcagttacactaatgttggaagaatgctatgattattagttctcttataatttatttaataagtttttaaatacctttagtctctaaggtaaggactagtctcaaaactaaaagaataaaaccctaaataaacaaactgttgcccatattatttacgcgggccaacttggagtggctctgctagaccgagaagccttctgtacttcttccacgtcgtacatctaggatttaggcagccctccaacggtgttggaccgcgggccgcggcccgcctagtaggccaacgtcgtgcgcatgctctcagtaaaatcacaccacgcgggggctttacctgcaaaaagcgcgcaaataaaaatctcacgcaggagacaaatccagtaatccacactttccttcgcctcctccatcgtggtcgcggccaaggccaacgaaccaattcctctaccattcctcctccctcctttcctgccattctcccatcccggcagggcgtctcctcctcctccctccctcctttccatcccgtttcttcgccgcctccatctccaggccgcgtcgaattcttccatccaccgcaccggtcgacgacgacgacgagg

SEQ ID NO: 9757 - DNA, 320 bp, Zea mays
ggtatgtattttccattttatattttttcagtattgccactatatctgcaacctactcaatcataaatcaagatcttgcacttggttgcttccccggtgtgaagatggtccacatcagactgcaatctaaattgtttactgtgaacgagaacttctacatacacatacgtggatttgtacatgtacaaaatctgcaatgcctcagattttatgcaccctcggcaactggcggaatccaaggtggcctggtagaaaaggggcctccatcgctcatcttgtaggctaaagctacaaatcagataataaaactctattagaaa

SEQ ID NO: 9758 - DNA, 839 bp, Zea mays
taaaccaaacaaaaatgtgacgagcgagaaaatgacagactacctaatttctcaatgcatgacacgctatttattagtgtgtgaaccaaagacaaattttggaatatacgcacacgtttgtatgttagagtaaattaaacttagaaattactaaacacataaataggagtactatatacttttactatactagaatgttgcccatgtcaagtacaatttcgtactcgcatgcatgtgaccgcgaccgaactataaacagccctgtcctccaaaagcatgtgcgcgcgctgtgttaaatgtgtactatatatagattgggaccttgtattaattaaggcgccattaattaaagcgaatgcgcatcccgttattactaatttttattctaacggcacggctgcttcctccgtgtttcgtgaaccggctcaaaacacccagagcagcagcaaggggcggcgtatgggcctaccaccgcctactacagctctagccgcccgcggactgtgtctgtgtctgtgtcgacgctcctctcgtccacgccgcacgccatgccatccagcgccaagtacaagacccaacccagcacctccacccgtgcagcagaaccaggcagcagcagcagacaggagcgagcacgcgctcgctttcgcactgcgccgccgccttggtccgctccgctatatatgcagaagaggctgagccgtgagcccaccaccaccaccacgaccaccaccggataaacccgtcgtcgtcttccttccccagaacagaaccccgttctgtgtgtggtcttgggtgggacgaggccggagcagatcgagccaagagacgaaaagaaa

SEQ ID NO: 9759 - DNA, 1500 bp, Zea mays
gaaatgtaacgtaaatggtaagggtaatggtttacgctcgattactcgtggtaacaaatttgaataggctagtattaatttttagtgtggtatctaattacggttagactaaaacaaacatgatttaacgttatcagctacccattgcgttacaaatatatgaaccaaacggcaccctgcttcatttcatgcgacatcagcgggattacaatgacacccgggcgcgctatccgatacaaggcaattgttacctggcttttgtttgtttacagcgcgaaggagatccaagcgaggcagcgcagtccgaaaacgccggtggtgcaatcatttgtttgttttcagctaacatgctgatcaaactacagcctagcctgccagaggagcgtattaattgcatgcccagctagttgctgctcactttggacgtacaagtctgaccaattcgtgtggatgcttgtgcgcgtgcatggtaattaagatatgtaattagctttagctagcttgcatgcgcgagcaggaatatattggatgtatgcctcagctggcaagtcgaacgactatactatactgctgccatttccaaatacattggatgtatgcgctgacgacgaacgtgtgggtggatgtgtggattcggatcgtttgtcctcagctgccatggtggctaagacaaggtcctctcgctgtttcgcagccaggatgcatgaagcagccgaggttacgtttctgatccaccaaaatttgaatcgatcttgcacccgcaccacgcacgtgcgtgagagagatatttgtatgctcgcagccgccgaccacgacgggacgtacgtgcatgaaccacatcgtccccggcctggctcaagatggatcatacatgcgtccagatatatagatgaataaactgcagtccgaactcacgtacgtacttgagaaagtgacacgcgacaggtcaagtgaaccagcgacgtatgaccccgcacatcccctggctcaaggcacgccccctcgatccgcctcttctgatgcacgcacacactgcagacaaaactactactcttattagtagtattattagtacgacgactcataactacctaaaaaaactaacaccggctactggaatcttcgtaaggtgagcaaataaaacgtgcgtgtgtaccgcctctttcttatgttagtagcgtcctatctagcataattatatatacgtacactattttctttatttgcaaggcacgatgcaacttgaatagggaacgagcaacttgaatcgtgcacgcacgtgagagttgacctgagatatatattttcaggaacctaacggctaacgcttaagatcagtttttatcacagaaattcctatcacgaagttaccaaaattgtcacgttaattagggcctgtttgtttacccctcagattatataatctggattaaataatcctaagaggcaaacaaacagtccagcttatttgccgagattatataatctaacccttggatt

SEQ ID NO: 9760 - DNA, 1500 bp, Zea mays
caactgggctgaccaagcgcgggttgggctgcgcaacgtggagctgggccgacgtgaaagggaattggtgggccgcgcgagttgagagaatttgggtcagctgaggattcatgcccaatacgggtacattctcatttctttttttattttcctcttttggttttcattttcaaatttcaagtttgaattcaattttgattcatctttctgtttcaaatttgaaacagattccaaccctagtgtgtcatataaatcctactattttcggtattattacttatttatcatatctctttaagtttagaggcataatatataattcaataggaatgcttgttgtcagagagggaattctccggccgggtggcggagtgcacccgcccttaatcctaagataaggaaggggcttaagcgttttgcctgtccggctaagcgattaccgagcacatgaacacgcgagagtttagagtggtttgggccaccggagcgtaataccctactccactgtgtgttggattgctgtggaagcttgagagctaagagtctaagttgggcctgagagatcctcctgttgtcgtgtgccctcccttttatagctcgaagggggggcacgtacaagagaactgagccccgacatgtgggcccaggaacacaatggatatagtacttggagctactaatgtttgctactggagcaatcttcttgaaccctgacatccgagatctgcatagcatcagcgtgcaggagaagcttctcatataagggatgatggacacagtgtgtcgcgcggcatgggcgcactgtttgacaatggactagacaggtgcgccgtctgcaggatggccctggcgccgcctgctagcggagtggacaggacgcattaaatgctgagggggcacatcatctgttagcatggtggcaggcgacgcgtcctctccgcaataaatgcagagaccgcacggctttagaggccttacgtcaggctctgcccgttggcttatgtcatgggccacaagccacgcggcagcagcgggtttccgcctgagcggggagtgcagggcaagacctggacacatgccagcaccggacccttattcatgccgggtttcccctgtcccgggaccttgctaaggtccggaccttacttggaggaacctggggcccacccgagggacccgacatgccttcttgggtgccctggaccgtaatcaagggtctgggttgtgtgtacaggggttcggtgtccctccgtggagatccagacccaatgatacatcccggggtgtaccatctttccttgccccatggtgcccctagacctgtccacgtggtggggtcgggtgccgttctccgtgcggtcaggagacgtcgcacgtgtacatcatctttatactgtagtagggggtacacctgattcagggtaccgacaaccccctctaggtgatctcaattggtatcagagtcgtactcttcatctaagggactaaccgcccgaagag

SEQ ID NO: 9761 - DNA, 1500 bp, Zea mays
atggacaatggtcaagatggatgttacaacaagctgatacatgcatggacaacggtaaacaatgggctatcagatagagacaagaatctaggaagtatgagccatggcatggaagcattcaatcagaggtttcaggtttggtttgcgcacctttgcagttctgacttttcaggaagcgcgaccttcagggcatcttgcaggcccagccacataagcctattggctgacacacacatcttccgagctatgcgctcagacatcgacctgcatgccagtcgtatttcagacaataaagacaatggtcctccatgctacaacactagcatctgcaaggacctaacaaatatttactgagctgagctttatcatgcaacaaataccttgctgtaccagtgcagtctcagaatcacaagggtatatagctttggcatggaccatagagaacatatgcaattccctcttccaaggccctggcaacaggtgaaatgtattcttcagtccaaaagagacttaacaagccttgctttggtagtcggcacatattcttccaatctctcatcatgcaggaggcaaggatacaacctagataaggtcatttcatgtgtacaaaagggcaggcttcggatttcctttcattcaccactcaaaagttaaaccccttcaattttaatctaccttggtgaagaagacagaagacaacactccaatcttgttcagtcttgggatatgtgatgaatcgacctgccacttaaggcgaagcaaacgaacatgttagtcactaagggattcagcagtcactacttacagagcaaggcaaccttgtaactttataggtctctgcaagtatacgaaacagctgctggatacaatgacaatacatttaatttgattacttgcactgatcttaccctcactcctgtctgtctgcctattcataatgcacactgttcttgccacctggaaagtgtatgtttgatcagaacttgagccatatataggagttattaaatatatcactgataccgagaatgtttcatcacctctatagagattaatatatcgctgatacagataatgtttacatcactgataccatatccagcatcatgcaccatcagccatctcaattctcaacacacacacaaaaaaaatcttgagctatcaaacacacacacacacacacacacaaaagtcataaagaggttttaaaacatagagattctactcttctaatttagatcacactgtctccatgtcccttggccctgaaaccagccaaccttattcttctcagccacctttaacccacaatcgtgattctatgcaacttacagctcagagctcacacacacacaagcgcagcaggcaacctcagggcctataaatagcagaccttgtgacaagagataccaaaccataagagcttctgaagagcgaaatacttcagtctagacactagatacagtaagccttagcgcaccaacagaggatacttcaaat

SEQ ID NO: 9762 - DNA, 176 bp, Zea mays
tgtaagtataaggcagtgttggatgtgctagctgttcagttcatatttttatgttcctgtctggttcactgtggtgtatttcaagaacagatttgtcttgctttcaagacattgacatctgattttttggctcattagatttctggacggatctgattgaataaaccgtgaaggag

SEQ ID NO: 9763 - DNA, 245 bp, Zea mays
ggtatctttttttctaactaataactgaattgctattttattcaaaactacatgtgttattgaattgaattggtcattttacaaattagcgcattatatttgtatcttgtagctttatctgtgatcatgtcttgaaaacaaaattgcttagtcatttatgtcttcaacacaaaacttgtctgatccaaattttgtttttggcattcaggcctatctgagtgtgatcatcatctatctttacgcac

SEQ ID NO: 9764 - DNA, 1428 bp, Zea mays
ttcgtgacatatttttttgtctttgtcactgatttattttttattgtcctgatttttttgtttatgtcgctgatttgtccgtgcgttcaatatttttttgtctttgtcactaatttattttttattatccagatttttttgtttttatcgatttccatcgatttacctccggtaacctaaaacggttttgtaaaccgtgaacggccctcatccgatgataccatcggaaattaaagtagctagcgttctggtcaagatgcatgccacgaacttgcgcctgaactcccccagagatgctctgtctcttacggtttacttgttccagaaggtgcattccaccaaataaaagcgaaaagaagcagcctggccggcctcacctattaataaagccgggtggaatccattctcgcgcacatatataaacacactcaacaacataaatgattgtaccattacaccaacataacgcatcatctattaataacgcaactttatttaattctagaagccactactaccacacagccatcaaagttaatcaaggagatactccatcaggtcatcttgttgcatgagaattcagtattccatatcactaagttcattcactttttattttttatttatttattttggttcgtgatgagccacaaacccatatggcctttccccaaaaggcgccgcttctgtcgtgcgttcctgcgtgcatgcattttcagccatgcatgccactttggccggaaagaaagtgtgtaatatgtatgtatttctcccacgcaccgtcacaaaaaatattgaacgcacagacaaatcagcgacataaacaaaaaaatctggacaataaaaaacaaatcagtgacaaagacaaaaaaatatgttcatggtggggctcgaacccacgaccttaaggttaagagccttgcgctctgccaactgagctagacaagctttgtggttatatattcgagctcggcgccatagatcttggcgccgagctcggtgccacgtcgacgccgcgtcagctcgtggacgacagcacggcaggtagctcggcgccaagatctatggcgccgagatgtgtaaactcggcgccatagctcatggcgccgagaaatgggtccaaaattgcatttaagttttctgggggtctaattggaaatttttgacataaaaaggactcaaaaacaaaaaattcggcaccggcaccgcaggcacggcacaccacggccagaccagaccaccagagtgcctccaccctcgaggcctccagtgtccactgcctactcgccccacgccacccaaatcccgtcgggacgacgaagaagccaagccggtgcgccgtataaatctaaccaatcgccatccgcccaccccccaaatcccaccacccttttccccttccaaccctcgggatctctccggcccgcc

SEQ ID NO: 9765 - DNA, 1500 bp, Zea mays
tcggtcgacctgcgtactgtagggctttgaccgtccggttagcccgccccgcccccgcggcgagcacgtgacgacgacggtgcgttcgtgggcgccgatcgccgaggggaggcgctaatctgccgtcgttcgttcatcatcgggctatatatatagatatcggaggacggaggcctctcaattaagcattctccgcgcgcgcgcgcgcccagcagcagcccgcgcttggccttccttctcctcccgacccgacgtcgtcggtcgcgccgctgcctgccccgtcccgtttcggtgtcgtctctcgccggccacgccaccgcccgccaagccaatcgtacaccccatcaacaaactctctctctctctctctctctctctctctcgctcgctctccctctgttttttttacacgtgggacggttgtgcacaagtctagatgcaggcgtgagagaacgagacttctgatgaatccatccgatccgaatccatactatttattaaacactggtaaattagggttgttgcatctactgctgctgtggagtatcttttatctaaaggtccaaaaagattggcttgtgcattattcgcacctaagctagcatgcagtcgttctctagctatacggtacaaaaagattcgggtgtagtttttgtaccatttagatatagatgcgtcccctccctagctagcgtagcgcgcgcggcgacgtgagcaatgacggatgcggcgtccgcatccgcacgcgcctttagctactagctcctagctctagctctccggagaggcgtctgcagaccaaccgcagccagccagcagactgttagacgacggccacgcggagccgagcgttgccgcgctttgcttgatgggataaacgccgcgcgctgggaaggttcagtgaccactccctgccgccgccgccgccgccgccgcgctggtttttattcgcttctttctgccttcttcctcctcgcggccggggcgggggcgtgctgctctctcctctccagggagttttctgcgggggttttggttgggttttcttcagcgccagccgtggatgtgtttaacgcaacagtattagtttcttcatgatcagctgtgtgtcctcaaattgagtttcgtgccgtgtaccagtcgcgcatgttccccagatcgattaaagtttcttcgcgcgtatgtatgagctctattcgaatgttctttgctctgaaaagattccccctgttcatggttacagaagggcctggagttgaagcacgaatcatcgaagcgcagcaaaactgagacacacgtcttacttcttcacaagtactgtcctctctattcatcatttagatgtatcatcaaattgacatagtaacctatgattcgtgcagtgaaactttgtatcgagagtgcatgtcttgatctttattttatctcactcttaatgacgtggtagcattgaaaacgacgcgataaaactaactcttatgttggccaggttcttggacg

SEQ ID NO: 9766 - DNA, 697 bp, Zea mays
caccatcattgaatgaaaaggatacgcatcatttgcttgagtcccttcgttttctgacaggggcggagagtgcccctggcggcagcgtggtggggtaatgagttgtggcctgtctcgaactgttccgcagtctcgactcaaacccaaccagtccatgtctcgatgagacgatgaccatcccctcccctccaaaaaaataaaacgcccatgcatatatccaaataaagaaacccaaccataaaatccggttttgccccaaaccgtcgcggacgacgacgggtccactcgtgactcgtgcccccgtggccccaccaccaaatgtgaactggccgcaggagatccgcgactccgcgtggcgagccgctcgttgcacgccagaggagccgcgctgatcttagcgagatgttgttgggacagctaggtaaaagccacccccctcgggcctcggcctctcgctcctcttccattgtataatcctcttccctcctccacccacttcacctggcacactagtggccactgcactggtagtagtagccgagtactggcaccgctctagccccagatcaaagctcgggagaagagggagaggaggtagtgcaacataaatcccgagtcccaccaaatcgcaagccctagcagcttccggtctgcgtctgcaacgccgcgggcttgagtgcgagagcgcgcgtggggg

SEQ ID NO: 9767 - DNA, 315 bp, Zea mays
ggtatgcgcttacctgcccctcctctctctgtctctctcgtggttctactgaacgagcactcgcctgcgctcttctctctctcgtggcgacgactgggtgactgccggcgccccaggcctgaggctccatcttcgggcccttcactggctacgagcaccacctggtacgcatacccctcctcttccgttcctcctgtacgagcaccctaaccctagtttaagatacttgtaatcggatctgatccaatttcaggtgtactgggtccgatccatctgagtctgatcttttgtttctcgggttcctggcagaggatt

SEQ ID NO: 9768 - DNA, 361 bp, Zea mays
tgcagcatcaaccaatgcaacgccaaactgctatgcgttcgtcaacggcagcttcgggttcccggacaaggtcttctcgctgccgctggcagggtcaatgcagctgatgaggttggagtcggatgggcatctgaggctttacgagatggggggatacatcacctggaactgcgcatggtgctcgatgttttaagcactgtcatggacttctgtgactacccactggcatgtggcgattacggtgtttgcttgcagtgacggacagtgttcttgccccagttccagccatttcaggctccgaagcgaacgacatccagacgctgggtgcgtgcccttggcaagcagcgcctcctgcgaccac

SEQ ID NO: 9769 - DNA, 1500 bp, Zea mays
gaaaatctctctactagaggtagctcagctcagcacgtcagcaacgattagcaaaagagatgttcaagtgtaattctacctccctgcaaaaaagccgcttttagttggcatcatcaccaaaatgaaatctcagctctactcatggtgagctctggaaggaagacgacgacgagtgtcgacgactaggactagcactgctgaaccatcgaccgtcagctccatgcgcttgctggtttctctttcacaaccatcgttctctgtatggcggttgcttactgaaccagcgcgggtatgaagatctccctccgcacttctcccgcagttgacgactccacggggacacttccctctcctgcctcctgcaagcaccttcacctcgctctcatggcctcagagcctatgcatcagtgcgtcgaattccagttccagtagatgtttgctgagcggatctttgttccttctccagtcactgatcccgtttgatcccgtttgtgtgtgccccgtttcaggttgtggtgctgagagtgtccattcactgccaaggatgcaagaagaaggtgaagaaagtgatccagagcatcagtggtacgctctgaattgcgaactttattggaacaggtctttcagtttaccagcacgtagcttcgcattgtcaaaggcccggcctgcacaagttcgtgacgcttcaaaaaatttatcggtgaagattaaatttgcatcagtgtccagtctatcacaattttatcggtgagtacatgcgaagctacgtgcatccttggcatcacaacctgaagcagggcttacttcttttttaatatactctactgtcggttccatttctgttaatcttgagacacaatggtcggaatacattattttcaattgaaaagcaaattaacagaagccgtcttcataaaacgatcgtctttgcgctaatccgtttggcagagactcaagctgtctctagcaaatatatagatcatctgtcagtggttgacatgctgcttgctgcccacctctaaaaatggattttgaccacctgtgctaatgaacgaaactggattctgtctttaaagaaagaaagaaagaaagaaagaaacccctgagactgaaacgccgctgcagcagcctgcagatctgctgctgggcagatgagacacacaaactagcaaaggctagccgtctgtggagatagcaggtgagctggagcatacatccaagtaagatattgtaggaaacgggacgttggcacgtgctctcggcccccgacgtgccagaaacagccggcgcagctgtgtggcctcatgtgcggcggcgcgcgcgcggacaaggcgcctccccgtatattaaatgccgcgcagcaggcgtcccatgttgccatgtcgtcgtcacggatcgagatcatgatccagcgagcgagcgagccagcacttcacttccattagcagttagtctcgggctcgttggccgtctttgctggggcagctacctagcagacgc

SEQ ID NO: 9770 - DNA, 387 bp, Zea mays
tgttactcagactcaagtcatcacaaacggtgctgatcaacttaaaaaaactaagaagagggagaaatcacacatcataggacccaggtttcgatgactgggaatcacacatcagatatggttaaatcatatcttttgtgatatggttaaatatagaaacatttgacttggccaaatctaatgcgacatgcaaaacaatagagggtttagggtcttgctggaagcttagaatcaaacattgaatagtgactattcaattttggtctctgttttagtatatattatatatatggtagttacaccgggatgagaccatctaaaattgggagtggttccctgatgtttccgattgcctttaaaaaaacaggctcattttattttccatca

SEQ ID NO: 9771 - DNA, 281 bp, Zea mays
agcaatggccccgaacgtcagtcaaagaacacacgagcgcaaccgacctacgctcgcgagcccacactccatcgcctacattgaaatgccccgccgctccgcgcctggccccggcgtgcaaccgtcacattccattccaaggaacacctgctctgctccgctctcgcccctcgcctctcccttccacgcaacagaccgacggccgtctgccgtcgccgtcgccgccgcgccaccagcccaccacaccaccagtccaccaccacccggcggaagccgcgact

SEQ ID NO: 9772 - DNA, 55 bp, Zea mays
tctgttttaagtaaaacggatccagcaacgcaccagttcctgaaacagaaacgtg

SEQ ID NO: 9773 - DNA, 1197 bp, Zea mays
ataactttacgttttgatagtgttgcacagacattggaccttatcgatagtgacaaaagaaatatcacgattgataaaattgttagttttagcaatcctttcagctgagtcacccgacttttattccaaccatcatacatcgacagatggttctcatctatatttgagactatagaataaagcaaggtatacaatgatgagtgttttatattggctataggtaaagatatattctaaatccaccctagagtgaccggcatagagcggatttatgacaagcctataaggttcgatcaaaatttcagcagtataataccgttgttctccacttctactttcaaatttggtgcagtggagaataatataggttatgccattaaaattttatttgaaccacatagatcctcataaataccatgttatattggtcatttggaggctttccaagtaagggacaattttggattggcaaatctcgcatgtgtgacgcttgtgacaattgtcggttcaaaatgggtaacacagaggtttcgttactctactgaaataatattaaaataattatctattaatgtaatattaaaacagttaaataatgttgtgcatgaccaagtcatactatttatgattattattgaagtatgcgacagaggactaataagaacataacggtgtggcacaggtagccatgaatcgatagttgcgtggaggctgcttgggcgtggtgatccacggacataggtataggtgggcactggtggagtcattggagggcttgttgtcagctaccaaaaataagttagatttggatggtctatttgtaaagcaaaacgcctgtaacagataacgcagagttagtatatcaatcttatctcatatagtcggttgtattagagtttatctcgtgtaaccaactctgcttgattatctgaaacagactcatgattatccaaatgtaaaccacggcaatggttgttattgcccatatataaacatgcagcacaccggccaggggcatcacggtgttttccaatctcttccaacgcctctgatattctttatggtaatcagagccaatccataaacaccaaaatccaccagagaatcatcatgtcgagcactgctgcaattatcaatcccctcgtcggtcaagctgtttctgagaaactggccaaggggaactatcaactctggaag

SEQ ID NO: 9774 - DNA, 793 bp, Zea mays
ttattatatttgctcttattattagtggcggggaggaaaagttgttgaaaggcgatgcatccacccgacccgaccaccgccctatttaacaaggcaagtacactcaagcgcattcgcccgccgaaaacgctaatgaaatcgattaggctactatagctactaccactaccgcgcgctagggtgatcgatgtacataaagaatcccattagcctagcgtggagctgaaattcytacttgggttccgtaaacatcaagtagggtgaaatcgatagatagatagatcagctcagcattgtactgcggcaagaactggttgctggtaccgtgtgccatgccagcggccagcccatcccagccctgctgctcgggcgctcggccactcgggtccctctttttcacttgtccaactcgagagcactgatttgcatttgcggcgcacattcccatgcaaactcctgatgatcgaaatctcaagacacctcagattaggatattactactgaggaactaaaaaaatatcggaactgttgcctgcctcgtctactcctggcctcgggccctcggctctctctctctcctgcctccaaagccccagccacctcgccacgatataagtagagcgagccaccagaccagagaggccatttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccagg

SEQ ID NO: 9775 - DNA, 741 bp, Zea mays
tgaaggtccggaaagatagtccggcgaagttcgtcccctttctcgggacgtttacctccttatttgattcactagctacttaggaaggtattcaaattaattaccctgtgcaatcagccattcatgtgcagggaaaaagacgcagagaacagctgaacacatttaattgtaattacaccataaaattttaaaaacatatccacggtaaaagcaaataaaacaatccaggctatgcgaaaaaaaaaacaatccagactagctaccaaacccgtcgatcgggttcagacgtgagacacgccattgcgggttggcctctcccggccctgtttctcccgtcccttttgagttgccgcgctgtgcacatctacccatctatctgtgctgtgcccataagggcatgtggatgtaacatatgtcacgtcgccgttgtccgttgattattagctcagcattctcccggggtcaaactgtgttccagacttccagtgtgtgtgtgccagccactactgtacaatagctctcttctttctctcgccgtagcttcgctcgtgctgtgcgtgtgtgtatatataagcatcctgcccccactccttttatctctctactcgtctccacggaatcgatcgatcggtgctttgatctctgagcctgagcaagcggtcgagctcaccaaccgccacgctcaagacaggtcgagtagctagctagctgccggagtggaaaaggaggcggtgcagtggc

SEQ ID NO: 9776 - DNA, 468 bp, Zea mays
ctgtttaagggctaaattacaaaaaattcggtctgatcggcttctcgggcaagcggtactcaggccgcttttttccatcgttgcggacgggcagccagacgacggccacggcacgagaagcaggaagagaaggctagcccatcgatccaccggctacgcaactgagtctattaaactgacaccagtggtcccacgcatctaatggtggtggctgattcatggggatccgcattttgggcccacacgccagagagaggaggtctggtagtgcgagtaccacccacacgaacaccagttcactaatcactacctctccctctccgtcgcgacacaggccacggcgggcggcggcggaggcttccgtgcggctcttggcggattgaacgcccactcgagctgcgccggctgctgtttcagccgtccttagatagaccctgctttcctcccgggcaaatccaagttgcccaa

SEQ ID NO: 9777 - DNA, 1461 bp, Zea mays
caactaaaaaagaaacagagtgagtactaaggaagactatatattttgtatattaacgagaagagatagttagttacagcacatccattggagcgccggccaaagcagatatatagtgtcgttacgtttgtaatcatagttctggtttttctactatgtataattaaacataatgcaaccttcttaagacggatgtatcaattcgatgggctcattcccttcttttttttatttatcgcaatttagtttaaaaaagatctagcggacgataaatatttaagaatgaagatagtaattatcttcagtcaatacaatagtttctcaacaatatataatatatatttgcgcgcctgtggggtgtgtgtttttacaacacaaacaaccgacagggaattctaacgcaaatgcttccgtttgtacttgattatcaagacataaagacgaagatggttacgttacgatgcttctagttggcatctgcacataacatgcatgcatgccccgggtttaatgcataatgctgtgtacatacattatttgcagcacacacgcgtattgctcatgtgacgtgccgcctgtctgtctatccttgaccggcacttggtaccaaccattatgttcgttgtattgcgagctagctagctgcctgtactatataactgcagaaaggtacactacagaatgcagatgctgcgccactggttcgcatacactattctattccactggccacctataaacatatgcatgacaattgacaaacaagctagcgtctctagaaagttggtgccggccatagcaattattcccgactggagtgaagaaaagaaactaccatttccatgtgggtttcctttgcatatcatagaatcaagatgtaaatatctatgagataccattatagaattttgctgacgtggctgcattgtrtgatatagtgttgcggacagcctcagcagccagctggagctgacaggggagttcaaaagaaacacacgtacaccaaccagctagtatctcctcaacgacatcggctaaattatcttgtcggtatgcatacttttcttcgcgcgcggggggcctttcattagatgcttgcacataaaactgcgctagctgatgctgaatctcagcctaacatatatactcctatatatatatattctcttgtattttatgccaattaatgtaacgcaattcagatgtgctggctggtcaacacactgtgtgcatatgctggctttcggagactaaacctggaccaagtttggcgcccgatttggatggtttctggtcccctagcggcatgcaggcatcagtgggccctataaatatgcatggagtagagcaacctctatgcacaccacacaacacaacacaataatacagcaaaggaggctagcagaagtgcaggattaataagctaagctagtagaaattaagcaaagcataggcacagcc

SEQ ID NO: 9778 - DNA, 211 bp, Zea mays
aggtcgtttgatagctccatggtctgatagcgcggaatgagccagttgttttgaataatttgggtgttaccccctgttccatggtgttagtgttaggttagcctctcattggtgagatacgccgtttcaagatgtgttctaagtttggagtgtgtgttttcctttgggctatgtttctgggggtatgtgtgtgctttggttataaacagaa

SEQ ID NO: 9779 - DNA, 1500 bp, Zea mays
atcttgtatggatgaatgatgcagtaggatggtagcttgtcgtacaggatcgggttggcatgccgactttgggattcacatcttgttgccagctcatgctatcgacggaagtattgatagagaaatcaaagcaacaaattcgtgttctggagacagttcatgcacagtatcttgccattatggcactatcgagaatctctgaaaagcttaacaaatttgatcaatttgctcatgaccatggcatatagatcaattacatttttctgtatatgtttttgcttctatttttgtctcctgaaaaatgattgtggctggccattcactcattcttcttgtagaattcaagtttctgttttcaaatctgaattgaatctaaatgaaagtgacacgagaaccatgcttcatgcttacttttgtcttatttgtgacgtttctcgcttaaagatatatgctcattcctaaaactaattgtgttgttgtgttcatgacaattaatatttttaaattttaatatatcttattataatgtgttcactccgtagcaacgcacgaatatttatgtagtatagtatataatgcatgaatacatgtcggattcccactccccccgtcccctcctcgtggcacgagactaccctccactcctctcccttcccgcccgcggttggaggtggtcgcagcgaccggaggctacatatgggttgaggttaattgcatgcttgggattaagaccactcacaccctctcttttctctgtacgtgtttgcttgtcgaaacaatgttgttgttcagcaagcgcgctgtttattttcacttggtactttctgctacgcctggcttgtgcgtccttccaaggttggaattccatcggtcttccgtacgtgctcctttttctgaactgaatcgatgcgcaacgacattttcacgagtaatgttaaacatgcgcagttggttccgtttaatcagacatgtgctgcgttacttcattaattggcagtaccaactgcaggatctgattatgatgttatgggcatcatatatagctgtatggtacacattgcggttttggcttagttcctaaatattctcacaagactagagtttgatcttaatgttcatttggaataaaaaaaacgaggatatattatttgccgtgcccttgaggtggatgccctctgtgctctcaattgagaagtttcggtttagagcatgttgtggacactctagataactgtgagactgcactggcttactcgttcttgtacctacatttcaaactccactccgcgagtaatgtggtctacagtgtaaaacagtgttttggttaaccatatgggtgaactgctggacacgatcttatatgagcatatctggtctttgacttcaattctataaattctatagtcttctgcatctgtagttcttccaactattttctgttttaatcatttattgtagccttgtatactaaattgttttctttcatttccttagtggaaa

SEQ ID NO: 9780 - DNA, 1500 bp, Zea mays
ctctaaagtagcatagttcaccatgcaagttttgtgtattcatggcaacatatctgaaagatttaagattacttctaccttgattttgtagatatgaaatgttgttgtcattgcacgaatcattaatgacttgattttgctctctatatgctatcttagaagtttcagagttcattgtttgtccgcaattcgaaatttactgttagctattgttcttgaacattccttgattttatttcttgaatatgcacctgattcatctaatggagtcatggaaccacagtttgtgcaactattttggatgaccgattttatttcttgtgtcgaacatttggcaattaagaaatagaagattacttccccaatatcccttcttcctaatctcaccattcacgttcttctggggaacaatcacttgctattactgactgacatgtccactcctcatatgtcagatattggtgttgatatatatgttgtttgtttccatgtaattgttgtgcactaacattatcgaataaattgtacaccgtcgcaacgcacgggcactcaactagttataactgaaatgccgtggagagaaacggtgttctctaactctaatcgagtatagtaattatatataacacaaaacacaaatagcgtttgctgcgragttttgttgcccgatgcctgtttttaatgttctcgaatatttatcgtccgcctgttcatatttaacctaaaacacgataaaaaaaacccgaaaatggtatatgatctatgttgtgcgatggcagcctccactgcagcgaccttggctctgctatctcgtgacactagataattactaaaaagcataatagaattagattggtcgttgtaacggaatcctggcccattgttacatgggccctgccagagaatttggccgacgcgaagcacgttttcgcttcagcaaaaccagtatcatggctccatcagtcgctttcagcttccgtagcactctggacgtgacgtgaggcgagagattctcgcgacgtggtgtggtggatggattctagaatccggttccgcgccgatggattccgtatttccgtggcagccaagtgaagcaaaggtcagctactcccgtcccgcgtggtatgtaaaaaacgtagcagcagtatcttggaactcaagtttccgtctgctcgaagacgaacgtaaacggaaagcggaagccgacggaatccgtcgcacgccgtgacgctgacgcacgccggcacgccgcacgcgctaatggacccggcccccctgtacaagtgggcctcgatatatatcactgggtgctcttcacttgggtttaatccaacaatccaaaccacccacaccacaccaccctgctcttcacgagctcctccactctgttcttccccgccgctccactgcgcccttcctcccgccgggatcctaaaccctagcccctagggagcgggagaggctgctgctgctgctgctaccgcggcggcgccggagggg

SEQ ID NO: 9781 - DNA, 1500 bp, Zea mays
ttatttaaccgaggaatttctattttttcaaaaaaaacatgaaataatttctcttagtactagtttgaaaaccttattttttcaagagatttttatttttccaagagaaattagttcattttatttttaaaaaatagaaatcacttgaaaaattagagttcccagactagacctcagaaaaataaaaattatttgaaaaaataagattcacagattagtcctaaacgtgttggcagccacctgacagctgactatattcgacttgttcaacaacacgtactgtacgtgcatgcgtgtggctacatttttcacttgtttggaagttaacagagtcgcatatggctggacatcttttaaagttaacagggtatagttccatgcacggcgcgttgatatattaccataactaagttgagaaatacacgcgcattactaattcgcaaacgcgaaggcacatgctcggcattcaattaattaaaataaaccacgggatcaaaaacgggacaatgacttgtatttcaacaaccaccggccaatgtttcaataactatgctatcatctcttactacattggtcaagcaactcagcatcttgcaacgttgaatttcctcctcaatccaactttgggcctatttgttttaactttttttttatgatgaatttttttgagaatctggctgtgaagataatttaagtataacgaggattatatacagatgaagacgaagaattatataggcttttatgatctagatggtgacagtgcctactatcacgatgactcggtcgattctatatttacattaattttagatagttttcgtcaaaacgattataaaaaaaggtcgaaaaactaagtatttggtattctacagcagcttctaatggtagctgaaaaaatcgaaaacgaatagggccaatgtgctgcccactgttttttttttcattctccgcttacaattattgtaccccggggtttggagtttggggtttgggggttccattcatgtagaggcaaaaaaaaaaaaaacacgcacgagaaaaacaaaaatatttacagattggctcactcattgcgtggcggtctgcctcgtccccttcctcccgtttcttcccttgcctccccctccccgtcgcgctgttcaacgttcaaacccttgcagctccctctcccttggtcgcgcagtcgccattcacgaccccctctcactctcccctcccttaaatccctcctctccccgcgtccttctccccatcaacgcttcattcgctccagtctcatcgaatccaattcacagccagccagacagggcgggagatctccaagaagctatcttggaatccgagaacaccttgcattcgcggtcagtcaaggattcgaattctgacggacgagctctccggccaaaaaaagtccgataatttccgcggggagctcaggaggtgtctcggtctcgggaaccggaggaggaggccgtgggggattgacgagggggcaag

SEQ ID NO: 9782 - DNA, 198 bp, Zea mays
ggtaaagctctggagagcttgaaagagtgggaaggggtaaaagtcatggatgatgttctcccattcttccagtcgctcaagctatgcgaggactgcagttactgttgacgattgtgttaaggagcttgctggagttgtccgtgagaagctaggacctaagaatgcaatcttcaccaaagcagccgatgccatggtgga

SEQ ID NO: 9783 - DNA, 1004 bp, Zea mays
aatcaaccaatatttttagcttaaataccatgattctagaagagaaacggtggtgcttaacttgcagtttgcctctttcatttgatcaattccccacttctgttcttagatttacactcaaatctgacacattgtacttgtttttgtccatttctcaacttccaatgcctttgctcaattaatttttataaaattatatgaacttctatgacctttctacatgtgtttttgatggaaacgaagccaattacagttatgttctacaggtggaaatatgtgttgtgctatatggcatgcctgatttgcttctccagttgtaaagttttcacttaatgtgttctttacacacatgacgactaatatgagcagttctgttgcagaaaaatggtgaaatctattgctatggagtggattcgataaacattggaactcagaaggtatatcttttgttttttttcattttcacaggtgtgcctcgtttgctcttgtgtcatctgtcatctcaattataaaaatttcagcaccactcttgtcaaaaattgttcttatgtcatctaggtagtattcttcatctcaaaagtgacgttgcttgcattaggaggagttgaccatatatatctcacaaccaccaatccgctgatattttttcaggactctacactcttgaatatctttagttttagtcaacacctgtcattgtctttctgctatctattcttctaggccagcattcttttccaatagtacaattattagtgtgtgaacagattccttaaaattcgatgtttcatgtagctactggggacggaattgtaatatctcatcgtgcttaggatgtactccctccgtttctttttattagtcgctggatagtgcaacagcgactaataaaaagaaacggagggagtaatatccataatagagcgagtttctgttgcctgtgactaagatatgttcaccccttttgttcttaatataaaatatataataatttgtagccatcc

SEQ ID NO: 9784 - DNA, 229 bp, Zea mays
ctatagatggacgaatgttatccggagaccggagagaattgaagactcaaccggcagccacgtgatccgccgacagcaacgcctcattgaattcggttagatgagtgagtctagttttggttggctttgcggttgacgacgaccagccagctggataagattccattttattatggtgacaaggcattgttgccgagcgtgacattgttgtgcgccttccactacagta

SEQ ID NO: 9785 - DNA, 779 bp, Zea mays
acgtctgatggtataagccgtcagaatttatgtagtttcctgtgttgtgagtaagcgatacaactcacgacaatcgatagctggttctaatgattaaggaaagattactggaaaagcaaggtcagtgaagacatcatgcatgggaaggaaaggagaaaaaggaggtgagaaattgagaggaagggtcggcgacgaggggtcaactgctcctacacacagctgtgtggacagttacaagagacagaggcccctcctcctgcctatgagcacgcactggcgaagattgccttatcacggcaccatccatggccactttatttattattatccggggctaccccgccgggcggcggccctctacgcaaagcgaggagaagcgagctgcgctgcgctgtgcaacccagcaaagtgtgggcgcacgctattgctccacttgtaaaggcggccagcaggccaagcggagggcaccgcaccgcactgtaccggcacctacctgagagcgacggcgacctccctcttcctctctcgctcgctccaggcagctcggcacacacacatcggctctgctggctgctggtgcatgctggcatccttttctctctctttctctttctctttctcctggcctctcttcaattcggctcctagtagcctgccgccatcacatctcgccttccatataacgagcgatcatcgtcaaggatcggtcggcgcgcgcgcgaggccaacggccggctggggttttagcttgctagctcctggcgccaggctatcccggc

SEQ ID NO: 9786 - DNA, 1500 bp, Zea mays
ccactttagcacgaaagagtaccagttctgttcagaatcgtcgcatgtgttagattgtaaaccattttaacacctggtagagtgccatcttccacatccaccaccaatctggttcattccccccatcacacctgtgacacatcgtgaacaaacaaaatcagtaacgaattaaaaaaaaactgcagaaacaacacgttaataagtacgaaccaagttgttgtatgtatgaaacatgctgcgggtacaataatttgctttcaaacacctctttgtttccaatatcatgtggtattctaaaaccgtagtattttaaaccgtgatattgtcatgactaaatatactgtaacatttttttttaaaaaaaaccgtggtttctaaaaaccctgttcccaaacacaacagggtctaaaagctgagttgataaatattcttctatttcaaatcataaggtatacattcaaggtccgtttagttgaagagccacgggagcagagtgattccattccagatttagagagtggaggggctccattctaagtttcgagagtggagtggaatcgttacatttttttgtttggacataccacaaagagagagggagaagtggaatggcgaaattccaccgtttttttgggcgagctcgtcctacatctagtaacaatatttcagatttagagctgtttcgtttcaattattgcgttcacacccaaaccaaacatataatagagctgctccatcccactcgctcctcagccagggttagatatacattatctctagatacttaacaaaacaatgtactcgaaaattaaaatatcttagaatttaaaatgaacagagtattataccgtttcaagtgcagcgttttaaagacagatattttctccagtggtgttgcataagaattctttttgtttttttaatctcgtccatgtgcaactaaatttgaacttgcaactttgaatgaatttcagaacataacctcatgtagtgttcatgaaatttgatgttgtttattacttgggggactgtatttaaaatggattttcaccatcttcaaactaaaaccagaacgattttcacttataaaacagtgtagtcgactgacaatggaaggccgaagcttcctcctgtcaaccattcgacgacacgggcgcgcgcgacacccagcgcgcctcgaccacagccactggcattccggtcccaccagccgcctgaagggccccgcacgtcattgtcccgcggctaacccgccgccgcgtcgcggaacagggctacatacctcgcttcgccgctagtccaccagaccaccgccacccgcaccgccgcacgcacacaccaactcctctccaacctcctcgccccgccccgtcggttcgattcggtcgaagcgggcgggcgggcgggcaggctagggatccggatgggcgcggcggcgaggaggctctaggggcgccagccgaggtggtggtccgtggggactgggaggggagggcggcg

SEQ ID NO: 9787 - DNA, 1500 bp, Zea mays
cctttcccgtttgtgggatcttctgtggctacaaccttgtgaccttgtgtggcctggttttcggccaatagaatcaggccacgtgttgcactaaacccgcggtttattaaatatgtgttaacttttgcgttagacattcgaattattccgcttcagctccgttataatgtcgtgtgcatgttaaaaacattattctatcgcgacacatgtttttatttagttaataattatttatttattcgacgcatataaaaatagaaatctaattaaaactaatttataatttacgctttataaatatgtgttaatatgattaacgtcaactcaaatattttgatttaatacttatttaatatagatgtgatatatgttattagttctcgcatgccacttctgttctaaattaataatttagacgctacgaattctatgtaacatagatgtaacttaccgagctttgaaatatgacttctactcaaattataattcggattaaatctaaattagatattactctgaaatatctttcgtatatgttttataataattaaaatcaacttaggaatataggtttatgtgttagtaatattattttgtcgcaacacatgttttcgttaattatccagttaatcgtttatccgatgtttatttaaacaacattctaattaaaattaatgtatagtttttaaattacgattttattgacacaagttaatgtggttagtaccaactcagatgttttcaacaaatatttgtttaatataaatgcaatgtctatttagcttttctcgagtatcgcgagcgcggtttcgcacgtggtcacgagctgatttgtgcgtcgttcacgtgttgtcgctcgtacttttcgcgtagtgtcgtgcgtcgtcacgtgtgctgttttcgcgtgtgtcgcgcgcggtgttttcgcgcgtgtcgcgtgcattgccacgcgtcgtttgtgcatatcgcgcgttgttcgcgtacgatattaaactgtgtcaataaaatctgagatgatatatgccacttttggacggagagagtagtttgtaaggcatgatttgaagatagaccaactaattaccataaaacaaaattgatatgagtgagaaatgataaaccaacccatccatcaaactgttcacacacgatgtccgtcacatcacacgtaaaagtgctagcaacttggcatatatcatcacataggaagaacacattcttattaaacacttcacaatgcatagcatcgaataaagaagtgcatgagaaattcagcagcagcgatttgtaactattattgttaccacgcacgcataggtgctcaaaagttccttgcatcagatggacagctctgtcgtggtcgccatctcctctctcttctggagcgcgttggcctccatcttgcagcacttgcacggcgggctcactatcggcaccgtgccgcgtgcatacgcgtgtccattctgaagccccttggtgtgggcgtccattttacgcgcg

SEQ ID NO: 9788 - DNA, 1500 bp, Zea mays
cgtttccgtcccgtttccatatttttccgtaaatacggaaacggtcgggtcaaatgtagaaaacggtacgggtcggtacgggattttttccgtccgttttcaaccctagaagggatcgaaggccaggcgtccgtgtcccccctcctcacgcacgtacgtgcaggtccatgccagcttccacgcatgatgcccgcccgtcgcccgacgatgcccggaccccggcaaaggccaccggagagacgtgaggccacgctgtgcatatcatgacggggttcggtggttgcaccggcgtcggcgtggtgtggtaaccaaacttttcacctcacgttttgttactcgatcggctggctcgcccggccgctcgctttctgtaaaacctaaaaagcgggggcgcgcgctcgttgtttggagtggtcatctcttgtcgtccacacctcatcgcttttttgtgtgtgttgatcgttttgccggccagggtgaaaaagctgggctcgacattttactgtgggtcctgggaagcaacgacaagagcgttcgaggagttttgaccactgttgggggggatttacgacgccaaaggccaaggcagtgtgctgctcgctcttggacgggggcccgttttcctgcagcagtacttgggcgttcgcagcgcacgcaagccaggccagcagaacagtagacagcattacaccgatcggtaggtcatctgcgatagccaaaacagatacttttattaaaactcagtaagctcgagaagttcttgatgcggtggcaaacggtaacttgtctgtgccgtacgaatggatggacagacggcaaataacaggaaagaataaagatgcataggaccgaacgtgcaggttagggtaagtagtagtacactggtacgtctgccccccataaccgacattcgtatcagaagacggctaaggaaaagcaaagcagcaaccgtcgcggtgcagcgccgtgtcggccgacgcttcttcttcttcttttttcactgcgctgcctccggcaaaccacgcctcagagttcagatcacccccagtcgtttgctcgcctcggcgacagacgtgaagccgctgccggtgccgggtaccgcgccggccgatcgcctttcgtccagcgagagaaaaaaaagtcgtcaaaccgacggagaccgcatgcaacttttctcctcccgacccgaccgcgccgcagaccgatgcgccaacacagccgcttgccggccgctcccgtgtgccggcgcctgcgcctgcgccgcggctcgcagtcgcacccagtgacccagaccgtgtcggcagccgcgggcctccttatttaacagatcgatccatccatccccacccgcaaacggcagccagatccagaccgacgtgtgtgagctagcttgttgccgtgttcgcacgtagtactcgagccaccggcttcccgcctccttttccttttcaaaacaaaaaacaaacaaaactgctcaggctcgctcgagcaacacgtacg

SEQ ID NO: 9789 - DNA, 1500 bp, Zea mays
attacaaaagtaaggctgaaaattatgtgcacgtgatactaaagtgcttaaaacrattagtgaatttgaccctatattttcacagagaataaactaatttttattctctgtgaaaatgagacatattcagctgagtgtggcaacagcagatggcaaggataggttctaatttccacagcgataaggcgatttatcaacagaatttgcgatctggtgatcggaatygcgcrttctgcggctagtcgcaaggcgaatcctaagcatttgcagctactactgtggacagtgacccgcgaaggccagcaaagcaccgggaggggcagagcgattrtgattaaagcagttaatagcttaattgttgggaagtggaaggagcttgccttgaagcrgccggactcagcgatggcttggatcccrgccaccctcttgaacaccattggcgacgtcctggaggctattctctcctcccgacggcacccagacctggaggcaagaaagcggaggggatggtgagattcggatccggaagtggtagcacccctcacgcgccaccaactcgacgccaccattttctcgtctgctggccactcgatctaggcgagggacgtgtagccacagtagagaaggctcgtgacttgtgagggacggcatgaggtgggttcggacaccgccaccgatgaatttggcctgctccttttccccctctaaccttctctcggacggcgaggcgaaggtgagcgccggcttgaggggctgctcgacctcctcgatgcggttgacctcggataaccaggtcagcgtggcggagcaggtcgggcacgtcgagcgtaggccgcagctgcgccgcgacgagggacgtctgcattggtggccctgctcccagatcctattacggggggaccaggtggacgagatctttgagggggaggatgggaagaaagagggcgcggatggagcagctgccatggatgaaagggggcggatggagcgcgtctgccatgggcgattcgtggcggatccctggcgcagacgaaatttgggagcggggcgcggctgccatgaatctgcgcgcgatttgtgggcgcggacagacgctgccatggatggcgggcgactgtatagaggagagcggggcgcggctgcctgaatatgcgcgtgatttgtgggcgcggacagagctgccatagatggcggcggattgtagagaggggcgcggagatggcggcgggagacagaggcgggggcggttgccgtagagcgagcaggcagaacactgtgtgtgcacgcctacagtagtaacttaaggagtagtagagatatatatatatatatgtgcataatgtgcttggtttgcatctataaggtgttcttgtagttctgttcttttccctgtccgtgctccccattccctacggcgaccaactctcctcctcgtcgtcatcgtctcctcttgcatgctggccgtacattctcaggttcgccattgccgtggccgctgac

SEQ ID NO: 9790 - DNA, 662 bp, Zea mays
gtgcgttatattagaacctggttgttagttcagtaactttcgataattttgcttctatgtggccgagacccttaggtagcttttccctatagataatacagtagattcacctatctgaataggtcagctgatcttgcatcaatctggatagttttgcttgttggactcctggcggtcatcttttcttcttcagtgtcgtgttggtgttatgtatataattaggtgatgggaaatgatcacctaatcataacgcgatggttggtggatcgggagagagttccatcttggttagacaattcaaaagggagttgtaaacttgtaataggctcgtgacgctgaacacgtccaatgttcggtgaacagacagcccatgtcaaagataagtatgaagtagctgattggaagctccaccttttattgttgcccatttgaagtttaccattgacaagtattacctttcgtctattgttgcaaatataaatagatgtgttgttagcacctgcttttgtatrtgttccatctgatgataaatgccttggtcgctttccctttcaggtttcctctcgtagtattccgttcagtttctaggatgtgagagcagcttttgcgttgatgataaaagtgaggatgcttggttatctggatttgtggtgctttatgtg

SEQ ID NO: 9791 - DNA, 315 bp, Zea mays
tcggcggctgcgggtctcccgatgcggctgcgggttgcggcgggggggctcgcgaagaagagggcaaaacaccttgtcctcctcgttgggtggctcggaatagatgtggggtcgggaaagcctcatgaattcccatccgtccgatggactaccaacggctaggattattctgagctctgtacatcgtccagcgaggctaggttacccttactgttccactccagtcggtcgaggagtagggttctagcgcctatctggtttctccctgcgccgccgccgccgccgtggacaaccggagcgtagtgggaggggatg

SEQ ID NO: 9792 - DNA, 1500 bp, Zea mays
cctaatcagacccttgattgggagggcccacgctaaccttaggttgagcccccggtcacgacgttatataaaagattaaggagtcgtaagaaagacaacgctagtacttcgccctaaaccctaatccatatataggacccatagcctagacgtcggagtgagcgtgacaacctacgttggcttagatctcggtgtctgttgttcctctgcaagggcaatagaggtgacgtgatggcgacgaccacgctccaccaccacctcgctagtacgcgtcaacacaacaacgacaaaggtacattaccatattactctcagtagaagagatctactcgttctcgaggatttgtagttacggattggtattctagttaggaacttaggaatatgagcttaaatggatcttaggcacatagaagctaacagtgacaagttgctttctctggatcaggctgcatgctaccgcgctagctatttgaggtttgctagcagcggaagcgaagcaacatgagcctgcagattaatgtgtccgatcgagatggatggatggagcggcaagcaaagcaaccaataatcagtggtatatatatagatccttcccgaagcacgctgcatgcatgcgtccacgcatcttggggcgcgcgcggaaccaagaatagcgtcacgcggaatctactcgaccagctcaagtgctcaacaaatcatcatgtcatgcttgcagctatcagcttgctcggtgacggcgatgaggcagcatcacgttcgaccacatccgttaccttctttcctccctttcagtagatagacttgcaagccaacccaaaagcaagcaggctgcccttgaagattcacatcacgttcgaccacatcacgttcgaccacatccgttaccatactgcatgtgaaactgacactggcacagcaggagattcagtagtcaagctaggctgcacaacagcttgcattgcatgatgaaagaaaagaaaagaaaaatggtgtaactgagragtgagtattgcacatatagaacgcaatgcatgagtgattcagttgcaaagtatggtggctgaactgaaacgctgccgcagttcgttcagttacgatagctgaccggaaagcagggcggggagaagagcgaagcaaaagcacaccaagcgtgccgtggcctgaaggaatgcccctgatgatgacgagttcctgggtgtcggcggaactgacaccagtcacactgacatatcaccgtgaagtagtagtagtaggtgtacgccaagtcttcacgaaagccacaaacgaaaggaatctccttggtctctgcttgcaagcaaagcttggttttggttgccagccactctgaattctgaaaccaccaaataaacctgacgagagggagcagcgtttcaaacgccaacgcaattcaacgccccacgcgagctataaaaccggaggagaagcagctgccaagttgcatccaatacccccacgaacccactctctctccccacg

SEQ ID NO: 9793 - DNA, 542 bp, Zea mays
gacagtccggtgcacaccggacagtgtccggtgcacaccggacagtgtccggtgcccgattcctttccttaaatggcgaagccgaccgttgcagatctaggagcggttggcgcaccggacagtccggtgcccccttccgaccgttggcttggccacgtgtcgcgcgcagaatccgcggtcgaccgttggcccggccgaccgttggctcaccggacagtccggtgcacaccggacagtccggtgaattttagccgtacgccgtcagcaaattcccgagagcggcctcttcggccgaggcagcctggcgcaccggacactgtccggtgctccagaccgaagcagcctgctggctgtacacagccaactcttttcttttctttttcttcctgtttccaatacttagacaagtatattagtacacaaaaccaatatactaagacttagaaacatacctttgctcttgatttgccctttattcatccatggcataacttcacatttaaacacttgagttggcactcaatcaccaaaaatacttagaa

SEQ ID NO: 9794 - DNA, 48 bp, Zea mays
tcggactaactgtccgtgtaaacatccccaatagattgcataagggga

SEQ ID NO: 9795 - DNA, 313 bp, Zea mays
tccgtggtcagaataataacaaatctaatctagaacttacttagagcctaggaggcgcaacaattgactagaattctagaactataagggtcgcattgtttcggtgcgcgcgagctgcacccatcattcttcggaagcgtataataatccggtcaatgaacgggaaaaagctaatcagacgactgatcgagacagattaattcaacagccatcccttttatttattcataaaatcgtgtataaaagaagcctccctctgggctctggaccatgcatctgtgtggctgtggcaaacagttctgaggtgtgagca

SEQ ID NO: 9796 - DNA, 316 bp, Zea mays
gatgcatagagtcacagagtcttgctgtaatggtacgaagaggtgggagaaaaatcaagctaggatagagaatcgaatccgatccacaatccaaatcccaccgaggctctggcgctgtggcgcagcccagtaggccatcgttcactgttcgcacacacgggacacggcacgccgcaggccgcagcgcgcgcgagagggagccggagccggctgcctgcttgaacgcctggtaacacggcctctcgcttcccctcccaaactttccctaccccgaccgccgatcctcctcgccttgacgtccaagagccccggtccg

SEQ ID NO: 9797 - DNA, 1341 bp, Zea mays
tgccgctgcgcgactgcaacgtactgatgaggaccctggccaggcgcggcagtttctcatgcgtcatggcagtttactacgatctccgcgcgcggcctcgtcgcagacagctacacctgcccgttcgtgctcagggcaatcggcgtgatgaagctgtctgtcgaggggcgcaaggtgcgtgcgtgcggccgcagtgaagaccgggttcggctgggatgcatacaccgtaaggccttgttcgtttgcgttggattgcatccggaatcgttccagataatcaaagtttatataaattagagaagtaatccgattaggaatcgttccgacccaccaatccagcacaaacgaataaagcctaaagagaaaaagggaaaatggaggttagctaatacacaataacaataattaaaaaggctaagcacctttaacccgtacagggtactattgcttggagctgcgatgcgatgacgagacggcgataatgcatgtggtgtggtcgcccgctgcttgccgccgttgcccccactgcatgcaggcagctaggtggctagcaaatagcgtgcgtcgccatgggcatggccattgctgccaggtctatggagttcgttgtcgcatcgtcggattattgtacttgatcgcgctctctctctctctagctagagcttccccgcacctcaagctacctgtgtgctttatttccttaaatttcatccaacccatccattagcccacgcacggcacgggggccttgcccttccccttagcttgcttcaaccccacgtactttatcactagctagtagagtgccggcccgcgcgctgtccggcccctcactcatctctctctctctctctctgtctcccattcgatcttgctcggagctagctagagagaccagcaagcagatcgaccactgctgccggttgctgctttttttccccccggacggaccttttatttagttacaaagctatagttttttcttattcagctccacttttattaattaaaaagatgcgcagtctgttacctctggcgtaagtctcaagcatcgaactgcctagctgctgtccccctagctgagagctgagctgctgagatagcgagcgccacccgtcgcttttcatttataatcgcccgccagcaggccgtctcatcatcattgttgccatccgcggcgccggcggctctgcatgcgcgcgccctgcggaaactgatccatgatctgatcccacggcaccagcagcaacggccgaccgccgggccggccggccggcgcgcacgcacggtgggcgcgcgcgcggtgccaaataaagagcttagagccgccggccgggatct

SEQ ID NO: 9798 - DNA, 89 bp, Zea mays
ggtggaatcttttggggggccgtacgtatagaaacgggagagcgacgcggatggttgtggacctgtggccttgtggggcaattggctag

SEQ ID NO: 9799 - DNA, 1500 bp, Zea mays
aagcagccgccgccaacgccacccagacccagccagccgcgcacaggcacatgcaaccatgcattcgcggacacgcacagcacgccagtacggcacggtctcgcccagctcaccatggctggccggtcgctcgcccgcccgcgcagaacgccggtggccaaaacgccatcaccaccagcgcgaatgcatggcacacgttgtgcagcgcgcggggcgggctcactcattgcgatgcgatgcgatgcgatccgatgcgatgcggtccgctagtgcgggttgttgtcgtttatctccttcccccgctctgctctgctctgctctgcctgccacatggccagcaaattttccacagtaaacccgccggttcacgtgggaatacaattctcgttttttccaatggatcaacacaacataaactttagttaactaattaatatttgtttagaggtaatgttttccttagccaaacatctatatattcgatcatcagtttttttaaaaaaatactatatataggattgtggtataagttttatagttttcacatgtaccatatcaaaagcttttcggatgtactataggagattctttgcaacgtatgagttttacagaaacagtataaaaatttcatacaaattagtttacaaagagagagagagagagagagaaaacacgtaggattcaagaaatatttcttcaatccaaaccaggatcccttgttttttaatttacaacatatagagagatagaggggtagggggaggggtttgtcagtatttttttagctgtttgaattgtctgacagcgaagcgaaaccaatgatccgcatatcttgtcatgtcacatctcgtccttttaaaagaatatcttgtcgtatttttcttttttttttccccaggattccatcccctggaaacttctgccgattttgttttccaagaaaacaaataccccagcagccgtggattgtgggggatatatatccttggctttgtagcagatcgcttgcacggccagcatcgttggacttggattgcagcaggcaaacaaaaccaaaaagacagcgcgagagcgtcagcaaatataccactcctacttttaaaagacaaaaaaaaaacagagtggaagaaaagagaaggccattcaatcctagcaacacaattttaagtttctgaaaaatagaaaatagaaattggtctggattttctggtccattctatgaatcaggtgatataatatgaatataaatcagagggggaggggggcatggcccgcacaccagccttgcagcactattatgctgtgttgtcacttacctactctccgctccctccataaatagctccaccctctcgctctcactcccccacctcacgcactcatccattcggccattccttaacatccttgttgcaagcggcgccagcttgctcgcgctctctcgcagctgctacgctaaagcaagtctagtctctagaggaggaggcggagggggaggcc

SEQ ID NO: 9800 - DNA, 1500 bp, Zea mays
atagctcccccaggtgtgagcgacgaccttgtttttatgctactttatatacatatttatggcaacatcaataggtgtttatgacatatatttcagttcatggctccccttccatctattatttgtttatgatatttctattcatatttttatgcaaatgtttattgattttatgcattatctcgttatctagtccagtttgtatatgaggttcctaccatttatgccatatatataagatatttatgacatacatatttacgcagctaaacaaaaattcacaaaaaggtaaccactcccgagaataaggtcatttgccacgtttccataaaatctcgcgtatgcaatccattggttttatgatgtccgttactgctagaaaaaatttaaattccctaatcaaccctccttattaaataacctaatcaactcatctaatcaaatcccttgatttatgggggatggacacatggatgtggggttgttgatacaatgtaaaccaaaaatttacgatgtatcaacaatatttttatgctaaaacttggggatttcactacaaacaactcccctatagcaacatattctaggcaacgtatagttatatgcgttggaagtgattaggttccaacgcttgttatgtgttgcaacctacaaccgttgtattacaatgatactgtcaacatttaacatgcgttgcaaaccgtatgcgtagagtaaatacgatcatagcaacatttaccatgtgtggcaaccgtatgcgtagagtaactagaatgcttgtaacgtttacatgcattgcaaaccgtatctgtagattaattttggtacttaagcaattttgcaactatgacttttatttttaactaaagcatagtagttggggatgctaaattacgcaaaaactgtgtaaagtgaggaattgaagaacaatacaaaatcttttactccacttcgtatcgttttatttattaaaatatctattttatcttgttgtcactatgttgcacttattaaaccatttgttatatctctatttatttgtcaaaaacatgcgaaatatgttttcgatgactcagttgcacttattaaaatatttttgttatattaccttttattaaaaggaactcgagattcagatgtccaaagcgatccagcgcctgttccacaagcatctatcgaggcatgtcgcatggacggccatgaacgcatgctttcatttaggacgctcaacgtcgggaccctaaaccctatctctgcaggccacaccactcaagccaattcctccccgcaccgccagcctcacctctytcccttccatcgcggctgcaccaccaccccactggcttccacacccagcgtcgcatcgcctcyttgttggctgcccccacgactcaactccaccacttgcagaacaaaggtagggtttgcctyccctaccctcctcatgctctctcgcctcacgagacaaggaccacccgtcatctctcgcctcccgccacc

SEQ ID NO: 9801 - DNA, 303 bp, Zea mays
cgttccatctagtagcatccaccgtcaccctcttctcgtttcttctgcccagtctctgccttcttcttcgtcgtcgtcgtctcggtttcagtcgtttcctaaaactttaccttgcatgcacttccctactactgctgctgctagcgaagacctttattagttattagtagtgttaagttattaccaacaagaagcagaaagaaagaaagaaaaaagggatcaagaagcagagagctgttctgttcttttttccccctctcttgcaagaaagggcggttcttgcgcggacggaacgcaggaaca

SEQ ID NO: 9802 - DNA, 1500 bp, Zea mays
gagatgataaaatgtgtgtcyttcatgaccttcgtccaaaaaccaatatattcttgagaaaataatgttcgaaggacgaagtgcattagcaagtaacctgtttttgtgttgtcttgttctcaatttatagcatttgaaagcaagtctccaataaagatcatgaacaagtaggatctatttaacataagaaaaatcgtgtcccaactttagctacaaaccaaacgcagatctaactcaattaaacttatctaactttagatatggtaaactgaaccaaacaggtatgcctttcctaagcgccgatgacctgttcctaagcgcgcgagatatattcgctatcgttcccggagctacgaaggtacgggccatcaatcaacttcccaaactaagcgacgctcgcggcccatgcacgtggccacgtcccacggcaagcctttccttttgttttatttgcttgattctacttttttttttcctttttactattttttgttttcggtgatattatattctcattttcattttacttatatgttcaaattttatttttattactttctatttaattttagttagctatttcctttatttattttaaattccattttattctatcttttaatttttatttgccttttctttcccattcctaaagattttcttatattgatttattttttagttttatttattattattttcattacattctaaattattattttcatttttatccttttttatgttctatatttttatttacagtattctgcgagatgaaaatgatattcacttagtatatatttatgacgcaacgatatttttaaaaaaatttcactatatcaatgagttcattctaagattttccatgccgtatcccacaaaagtttaaacatgatgcttcattatatatataatgtactattcacagagtatctataagatatcttgtgatgcattctatgttgtttcgttcggtgtcttttactttgctttattaccatttgttgttatttattttttttaccttttcttctttatttactctagttaattatttgaattgtttatactgcgtgcgatcctgatcagggtatacgaatacgatgcccccggccttttgaggcttcaggctcgtgaccacggaaacatctagattcatcgttcatgcacggtcacgagtccctgatctgcctgctaactcctagttaaccagatgctcagctaataaagaacgcaatttggtttttactagttcacctgccgtgtttcgtaccgaacacctgctgaagtaaaaagacactcgcaatcagaaacctgctcgtcttttgtgaacccagcacgacaaactgccaccccaccgactcacgggcggcatggacaagcgaaccactgatccccgcaccatcgccattttgccatcgcgtacgcacgcgcgccggattaaaaccccacggttaccaccgcagctagcgaccgagcaggaaccagtgaaccagc

SEQ ID NO: 9803 - DNA, 732 bp, Zea mays
ggccgccgagcgtctctcgagccgattctggagaagacctggcggcgatgcccgggtgtgtgctgatgtcgccttcagagtggagatcctccacccgcgtcgccgttcgagctaggtcggacttcgccaaaggtgtagttgacgccgagggtgctgctgcccccttcaactgtcgacgtccgagcctgcaggatcgggttgtcttgtagcgtgtgtatgttttctgcggccgccgaggcccaaacacactgtcgtcgtgttgtaaagctgtgtccattttcctcttgtttcgagtatctggacttgcttgccggtaacaaacttgtttgtccgagcgagagttacttttcacggaaggtgatgagtgaggtatccgtatcccggaggcgtaaggagaggatccagatgtacaatggggggtgtagcagtgtgctaacgtgtctagcggaggagagctagcgccctaagtacatgccatcgtggcagccagagaggttttggcacctagttcgtgtggtgtcgtggccatcggaggagtgctggagcctggcggaaggacagctatcggggctgtcgagtccttgctgacgtcctcttgcttccgtaagggggctgagagccgccgtcgtcatggagcgtgcggggcgccatcattactcgtatagtggagcgagccagatgggacgccggtcatgttccccttagcctgagtcagctcggggtagggtaatg

SEQ ID NO: 9804 - DNA, 747 bp, Zea mays
ctacaaattatactacaaaataaaattactcacttagccgatggtgagatcggtgtggccgctggtgggtgacgtagggctggacgagcgttggagccgacgaggcagtgggggcgaggtgggcgctagcgtgggcgggcgctgatggctccgtcgaggatggctcccgcccggcgtaacggcggtgctggtcaagtggcttacgtgcgaaatgaaacggtacggtcgggcgccgcggacttaaaattctttatttccgacggcttgtatgacagtccaacgatctgtctgacagctgtcggcataagcgtcttgccgacggcttatgacaagccgtcgaacgtatgaacttatgtccgacacagataagggcggtcgtcaaaaaaaaccgtcggacataagttgaccgtcataaatttcccattttggtgttatggttactggatacgtcatgtctaagcatcagcggcaaaatcgcctttggctggtgaaaccgttccccggctcgtggagctgctcaacaagccgtcccaaacgggcacagcttcgaagaaagaaccattattaaaacattgatcgattgatcgattgatgcatgtgcatggatgctacgctgcagtcgtagaaaagcagaacactataaataaacaccaggttccatccgtctctgcagtcacccacaaccaattagccattggccagcacagcagtgtataggcatagctacgtacgtgggaagtgggaacg

SEQ ID NO: 9805 - DNA, 618 bp, Zea mays
ctcgtcggcgagacggtggaggtgcgcaggggagacgtaggtggtggctacaggaaggtggttttcagcatcgagccattggcattgagcgaccggcaaccgcccgtatcttcgtcttcgtcgccggcggcacccgccagagtcgtcgcgtccggctgttgctgttgttgcatgaagaggctgttggaggaccgggacatcttcatctacctgtgagtgagctctgctggtttccatcaaatgtgtgtgatgtgtcatgtgagacatgttccaacgctattcggttcttgatttttgacggaacgtcttgtggtggggtgtaggggcgagaaggccttctgcagcgacgagtgcaggaacgggttcactatggaccgtttggctcgaactatcttgagcccaaggaaatctgggcctttttaatcgttgtcacctagctcgcggatggtccacacgcaatttccaccgtcagtattgcattggagtgaaacaactcccatccttgtcaccggttaggaacttaggaatggactcgccggtgcctgcctacgctcgtgtgcgcgccagcaagatcgcaggtgtgggcgggcgaggaggcttgcgccgatactcggcagg

SEQ ID NO: 9806 - DNA, 1449 bp, Zea mays
agctagcccaccaggccagtgtaccttataagatatattatgagcttgtttggatataatttataagatatttatggtccacacaaactaaaattggagaatctcttttagccttttagggcctacgatatttctttggcggctcgaggttttcggcaaaactagaatcccccaatcttctcttaataataataataataataataataataataataataataataataataataatcctaaagttagccccaactaagcatactgtctttttttatatataaaatatgttcccctggtcatggaagaagagcgcaagcattgttatccattaaaataacattccttggacacgatacctttttctcgcctttgcattgcatcagccatcggagctccctttggaccatttcccctcttcctcccccgtgacaaagcacaagagccaaatcccccaacccaactgccactggaagcttgtggagtgcgggccccacctccctgcaattgatttcccccgttgcgttgcatcctcagttcctcacgccgccaccgcgacgcgccgacgcccatacgccgccatcgtcctataaagcagccgcccacacgttcccatccacccccatccatccatcctctccgcgcgctctcgctcgccctgctacctccgcccgcggcttcctctcccacaagagccaactgtcgccgtcgccggtgcctgcctagtgccgccagccagccagtgctgttcccgcgtcctgggcagcttgcgttgccgttgcgtgcgttcccggccaccaccacctggactggactggacggtcgctgtcgcctctcgcctcgcctggccccgtccccacgtcccgttttcggtgtcgctgtcttttgggctctacccgggcccgtcgctctctccctacctcccttttcgctttcccaactcctgcctgccccggcgctcagcaccgaagcaatcatggaggcgcgctgggttcgttcctgacctccgcccgccgctgccctcccccgcctcgtcgacaaatcacgccgcgccttttcttttcttttcttttctttctcagtttcaggtgttgttttgccactagctgctgcctgcctgctgccgccgccttttttccggctttcgcttttccgctctctgcaccagcctcaccctcccaaccgcgcctccgtccgctttctcttccgtcggggccggccgcacctcggacccatcaggtgctgctgtgctgggcgagttctgccccccttccttgcttttgtctggcattcgctcgctctagtttcgcgcaacccggccgtcgccgcctcgggtttctcgcctgtggctttgagccgagagatcgattggggactcggtttccttcctgctctgagttgggtttcgcgcggctcggactttggccggcgggcgaataaaccggccgg

SEQ ID NO: 9807 - DNA, 1500 bp, Zea mays
agttttttataaaagctgtcggaagttacaaaaccgtaggaacttaactaacttcctacggctggctctaggaagttaggtttcatccgttcacaagccaataggaagttagtcagctgacggcgctgacggcgtgaaactactaacttccgagaatctactaayttccgagaggtttattaagctgtaagaagttaggtaacttcctagagccctctaggaagttaagctaacttccgacaaaaaaatttcgagagccaaacttccgacgggatgacttaacttccgagagtttygctaacttcctaaagtttaggcctaacttcctagggtttaggctctagaaagtttactattttggtgtagtgtagatattgtgcggagtcatttcatcttcaaacaattcaactaaaaaacttaagcttataggaagagatttacgattcacttatattttaacagtataatcatattattagcttaactcaagttaattaatttgtagagctagaaaaagatcattatatttttggaactaatactgtggagtttcacacaaaaacagtagtatttctttttacctactcccaataataatgtgccttcaaatgggaacactacactacatatatatggatccacatcgccaaaaactagacatcagtcagacgctaatgctatccaccacacattgccttttttgtatccagatatacatatgtccaggccggctagctgtacttaatttgccatctatcaaatcatatcacagattaaaaaacactctaataccaaagataggcattatcactgacaactatccatctcatgtgccatgcatctacttactaataatctctccaaaaaaaagtatgcaaatttcctgagagagagagagagatacagagacagaccacatttagcccaagtacacactgactttagtgattcactctacggccggatgccatccagtgccaggctacctgcaaacaaacacgcgccgtgggcgattccatgtgcaagtgtactttgtttacagaaaagacagggggctcttattatgaaactaatagccaaccttttccccccttgagtgctgagatttgtaggggccaaccatcaagcaggaggtgattgcaaccaaacaaatactatcccacacattgacttcctaccccttcccttcgtctctccctatcatcctctctctgcagctcagctagcctcactgtcgccctcgtcagtcttatatattttatgtgctctcttgttcccttgtgtgatgtctcctcttcctctccctatccttgctttctgtgcctctcaacaaagggcagtgttccttgctatgtcatctagctagatagcacagagcaagctgcctgggcaggcagctagaaaattaacaacaaaaaaaaaaggtcaggagcagtgggatttggtagcttgctgttgcttttggcttcgtctccgggcacatctcactgctgaaacctc

SEQ ID NO: 9808 - DNA, 627 bp, Zea mays
ggtcttctccacgcgtcacgtttccaactcccaactgaaactagctactgccacgcgtcaccaccatatccctctatcgtctcttcccttcgtcctccgatgacatcagtccgtccttccagaaccggtacggtaatacaataatgagtcacaaaagtttaaacaatatttaggaggtgtttggtcccctcatttttagtctctaaattactaattttttagtttggtaattgagactaaaaattagttcttttagatcaagacattgtcaattttaaacaatattgtacttattttcattcaataatactagcatagcctaacttgtactagctagggtttcgaatttatttaactagtacactagtagctagtagtacttgagagttcgtagagttgatgctgaatgggtggacggtgccgctcctccctcctatatataataactatattgtacgccctttgagttggaggagtcccctctctctctctatacctttcttgcccaagcagtcaatcaagctgggaaacttaaacagaaagcgaagcaattaaaggccaccaccgccttcacttgttccttttggttattttcctcttgctgtggcttaacttgacaagaagaag

SEQ ID NO: 9809 - DNA, 1500 bp, Zea mays
tgtacatactcgtaggactctagatgcaagattggcccgctccgctgtcacgtgcgttctgctagggacaacaaccacaacaacacaacacaaccagcgcgtgaaattgccggctcgcttggatgcgatgcgatgcaacccccgcgtcgcgtaagcgttgacgtttctgccgccgcccgctttgcccttctttatttttttcttcctctggaagcatcagcgcacacgtacctacagcggctgccggcctgcgtcctcggcggccgctccgcacttatctgccgccgcgccgacccacccggctatcagacgcccgcgcagaaaaaagtccgcttatcaccaccgtcgcagctcgcagctgtcccggcacggccactcgccggggtccccccccccccaccctggaacaaccagcgcgggcgcgcggtctgtttactgcggccgtgcaaaagccgggggcggtgccgtactcgtacactaccactaccaggcgcgtcgcgtacgagtacattttcctacgtttcctgtgcgtttacgcggtgaggtggtcatgaccgtgctcgtacgcagagtgcgatgctgtgctgccaacaccaacaaaaaaaaggtccaaactaatcgtaacacagtacgtgtatttagaaaccatccaccttgtttttcggatcccgtttagatcgtgtggaatggaatctatgaaaaaaactgactcgttctggattgcaacgacttgtagattatcaaaaccggtgcgacaacttgtccaaacacttgcgctgagtatatattcaatgagtctagacctttggatacatgaacctcatgctatacgattgaagaaatccaatacacatgtgtggtaaagtacaacgaccggatgattttataaagtaccccgtattttcatagggtaggttacttatgtgcatgtccttgtgtcacggagtttgacgtttaggacagggaaatgaagccatcgtcatctctctgtacagtatgcagtagcactgtacctagtcacgtacgcacacgcagacagtacagacagagaacagcgatagacgcaacaacctatcaccaaaaaaacccggtccccgcaccagtctggaatggaacaaacaattttttcctccgaaaaacccgtaaaccggacacggatgccaaaataaaccccccaagaacgcctagtcaaaatgtccaatcctataaagcgacacatcacgggataaccaccgtagactccgcgcctctccgcccccacacgcgctttcgctgcaccaaagcgtcgtgtgagctgctacttaacctaaccaacccccaccgccaaagccaaaccattccccccgttcctgattccaattccaaccagcccatcccccttcgaccatacacacagagcggaggcgaaggcaagagcaaacagagtagccgccgccgccgccgtcgtcgtcgtgtgttgagcagggttttgtttttacggcttagctttgagcagcagag

SEQ ID NO: 9810 - DNA, 163 bp, Zea mays
agttgaaaattacgaagctgttctgaaaaaaaggacttcaccatccaggaccttgaaatcatggctaaagaacacgaaggtgcattagaaaagaaagactttgttattcagtctatggaaggttccttggctgaggtccaagccgagaatgacagtttaaaga

SEQ ID NO: 9811 - DNA, 251 bp, Zea mays
aaaaatttacaccttcagctgaaaacctgcccagcacattagaatatattgaaggcgaggttgacgctcttgatgaagttattggtggccatgctgacttctgcgccctggtagcttctcggggcacagctaccgcttttctgaaggctggctgcacgcatggaaaaattgtgaatagaccaaacttcagcttatcatcatcagatctgatagatattccaagcctagcctgaagcatcggaaatagattt

SEQ ID NO: 9812 - DNA, 863 bp, Zea mays
gcagaatctagctcaacgtgctttgttgcaactattttttatgtagtttttgatactgaatccagtttctaatactctcttccaaaccaaatcaacatttttcaaaaaaactaaattcaaatggtacattcgttgggtctcttttcggcacgatttgcaacacctcgccacgcagaattaaaaaagggcatgaagaggaataccatgaagaaggagttgggggactggactagccgcttcttcttgtgctttagcttctcaagctctgccggtggattgagtaagtcaatgtcgttttgcagcacctgcccagatttccaagaaagaatgcgtaatatcattagatcgaagagcaaccaacaaaaccgaagtgaatcagcgtatcggattagtgagcgcaccatcttggagacgctagcgccttgggcgttcctggtctgctacggacgaagggagacagaaggggcaaaggcgagcaagtggcggcggcggcggggagtgggactagagcggcgggtggatactttatatataagcgcggccaggtggggtggcgaatctgagccgttcatcgacgtgctgcgttcatctcggctttccgtgggtcgtgggattgggcagtcccacgaaggtagtattggtggaggcccaacaccaactgaccaacagaaatgccttcgccctttggggtttgggctttccaagctttcaaccttccggactctcctacatgacactggtatctgggccccatgtgctaactgcctgtaaaccctaatcccgaatccctcccggcctcctccgtctcgcgctcgattcgaatccgagctccctatcctgctgctcctgctgttcccgctgca

SEQ ID NO: 9813 - DNA, 460 bp, Zea mays
ttgcagcgggaacagcaggagcagcaggatagggagctcggattcgaatcgagcgcgagacggaggaggccgggagggattcgggattagggtttacaggcagttagcacatggggcccagataccagtgtcatgtaggagagtccggaaggttgaaagcttggaaagcccaaaccccaaagggcgaaggcatttctgttggtcagttggtgttgggcctccaccaatactaccttcgtgggactgcccaatcccacgacccacggaaagccgagatgaacgcagcacgtcgatgaacggctcagattcgccaccccacctggccgcgcttatatataaagtatccacccgccgctctagtcccactccccgccgccgccgccacttgctcgcctttgccccttctgtctcccttcgtccgtagcagaccaggaacgcccaaggcgctagcgtctccaag

SEQ ID NO: 9814 - DNA, 410 bp, Zea mays
gcttcttttgtgatcatcattgtaagggcgagagactccaagttgtggatttcctcacaaacgggagaagactaagaaaggaaaaaccgtggtattcaagttggtcatcggatcactttaaaggggttgagtgcaaccctcgtccattgggacgccacaacgtggaagtaggcaagtgttacttggctgaaccacgggataaaaatcgcgtgtctcttgtgtgctttctctttgattgtctgtgttcgcaagagatcgcttcaagccacttagccgtactaacacttataactaagttttgtggctactagtatttgatttttacaggatcacctattcacccccctctaggtgctctcaattggtatcagagccgttctcttcatctaagggactaatcacccgaagag

SEQ ID NO: 9815 - DNA, 1500 bp, Zea mays
gaaaaagggggagtttttgaaatctttgatcaatttctcttggaacaactctctttatgtctcaacaagtgtgtttgacttagagataggaaattgaggttgatttgcaaaaacaaaaccaagtggtggcaaagaatgatccaaatatgccaaatttgattcaaaacaaatctgtgttcttatttgcattgatgttgcacatctttgtattgcttttgttgtgttggcataaatcaccaaaaagggggagattgaaagggaaatgtgcccttaggccatttctaagtattttggtgattaagtgtccaacacaagtgcttaagtgttaaattatgccaaatgatggacaaagtgaaaatcaacataaaggtatgtttctaagacttagtactttgttttaaggactaatgtattgtgtctaagtacgggaaacatgagaaatcaatttggaaaagagatggctttgttcagccaaagacagtttagtttgggagcaccggacagtgtccggtggtgcaggctggctctggcgaactggctgctctcgggtttcgtcggcagcgtacagctataaatcaccggactgcccggtgagccaacagtcggccgggccaatggttggccgcgtaatccgcgcgcgacgcgtggcagagccaacagtcagaagggggcaccggacagtgtccggtgcgccaacggctctgaatctccaacggtcggctgcgccaaaataggaatgaaatccgcaccggacagtgtccggtggtgcaccggactgtccgatgcgccaggcgacagaaggcaagaattgccttcctggaatgctctcaacggctcttagctgccttggggctataaaagggacccctaggcgcatggaggagcacgccaagcattctctaagcattcctaagcaccaagacttcaattccgcacatttgattctttgtgatagcaactagagcttcatttgagtagagaactcttcgggttgtgttgtgaactcgagttgtgacttgtgtgcgtgttgtgctctgattttgtgtcttgagtgcgttgctcatcccatccttacttctgtgcttctttatgaacatcaaattgtaagggcgagaggctccaagttgtggagattcctcgcaagcggaatatagtaaacaaagcaaaacaccgtggtattcaagtgggtctttggaccgcttgagaggggttgagtgcaaccctcgtccgttgggacgccacaacgtggagtaggcaagtgttggacttggccgaaccacgggataaaccactgtgcctatctgtgttgatcttcttgtggttattgtgttttgcaagaactcctctctagccacttggctttactgtgctaactcctaatcaagctttgtggattaagtttcaagtttttacaggatcacctattcacccccccctctaggtgctctcaattggtatcagaaccattctcttcaagaaagggactaatcacccgaaggg

SEQ ID NO: 9816 - DNA, 132 bp, Zea mays
cctgaaaaccaaaaggtaaaagaagcaagatctgccgcggctccattttctggtcgcctcctccgccactgcyatctccctcctctgtcctccgtaccactcgtcttcgtctagccgccgaccgccaccacc

SEQ ID NO: 9817 - DNA, 1500 bp, Zea mays
ataaagaaacaatccatgtgtatcttataagtatttatattgggctcaattctaagtaaccttttgcacttacattatgcaaactagttcaattatgcacttctatatttgctttggtttgtgttggcatcaatcaccaaaaagggggagattgaaagggaattaggcttacacctatttcctaaatgattttggtggttgaattgcccaacacaaataattggactaactagtttgctctagtctataagttattcaggtgccaaaggttcacactaagccaataaaaagaccaagaaaagggttcaaacaaagagagcaagggataaccgaaggctgccctggtctggcgcacyggactgtctggtgcaccaccggacagtgtccggtgcaccagggaactcgactccaagctaaacttcgcaccttcgggaattcttagaggtgctccgctataattcaccggactgtccggtgcaccaccggacagtgtccggtgcctcaggggagagcgactctgaactcgccagcttcrggaatccgctccgctataattcaccggacatgtccagtgcacaccggactgtccggtgagccagcggagcaacaactacttcacgccaacggtcgactgcaacgcattaaatgtgcgccagcgcgcgtagaggagcagggcacgcgcgggtggcacaccggacagtctacaggacttgtccggtgcaccaccggacagccaggcgggcccacacgttagagctccaacggtcggaacccaacggcctggtgacgtggctggcgcaccggacagtgtccggtggaacaccggactgtcccgtgcgccatgcgacagcagcctccaccaaacggctagtttggtggttgaggttataaatacccccaaccaccccacattcaagtcatccaagttttccaccttccaactacttacaagagctctagcattcaattctagacacaccaaagtgatcaaatcctcttccaattccacacaaagcttaagtgattagtgagagagatttgcttgtgttctttcgagctcttgcgcttggattgcttcgttctttcactctttcttgcgaacaactcaattgtaaccaaggcaagagacaccaattgtgtggtggtccttgcggggaagtttgttcccgtttgattgagaagaagaagctcactcggcccgagggaccgtttgagagagggaaagggttgaaagagacccggtctttgtgaccacctcaacggggagtaggtttgcgagaaccgaacctcggtaaaacaaatccttgtgtcacactctttattcgcttgcgatttgttttgcgccctctctctcggactcattattatttctaacgctaacccgacttgtagttgtgattaactttgtaaatttcagtttcgccctattcacccccctctaggcgactttcaattggtatcagagcccggtgcttcattagagcctaaccgctcgaagtg

SEQ ID NO: 9818 - DNA, 1500 bp, Zea mays
cacgcaatcggctgcagagtgagctcagagctcaccctctccctctgccgctgctccgctgtaagtcccggcttgctactaagctagctaccagcagcgtctgctgcctcctcctcctgctgctctcagggagctctccgtttagaccagctcgtgtgcttcttgggaagaggtttccgcgttgctgtttctttttcagcctcgcattaggatttccagggaaatcgggggatgccactatagtgtcccgctgtcggctaatttggcgrccagtattttataactaatgggttgttcgcttccagctgtaaacactatagaaacaggtatggattaaagccaatcgaataggctataagatctatagaaacatgtatggattaaagccaatcgaataagctataagatctactgagacatgttgacttcgttaccatgttaatatatcatatttttcgttgacaacacgactgaggccctgtttgaaagcaacccagtttttaaaaaaccagtttttaacatttagctaggagaggccaccttcttagtttttaagaaactgagaatctaatttctataaactgagtcataaactggtacatttggaaccacctcaatttctataaaccagtttcttaaaaattgggtgcttccaaaccaacccttagaccctgtttggaagtgtagtgtttttatagttttgaataaatactatggtattggaagccaacaggtgtttggttgatatagacaaaacacaattttgaataccatggtttacctaaacccgtgttatttttttggaaactccactcaggacctcagttttcttctctctacacatactttagttttccaatggaaccaaacatatctcagttttgagaaatattgtggttttaccccggtaaaaataatattgtagtatttgtatcatgtacaattataaattatgttattttaaaactacagtatttcagaactacactaccaaacatgctcttagctgccagagcctgtttggaagcacacagtttttaaaaaactggtttataaaaaacttgagtagttccaaacataataatttatgttccagtttatataaattggattcctagtttcaaaccaagaagtaatattctctaactaaaattagcttttatttattcaattaaatcatgcccttgttggttcaatagaatttacatttattgtcatcgatttttgaaatagagaaagtgtatgctaacaattgtgtataaaaaatagaaactagtttattggaaactgagttttaaatgcctcccctcattttctatataaaaacaaaacctgctcgctagtcgctagtcgagtcgacagcgctacatcgacagcggcgaagtagaaaaataaaaataaaacggggacatcggcgtttctccctcggacctcggtccctccacgaacgccacgccgggagtctcccacgcagtccaccccgcgtcgtctggcctcgcg

SEQ ID NO: 9819 - DNA, 1500 bp, Zea mays
cccgctgcctggtgccagccagccgcgcggaggagctcgctgatggacgcgcgctgcacgcggggaatcgttccggatttgtttatttgtgcgagcaatctgccttgcttgcacgctgcccatgcccagctagcatgctgaaaaatctcttgcgtaattgttttttattatcagaatgaaatatttggcctgtaccagtttttgtttagtggttatggggtaggcttggtctcctaatttaaatccacagctttcccaatcggttgtgctgtcctaatctgtgccacttccacggtctggacctggcgtgccgatgcacgattgcctgtggattggagttgcgtcttcggctccgacgtcgctgtccgagccatgaaacaattcgccgcagcggcagcaggccgggcgaggcgtgcgagttccacattttcttagcgtctcgtagaccagatcgtccctgttgagatgcccgcatgcgcgtggggggcaagactgccctgcacttcccaaatattctagcctggtgggcagtgggaggggagatcgaggtggacgattgcagctttggattattcagaaccgatggcgcgagaccgaccaatcatggccgctgatcttatccacagcgacattccaactgatagatgccgctcactcttggtgctgcgttccacgagcctgagagtagtggtggaggtcgagagacggccgtctgctcagccgtcgttggcgacggctcgtttcagggtcccccacctactaatcacgaccctggcctctctcgattctgttgccttgccattgccatcatccaccctcatgcatgtcggtgcaacgcccatgggcatccactggtgcttataagaggaataatccggcttccgttcctctgaggacatcctcggccttccagggcagcaaccacgaaagccttctgcgcggggtgctttcctcgcagcaaatattcctgccttttgcattccggctttgcaagttccttgctttgggcatatatattgtgaggtattcatcattgtgctagcttgtagcttctgaaagggtcttgtgcccatgatgtggtggtggtgcctacagtattctgttcatactgcattttatgctccatcgcccccctttttgtttgttccggctcagttcagtcaatcgaggttaggttgctttgggtttgttttccctgaaaacatgctgtgtttgagcaacctcacgcggtttcaaacaaagaaaggaaaacacaaacgatcttaagtaatctgctctctttgtgcctttttttatgatgtccgaggcagcatccggaattggtccaattgtaggcttttatatgtgtgtgttcgtaaacaggagagttaaactataatatcgtatatctatcgcataagctttattgaacgccaactaatctgtttggcatgcatccttgtgccaggtctctatatatataggtggttcgaggtgatcggcagaaccacacaggcaaag

SEQ ID NO: 9820 - DNA, 571 bp, Zea mays
tgttactgttaaagtctgttcaaatttaggtctattgacgtgacaagtgcctctagtctcactgctatcacttgtggcgttgtgactccctgagaccctgaccccctgtccgttatgatgccctgggcagcttcattgcctcacctaaagtaaaaaagcaagctgcggctttctaacatcattttgctctgccctgtttgtcatgatcgtcgtaccttttatattactgagctttggaaggttcttgctttgacgtagagcaaactctgaatctgtccgctcagatgctgagctcattggtaacaccctactgttgttagattcttgccgtagctagaatgttgccttttttccattccattatgctgcctagtggtgtggtacccatggcaaatattctatcatcatggatcatcacctgcgttgcactcactcaatgttgttatgtacaaattcaagcgcatcagatttgttacttttataacacgccaacatgggataaccccgtggctacttttatgcagtcaaatttgtcaagctactgttgatgctccagatatagtagaaaacc

SEQ ID NO: 9821 - DNA, 171 bp, Zea mays
agtaatattgaactgatttgaattttcagtattgtacgttgaattgtatacagtataaggcagctagagatggtgtgacattcagtatttatattgtgcatacactgtgaaacttttgcctgaaaattgttatgatctacatacaacataaaaatatgtagggtaccatag

SEQ ID NO: 9822 - DNA, 1065 bp, Zea mays
tgattgcaaagcatgtgagtgcgagaggttgtaagcattgttattttctaacttttcaatcgggtgtagtctatacacaaatgcaatcaaaagctaaagacaacggtacggtttcgaccttccactacactgctcaaagttcatccaaaagtgcaaatggaagcagtctcaatacagtgatgtggtgacaaatgcaaatccatctcgatctttctgaatatcacttatcttgatttagattttagcacataattaatgaatcaaaatagtgaatgactcaaggcatgagacatagccacctagcatactagtgagaataaaaaggatctcaacataccctacacatgctaggtgctaatctcaacggtgaacaatttttagattgttcaagtaatagtcaagttcacgagttttgacacttgaatgctcggaaattattcttgtgatatctctcatcattatcctatctggaacgtctcttaaaatgtaagaactcagaatctatgtaatgccgtttgatgataggcatgataggcttttctctgactgtataattagtattgttattccaagatttttttttattttaaggtaagtgcctaagtggaactatgaatcgtacgtggggtcattaatatggcttattttagtttgagttgtttttcttccatcattaactgtaattaatataaaaaaatcatttgtgatacccatttaatatgtgacaatacattagtactagccttcagcaaattaaccagcatttctttaacagaagtggaccccatctgacactgtccttgtggcgtggcctggctaacacgtcagatatgagagagaaaccactggcttatatagaggacggacggccggcaactggcaacagtgcacgcagcacgtagaacacgcagcgggctcgcactgcaggtaacgtccctccagccttctctctttccctttctttctcatccccgatctatccatccatggtttacttgaacctcaatctataccaccacttgaaggacggagcagcagccgtcatagcaggtcatttggagaagg

SEQ ID NO: 9823 - DNA, 1500 bp, Zea mays
cgagtggacggtcgtcggagatgatgcgggcgagcgtcgggcgatgaggcgaccaacattgggggtcgactcgatgggtgaccacgacgagaggcggacatgcgtcgggggctgaagaggatgtgcggctgagccccgagatggaagaactgtcagaggcaaaggcagacgtgatgacggaaacgcaacaccggcgaaaaaagtggatcacgtgtcttaattagaccaattcctgctttgataccatgttagaatagttaccttgagaagatttgagggaagaatgcacaatcgtaggagagaatatggacatatatagtgtcctgtcttcacaggtcatatggacctacaatacaatatgagccctgatatatataacaatacacaaatttcgaaattcttaaaaagtcttgattgttggcaattacatggcttatatgcttactggtattttgtgccaccagcacagatgatgactcgaggccgagaataccatcgtaattgactttactaatgcaacacattgatctaaaaaatgttttaggttttttcggggcattgcttttagaaaggctttaaggtcctgtttattccgaattataatatgtccaaattatataatcttacgtaaataaaccagtagttaaacaaacatatagattatgggtctagattatataatctaaagtccagattatgataatctcataatctcatcaaaagtagcttatttaaaattatttttagcaaatgacccactacccatggttatgtttataaaattacaacctctcctatttttcttttttccccaaatcacacgcacggtcgggtattgttgtctttaactttgtgtcgaagaaatcaataatcttcatttatataatctggtcatccaaacagttacatacagattataatatcgacaaattataatctataataaataatttagattatcttttaaattatataatctataagctaaaataaataaaccctaaataatcgttgatgtccggccttgtgctaggcagcaaccaaacataaaaaaatacaccgatgccaggccgtcactgtgcgcgcgactggaggttgctgccgccgggatgatcaggctgttcgttttacgggcggcgccgggcaaggtttcactcgttcgttcgtgacctgcgatgacgtctgctagaattcctgcttgcctacgttcctgacctgctagtaggagcgtggcatagaatacggcccaaggcccatgctggagttttagctttgagattcggactctcacgtgggggcggcaagcgcaggtttgctctctcgggcaaaggacttgggttacgtaattcttttccagagacgccgcctccctaaacccttgccagtctccctcccggcagcggcggcaaggcctaccgccgcaaaccctcttcctcagccgctgcgtacaaaagaagttagcttctttttaagtaggaggcgggagccctaggtagcccc

SEQ ID NO: 9824 - DNA, 1500 bp, Zea mays
caatagctatcatatcttatctcatcttttatacactattttaaatttcactttataaataataaaatttatagattaaatccattaatttacacgatctgttgcggctaatcttagtaacttggatcccaaccattaaggctgggtgttttctttttcaaaaaactaaactgagccaaacaacctttttttttgttttcttgctttcggttttggttttgaatttccggaagttcggtctccctctcaacgtcagaaagaacctgtttttttcagtagagtctctgtcttggtctcggttgtctgtgagactaacacacgttgttgtttttagtagtgaaaaaaatggtagtagatgataaatagttatataaaataatattttatggttatagtaaggtatataagaagaatatagggggaaccgctgccggagataaaagagtaagagatgaaatgttggtgatgtgacaaaaaagtaatataggaagaaaaatttagagagaacactgcaatagtctgagagaacactacaatattctgagactatccgtactcatactactctaaatttctaccctaaaaagaatattctgtcctggtcagcaaaattttttactctataccaaaatcctccgcactcatatttactctatatcccaaccatataccaattatcatatataatattatttaccacccagtcacacagtaccgctgccagccaatcctcggtgttgtccgcacacacagtaccgctgccagccaatcagaagttgagagagaatatagagttggagcaccaagaacgctggatatgaggttttcgttggagcccgtaaacttgcagtgccctttacagttcaccgctgcggcgttctgcgagctgtaaatatttgaggtcttcggtttacagtcgtgggtgcggacagccttatacgcaccaaacgtggctgtccttgctcatttgtgcacagtataataatttgacatgtgcatgctcacaagagatttataaaattaaactgagaactctcaaccttgtgcttccgacgaacgaaattgatgtatgcattcactggaagctaaagaatttctaggcgattgattgaatgaatatactaacccaaggcaacctgaacgtcaatttctttggcaggctgcatgctcaggctctcacgctggctgccttggctgggtccgcgctggtggagtactacgaccaccagcaagggtcaggatcgaaagttcaccaatatgcaaagcagttcctttcatctgatagcaatagcggccaacaaaaggagtagctagccagtgtccttgcgaagtgcaagcagcggagtgggcgttatttcctgatcaaataattttgcctatggcacattctgtggaaactttgacggatctttgcctgcttttctatgcgatgtaagctgctgaaacctgcactcatcaaatgttgtgtatgcagatggtaccatgcatttgtttccctga

SEQ ID NO: 9825 - DNA, 1046 bp, Zea mays
gtttttgtagtagtacgtgggttggaaaatggaaggtcgagcgtttgaagaccccattcgatatttccatgccgcacggctctcgggcgcatattgtgttgccatacgctgatacgcatgcagccgttgccccccatccgtccgtttcccccaaaacacagacggaaccggcgggaggcgggggaagtagaagaaagaagaagcgtaacagaatactagaatggaacggaacgcggacgggtgggggaaacggctcccaattccaatccccacacgcaatgcaagcctcactagctcatgccccccgggcccggcgggacgcgtgagcggcactgggggcgaaacgcttttgttatgctgcgaggcatggggcgggcgggaggaggccggccgccgccgcctccgcgtcgcgcgcgggccgggccctggctgctagcagcgcggcattattgcgcccgatcgcgtgcgtactgtgtaaccgcaccgcgcctcgggtgggtcgtatcgtactagtagtagtagtagaccgtatagacatgggatgcctaggggccggcctgggggcagctggtggctggccgctctgtctctgtgctcgcctgctcggcatcaatgcgcgcggcgccagtgcatgccgtctgcagtccgtagaatcgctgtagatggccagcagtccggggccacacacacgcagagaggcaacacgtgagccgaggggactctctcgcagcctctgaccgcgtggggccggatgataaatcacgcacggcgagcgtagacggctagcacagcgagtgtcactctctctgggttttcaaaggtttgagaatatcaaactttcttaaatttggttttataaatttataaaacggaggtcgaaaagagacgtgcgccagcggccgagcctgccctgcacctgcgcggttataaaacgctagggagagggcgggagcaagagcgcttggcgaggtcctggatgactgactgaccacactagcgcagcgcgcacaggagcaaaggggggcatcctctatcgcgcgcgcgcc

SEQ ID NO: 9826 - DNA, 121 bp, Zea mays
cgcggcctccctcttgcccatggcatacatcgcgttcgtgttgcctactcagatcagaggcgggcctcgagcgaaccagctgagattgcaagaagtagagcagcggccgccgccaagggcc

SEQ ID NO: 9827 - DNA, 330 bp, Zea mays
aaagggaggaaaactgacgggagatccattccatccccaaccaaacaagtttagatataaaaatatagcatcgcccgcgctctggagagtctggatcctcctgaacctccaagcagcaagcggtatttttgtcctctgaattgtttcttcagagaattaatttaatcctctctggagcagttgtctttccctactgctctgctccagtatttataaatttatgaaatcaactacactaccctcgttcttaaatatttgtggcagtcgtcgtctttgccacraattcatgtacaaagcagctattcactatatataatatgttggatgtag

SEQ ID NO: 9828 - DNA, 51 bp, Zea mays
cctgcaggtggaagcggaggaagcagcgacgcgcacgaggacgacctggtg

SEQ ID NO: 9829 - DNA, 903 bp, Zea mays
ggttcgcatttcttgatgccaccatgcttatataagattattattggtctgcgtgaaatactgactgaggtgttcagttcgatgcctaactaacgaataggtgactaatatccacatgtgcgaactatgtatgaatgccaagtagtgtcatcgattagaatttagaaagagccttttcgccttgccagggatggagccagaattttttttaggaggggttgaactaaaccctataaacaatataataatcttactaaatcactcgcaatagacatattgttgggtctatgcttcgtcgccgaaggtcttcaagggagaagcagctttcggctgaagctgtttgtatgagatggccgaaggttcctcttcatgaagcttcgatattacaaaccgacttaaagatagaatgaccttttagtccataaggtctgagtcaatgttgtaaacttttatgaggggcataattgtaattcctcacaggctgtgtcctgtgcctataaatagtgaacagtattccgttactgttcacgcattctggtaattgcagttgcatctttcggaaatccacctttgccaaggcagaggtattattgtattcaatgattcaatatattaagtaaatataatataattcgtctatgatttatttacccttttataccctttattttatgtcatcttatacaatctattgaaattttactacgaagactttagcttcgtaattatattctcatcaaccttcgtccaagactcattatcctcaagggaataatgtttcatggacgaaggacgttaacatttaacattttatgttgccttgttcttaattcatagcatttgagaacaagtccccaacattggcgcccacctccggtgaactcacttccactttttgagctg

SEQ ID NO: 9830 - DNA, 131 bp, Zea mays
ggtatgatgtccaagtatatcttgataattctttattggctgctatatgattttgcaaaaactgttgaaaacttcactacccattttgtcggaatgattattcatgatttagactggtgatcctttggggg

SEQ ID NO: 9831 - DNA, 461 bp, Zea mays
cgcgcggccatggccatgcatgcatgcctagctctactatatacgactagagctacccccttcagttggcctcacgcatcgtcctaactcctagcacgcgcacactgcaccccgtctccatcgatagagcggagctgggcctcagctagagctagcatctcgtctccatcatcgatctgcaggtgagcgccatatctatatctatcaatcaatcaatctgcagaagctagtctgttaatttatacaaatatacaagtaatgaatcgatgtgtatcgtattatttattgcatataataattaaatggatgatagatggatccaatttctataatatatatatatatatatatatatatatatatatatatatatatatatatatatatatagcaggctaagacgatgaataattaattaattaatgaaatatcccttgcaggcagccacagacaccaacact

SEQ ID NO: 9832 - DNA, 1500 bp, Zea mays
acttcaacaaagaaaccattatttatacatatgttttgcggtgtttattacttatctcatggttacgcaggacattcttcatcagatacatgcccatatgccgatgtgagatgctgctcaggctacctgcgtgtctcatgcttttctaagttcctagagatgcaagtgaaagaaataagatttgattgccattgttcatcaaacataacttattatgctattaccgagcattcattccttacaccaaatcttcaaaatctatctcttaaccattgatgaggtcagttttatccttgataattaattcatttttatggaagcaaagtttcatagaatagttgcatgattaaaacatgagatcaggtttatacttrataattaattcatttttatagaagcaagctgccataaaatagttgtattattataacagcaaactcaacagaaaccaaagtcaaggtttagactatacatttgcagtaaatatatcatattttacccataactaaccttagatcatttatgtctttagattactaatacaccaatgacattaaacaaattcctctagctcaagtacctggagattacattgcctgctccattttttctccagactttgactttagctccctggtatcttttcttgatgcatctcatcatcccttgttttgagtagatgacataactgaagactccgtccatttatctatgtgatgtttccattaatatgtcttctcataggtattattttcattggtatagtgattgcagtttgtagttaatggtacatttggcactttttgtaaacaaaggctatgagttcgtaatttgttcttataatatatgaattgtaatggtcttcaattaatgagctgatgtgttgcatgtttattcttttcatgcatattgttgcattgaagggaatagacaccatatgtccatgctctttatagagcatattctttttgtgagattagttactgtaaatttgttttatgatcatatattatactttatcgtacctcatcaaattgcattgtttggagtttttgagttgtactctattttccttcttgtccaatgctttttattctggatgatattattgttttcttagataatccaatcattgattagtttgaactttaaaatatgtttccccattgtaggcttcgacagtcttgactaccacagaccttttacttcaaaaatacagggaaatgcaactccttcattgaaacttctcatcttggctcacaagcagtacatgaatacccgtttcttactgaacagtcaagtgaaacatatgagagggcaagccggtcgcgtttatatgatgctccagcaaaagtgtcaaacttaaggtacctccgatgtcttcaggatcatgctttctccatggagttgagcaggcattctttggtgatttggcaaggttgtgttaccaccttacattagaaggatattgaagctgattgaatttataatcggatcagg

SEQ ID NO: 9833 - DNA, 171 bp, Zea mays
tctcctcggcatccaccagcggtgcccgactccaaggtatacagccgcagcgccctgtgtcgagatctcccttgtacccccccttccctctagcgttttcctgatttgagtgacaagattctaagaagctgttgttttatgtgttacccaatattctaacctctcgcagaa

SEQ ID NO: 9834 - DNA, 1211 bp, Zea mays
ggtcacttgagttcacactaagctaagataaaatgcagtatccgcagtttaatacccggtatgcaagtcgtatattcactttaattttaaatttattttttgtagggagggttcacattaattttaaatttattttttgtgaggaggacccatcacactaacttgtcactgctgttgcactgtatcatcaaatataattaggttggtgtatcgtcgcaacgcacgggcattatactatatgtatataagttatcgtgttattatacggttccgttgcaacgcacgggcactcacctagtaacaacaataagaagaagaagaggaggaggaggagaggagattctccaatgttgtctctcgtctatctacgtttatatcgccttaaaaaatgagaagtaaatcttttatacatctctatcgtaggaaaaaggattaaaatccaaatctgatatctggccgaacgcacgatgtggcactgaggcgcacgcgcacggccggacgctgggccgctgatctgcgggagcggtcggtctgtctctctcttggcatgcggggcgtgcggcatgggcttaaaactcggcctgtttttcgtaggcctaatctggaaacgatctgggctcgatctcttcagtctcacacccgtttgcatttcctctggtcgatctgccagcttttccttgccgagagctcagtgcacgcccagtctgcacgaacctcttaagacctggaattccttttgcttcctgctgcagtgcgtggtatacttaatcaaggtcacgctggtcccagagtggaccaggagatagtcaaatttcttatattttggaacacgaaatatataggcgaggaccagccggtcaatttcaacagcccaaccacttgtgggtgcagtgagtgcagcatgggtttggattgacgaagtgagcttccaatcgaaaagaaaagacacatgtcaagtagatgtagatatcaacctcgctgctttctcccagtttttctcaaccgtcgcatggatccgtgaaccacctccaacaaatccccaacaaacccctgctgctcatccgatcgagagcttcctgctcccttctgttcgcgtaccactcgcaacgtccgtctgagcattactattagtgcgcgcgctatctagctagtgtggagccgtggcaacgagcagaggtgcctagctcatcgatcaacaagtgagtagcacc

SEQ ID NO: 9835 - DNA, 621 bp, Zea mays
tctccgtgccacaggtagagagtgtgtgtgcagctagcaatgctgatgattagctgatcacatgctctataggtcaaaggatcaattatgtgtgtgaatctttaattattctatgcatatgcttttgcacatgtaaacaccaaggaatatattagtgctgcatgggtccggtccctccttgttggcgtatttaatttgtggtcatgtgcaatggcgatgtcaaattaaagcgagagtaaaaaagtggtggtgtggatggtttgtttctctgccatcacaagctacgatgggggttgtggtatcaaatccatgggatggatgaaaactgctgccaattttttagatgtgtgcctcgctatggctgtacgtgtagctaaaattattggacaccaaccctaccctttgtgtcgcgcgcgcttctccctttctcaaagttgcgtaccgcttttcctcttcatctgaagctgctgccatataccgccctcttcctctcctttatatctaccccttggacctggaggagaggagctagtgagctaccgagaagaagaaggaagggccatcttccgacccacttgtaggcgctgtaagcctgtaagcagtcacctctcagccacagac

SEQ ID NO: 9836 - DNA, 105 bp, Zea mays
ctcgactctcgagagatagagcgaggcaccaagaagggaaaaaaaaagagggacaggaaaaaaaatcattctcgtttcgctctccgctagaccccgcccgaatca

SEQ ID NO: 9837 - DNA, 95 bp, Zea mays
tcatcctctctctactcccctgcgccgtgcaggatgggggtaactggtccagcctttcggcggatcctccgcctggaggttaagggttcaaggcg

SEQ ID NO: 9838 - DNA, 55 bp, Zea mays
gacgcaaaattttacctgatgctgggatgtgcaagcaggaatttatttcaccagt

SEQ ID NO: 9839 - DNA, 1476 bp, Zea mays
cgatgcgagcctggagaacgatcgacttcttacagccgatacgacccgggaagtcaaacatggctcggactgacatttgcatgtgtttatgtacgcaagaaaccaactcagagcatgttggcaccctaggttgcgctgtgtattttggtgctttttttcttttcgatgttgtgggactgctatagtgatttctacactcggcttgatcgacattctaaactatcgaaacacatgtacgttagtcgagaattcagttcatgccatttaaagtgtggctatgtaatgtgtgctggctagatggaaccataaaggctacaatggtcatacaaacattgtgtgattgtccaatttatgattgtgtaatttatgactcaacagaaatattaaggctaatgtctataaaaaaaatagtactatgtaactactgttggatgagtcctatgtgcctatctatgataggcacagtctcttgtccaggttaaattgttagagcaactccaatagttatgtaaattttagctctctaaattatagatttaagaagttgctaaatgttttttagagtaaaaaaatgtgagttctccaatagttctctaaatataggttgtaattttgtgttgtatatatccatataaaaaataagtcacaaaaactatataatgcagtcaacatttttgtttagggagttgttaaatggttgccaaatgtagagagaaaatgaggttagatgacaggttgttaaattttgaaagtttatttagagaactgttggagaatagttttcatgttaactacctaaattattgatttaggaagttttttagagaactacgggagttgctctacatccgaggatcacaagcgtgaaagatttttgcccccaatcaaggcgcgtggatgatcctggctcggttccttgaccgagtccgaggacgtatccaacataggttggatccatccaaatgccctagaactgaattctttggaagctagtgacaatgtgatacttgggaagagagttcagaaaatagttattgggaattttgtctttaacaccctgtgcatttgatggaatataacaagatgggaagtgtaggttctacttaactcctaattgcatatataatgttgtttaatatattatgcaaaaaaaacacaaaatggcctagatagggggccaccagggctagacaagcagaagaggcgaaaaagagaagacattacgctgctatagggcaatgagaaagcaacgcaatgcctgttaacccattgaatcggtcaatcgttttcaacttggttgcatcgatgatcgatccatccgtgttcgctgataatttattatattaatgtatcctttcttcagttaatgccagcgagccttgtaatctccggcaaattcggcatctttcgagtagtattcatgtagtagcttttgccagtctccagacctttgatcctgtcgtctgctgtagcgaa

SEQ ID NO: 9840 - DNA, 712 bp, Zea mays
catacatttgtaacattgtatttagaataatagaatataatataatatatctcatctattttattgtttattccattcaatatgtaaataattggatattgaggtttcttcttttatatctagtcactaaactatgttctttatttgtactaatatctgataatttacgcttcctattagatggtctcctcatttctattaaatatagttttccacgcagtcacgccaaatatttttccacacagtctaagactttaggccttgttcggttatttcaattttatatatattgaaatgaattgagatgtattttgacttgctattgaattaaactgactcaataccatccaatccacgtggacggcgaaacgaacaagtccttaatccgaaccgcacagtatttttccacgcagtaaaccttccagaaaacgagcggaaaagcgtcccccaatccagcacacgctgacgacacaccggcggggcagacaggcagatcagccgcacctccccagtcccccttccccacctacgacgaccgccgcggacgaatcaaaaaagcttcctcctcccggcgtcgcctccgcgcgtggaggcgacgatccattccgcctccgtaggattttgctcctcccgatccagacgtcagatctcgcgtggcggcacgcggatctggggatttctctaaaggcggcggcggccggaacagcggcag

SEQ ID NO: 9841 - DNA, 1500 bp, Zea mays
gcggaccgtccggcctcaggcgcggaccgtccggtcggtgaaaaccagaaaaccccgaagttgataggttcggtaaaatgtatttttagcgtcctcgcagaccatccggggtgcacgaccggactgtctgcgactgctttatctgacatctgacgacgcatttaatgcatagtagccgttgatatagccattactgctgaccgttgcgatttcagtcgttgatgtgcaggggcggactgtccggaccaggggcgcggaccgtccgcggtcggcagaaaggggggcaacggctaggaagtggttgggggctataaatacaaccccaaccacctccattcacaaaacccaagcactccaatctttcacatttaatacaagagctagcaatccattccaagacacaatcaaagcttccaatctctccaagttccacagttgagacaagtgatcattagtgattagtgacttaagagagagagtgatccgtgtgttatttgtcgctcttattgcttggttttcacaatcgtgcttccttcatctctttctcaaccttctaagtgaattgtaaagcctgcaagagacacctaattgtgtggtgatccttgcgaggtcttagtgacccgtgagattaagaagaagcactcaaccggtctaagtgaccgattgagagagggaaagggttgaaatagacccagtctttgtgacctcctcaacggggactaggttctttggaaccgaacctcgataaaacaaatcaccatgttcatccgctttatttcttggttgatttgttttccctctctttgcgacttgagtttaactctaacgctaacccccgaccttagtgcgtgtttaagtttataattttcagattccgcctatccacccccctctaggcgactttcaaagtacttgagttgttacataaatcggagttttaccaaaagataacaatgttcttaatggtgcagcggataatagataacatcgatattgagggatagggcaaggcctagcccactactcctcctggtcctcccctaccgaggcgacatcccactcgaccgtccaacccggtggcagggtggatggccaagtcacaccatcaaccatatcttgcagtgtacctgtaaaagtgatgccacaagcaaggctgagtatactaatactcagctagacttagccggtgtgaggagactactcctctacctctagaccatgaagctgtttggctgaggggtttggtttgccaaaaacactagctgagtctaaaaacaagttttagcttttccggttataacatatccatttacgctaggtttgctcctttctaagcatacatggtaacaatcatttagtgcaatcaacatgttatctcaagaaacctcatttcacttcttactcggtgcactacaaggggtcaagcagtctcattagctgcgagaagcagacgattcgaattgagtttttaaccttgcaaggtaaacctaaacacatgac

SEQ ID NO: 9842 - DNA, 443 bp, Zea mays
atgtgagtcatagaaatattttgtaacatcactgatttactaatgtgyttttagtttaagcattgacttcatcttaattaaagtgaattatttatttttagtgtttggcagaaaaataggattggctttcattcattcctctagtcgtctcacagcatctgctgctacttgttgcgttgcgttgactgccgccttctgacagcgctgctggagctgcagctgcgagctgcctgtttggaatcgcttgctcgcggtatcattttattgtactggagctgttgtcagtgtcaggaatacaagagccgtgtggaaattgttcgtccagtagtaccattccactgctgactgctgaaacacaataatagaggcagaagcagaggcagaggcagaggcagagccaagacggttccgttcagtgtctggcggcgcatagatagatagcc

SEQ ID NO: 9843 - DNA, 1487 bp, Zea mays
agggcaaaatattctccccccatagcatgatggcaatgaggatcgatgagggcgcaatggccagaagtcgacatgaggggcaccgatggagacgatgtcacggagaggacaagacaatcgacagggcagtgtggaacaatgctggcacccggaagccagccttagcacgcgtgaccatgcgatggtggttgagcacttgggagatagacaccgcgccgggtgggagacaacgatccaatgcgtccgtaggagatggagatggagcatcgacactgccagccatgatggcaggagccgtccagtccagccggcttggtcgggatggcctggtcctgcactggtgggtgtaggcgacgcgtgaagacctggccaaaccgtcgtggtgcagtggcgtcgggtgcaacactagcagcactaggtggagtagcgcctactgcttgggtgctaggagcagcagcgccgggagctgtaggggcgccgggaacagcttgggcgctgggagcagcaacgcctataggtgtgctgggcctataggtaacgacaccgggttagtggtaattgtatccaggaagtcaaaatcttgggaggaggcagtgggttgctgtttggcaaaggggaaagtggactcatcgaaaacaacgtgacgggaaagaatgacacggttggataggaggtcgaggcaccggtaccctttgtggtgcgatgagtagccaagaaaaacacacttagcggaacggggatcaagtttgtggctagtggtggcagataggttgggatagcaggtgcaaccgaacacgcgaagatgttcgtaggagggtacagttttgaagagggcgaaatgaggagtggaaaaatgaagggttttggtgggtagaatattgagaagaagtgttgttgtgtggagtgcttcaacccagaaggttggtgggatgctggcctgaaagagaagagagcgaatggtgttattggtagtacggatgatgcgctcagctttaccattctgagatgaggtgtaggggcaggacatgcggaggaggacaccgtgggtgaggaagaacgttcgggagctggagttgtcaaactcacgcccgttgtcacattgcacagctttaatcgtgacaccaaactgtgttttcacataggcgaaaaactgagtgagagttggaaaagcatcagactttagtcgtaaagggaaagtccataagtaatgtgagcaatcatcaagaacgactaagtaatatttgaagcccgagacacttaaaatgggagatgtccacaagtcacagtgaataagatcaaaattgttaaccgcacgagaagtggacgtacggaacggaaggcgaacatgacgactcaactgacaagcatggcataaaggagagctagcatctttattacacatgggaacgattgatgcgagcttggagagggactcgtggccagggtgaccaagacggcgatgccaaagtgacggagtggagctggcg

SEQ ID NO: 9844 - DNA, 402 bp, Zea mays
ggtaagcatgcatcttgtgtttacttatccaatttcagattatctttaaaacttatagatgaaaatcgcctatgtttcctttattatattttataccttgttttgctttgcccttcagttcagtctcttgagagttctttgagaattgcaagcttctgtcattgccatgaccatgtttccaggttaagaaacttcatcaagaaaagcaactaggcatgatggtggacaaaggcctgggtagcaactaggacagggttgagtcagtaccacctatctcactagcctagaatgttcgaggtgatcaggatgctggaaggagacaaactcatagagagatgggaggtgtcatagaacgtggacacgccagagttcgtctcatcagagctcctacttcaaaagtac

SEQ ID NO: 9845 - DNA, 1184 bp, Zea mays
ttaaagtgacgtggctaaatggtgtgcatgctttgctcccgcgtttaatatatagaaataaatgtaatttgcatgtacgtgtatgtttattattatttaaataaatatggaccgaaaagaatgggctagaaagaattatattttgtgacatagggagtaatttatttagccaatcaaacacactcatcaaacaactttatacgatcttactttataaactgaaagcaaatgtaatagcaaattctacgtagactatatattgcgatagagaaaaaaatccgaagagaaaagaagcaaatataaacttactgtagaatgagagatagattagaaaattttttatagcgaggaaaataaaatatatttatttatttattaggatttgtgtcaagatcaggcaactaaaccgatccgaacgatcgtgaggatcgttgcgtccggtcttcaatgatccctcacctcgagctgaacacgctttgggtctctccagtcgctatcctattttatttcttattttttattttaaactttagtttataataaactgtataattataagtactctattttactacatttttttattttaaactttagtttataataaacggtataattataaatactctattttatactatccgctgcgtacaactttagcatgagtttggagagagaactagcggattagcggacacgaccggagaccctcgcatggattatggatacacctggtccacgcactgcgctgctcggctgacagtcaaggtcatgaagcccggtcccacttgccaggctggcctccgctctggaccatcacccacgagaaacaggcgccgttaatggctgccacaacggtaaacgttaccctttcggagaagaaaaaaatagcggtagcgctcggatcccttcttcctccagatcacaccaccgtcgcctccgcctgcaaatccattcctagactcgagctgttgctgcgagcgagctcgggttggggctcaggtctctagggtttcgcctccctgctcctggtgctcatcgccttggaccttggtctgtcgggttagggttgtcgcggctgcgggagccgtgggtcggcgggtgcggccgatgcggcgatcgccggagatagggaggctgtagcggcggcggggcaggggatctcctgggtggattctccggcg

SEQ ID NO: 9846 - DNA, 1500 bp, Zea mays
gtcaccgatatattggcccttgcacttagtgttgcattgtgcgctttaactgtacaagaagcactgtgcaagcttcttgccctttatttggggatattgggataggatattcgactggaagtggacttccagcgacatgattaccagagtgctcagaactaaataatttggctccattttcgagcaggatgctacctatcagtcatggccagttgacgctcatggaggggtgctccaggacgagctggtagaagcttttctacatatatatgattgcagctacattagaaataattgtaatgcaaattatctttacctattggcacttgggttgtggcaaatacattggaaataatagtaacaaattatctttacctttttttctgttctttttggtacagttacaaatgctttataaggaatcagatagatctaaaagtcttactgccaacacatgcacacactggtggtgcctttatctagctattcagatcaaggaacatgagctgagggagaaggatccggtggtcttgggcaaggatcagctcggggcgctcatgtaggaggggatgcatgtagtcttggccaaggatcgactcggagagttcacgatgatcagctcggggagctcatgaaggaggggatgcatgcagtcttggccaaggatcgactcggagagttcacgatgatcagctcgaggagctcatgaaggaggggatgcatgcagtctttgccaaggataggcttggagagtttacgatgattagctcggtgatctcatgaaggaggggatgcatgcagtcttggccaaggatcggctcggggagttcacgatggatgtgtttcaatttttgggctttcctaacctttgatttggtttggttgacatttctttgtttgatcatcacttgcctattgatctactgacatgccagattggtatatattatttttatgacagtcattgattatggtggatagtattttcattaggtatgttcttacatcttttttcctcatgttaacatgtctaggctgttgaaaatataagatcatttcatgttcttgcatcttttttcctcatattacgcgacctttttatttgtgggcttatgctcgcacagaaaaatggcgagcaaagtattttcaccatggctacatgatctgagaatgacgattgtgtctagtgaacgaagaagaagatatctctcaaaataatgtatttgtgattgtgtaccatctcatcgaacggacatatataactagtgcagcacgtgactgaccgcacgtccctcttcccacaccccacatattccacaaaacctctgtgctacggccctggctctggcccacaccgcattgaaattaaccatcccgcacggccgcacactcgtttcctcctcccagtccaagtctccagctacgagcctacgactgccaggtctccgcttgtcgccgtcacgcgcgcgcaggggcagggcgcaccatccccgcgccgcc

SEQ ID NO: 9847 - DNA, 1500 bp, Zea mays
tgctgatacatattaggccttgttcgtttacatcggattgcacccggaatcgttccagctaatcaaagtttatataaattagagaaacaatccggctaggaatcgtttcgatccaccaatccgacataaacgaacaagacctaatctttagtcgagaaccaaacgggaccatattcacgtggtgtgtgaatgcatgcagatttgaaactcttaaggagacctcatgccttctcatgcctttggagttttctatacgtcacggacttaactgcacaataacagtttattagttttggacgagtaaaagtacgaacaagataactgtctgaaaaaacccacgcaccacacactacagtgtagtcggaaaaaataagaaaattcattaggtacctgtgacctccacgtcttccgtcttccactgatcgcagcacacaaactccctgccgggtgggcgccgcacgcctgcacctcttccgctgcgcgaggatccgcgagccgcggcgacacgggggagcccaagcgcccaacctccttcccgcttcgtttgcttgtatgcgctgcctcgtcggttccaccacctcactcactcgcttctcccccttccagccgtcccttcgcagcgcacgcacgtaaaccacaacccagcagctggtacgcccccagcgtcgccgtcgtctccttcccccgcgcaccacacccgcagccagcagccatatcatacatcacctcgcctccagcgcggcgccgacctgcctctccattatttatacgcatttccgcgttccccaccctcctctttctcaatccagccaagcaccggaatcgcagggaaccaggagcgattaaaaaagacagcctcccccgcaaaggtaaaaaacaaccaccgcatcgcggcaggcaaggcatcgctcgccagcccccgagcggagggggaagcaaaagatcgataaaaaggagaggaggagacgaggcgtgccatccgaacccaagcaacttcctcccaccaccaggtccctggctccctcccatgcccgcatcgagatcttagcgggacagcgagaggagaggcgacgcggacgcgggcgctccccgatccctcctcgctgcccgtcgccgccgccgccgaccgaccgaccgaccggtaagcgtccttcgatccgactgtcgcgtgcagtgggttcctcgcagcgccgatcggtgccggatcgcgccgggggcggccggatctggtacggatctcgcggcggccgcgtaattccgtggccttgtgagcgggcgttggcgtgttgccccgtgtgggcgctctctctcgtagccctgatcgcggtgttgctttcggctcggatctatgtgatgtcccgcgtgcgtttctgtggtgaacgctgtggataagtcgggcttttgtcggcatttggcagtggctggctggtatgaaactgggcctgctgttgtggattgcaggggccagggggaggaggagggaaggggagtacggacacg

SEQ ID NO: 9848 - DNA, 73 bp, Zea mays
gcgaacgttgcgcatgtacgtaacttgtgaatagtagtagtagtactaggtagtgccactactacatgttgcc

SEQ ID NO: 9849 - DNA, 332 bp, Zea mays
gccagatttttttcacagctaaatttttttaaaaaccaaatcaaataaccccgacttacttcttaccccgacttacttcttgggctgtcgcgccggaacctacttgggccagccatacaatactgctaggtttattttatttattagtgggttgagttgggtccaaggtttttatcgtcacgcgtcatcacaagcatactccatccagtacaatactgttggtctagccggcggcggccgcgtccctcatccagtcatcccctttccgcgatcaaaaccgagctagggttttaggtgcgggggagagggtgaggagcggacggaggcgcgcc

SEQ ID NO: 9850 - DNA, 1500 bp, Zea mays
aactttattccatcttaattacaacactgaagtagaggttaatgcattagttgtctaaattatcaaaaataaacataggactttcagtcgatattgctacaacaggctgaaaaataatggactggctggaggagtgaagacatgaaatagagccccaagcatctcccacctctttgcggatgattcactcatcatggtccgggcaaccagaaaacatacagtgaaattagaggaagtcctaaaggctaaataaaaacgaggcctgctcgagtaaaatgattaacagggacaactcgaaaattttgctcagcccggatactacttagtaaccagtgcaagcaggaggtagtgggggagctgcagttgaactaggaaacgttccgtgacaagtacttgggcttaccaatccatatcggcaattgcggagcaacctttgcataattgaaggatagagtgtggcaaaggattcaggggtggaaggaaggttactgtcaacttttgaatatttgaagggttgaaggtggtgggtcaagcggtcccatctcatggtctaaggctctctaacacattacacataacagaatgaatgtgtactcgtggtccatatatcagatccgcagtatcatgtatgggctcatggcagcagcaatttatgtccctatcaactttgtcactcctgtattttcagcagcctggatgcagatggatacactcgcgagccaaagcaaaaatgaaacatacccgtacgagaataaattaagcagatgataatataacaagaacgtctgaattttagcccaaggttgacgacagataggtcaacttcaatgagaaggggctcgtggcaaaactttacctggggcaaataaaagaactacaaatgcagggacctgctctagctcaggatattagaatgattgcttagagtggttgagccactatcacaattcgcagcgacaaagtggagttaataggtcaactggctgaccatttgtctagttcactcggtttccagcaaaggcatgtcagctcgtctttaaactcgaacatgtttgtgcaacacgaccgggctcagtccaaattaaaaatcaacgtatgggggctgagaacaaagtggctttatgatccagatcatccatccaacagtagagagttgaagcttaaaacataataaaaaaatgatagccgaggatgagaatttagtatatatgttggtccgtacattggattccagcattggtcactcgaaatcgagactccagctattaaaggagaaagaacaaaccccacgatctttatctgttatagcagatttataaatagatgggggaggtgggcgatcaaacagaaagagatagcaagtgacgaacaaagcgagtggaatcttcacggataatataaacagttcatagcggaccaaatggctcagggagcggctcgaacctatgatcaaacaccgggctctggtccgacttgtcatccacgctgtgcaaccaactc

SEQ ID NO: 9851 - DNA, 1500 bp, Zea mays
tacaagtggatttgacttagagataggattttgaggttgatttgcaaaaacaaaccaagtggtggcaaaggaatgatccatatatgccaaattgaatcaaaataaatttgagtttttatttgaagtgatattgcacttgttctagttgctttatgttgtgttggcataaatcaccaaaaagggggagattgaaagggaaatgtgcccttgggccatttctaagtattttggtgattgagtgccaacacaggtgcttaaatgtgaatctatacccatggatggacaaagtgcaaatcaagagtaaaggtatgtttctaagccttagtacattgttttgaagactaatgtattgtgtctaagtgcttgaatcaggagaaaacaagtcagagaaaagttggctgtgtacaaccaaaaggctgttcggtctggagcaccggactgtccggtggtgcaccggacagtgtccggtgcgccaggctgcctcgagcgaagtggtcgctctcgggaattcgccgacgatgtatggctaaaattcaccggactgtccggtgtgcaccggactgtccggtgagccaacggtcggccgggccaacggtcggccgcggaatccgtgcgcgacacgtggccgagccaacggtcggaagggggcaccggactgtccggtgtgcaccggactgtccggtgcgccaacggctcccagatctgcaacggtcggctgcgccatttaaggaaggaaatcgggcaccggacagtgtccggtgtgcaccggactgtccggtgcgcccgacgacagaaggcaaggatggccttccagatttgttctcaacggctcctagctgccttggggctataaaagggacccctaggcgcatggaggaggacaccaagcattcctacaacattcctaagcaccaagacatcgatctcgcgcattcgtttcattgtgatagcatatagagctcttgtggagttgtgaactctttgagttgtgttgcgagctcttgttgcgacttgtgtgcgtgttgttgctctgatcttttgaagtcttgtgtgcgttgctcattcccccttgctctgtgtttctttgtgaacttcaattgtaagggcgagaggctccaagttgtggagattcctcgcaaacgggattgagaaaagaaaagcataacactgtgatattcaagttgatcattggatcacttgagaggagttgagtgcaactctcgtccgttgggacgccacaacgtggagtaggcaagttttgtacttggccgaaccacgggataaaccactgtgtcctctctgtgttgaactctttgtggttatcgtattgtgcaagatcttctctctagccacttggcattaactgtgctaacgtttaaccaagttttgtggcttaagttttaaagtgttacaggatcacctattcacccccccccctctaggtgctctcaattggtatcggagccgttctcttcacaaagggactaaccgcccgaagag

SEQ ID NO: 9852 - DNA, 92 bp, Zea mays
tgtaagtggaaacccatagcaacagccccacgggtttaattttcatcttttgaatcccatgctcatgcttcacaattttcattttaattatt

SEQ ID NO: 9853 - DNA, 1275 bp, Zea mays
ggcttacacctagtccctaattaattttggtggttgaatcgcccaacacaaacaattggactaactagtttgctctagattatatgttctacaggtgccaaaggttcatctataactatactaatttgactgtccggaataccgtagattattccggacaggagaagctttctagaaaaacaggccaagcgcggaccgtccgggcccttgtggcggaccgtccgcgacacaaggataaccctcggacagaaccaatgcaaaaatccgagtctgcactgtggaccgtccggaggataagcgcggaccgttggagcccccggtcggaccgtccggtctcaggcgcggaccgtccggtaggcaaggatccgaaaaacccgaaggtgacgggttcggaagaatgaattatagcggcctcgtggaccgtccggggtacacgaccggaccgtccgcgactgggtctgtctgacatctgacgtcgcattaaatgcaatatagccgttgatatagtcgttactgctgaccgttgcgttttcagccgttgatctacaggggcggaccgtccggacctggcacgcggaccgtccgcgctcagcagaatggagcaacggttaggaagtggttggtggctataaatacaaccccaaccacctccattcacatcatccaagcattccaaccttcaacattcaatacaagagctagcaatccattccaagacacattcaaagcctccatctctccaagtttcacaattaagaaaagagatcatttgtgattagtggcttgagagagaaagtgatccgtgtgttatttgtcgctcttgtcgcttggctttttcaatcgtgctttcttgattcttccattgtgatcaaactcacttgtaattgaggcaagagacaccaatcttgtggtgatccttgtaggaactttgtgttccaagtgattgagaaaagaaagctcactcggtccgagggaccgtttgagagagggaagggttgaaagagacccggcctttgtggcctcctcaacggggagtaggtttgcgagaaccgaacctcggtaaaacaaatcctcatgtcacactcgttattcgattgcgatttgttttacaccctcactctctcgcggacttatttctatttctaacgctaacccggcctgtagttgtgattatttttgagagtttcagtttcgccctattcaccccccccctctaggcgactttcaattggtatcagagcccggtgcttcattagagcctaaccgctcgaagtg

SEQ ID NO: 9854 - DNA, 1500 bp, Zea mays
ggcaaggtgatgcagttcatctgcaagcatgttattattctagtgctagctcatgaatcacaataaggtaattccatcaactcctttggttcgtaatataatgaactttgcatgcatgcattttcctctaaggttaataaccttggcacattaccctgtgtggtaagcaaagaaaattggccacctaacctaggccagtacttttttgggtaaaatgttgtgttggtgccttggtggcaaatatatatatatatatatatatatatatgcatgggtataagaaggctaagaagttattttgatataattaggttttagtgacaggctggctatcaaaactgtgacggtcgactaacggcatgtttgtttttcctagtgctaaagtttagcacccgctaaaatttagcacatgctaaactttagcatttgagatagagctgtttggataaagtgctaaactttatcaactgcggcggccaatggtgggagagtgaaaggggtaatccatgcaaaataggattggagactatttttagcatagttttatcatctttggttgagctaaagtgctaatatatgctaaactttagcacaacactttttgtcacatgtttgtttctttagcgtctaaacttcagaagaaaaaaatatagtgctaaagtttaacgagaaaacaaacggtcctaaaacaaggttaaaatgtaaaaagttcggtggcctcgtgaatcgtggtccggagcagaactcacgtgggacccgttccccgcgcagagaatcccgaggccccaccgcgggagccactggccgcccaccacggttcacctcgtgcgctctccttcccggacacgtgtcgtcctatcaacgacccgcccaccgcgtctgagccacgctggacgctcggtcgccgcacactcttccaccgacatgcggggttccattcctctccgcccaaaatgtcagtggcgttcgacgtaaccaggcagagtgcagcaggaaggacgttgtgtcgtaccacgtgggggactcgaccgggggaaccggtaaacgtggcgcgggccccgccgagaacgacgcgagcgatccggtcaccgcggcccgggcccgctggcccctagtcgccacgcgaaccactcctttatttcttttgtttcctactcctatttttaattatttttttgtttcctaatgccctcgttttcaattaaaaagtgaagcgcaagccattaaacaaacacaaatagcacacacgggcacacggcaggcctacaactacaagaggagaggagaagagagaggagaattttcaatgctgccgcgcaccgtcatcactagctagtggaggggcggacgagaaggcgaggagctgaggggagagaggcttcacagagcttgcttgagcctggagggggctgccgctgtttgtctctccactccacccaccagcagttacctcgggagggcatggcaaaatctggtgcctcctttccggagtccagttgg

SEQ ID NO: 9855 - DNA, 440 bp, Zea mays
ggtacccgtaccggccctgctgatccgatctctccgcacgcccgcggccccggccgcaaatcctagctaccgctcgcgcgcggctgcgctagatctcgcgcgtgcgagctcgatcgagggggtctgagctggggttggccgtgggagggagtcgtccgagctcgcgccgctggagcttgcccatccgggctgccaattttgggcgccagcttttggctgtttttgcttctgtacttgtagccgggtggccatgatttcacaagttctagagtagcctgtggtgtagtgcaacgttatagtttcgggaattgacacctctgcctgcaatttgaggtccgagctcggcgtcacatggtttggggatgatcgatagttccaggcttccagcacggggaggacagtagagctggttgcactggttgtttttggatgcttagtgt

SEQ ID NO: 9856 - DNA, 955 bp, Zea mays
cactaatcaatttaattgtgtaatatggatactcctccgcataccttgtgaacaatttttcgtatgcacatgcagctttcaacatatcatacgtggagttccacctcgtgcaaacatcaaggctcaagaatgcctgcctatccaccttctctaaggagcacactctttaaatttgactaatatagatgtaccattcttgataaatctcagtgctgcacgaacacgtttaatggatggcaaatcgggaaatgacccagcgatccgcagcctggaggccctggctttgagcctttgacctaaatgcccctccgccgtcgcttctcaattctcatctcctcctcctccgctggccgctgtcttccaccattgcccctcccgggctcgcctcgacttgcctcgatttctttcgacgcctcttcctctctttgccctcgaaccgctccccctccctgcccctgcccctgcccctgcccctgagcggccttcaaatccacccgctgtttccccgccttccccttggcgcgcagctccggagcgcccggccggcgccgtccggtgggtcggctcagcttcttggatctcgggcgagactgacagacccgtcggtcccggcgctctcgcggcgattccgattgctcgcttgctgatggatgtggctactccctgtgcgatggctgcgtgaaggttggattgggtctgtcggccacgggattggatcttggcgaggttccagaagcccgaatttgctgtgtctgtcggactggatagccgccgctgccgccgctgcgatttcctaccgggtgagctttcgcgatgctcctgcctttgttcctggatcttgtccgtgtgattcgctgctgcttgtccatgggtttcatcaccgattccttttgatttgggggactcatttggttgatcctctgtcaggcactctgtttcttgtgatagggcggcg

SEQ ID NO: 9857 - DNA, 238 bp, Zea mays
acgaagcgcgtaaggcaaagcaccagaaaccggcgcaacagcagcagtggcgcagggagattgcgcagctgaagcaaaagctgaatctgctctgaacggattgactgacggggtatcgctaacccacaacctgcgccagggatggcgcactcccctgcggctgacaaaattccgcagaatttttctccagtttgtcccgcttagtgattattattctcgctaaatttaagggacgatg

SEQ ID NO: 9858 - DNA, 721 bp, Zea mays
tctggagcttgacgggaagctgttcgccaacacgcagcaggcccctacctagcgcgccaactgtcggcgtttcgagaccagggggtccctaagccgacgagtgaaatgtcaccgcgtgccccagcccagatgggtcggcgcgaggccgagcgcgaaggggggaagtgaggtggccggagatgggcgtgagagaggtggaaatcctgcggccttcgtgttcgtcccgcgcccaggtcgggtgcgcttgtagtagggggttacaagcgtccacaagggagagagagcgagcggtctcacgcgagcgcctgactcgtcctcgtcctcgtccccgcgcggccaaccccctctaagagggccctggtcctttcttttataggcgtaaggagaggatccaggtgtacaatggggggtgtagcacagtgctacgtgtctagcagaggagagctagcgccctaagtacatgccgttgtggcaaccggagagattttggcacccagctggtgtgatgtcgtggccgtcggaggagtgctggagcctagcggagggacagctgtcggagctgttgagtcattgctgacgtcctcttgcttccgtaagggggctgagagccatcgccgtcatggagtatgcggggcgccatcattgcctatctggcggagcgagccagatgggacgccggtcttgttccccgtggcccgagtcagcttggggtagggtgatg

SEQ ID NO: 9859 - DNA, 402 bp, Zea mays
tctggagcttgacgggaagctgttcgccaacacgcagcaggcccctacctagcgcgccaactgtcggcgtttcgagaccagggggtccctaagccgacgagtgaaatgtcaccgcgtgccccagcccagatgggtcggcgcgaggccgagcgcgaaggggggaagtgaggtggccggagatgggcgtgagagaggtggaaatcctgcggccttcgtgttcgtcccgcgcccaggtcgggtgcgcttgtagtagggggttacaagcgtccacaagggagagagagcgagcggtctcacgcgagcgcctgactcgtcctcgtcctcgtccccgcgcggccaaccccctctaagagggccctggtcctttcttttataggcgtaaggagaggatccaggtgtaca

SEQ ID NO: 9860 - DNA, 721 bp, Zea mays; identical to SEQ ID NO: 9858

SEQ ID NO: 9861 - DNA, 1488 bp, Zea mays
cgataccgtccattttttagagggttgctaaatggttatcaaattagaaaggaaatgaggttagatgagaaacgctaaatttagaaaattcatttaggccccgtttgtttcgtttcattttgaggaattagaatcttactaatggaatatgctacttttttataatgtaacattccaccacttccaaagttatcatataagactatctcaaattcatggggtgagagatggaaattgattctatagatttacatgctattttcccgatgtacaacttatagcacactcttctgcttacttcgctataacataaatgtgggatataactatctctctcatatgatttaggataatatacaaatatattacatatataaatatatgaacttaattagttttgtctaaattataattattaaaatggagttcaattccaaggaaacaaacgggaccttagggtagtttgacaaactcattttcccaagagatttctatttttcttagagaaattagtttatttttcccttaagaaaatatgaattacttaagaaaatgaagttcacaaactagtccttagagaactgttgcataggtgtttttatgttaactacataaattattaatttggaagtcttttcgacaactaccgaagttactctgatcttatatgcattatttacttgaaccaaacacctcataaatctccttttattcaagtttaactagaaaaatatttatctccacctatcaccttcgattcctcctaacctcgccggtccacctgcaaccgtgacggttcttgttcttcttcccacccagcgtgcgctccctcttcctcttccccttctctctcggcgacgactgggtggccgtagctgcctccatacgcctggtgccctggtcttcttcgggccattcgccggccgcgagcaccaccaagtacgcccacctcttggtattcacttcctggtgtacaaaaccgagcacccaaaccctaacttattatttgcattcggatctgaaactaattgcaagtatatatgcattcatgtattatgtctactaactttgattgctttgcaaaaattatcgggtgtacatgtgtacaccccatgtcctttactgggttcgcccctttccagtagaccggctgttcggctttggtggcattagttcaggttggcgattgacgacacataaataggggttttagcattcttttctacagggccataaggcagattgtgcttaggatgcctgtagcatagggttatccgaaggcacctgaatgatgcatagtctgtcctctgttcatcttcaaaattgtgtccttttctttctccttttattgctaggaatatcacacaatacattgcagatcttagctattttgtttttgttcccttttcttgccctgacttwaatttgtcttttccatcctagaagggagagcttcccaggtagagctgtttctccgtactctagcag

SEQ ID NO: 9862 - DNA, 136 bp, Zea mays
cctgatgtagaaagcaaaatttcatccaaatagtattagagcataggcatgagcagaatatacatcatgaagtgtgtgtagttttttggatcttacctcaaacagtcgaacaacattagggtgccttactaatttc

SEQ ID NO: 9863 - DNA, 512 bp, Zea mays
ctgaggctggccctcttcggctcttccccaataaatcgtccatcagacgtacaaagaagttaaggccagtagcaatgccttcccctctggctcaccctctcctttacagactgccagagggccataaagaactattggagtctataccactcaaggcccagacaaatcaaacgtactacacatgacatgatttagcccacggtagggttaattttcagttgaccttgcgtaaaagcacaagagaagtcttccagtttgcttgtgtggtggtgcgcgcgtagcaactaactgcctaccatacgatctactacattatggcatgatgcaccatggtatacatatgtagtatggacaaagagtgagcaacagtacagaaaagtggcaaccggcaaaagcacgaaaatgaaaacaagagtgccagcaccaggactcataatataaacaagagagatggtgagcagtaccgatgaaagaagatgagacgattcagaagttaaacaactgacctgcaa

SEQ ID NO: 9864 - DNA, 77 bp, Zea mays
tgtgatgtgatagtatttacatatatataatttttttcaatcgatgctgatgggggggtgacccttgttgctgccaa

SEQ ID NO: 9865 - DNA, 193 bp, Zea mays
ggcgctctgctctcatcctgtctatctacgagtcggtgcctgaatgctcccgtggttaagctccggtacccagaattccagttccaagaatagagttgtatatagctacccgcgttgcctttctactagtatggtcttattcggcttgactcggttcggtcagagtcttgatacgtagttggatcgcgaacaa

SEQ ID NO: 9866 - DNA, 488 bp, Zea mays
gacgttctggtctgctttttgttcgtcttctatcccatgcaaatctctgggtattgtgagtgagttgtatgtcgacctgtgcctccacggctttgcggcctgccttgttttttttttttacccctcaccgctcttggaatgcgcgtttgtgtttatcctgtcagaagtagcgggcgatactggatttgcggtgtacaagcttcttccttcttggatcattagcttggtttcttgctaagttgcaccaagtctgaaatcaactcaaaattctggagcagaaagacgctaaaaatgccagattgcgtacgctttgtgaaacgtgagaacttgaccgccttcaatgtttgaacgcagagcatcttccgaaccagtaaaaaaaagcggtttcatctcatttgtggacgagtttacatgaaacatttcgattcacataaagtctacagtctagcgtgccaggacgtctcgaatttcttccaaaatattccaaa

SEQ ID NO: 9867 - DNA, 181 bp, Zea mays
gatctccatcctcttgctgttgctgctgctgttgatctccatcctcttgctattgctgctgctgttgatctccgctctttccaccggcgctggcttagctggcgcgggcggcgccaacgccacgggctcgacggcccggggcacgccggggggagtgctgcagcggataagcgcccagttg

SEQ ID NO: 9868 - DNA, 683 bp, Zea mays
tgttgagaacaagtccccaacattaccctcatagtatctatagttgacatgtataaggtttgcggacatgtttgtaatttcacacgaagttgtacccctctactataaataaaggaatagtgacatgcgttagtgggcagatgttgatcggtagagctctagaacacgggttcgttctagctatgaagaaaggcgtagcaactagttctatactcactcccatagacccaaaccagcaaggagaaacacttctttgtgaggcacgaagccaaaaaaaggaaggccttggatccttccttggaaaacaatcaataagagctagatcaagaaattcacaatctcaagatcatccaccaggaggtcgagaagtgaagagaaaatcttcgagtctccgaactttagaaaagaattgatgaagcatcagagcagctccacagcctaacacaacaagttgagcaaccagaggagccatgctatcgggacaatcttcactttgaggaacaaggttttcatgatttcctgtatgacgatgcttttcccttgacaccagaactgcaagccatgcaatggccaccattatacagaccccacaactacctatgtatgatggcttgtcagacctgaagtagtttttattgagctacgaagttacaatatctttctatggaggcaacacaacagtc

SEQ ID NO: 9869 - DNA, 59 bp, Zea mays
atgtttttttccttactatctggcccgaatacttcgccattgggaaataattgggcctt

SEQ ID NO: 9870 - DNA, 1500 bp, Zea mays
ataaatgaaattggtcatctgagctcatcgatctggtcccttttgttgaatttatgatgccaccatggtggtgtggtgtcggatttatctctgcttcaagtatggcactagcttcttaagacatcagctggcagactcattgtcttgaacatgtgggacaacttacagttcagctactcactccgtccacatgagttagttgttttgggtttgttctaaatcaaactatttaaacattgaccaacaatatgtatatgattaaagttttatttttttttgtgtattatgatagtttaagtcatgataaatctaatacttttactttttatattgtaaaaatcttatcaaatatttgttataataggtcaaagttgttagtaactgacttaaaacaaatttaaactgactaactcatgtagtcagttactaacaattttgacctattatatatatagcttagtctcacaaaatctctagtatgtgtagctatctcaaatgctaagtatgaaaatttacaattgatattacaagttgtacacatttttttcgaaggtatatgtatatatatatattataaaccttaacaacttttggtagtgttgcttcctccaaaatttcaaatctaactatatgtaagcttaaaaattcaaacacctagcacatatgtaggggagctaacgctaccaactaaggtttgtaaaacttattcaaaactttactagtgcaaaatgcacgggcaagaaacataaatctatgcgaccacaatccatgccaattcgatccatgatcagctctagaacggtactgcactatgacacttagattttatttttatgaattatttattttttcaagttatgtaaattttaatttacattacctttagagttaaaaaattagagttgtatgagtgtgtgtggatagcctgagactcagtttggtaagcatagatgacaaatgggaaaagatactataagctccagtgatatcaacgaaacctgctccatttgctgaaagaagcaaagttctttgggcggcaaccaacaaagttttgtgtggacggactatccctgaccttcttgcatgttacaatctgtttttttgtgtatcctctasgccggcaatgccggcgatacaaacacagcatcttcagcatcctccgtcctacgggaaaattctaatccatagttcaacatcatcccattattttacatcgacctctgatacaatcaacataaactccaaatctgagctacttctcgtgtcgcctacatctgtcctttcaaggcccatgccctattgacaggccggccgtgcgcctaactgatagacaaaataacaagaagcgcctgtgtgtgaactgtgcagtaaaggacaactgaccaagttgagagttcatagttactatttacataagcaagcataggaaaatccttttcagctccttgcctctccttcctcccttctccctctctctctccagttttctcaccaccaacc

SEQ ID NO: 9871 - DNA, 1230 bp, Zea mays
gcgaaatttgttattcagaatggaatcagcaggagaagagttctcgactgtcatcgctcccgtggctcgtgatcgggattgtggtcctcaacatcgccggcgctgtcgtttagttgtattatttagttaatttttgtaaatacattttactattataataaattttgtgacactgatttctatacactgagttattatacgtgtgaaatttaatcttaacatatatataagatacatctggatttggtattaaacccaggtttgacataacatgaaaagattagagatgagaaagaagaaaaacaataaactggcatcttcataaataatgaaatgtgaatattcttttaaagttgtccatctttatactccgtccgtcccataaaccttaccgttctagcattacatgtgagaaaacaagccaactcagagaatgcaacaatacccaattaaatgcaatgattcttgtgcacacaacattactgccactgctttattacactttttttttgtctagaatcagatgctaggattttttttagactcacacacatcaaaacgacgagctttatggaacaaatgcttcgaggacgacaactttttcgggacggagggagtggcaggtaaaaatagaaatgatctggtttgagttttatattaaataaaagagcttttgatctaaaacagtagttgatttttttatctctttcgttgacttttgcctttcataatacaaaaacaggttcgaaagccgaaaaagagtcaaatgctcaggctcccgaccggcctataagcgagtcttgccggcccacgcccacaagggaggcccagcaaaaccaaccctagtcgccgtgtgaacggaccgagcgcgccgccagccctcctgttccgaagttgcccgagtccgccgctccactcctccgtgattccatccatcggtctgacccgctaggtgctagtgccggcagcccgccactcctccgctcgcccgggtcctgacgctctcatccactgcagtcgccggcaccgcttgcagccgcagccgccggaagcttgttgtagctcgctagctaaacggtcagagccgagctggctccgtacccacgcagccacgcttactccgatcctccaaaatcgcggcgccactaatctaaagccctaaacccatgacgcagccgccgcaccacctccctctccatcgccagtaccccagcctcgcctccgtcgcct

SEQ ID NO: 9872 - DNA, 92 bp, Zea mays; identical to SEQ ID NO: 9852

SEQ ID NO: 9873 - DNA, 565 bp, Zea mays
ctagagggcatataagcgaaatgacaagccccaattgcttgcagcaaccaaattcattgcacacttggtaaatcaggtggtggcacatgaactcttggcgctggagcttcttactgtactcctgtaaaatccgactgatgatagtgttgaggtggctgtggggtttgtcaaagagtgtggggcaatgctgcaggacttgtctcctcaagggcttcatgctgtttttgaaagatttcgaggcattcttcatgaaggagaaatagacaagcgagtgctatttatgattgaaggcctttttgcaattagaaaggccaaattccatggtttcccagccatccgtctagagttggatctagtggagcaggaggaccagtttacacatgagatgtccctcgaagatcacctagaccctgagaccaatctaaatgttttctaggcaaaccccmattttgttgaagatgagaaggcatatgagaatctaaagagaagcatcctgggagcagagtcttttgaagatggaggaggatcagatgctgcttctgatgatgaagaggatgaggaacaa

SEQ ID NO: 9874 - DNA, 269 bp, Zea mays
cctgttgcaacggactcatccgtaaagatcgtaaccgccaggatcttcccccaacaaccaaatcgccccaggcttcttgcgccgatctaccagattcccatggggatatacatacccagggcacatccgcccccggcaccgtgtgatcaaaccgtgcccacaccgagcaagcatcgaccaaagagagaagggagaaagagacatccgccgtcgggtataggtgtgtgggtcgccaccttgctcataaagtatggtcggaggatgtcgac

SEQ ID NO: 9875 - DNA, 1500 bp, Zea mays
ttcacacaaaatttgaataagacaaaccgatcaaacttggtataaaaatctaaacgaaatataaattgggaccaagagagtaaataatactaccatataaatcacataaataatgctaccatcaaaatcacatgttacctgccatctaatacaaccatataaataatactaacatctaaataacatatatattttctgcagtaatatatgttacttggcaaattcaacaaatacacaaaacatatttcaaataaatcacaaatcggagctaaacatgattgaacagagacaaaccaaagtttcacaacaaaataggcgtgaccgaaaaccccgcaattcgatggatttcattgtggccgcgacgaatagggctgcttaggacgattctaatttgggagcaaaggagattaaatcgagaggattggttgggtcatgtaaatgaattaacgggtctggtggtttttttaaccgaccaaatatgtttgtttaaaattcaatgtatcaaaatattcagaaaacatctaattttttgtatcatttttttcctgaccttataattttttaaaatttttaaaatttgaaacaaagtctaccgaaatgtggatgaaatttatttccgggtagtacggagacgaatttcccccaaaaattcgccgattttggtctgggaaagtattccctggtgccgactaggcgacgggaccaccaaaaaccactctcttgtgcgcgagcatcgttaaaattggccacgccgccgccgccggccggcgaggagccggtactgtctgcttgctcttcttttcaccgaaccaaaacgcccgccggaaagggtcaaaggggaaacagagatctcggtttgcagtgatgaagcttcgctgatgagctggcgcccgtccactcgcaacgacgctggacaaaagactagccgtcccgtcccgtcacggcccggcgacctggcaaggagaactgcagcgacagcgacagcgacctctggacaatcggctgtgacggtctttctcgtttgttttatagataggaaagaaataaagataagggttaaagctttctcgtagcctcctcagaacatacgggcgattgtcttttcgccggtgagccattaattccgtcgagctgatttcttcttgctggttttgccggttttatttttttcttttattggtaattcttggccgtggcgactgacgattccttttggcgcttgtaatagcacaagcatagctaaagtcgtcccgtttcctcctggtttcaatctgtttggaacttttgttagttccggtccatagggggaatcgtactatcctgtggtcaaaattgtcgcttctttcttttgtcgctctctctatacacaccaaaaagaaggaaaaaaaaccacgattttttctcccaactttgagtaattaccgagtgtttcttcaagtcggagctcggctctgtgcttagccgggaccctatacttggggttttggcgggtccatcgga

SEQ ID NO: 9876 - DNA, 1365 bp, Zea mays
tacacaattggaagttccatatatggttttattaattaatacaactagtgtactaatctcttagtgcccattcccttcttccgccctctttctcaccacagtcgagtgagagatgcacgagagagtgccaactttgcacgtgtggcttctcgtcattgcccatggacacccaatggtgagcatgccattgtggagtggccttgccatggtgccttcatgctcgagactaacatcacacacctcttctcatggtttgtcgccccgccgacaatcaccgacggtcgtggcaagttctgatatcctctttccttcctctgtctactgtgtgttcgcgatttgaaaatcttaaggttaggctttggttttttggggcatccggctagggtttcttccttcccttattatacatttctacttcatgttctaactagataacaacctaaatctaggattttgagaggttttctcctaaagacaaagggattatagcatatggaattaggccccatgtccgaaactatggctttcatacaactcttaataaaattgtgatattagctcgtaacattagttaaaaaaacgcaaaacgaagattatgccttcaggattggcatgaattactatagagtctggagtctggtgtcaataacgacagatactctggtagaatagaggtgacagtctttccttcgctgttaaatcgggtttcgatactgtgcacgagtcagagggtgataaaggttgatgatttaagtgagccatttctctatttatacggtacgaaggataaccacaactaataaattattgcgtcccatcggagcgcaagtatggcatgtgactgtctttgtaatcgagcaggatgagatgaactaaacgatcgataattgcattttgtgaactcttattaccacccgacagggaatcaacatgtctagtcaaacgaatcaatcatgctttttgcattgtcaagtgatatttctgtactacaaggttggacgaaccaccagcgacgactcacgacacgcaaactggtttgttttcacgcgagccacgtgatcctttggagctggtctccctgcagttggggtcagtttgacggttaaaagcagaacagccagccccggttgcgtcgcgtatgcattgagcattgtggtcgctcctgcgctgtgtgtttctggataataaaagccccgccagcccccgcagcggagaaccgcgcaagtgggtcaactcgcaactgaagaccaaaggcgagccggctgcccggattccggaagcgcccaagccccccaacgcgaccgtcgctgtcgccaccgcgctcggctcgcccgcgtccacagaagccgccagggccatacgccg

SEQ ID NO: 9877 - DNA, 691 bp, Zea mays
aacgagatgaatccaggcagccgctaaataaagtgaaccatgatcaatcatggccgtgcttgtagatcattctttttcattttttttgaaaccatcatgttccagacgcattttttattcatgcttggagctgtaattccagccggaacatgtatttttgatgaggcgctcatttgtttccccatctgaatctcaagactgtttctgctgttcatgtattccatggaatttctgtagatcgcgttcgtctgtcagaaggatgaataaatcagttgatgctttgattttgaatccattcaggaccatccttcaggccgcacgagttttggattcagaaactttgaccatgcccaacttaaacctcccgagaacccagcacagctagcgaaatctcatttttaccctgacctgacctacagacgcggtaacggttctgacgttctgctgatctgttcccaaagcccctgctgatctcgcacacgaaatcccgctttcgcccccgtcctcttccccgctccacctccctttccccctccctccttactccagtcctcccatggcttccagtgccacgggacctgcccgctccccgtgagtccgagacctcctccccgaccgagccctgccctgatcccgacccgggacccacccttgatccggaccgtcctaaatcccaacggggtctctggcg

SEQ ID NO: 9878 - DNA, 838 bp, Zea mays
cgtgcggtggtactatgtgaaagcacggcggcgtgtggctttctgtcgtattgagcttaggtatttttaaaaaagtctatattatggcgtaacagttcatttgtagacgacaagcagaggaagatgagcagacctacgatttcgtaggtaaacgtaaagcataacgcatgaaactgttctttaaaggagtagaaaaatagagatttactgtttactaggtaaaataccaattattccatcttttgtctccccttccctccatcgtcttgtcccgtatcattctcagccaaggttaaaaaaaccacggtaaactggcctgtttttcgaaatcgtaggtcgcaggaacaattttcacctaattttttaaaagctttgttccaagttcaaaaaattataaaatacaaaaaatatgataaaagatctagtatatcttatatatattttaaattttcaaattaatcattatttttgtaaagaaaacaataaaaatggtggcaaaacaacgaaaaccgataaaggataacagtttattgccgtgaaatctctgaaaaccgttctgtttgaatttgaaaacacaaatcggttaaacaactgaaaaccgacgaaaatcattttttctttggaatatggtggtttctcggacggttttaaatttaaaatgtcaaatcatttggtttttcttgtttttaacggttttcttttggcgaaaacgcgaaactgttttttttatgggaagcggtatttgaacttaaacgcggtttggtggaccctgttctcatctcagcacggcaggcacggctgagcgaacgctcctccttccaaacccacgccgacaccg

SEQ ID NO: 9879 - DNA, 462 bp, Zea mays
gtcagtctgcagaaagagcagcaggcagggcagaggcgccaccaaaccaaaccaaaccaaagccgggttttcatcagaaaagaaggcgccaaagccagggatggagcgatgagtgagcgacacccggaggacagcgacggccagggccactgttgctgttgctgttgctgttggcttcgtgctcgtgcagcggcagggacagggagatggccgagagcccgagacgcgaacaagaagcagatcatgcggggaggagacggtagggcgggccggcggggcggggcccctgtaaagcacgagccttgttagcaaaattatatatataaataaaccccactccatcgattcctctgccgtttttagcaccgaatcatcgcagacgcacgccacgccgcacccgcagcactcagcactccggttcgggcgttcgggcaggcgaattagggatacgttggaggagca

SEQ ID NO: 9880 - DNA, 1372 bp, Zea mays
ctcttgataggatgagtgcatgagctaggctcatcgaagctagccgagtagacagaggatatctaatcatgtctaaaaccattatactttactcccccagtactaaaaggaacataattatgtattgtatgtgttacatatatgtgtttagattcatcatcattcatttgaatataaacataaaaatcaaaagctacaacgactaatattttgagacgaagggggtaaatatttatatttatggctctaaattaatttattataaaaaaatacatttcataattaatctaataatagtatttatttgatatcataaatattgataatttttttgtgtaattgattaaccttgacctattattaaaatataccactgtgttaaaattgtataataatctttgtgtcttatcaactcttaggttcgttcaccaaactctcaacgattcgtgtagtacgtgtacccctcgataaacttctgtgtctcaccaatcatggtccctcgttcgccactgcgtgtgtcatctccttgcaattgtactaattaattattggaaaagcaggcagcctaataaataataaatttgtctaataatcacaggagcgctaaagcagaagtagctaaattaaagtttagtcatttaggatccaaacagaaaaggctaaaaataactaaactggtattcgttttactattttagttacttttatctaatttgtttggatctttagcatgtgggatccaaacaattataattgtatttggagcacgtggacatcatggtcagtctgaacacattgccgattgaagtcgtttgacgaaaaattgcagcgcggcgttatcataaacttgacagggcgaggatgttggtcatcagcacctaacgacgcgcgacatttggaaaaagaactccaactgcatgtggacgtcaagtggtcaacgtactcgattttcagaaattaaagacacttgccaatttggaaaaaaaaactgttggtctggacttttccacaagtagtggtgcttggtgtgaatgtgggtggacgttcagccatgcatcttcatacagagctgcgagaaaataattatagaataacgactttcccatcaagcaattactcggcacctacctgctcgcgaggatttgcgaacgtgtgcaccatttccgctgcatataaatagctacgaggcggctcgtatttttcatgcaccagtcgactctccatattcgccacatcttcttacgtagctctctctctctctctcgctacaacgagtagagtagagtagaaggggtgcggctaatcggagcactagttcatcctcagtccattcattcatcagtacacccagccttttccggcacacgcatct

SEQ ID NO: 9881 - DNA, 1317 bp, Zea mays
acatgatcgcggatctcataccctacctttttttttttttttttttttttgcaaccagcagtcactcatggttcgcagcctttgccctcctgctggtcctactcctaccacgttggtccgagtatacctgggttgagagaaattttgctgcctccccccccccctacttatactacttccgtccgtgaacaaatcaacttctagaggtgaattgagccaaacttttgcaaacgttagaaatgttgaacttaaggtaactataaaagttaatttatttgggggatggagagagtattagacaaagccaccaaatgttctggtggtgcatttgggaattgacaatcacagagcaccaccaaatggctaagggccacagtagcatgttctgctgtgtaatgtccaggcagtctgctgctgtttgcgcttttgagaaactagacatggtgtcatggtaggtgatgagacgtaggaagatggggaccaattgctgaatgctgccgatagctcaaattggcagccggttcataatcgtcgctgcaagggaatcgctctgatcgcttttgtgcgagcggttggtggaatctggactctggggcaatgcaatgtgtttggtgaaccgagtgcaacgctgctaagcaaggaatacgaacctaactcgagggatttggtctgccaaaccatcggagcaaagatgcgcgcgactgtgggcctgttcagttcagtcagccaaagacgtctgattgccttgcgcgttatatccggatgagggctggttatcttagcacagacaagacaaacaaaaaaggaatttttccgattaccaatcgacaggttcccgtacaaggctgagcatccgttcatcgtccagaacggcagaatctaaaaatcatcagtggacaccatcagacgtgcaaaccagcacacctccgtgttgttgttcctcagtgaaagcaatcatcctggaattcttcagttttcttcgctacagcataagatgccaacttcagcaccggtttacctttggctcagcacggaaatataaaagctaccgagggagattcctcaagttccaattgacaacaggaattcttcaactcagacacacccatcttcaaacagagaatccgttttacctgaaaactttgacgggccttattggacatcaatcatcgtcgaccagaattcccccaaaacactgccttccttcctctcctctataaaaccaacccaccagctcaaagtttcaagcaccagagcaaactaccagcttaagtttccagcaccagagcaagctaagtttccagcaccatagcaacg

SEQ ID NO: 9882 - DNA, 1500 bp, Zea mays
tagaaaataatttgacatcatgaatcctgaactatttataaatcaccttaatcatttctatattttccttttctattatatttccttatttggatgttttttttcaattgtgaatagacaaggggttgagccagaaagatattggagagcagttttttcatcttgtcaaaaaaaatctagattacaattacaacaattacaagtaactttcagaaactcttggagatacataagaactcttccaacccaaaaaagagtataattctcaatgcttgcaaagtcgaacaatttaatttttgattaaatgtatataaataattagtaacatttataatgccaaatagatattattagattatctatgaaatatatttttactgtaaaatatacttggaaacataaatatatatgccattttttatagacacggtcaaacttaagaaagtttgactcattttaatttaaagttgtattttcgtatagtacgatacaatctcatgccaacactcgtcgacattcgaggaacgactcaattcaaatcgggttcactgcagcaacaagagtaaagaaaatyagcgctgctacgggtacaacttcgtcatctgatagctcataattaattcatagttcacaataagaagcaacatgaaccatttctgaaagagaaattagtatgagctatggcgctgcaatgtctagtcatgattttgccacctgcccacctaggagatttgctagagtgactgaatgagatctcaaaccactatttccggatctgagaataataatgggaggtggatcaagcaatggatattctgttttgaaggttaggatgctaagatggatggccatgatgatggattatttcggtttggtataataaatgggagatgacaaatataaaaagctgttggcagagtgttttttcccgtactaatagctttcattgttttagatatcgtttgttacccagccggtttaaaacttaccatattttaagtataactattcagtgaccatcttaatatggtgtggacatttaaatatgataataatataaaacagtcataaacaaaatcatttctgtaacttttatttaaaaaaattcaataaggtctagttagggaattccatttttgcaagagatagaaaatgaactaatttttcttagaaaaaaggaaatcctttggagatatgatctttccaaaatagccctaaacagattctttcattttcattatcaggaaacaattcagcctggaattggtttatatctaaatagctgttagttgatttatttctccttatgatctcgagcgcggcccaattccggccttttatggctcaaggctaggtagccgggtgctttccttcgtcagttccgggcttccggccttctatggagaagcttccttcagtgagtcctccctttccgtttaaggcagcaagcaggagcagacaggaggcgccgagagcccagcgtcggagatctccgccgcc

SEQ ID NO: 9883 - DNA, 246 bp, Zea mays
caaacaacccaaaccactcgctcactggcccgtccgcctcagggcggatcaacatagaaccaaatgttccaatgaaaaaacataaaactcaatgtttatcttatgaactgtttgtcagagagctctcaaagaaagcacagaaagcaaacaacatctggtggaggctgagcggactgctgggtgaccggaaccggcaggtcatgtacatactgctccctgctccaggcgctgttcacagtggcaaca

SEQ ID NO: 9884 - DNA, 288 bp, Zea mays
tttctgttcatgcatcgagccctgacatgtggaggagaatagctccagttagttgtgttcgcatttgagagcgtccatgacttgtgacgtggggatagacacgcattcgagctcgtcgcgtgtttcactcgtcgacgctttgtttctccatgcccgcgttcgcataaaggaagaagaagcacaaaaaatgttgcagcggttcacaagcgcaaagagtgtgctctctgttcttgccgcgtagtcgttgccaagtgcgttgtcgcggcggtcgcaccggcgagctaaccg

SEQ ID NO: 9885 - DNA, 615 bp, Zea mays
tacgccttatatactgggacggagggagtatcgtttagcaactcctcacaactatctttagtgagctttattaattttataaaactactagagatattctaaaagtgactaaactttaatcagtaaagtttagaaggtggtaatcaaacaccccctatatttacgcattccgtgcagtttagacctctgtaaaattcctgcgagaaaaaggagtttgctgacgctgagtgacagtgacagagaatgccaggtctaggctacgttctctgctatgctccgagcagtgagcagtccagtccctcagctgccagctgcccctgggcataacaagccggccagttgccgatgcactgtcgctagcatagcggctgcaagctggcgctccacctctcgccgacatgcggtcccctcgtccctcctctccgactcctcccgaatatataagcaggccggtcgcctcgacctcccttcctcgttattccatcaccagttcaccaccgtcttcctcaactcttcctctcctctctcttctgcaccatctggtgtgtgtgcgcgttactcgccgcgtcgatcgaagaaagaggcgcacgggagcgagctacgcgaagcaaggca

SEQ ID NO: 9886 - DNA, 73 bp, Zea mays
ggtaacagttcactcgttcaacagacactgaatcctgggctcttgcaccttgaaatcatttttctaaactttt

SEQ ID NO: 9887 - DNA, 193 bp, Zea mays
tgtatgagccttcactgtgtgactgtgatatactgcagtgcagaccgtccttccgctaagtgttcctgcagcattgaatttcctaaactatgctaaaccttgattcttgttacttttattttgcaggcatatcttggtcttgtaattgtataaaaagaaggtttggggaatcaggtttatctaaccagtggac

SEQ ID NO: 9888 - DNA, 1460 bp, Zea mays
atatgcaatcacttatcctggtgcaagcatgcaatcaagcgatctgttgcatccgatctagatctaatgatgactgttattttatatttaacttcttccacctaaaacatagtacctattttacttttaaccccttccatatgaaaccgttggatctagattaaatgctctggatagtttgattgcacgcttgcaccaaaatgagtgattgcacaggatatgtcctctctaaatattgatagtagaattaacaactaataaatagccacctgactattatctaatttgataaaaggagctaataactgaattattagttagactatttaaatgtttttaactaattttaacaactaactattagctctattgtattaagcactctcttaaaaattttatatttccaaataaatattctaaatacaacgagtaaaagctattccagcattccgcgcctcaatggccatatcccccgcacccgcaggcccaccgctgtctctcacatcccatgcacttatcacagatcacagacaataacgagataagcagatcgataagccaccgtgcatatcagacataataaagcctataaattaaagataatcgctaactcggtgtccgaacagtttatactccccaacctggttcgatagtgatttcatcttcctctaccaggcggctccgtggtccgtgctgatcaactgcatcaaggatcgtcgccggcggcgcgctggcagcagttcgcacggcgagatcggattgatcgagatcttctaggtgatcgccatacttccccgtctaattttagatgcatgtaggttttcgctgtttatgttttacagatctgaagctgagtaaaaattatggcaaaatctttacgcggttccgtggagttccgtgccctttcccagttttgaaatttctgctcacaaggctgccatggctttggattttctctctctcttctccgatggaagacatttcttgggaaagcagcgctattagtactaaaccgttctgggcttccgggctcaccatgtcaggcctggacctgcgctagacctcgaagcctcgatcgcaccgcatcttctctctctgctgctggtccgctccgtcgccgccgaccccgccgccagcttccccttccacctaaaaggacgacctctggccgcccttgtcccgccccgacgcctcggtttccactgcataggcgtggtgcggcgatccgtccgggcctagggttgcggtaaggaaccctaacttgcttcgatgtttttttcctctgagatttatttgtcgtgggagatctctcgctcgccatgggcaatcagatcctaattctccgggggagaagcgggggagctctactcttgactgcgccctggtactgtgcagagagacactatagggtacgaccctaggagcatccgcctccacgtgggtgaggcggaagagggagg

SEQ ID NO: 9889 - DNA, 577 bp, Zea mays
aacaggaacaggaagcaacaccatccctggaacatctacatcttagttcatgctgctggcagctggtatagtgtttacttcatttgtttttttggttgctgccttgctagttgtcttgctcgcagtcgcagctggtatagtgttcatgcttaattctgggttttttacttattttacttattcactgctaatctactactctattatagctagtattttactttttttacttattcacttctaatctgctactgctttaattcaatgcttcatatagctgattagctggtgtatactgctttagtttggttaatctctctaatggcccacggtctgctttagtttggttaatctctctaatggaggaaattagtaatggcttcttcagtttcctgtcccagagaaaattagtaaggtgaggggctgtttgacacgagatcttactcctttttttattttaaaaatcatgccaggacaagaacagacatggcgggagtgaaacgttggcatctaggctccagcatgcatctagcaacagatatcaagtgatctaataaacaaggtgttgagcacagtg

SEQ ID NO: 9890 - DNA, 416 bp, Zea mays
cgagtggggcggagaaggggcggcgcacgatagttaaaaacgcacgactgttgaaactattgcattataatagtagagatgtcatcaatgtcaattagttcttcgtgacgacttgtatacacctttgagccttttagggaaaaaagaaaaaaagagaagcatattttcctcttctagctatttgaaaaaagggcgagaataaataactaatcctacctctttcaagtaaaccttgatagcagtcatctcatcatcatcataaacaaaaattatgaagccattttaacaacactggcgtcttggaacgctggcagtcggatcctgatcactcgtacaggtcgaagtcgaacattggcggagcgtatgcgcctaggtcgccgaagaggaatgtgtcaacctccgcgtagacgaagctc

SEQ ID NO: 9891 - DNA, 436 bp, Zea mays
tgttgtaggttctgggatgatttgataggtcgaaattttcatatctacttcgagtcatgctagtccggtgctgaagcgtgtttgagactattactaattttggaccgtgtacgtaccagtttaaaaagtccgcaccattatcccagcactaactactaaggcggagatgacccctgtataaggcggcgcatatagacacctgccgattcggattacacacgtcaccaggattaaggaaacgttcagttcggacttcgccacttcggagttcggagtcgtcatgataaggctgaactcggccagctaaggactctcgactcgatcgcatcctataaatatgacacccatcgtcctcccgtttcatcagatccaagaaaccaacctcgctaggctagctaaccacaagaaagatcgcgcgctgcgagaggcgccggcc

SEQ ID NO: 9892 - DNA, 689 bp, Zea mays
aataccaaatatgattgtgtgttgtcgcaacccagtgacattggacttgttctatatctaaattgaagttgctctaaaataaatctagtgctttagacatgatttgtttaaaaaggtagatccttaattatagactattttcgttatcgtctgctagtttacttttaaactaaatcggaacaaataaaaaaaagacagataaagtactaccgaagagtttttctttcgctccagcagccgttaagattctgtcttagcaaggaaagtttgtggtaaccacgtacgcaaaacttccggggtgcaaactgcaaatgggtgttatgtctgttcccctcgtctctgcaagtaggccaccctcgccgacgggctgaatcatgtaaccaagaagtccacgtggaggtggaagagggcaatatggacagcgaggagagcacgaaaccaccgccgtgccgtgcagtgccatcctccctccattgtttcccggctctccgtcccttgggagttgggccttggcatttccttaagataaaaaaggggggaaatcggcttcctactccccgtccttatcgccagccgaaccgacattgttttctccccccttctcgccttctccttctcccccctagtctagaggcgtttgctccccaatcccttcggcccgcccgctcgacgtgatcccaccggcagcc

SEQ ID NO: 9893 - DNA, 906 bp, Zea mays
gggggtatttataggcactcgagtggccgcccgtcccttgtcaaagacgtttatatgccctcgagtacatggcttatccccagaatattcccacgaggggaggttacagacagtcattacagtaaaggctattacaaacgcagtctgtaatgcgcttatcctcgcggggcccgttaccttgggccgaatcccgtgtgggcctcccagggcggtgacgaagtgggagactcgtagacttcgacagagacttcgtcttgcaacagagaggacgaaggggaccgccaatcaatgtcttcggcttgatcggacgtgtttggtggatgtagccttcgtcgaaatgatgagcagacgaaggtatcgagcaaaaggtagcgtgatagccttcgccccaacaaataccataagccacaaccatgaccgtcgacaagaaggaaaggatagaggaaccgatcgaaccgcagcagtcatctcccggcccgctgcaaacgttcctggtctactcccatcccatcacacatgcatttccgcaatcaaaagcatcacgtaaactgactgggaaagcgcagattttaatatgtgcaccgggaggatataaaaaatgtgccaaaccgaaggtgcttgcatcgccacgttatccgaatatggctttcaacgacatttggtaggtttttgttgtacgtgcagtaacgacagaaaaaaaaaacggagacgtgcagcagtgacagcgtcatatgcatctaatctgctggccgccttccattccagtccacacacacactaacaatcattaacgagagtgctctggcctctggctagctatctcgtccggtcctgcatcaggtcgtagatatagtggggatagttttgttgttggtctggaaagaagagagggaaaaaaaaagatcc

SEQ ID NO: 9894 - DNA, 1078 bp, Zea mays
agtacgtacaccctgtttttagcttgtgttgcggtcgtgctgccccgtgttacactgcatatgcacgcagacgacgccctggtggcgccgacagcgacgtgtatggctgtccaaatgggcagtacttcctatcatgttgctcgcccggctcggcttgctggtcgcttgccccagtcccaggcatctgcatgttcgtctgcttgctactcctgaatcctgagcggcgccgggcctcaatgaaaccgtgcaggccgtttctggtgtcccgagcacagacagcaggggattcacctagaatgtatatgtgatcccggcgattctgctgaagcctgcagcaaaaggattcgcatcatgtgggctgcgtagtactgcagtgcagagagcatcgttttgtgattccgagttttataggatgcgtttgtttttgcggaactacgtcaaggtcaagatccttttttaatcgtgccatcatgtgggtatagtatagatcactgcgttgaacaagggagctcctggatcaaaagcgacaaacagagaaagaccacccccagcagcaataattcaacgttcgggtttcaattcgtgagggaaaaaaactcaggctcgaatggcaataagcgcgagcttaccatttcattccataatagcattggtgagtggtgagatcaaaccaaaaaattgtgtcatacgactttgcgccttcaatcatgatcgatcgatataattccttggacttgtacgtggtcattcattacggcccagctatctttcagtacttgagcccatgatgcccaactgcgtcgatttcggcccgactaatgacttcgtgacaccttgtggggctcgatattttcggtggctccaactggacaacaaagttccacttcatgcaaagtgggagtggcaagcaaaagcaagacgtaatagtacctgaggaaacccagcacgcaagggcaatttggtcttgttacggaacagaagggatatggttcccgggctccggcgacgacgagaggtaggcagaaatcgtttgccaaatcaacaccagcaacagcaaagcgactacagagagtaggag

SEQ ID NO: 9895 - DNA, 84 bp, Zea mays
actgcagcaggtaatgaatggccaaactcccaagattcaggtttcaaggactacacactcttactgcatgcaaaactctcctga

SEQ ID NO: 9896 - DNA, 341 bp, Zea mays
ctataccttgaatcacacagctcttttattatattgctgttgaacccctgtgggtggtcgttgtcactggtgcagcaaagcgtacgtctcaattctcatgcagaagagttctaaacaatttgggcggaacttgacgggtacgcacaccacacaggtaaattaattaattaattaggtacgtcgtcgtacaagcaccgtatatatactactacattaacgcgtgccatcaactatatataatacccctcatacaacccggttccagccatcaaaccaaagcagagtcgtcaacaacagcaggaaacataactgaaagagctagcactacctgatcgagcacc

SEQ ID NO: 9897 - DNA, 1500 bp, Zea mays
catagtaaaattggaactcagttacatcatcaagagatgcaattaatgcttgggatgaacggtgcttgcttattatgagcaagtggcaatcttcaagccatctcggtatgtggtaatgagtgtgtttcagctaccaaactggctgcatgaggttctagagagagtaatatatatggctctatcggctatccggtgggagagagttgacactatttactatattttaattcgaatacggatacagatctaaatattatcgaataaaatacaacaaatagttccgattcagatactcacatggcttggaacataatgttataataattatcaatttgttttatcgatggatttaccgttgacaaaaaatcatgttacaagtaaattataagcatagcaatagataccttatgagcatattcattaataaaaatattatttaacaataaaaatatacgtcatgtttataaatatatgtcaagctttgaccacatttacatattattttacaatctctataaatagatatctaataattcatttaattgttataaaatagtaaatatgtcaagaaattcaaatttgtcattccaaaatgaatgaagtatatgaatgtgtgcaccaaaatttaaataaaaataatgaacaaattaatctatatattgtaaagtggagagttgtagttgattaggtattttggattctaaatattttttatattaggtatatttgtatcttagactccaaaaaatcacatgtatttacatatagtttttttaatattaattaattttatcattttatatcactagtaatataagattactataattatttatttttcatataaacattttaatactttaaatggtgtacataatttttctagcatattatgaaaaataaaatcatttgtaatttgtaatttggaataaaaaataaattttaatggttttatggaatactttttttcttctcgaatacagatagtatcggatattctacggttttgtcgaatatgaatttagattcggatagagaaaaagactataaatcaaattcggatacatctatttaatatctatattaaaatcgaatacaaatattcatattagcattttaaatgaataaaatatcgataattcagttctctagacatctgaatccatgataattcctttggtccaaggcccaaactcgagtgggaaaccagcatactcaccttttgtgtctcatttccggccccacgagtccacgacgcccacagctgcaaaccaccacacaactcgaccagtccagagccggtcctcagatggcctccacgtagcacgcttccacatctccccacccctcgtcacctcgtcctcagcaccccaagtccccaagaccccaaccaacatttgccgaacggatcccgcccgagcccgagagctcgcgaagcccaggcccagccagacccacgaagcgatgcaacggagatagtgagatcgcgtgaagccgccg

SEQ ID NO: 9898 - DNA, 1500 bp, Zea mays
tcctccgttcaggcaggctttcagctaccgccgcgcggccgcgaccggcggcctcctttagcggctacgtacgacgtatataccgggcaggcgggcaccggccacggccaacgctagctgctgccaggttgctggaaagagcagctaagagagataattcaggtctgatatcattctcatcactacaaagatttatgctgctatactgttacttttcgattgttggatgatgtctgatctgatggaagggggtttcagtttcagcttcggtttcaatttcagctgcatgcatgcagctagctatgggtgttctcgtgttccaagttctttctcttctacttccttttgtcatgctgccttttctttttccttttccgttccagttattaatttgcccatttcttctcgatctctgatctcctcttcgctgttcttggcttcttcttgcatttgccgccaagagcgcaagagggatgcatgcataagcatgggttagttcctgctgcggtttctcttgttgcaaattaatttatcaccgccgaccggggcttattttacgccctggctgcaggggtatatagtagcttatcacaattatatttccgctataactttctgtacctctgcctttctctgtcgacggctaccatgtgcagcatgcatgcatgcattctcttgacctagtagctaggctccttggtgcgatatgatagcaaggacagagaagttaatgacttcttctttgttagttgttgttattactaaactgttgctggtggtgtgcggctagtttgtttcgttttattttcctatgggtggctgtgtccttgtttaattatatattacctacagtattagatactagttggtgtctactcttgatttcaacgctctagctctttctcttcggtgggtgatgtggtggggagaacatgcatctatatctatcaagtgctcctccatttttgttttgttgttcttggacagctcgcctatccaaagaactaaaaatgtttatattagcttagtattttccctggagctatgaagttgatactggaagactatgtaatatgttttgtctcattaagtttcacagaccctagagcaagaaatactacagttaataaaacccatccttttctggggaggacctttcgacggtgctgatctaatttgtgccacttgtgccttctctctcaccaattaaaccatattttcatggccatagcattccgccagctgattgtaacgcccgcaatcaataccagtaagtgcccacacacactagcgttgtttcttgttagcacgggtgtcacacatgtcccaatcgtatttagttgcatacatcttaggcgcgtacgtgcatccatggaccatggtgtggtgccaattatgtcagttgtcgtctcttctactctctgcaatctttactgatgatagtggcatcgtcttcttcctcctttttccatttgttttcaggagtgggatcgagacgac

SEQ ID NO: 9899 - DNA, 214 bp, Zea mays
aggcatgtgggttcttgttgctaagttgaaaagaggggctttagacatatctgatttgaatgttgatgatcgaactaaagtgtaagggcgtaacgatcaccacattgttgtctcataactggtgttaatgaaaaataacatggtgctgcacgaaatctctactttctcttgtaagaaggattgttctatcggcataatttaatttgcatgtata

SEQ ID NO: 9900 - DNA, 928 bp, Zea mays
ggctcgccagcctatcacaaccctcctttaccagggcttctgacctgctatgtagagacaatatagccaaagttgaattcaccctaagtcaatcctttaaatactaggttctacatcttttagtctttggtattgtgataatcttttttggtcttcttttatatgttttgctgtttggttgagcccttttttctaagtcaagctgctattggagacactataatattctaaacacaaacaaattagtggtcttttttatttatgcgtgtgtttggcatccataaggaggtctttttgtaccccaggtcttctttagaccatctacttctgcttaatatattctaaagcgcagttcctctgtgcttccgagaaaaaaaagtggccacatgagaagaatgacaacatgttcttttttcttgaatacgccgcttatcattatattaagaagaaaataatgacaccatataattgaacttttttaactttagtttgtttgctaaagaagctttaaattttcttacccgcttttccacaatagctttaatcttgttcacaattttaaactggccttgctattaaatattttaattgggtcatatcaatgatgatttgccttagagacactatcctgatttagttgtggatgaagataatttttataattccaaaaagatttacataaatctagactacttatgcaaagaaaaaaacagaaattagtgttgaataatcatgtataaattcaaacatgcacatctttctaatgctagttctcctgcattacattaaaattgtttcgtttccttttttttactagtaactactgattaataagtttttcaaaaaattcttatttttgtgagtatcttgttctttcatgtttcactattttccaccaccctcatcatcccatgattgaattaacatt

SEQ ID NO: 9901 - DNA, 106 bp, Zea mays
cttcgtgtagctctctcacccccaaccccaatggtcagcccgtgagggtgaggccgtgaccatttaaaagtcgttctctctccctctctctccaccacaccagcca

SEQ ID NO: 9902 - DNA, 1339 bp, Zea mays
gactgtgtttcagatatatatataagaagagggaaacaaaggtttaaagtggcccaaaaaataacacactccttatggaggtcagtaacactcgtacatgaaaggatccataaaaacacacactccctacaacaacctatgcagggcaacaaaaaaggagagccctttggctccagcaatttttgagcttcttctttcctcatctgcttgctccagagtcaaaggctgggagaccctccataaaaaatggctctattgcgatgcttccaaatcaaccaagatcctaaaataacgagggagtaaagacctttcctgaccagacatttacggtctctgaaaccatctcccaccaatgcataaaggaaattgtatgtggccgtggggctaaactatacaacccaaactttcttagtaggttttaccagaaaactcttgagaagacagctcatgagcaagtggttaagggtttcaccttgctggtcacataaaggacatctgctagggtgattcaatcctcttttcgcaaagcgatcagctgtccaacatttattatggtccaccagccaaatgaataaacaacactttggaggacacacgtgtggacacaaggagtacaaagaaaaaaaatgaagagtatgaacttttatttagtggcccatctaaaagcccattaattcagcacaagttccactagcccagacgtttctttaacctaacctttcaactgctgcagcgaaggcacacagccgccaccgtttcttcatctcccagcatcttcttcctcgcagactcgcagtgccggcgctccatcttccgctccctcccttacacgtgctcggcacgcaggcgacggcggctacgttcgggctcgggctctcagcaaccgcgtcagcggctccccttcccgcctctagccagtggcctcgtgccctcggctccggtcctctgcacaccggccggagaccctgcgtgcgtgcctctctctctctctcctcccgcctcctgtggatcgtgaacgacacccggcccccgctgctgcgccgcgtgcggcctgagggcagcgggagccaacagccgctgctccaccaaggcggtcgcgccgctttgggagcgcttatgccccaaagcgatgcgttacccgtccgcttagcgcttcagcccgctgaagcgtgcgcttagtgccgcatttttggaaccctgatcagcccagtaccaatacgtgtatccgtatctatgctgcgcaagcgcaaacattcacttgcaatcgtatgcttcttcattgggaacaggtcataacagcggtacaagggtgaacaaagaacatcgagaggaagacaat

SEQ ID NO: 9903 - DNA, 1500 bp, Zea mays
taaatttcgcggtgaactttttgaccggcttcggtttggttccttccgaccagtcgagggagggagggagcgatggatggcgcctacctgatgatgaaacttgacgaatctcgcagcacagcatcattcagaacagctggcggtgcgagtcctgggcgtgcgtagcgtagcgtgacctctctcgctcgctttcgagcgcgacgtgcgatcccgcgcccataccctcctgcgcccgtcgtcacggcacggaccaactcgatgcaccatgtctcgtcgatgatcgcggtggcacagggcacggcacagcgggcaggtggtggcaggtcctctggtgtccaggagcagcggcctagagccgccgcgcgcgtcggcgtcgccgctgcgcgcgcgcgagcgcgaagccagcagaaactgcagagattccaaggcggcctctgtgggctgtggcctcagacgtgaaggccttcctgttcctggtccagaatgcagtccagtgaaggcccatgtacgtgacgggccagtaccatttcttctcaggctcggaaagtgaagccacggcctgggctgcattggtctttccgattttcagacaactgtgggcaaactctttctttctttctttttactagcggaatgcggatgtgcagtgcagtccatcactatgacagacaagctcacacctaagggcttgtttggttattgccaatacacatagattggatgggattggaaaaaattgagaagaaatttgacttgtttggaattaaaactcatccaatttcactcaatccacatggattgagagctaaccgaacaagccctaaagtgattagggcctgttcgttgagtgggtttaaatccctaggagtcaataaccggacaaggccttagagaagctaatacatcattgctagatgttagggcatgtacagtgggtgtcttaagttgtgtcttagagtgtgtctaggggggtgaatgtaaaaaatctcaagacacgtatcttgacgaagacacagtgtattagctctatattcgagacaggagactatctgattggtcactttaatttattgaatgttctgattggtacaatgaatatggtaagacacatgttttagacatgaccactgtattatgttgtgttttagttgtgtcttatacttggagtacggtgcagttgtatctaggttgtatatgccctcgtggcctcatccgttttcccactcgcttgctgggaatagaaaccgtcaccccagtccccataccacaycaccaccgcggcacacacaaaccaaccacaggcaataaacactaaacagctcccactcccagtaaatttctcgtctcccaatctccgattcgaggaagccggaggaggggatttcgagccgcggaatcgggacattagagtggccctcgacgcgtccgcgggtggaattgccgagaagccgagagagaggrcttggagcggagttgcgggaggtgtgagagaaggcggcg

SEQ ID NO: 9904 - DNA, 218 bp, Zea mays
ggtgtataaatgagaaaaaatgaataattggttaggaagaacgtcggggacaccactgacaacggctggtcagttccccttggaatttacgcttctctttttttattgcttgattgtgatcacatggtaggcctcatgtgcgctttgctgctgagggttggtcagtttttcttggaatttaccattgttctcttgttttattgcttgattgtggcctc

SEQ ID NO: 9905 - DNA, 55 bp, Zea mays
tgcagaacatgtacaatcgccgggttaattaacccggttccttcaaggagtgtac

SEQ ID NO: 9906 - DNA, 484 bp, Zea mays
ggtgggtgcggcgggtgcgggtgcgggtgcgggagccggcaatcagacggttgggatggaggcgggggttgatccggcaatcggacggtcgggatggaggcgggagcatggttgtgcttagtctacactattgccttaaggattagtagagatcaagagaggaaaatggcacagtttccttacataaaaaatcaattaagacaatttaatttggttggcccgatcctttttggattggtcatctctgtcaagcacggcctaagtcctaaacagacacgggccggacttagccgtcgacctcaggctggaccggcccacgttcgctccggtccactcagaacggaaaccagcaaacgacatctctccccggcggcccggtcccttcatctctcgccgctgtcgtcgccgccgcgccgtatctgcagcttcccgcaccgtatcctgcggaagaagtttctaacgggctacatcccaccaccgcacg

SEQ ID NO: 9907 - DNA, 280 bp, Zea mays
ctgaacatttttttgggaaaatattgcaagttattggagtagtagctttttatttaggatttaaaattttagggagtttcctatgcattggaagaaatatttttgggagttgttggagatgtttctaagccccttgcactatcgattgttcccattttccgattctttggtcttgttctgatgcggacttcacagctctgatgttacctttcttatatctggcttgccctgtgtggcagcagggattgagagaggaaggaaggaaaggaggtgcttcaat

SEQ ID NO: 9908 - DNA, 1123 bp, Zea mays
tctctctctccctctctctctctctcagctcggctcgggttcctcgcgttcccacttcccttcccttccttcctcaccacttcttccgacccaagcaagagaaaactaaaaacaacccggacccaccaatcacgtgggcccacccaccgcctcaccaccagcgtccagggaggaggaaagggaaggaggaaccgaggaacccgccgcaccgcaggcacaggcaggcagggcagcagatcgcgagttccgacttccgacgcgtctccgaccaggccgccgccatttctctgtctccacacagcgggatccctccgccgctcgccgcttctcccttggtccaccgtccacccaagtaagtcgtcgtcctaactgtctcccgtggatcccggttcccgacccaattcctcgctggctcaatcggacccgaatctctcgctccacttctctgggttcgttcgtggtgcccgtgccctgccaagccgcccacaaatcccgcggttgttttgtttcgatcggtttaggttctttttctcgctcttcagcgccagagatcggccggtctcggttcaccccaggggctcctggaacatcaatctatgggaggtgaaaactggcggaggtttcctgtttcattaactgtagaggagggagaacagcacattgtcatatctatgttcatgtaattatgtgtcatatctctgtttatgtactcgcatgggactaaaaggcttcgatgattgtcgttgtatatgcctggggatcaagaaaaaccacgaatgaattttctgcatcaaaactatgaattggcgaaagcatcttaatttgatcaaaactatagagagaattataaagatttatgacatcgaatagttatgctatgaaaatgtaactgatgaagaaatccaatgatacttatttggtatggtaaattgtcattgttttattatataaattttggtcaagaagttggaaygacttataattttgaacggacagatggagcactaatgttgtgctatcctcattttttcatggtccgcaaatatgtcaagtctctgttatgaatcgtcatagtaccattttggtctaacttcttttctacccctgcttctccactgcagcc

SEQ ID NO: 9909 - DNA, 1383 bp, Zea mays
ctgttttaaatctttgactcgaaaggtcgagtttaatccatcagccaggagtacgagtactgccgtggccgatcaaaccgcattgatctctctccaacccaagtacagagagctcaagaaaataaagtactacagtactgcacaacgaaacaccacacaaaccattaaaatcattgcgggtggctccatgacggctccaaggtcaaacgacaacatatatcaagcggagtataatcagatcggataccaacgtactcgtttcatattttctcttcagactcgatcgaatatatagatattatcaaatatgtcggatataatttgaatagatatatacatcttaaatgcccaactttaaaaatatggatacagattgatactgagtacccggactcgaatacgaattgaatctcagaccttttaaataaatagatttatacctctgatttccggtaaaggttcccagtataaagaagttgtatgcatttcttcacagatgaactacatctatacatggttggctactcaataaggtcttgttcggttaatcccgttacccatagattgaatgagatttgaaaattttaagaagaaggtttgacttgcttgagatttaaattcatccaatctcactcaatccacatggattgagagctaaccgaacaagctctctaagggcttgttcggttagctctcaatccatgtggattgagtgagattggatgaatttaaatctcaagcaagtcaaaccttcttcttaaaattttcaaatctcattcaatctatgggtaacgggattaaccgaacaaggccttaaaggtgagatagttgggtagctgttggggctcaaaattggtactccatttttttcaaacaccccttccagtctttcgttcctatgttttatcattgtatttatatctctttcccgtattttcttccgttgtttttgttttctttcattgcaaacagccactgacgttttcacgtttccggtccaaccttcataaacagaaacctattgcagaagtccatcgggccttcctcgtagtctaaaggcccataattataaacccgagcaagccacgcaactgctttgcgattcgtgcaaacccctctcatctcacgctcaaaattgggcaacgcaccgaggtcaaccaggtaatttagcacatgccctatctcccttacataatcctgccccctcgccagtcgcgaaaaccctagccgccgccagaccattcgtttctcgcgagccatcgcttcggtaattctcaggcaccccgctcgatctcatcctaatcggtgtgattttcgtcttcaccgtcaacccacccctccacttactctgattcgcactttgttggcaggcatccggaagaa

SEQ ID NO: 9910 - DNA, 278 bp, Zea mays
cgttgcattgttttttttttcaaaatgatctcgtgtgcaaccgtacaaatgcaactgagaggagggaaatgcgagacccttcagtcctcgaagctctctggactgtgggtgattgggtgtggtcgtgtgggcctaaaatgggatggcccatccaagcccgacccgtatttgccagattcgagtgaactggatccaactaaacaaacaattttccccatttgccattcccgacgagcaccttcaccgtctcctcccagtcccacctcgcgtggcacgcc

SEQ ID NO: 9911 - DNA, 1500 bp, Zea mays
ggagagaaaagaaagaacattttaaactattagttataggtctagatctagatagagataggcaacacacatcatgcatgttgttccattgtgttatcttttcttagttcgcactctgcacacatcttcattagtttattcatctttttgcatattttttcatcctttctcccctcatatccatggcagacaaggacccaataatgtcacctttccatgagtttacctctacactcttctcctctcataagtctgagcgaatctgatgaccatgagccctcctctaagaataagtttagtagatacaacaacctcgaaccaggttagttggtaacattttgtagtatcagaattgggggttttgtgttctctaaaagagattttgttgagaccgacgaagtttgaggtgacgataaaggtgggggacgtcactctgagttatgggagagagaccgatggtagacggttgaaaggtgggcggtattttagcacccaagtcatgtcgaaaacaaacacttattttagagttgaagaagattattgagattagagatggctgtggtcatgagcatcaacgaagacggtgtttcaccaccagggatggcgagtggtggacgactggaaaaaagattgtgcgccccctaccagtcatgctaataacatgaccgagcgtgtgttaaccgtgtccatatgaatatgaagtactagtaatatataatatgcaagccataataattttgtgcctactccagctatcaaaattcctgttatgtcctcccgtggcaacacgctccgtcccaaaactttccagaaacattgagggggcagttcgggaagaagtgggggaaaatcactgccccccatcgttttgttagggccaatcatggggcgacagctgggtggcactgctccggaggctattaacaactggggttaagcgagttaacaagcgcacgccattggactggtcagctgctaaccgcggctgctaattccgaccggggagccagccagccacggctcgctcggctatataaaccaacacgcccccgcctcctctcctccccctccgcctcctgctctctctcgcctctggttggcagagctctcttgaagcctcgagactcgtctcgccgctgctccctcagctctgccgctgcgtgcctccgttagctgttgcattgcagcgcagccccgcgagccttgagctgctaggtatgctcgcgttcttggccgctggaaatgtgggtcagttcagagctctgatgaactctgcgccgaggatgggaaaaaggacgggattgcttattagatttgaaaatcgaaatagtgatttagtttttcagggttctagaaagaatgataaaattttgagggggcgtaaataatgacatgaccgaatcggaatttggcttggaattaattatcgggagaagtgttcggactgcctgctaatctcgattcctctctgcagctcgcccttcaccacagtcctcagac

SEQ ID NO: 9912 - DNA, 271 bp, Zea mays
gtaaacctgtgcttctacgttgctgttgtactaccacacccacactagtcgtctgtctgtagagccctccctccctccgcattacatgtacttgatcgtccggccatgttgtgatcaatatattttagcttagtttgagctgtccatgttgtgatggacgccgtcgcagcttgataggaattgctgacgacttatttgttcagacatctgaatatctgaacatctgaatgttcagatagcaagtggtagactggagatagcaacatttgga

SEQ ID NO: 9913 - DNA, 523 bp, Zea mays
gtaaacctgtgcttctacgttgctgttgtactaccacacccacactagtcgtctgtctgtagagccctccctccctccgcattacatgtacttgatcgtccggccatgttgtgatcaatatattttagcttagtttgagctgtccatgttgtgatggacgccgtcgcagcttgataggaattgctgacgacttatttgttcagacatctgaatatctgaacatctgaatgttcagatagcaagtggtagactggagatagcaacatttggaatggaaggatatgcatgcatgggtgagattgaatcttaggacagaaggagggattgtcgcctcaacaaggcaagtcgttatccaacgaactaatcaaagggggatttggtggtgggattgcgacttgttcgtcgtccaacccatctctctctctagaacccttgacgacaagttgggagtccttccaacgcggcggctcctttcgaccaccattgactacatcagacatacatagcttccttgcgtccgtcg

SEQ ID NO: 9914 - DNA, 1500 bp, Zea mays
ccaccagtacacgagtattagtagtacctatccatacttgtacccgtctacttgacaaggtagatgttcttaactattaacatactaacgggtaaaaaaaaacattccatactcgactttatatcgggtattcgggtttttggtatccattgccatatctacttaggccactctcaatgaatatttttatcacactgttttttagactgccatatcaatatttgtgtaggaaacaaggactctagagtttcattcccatgaaactctctcatctcccataaaacttcatttttcttcattaatttgcataccatgtcattctgtttatttagataatatgccatttaggctcgtttgtttgagccaaattcattcaggaatcattttgattgatcaaaacttatataaattagtcacgcaatccagctaggaatcgttttagacaagggattcgtggaaaccgaatgagcccttaataagaatgaaacttccatgatagtggcttagagcaactccaacaattcttttaaaaaactttctaaactcatatttagcaagttgctaaataactatcgagagaaaaaatagtttgatgttcaacgattcctaatatttagggaataatttaattttgatctaattctagcatgcatgctctcgtcgaacctggctggcaacagagtcgagaacataggacattgaagtcagaggataaagccggacgacacgacttgtgggggagcattggtctgacaacacggcctttgggtggtggtggtttaatggtgaagaaaaagcttgtgtcacgtgcgtcatacctagctgtctcgttgcatgggaaaggggaaaaagcacacgtgacctagctaccttgctatgcaagaaaataaaaaaaatgagcatgtaggtatgaagaaatcaacgtcaactatgtttaatgagttactgtctggttgccaaacttaaatagtaaataaggttgataacaaatacctaaatttagggaactattggaggaacatttttatgttcacttcttaaatttaaaaattatttgttgtttagacaattggagttgttcctggccccacatcaacaacacatcgcgtcctgccgtcgtgaccatagcgaaacccacatttcgggcagtatacgctgacagctgactggaggacccgatcacccgactgtacgtcgtagattttggaagctcgtaaaacccacaacgaaaagaccaaataaacccagaaattccacagagagaaaaccaaacgaaccaaacaagcgcaagcgcaaacgcaaacgcaaacgcaaacgcctcccttcttccctccgttcgttccatcgtcgctccctactccggggcgccctccctaggtttcttcctcggatagagctctcgtctagacgtcactgtcctcgcaccgctcccttctccggcatccgagccgtagccctgccctccgcatccacaatttagatgcggagggctcggccgcc

SEQ ID NO: 9915 - DNA, 1500 bp, Zea mays
agccgaacgaggtttttcgccaacaagaagaatgggagtataggacgatagatacaataccgttgatgtttgtttttctttcccgcctgaaatctagattggaatgagaatattaggatctattgaagatgttctcaagggcttgtttgattacagatggattgaggagggttagacatgattaaattttaatctatttaaaatttaatataaaaagatttaatccacacaattccctccaatcatcttgcaaaccaataaggtctgatatggttataatatttttgtgccatgtttaacttgaaattaaaacatcgagcctttttagacttagaccaggccctaactagtggatatagtatcggtcaacgaaagcccgaaagctttctggtgtgtttggaaacaaaatatttttttaagttttaagataaaaccatggtattgaaaaaaacagcatagcatttttttgccaaaaaatgtttggctacattgtaaaaaactttgttttgtataccatgatatttttgtagtatttgaaacttcattccaacctaaagtttttgtctaagactagccttgcacatgtataaaaaatactatggtttaaaataatttgtctccaaacataaattgttacggttatatcataacatcttaaaggtatagtattttaaaatcatgttttgaaatactttgcttacaaacacggtaaacggggcctgatattctctgcaatatagtgcccagtcccggggccgaacgcagttttagcttatgggcctcggcctgttagtgtgtgaacggaatagcggcccagatcaccgccgcgcggtagacatggtcgcgaatcgcgatatcggtgccgccttttcttttcccgtttttataaataaatcagcccgaaaaaaggacgcggtcgtggaccgaacaaacctttccccaaaatttccccttccccgcacaccgaacgaactctcgatctgatccctatccttgcagggcccgcctcggctcaccgatccggccccggatccgctcgtcgctcgacgggatctctcgattggtaccagctttgccccctctctttgattccgtaggttcacgagttagggtttgcttgtgtgggtttcgggcctcgatttgctcaattgaggacggattttgcacggggcgtcggatctatgcgtgtcctgtatgttgtacctaggattgttgccaattctcccgtcaattttgcgtgatttttctggttgtcggatgaggggttagggtttcgttcggtccagaggtgttggactcctattcgcgcattcgttagggcttcatgccgcgatatccgagcctcttgcttgaattagttattgcatgaacattgaacagaaacgttgttatgtaacttactggttatagacggcaattcatctgtgcccttcatcatggtagttgaatatggactgtaattcattattttattctaccctctcagtagtttagacaagc

SEQ ID NO: 9916 - DNA, 1476 bp, Zea mays
tcccttagaaacaaagcaagtaaccaacaagatgagactagccaacatatgtggggagctatggtggcccatacgaagctgggcatggtgctgcttgcagatcgacttacaaaggagatgtcttgtcatagatgaaagcatcatggtcctgttcttgtgggtgaaggtcttgtcatgaccttgctgctgcattttctcttcttcgcttctcatacgatgcaactcttgtcatgcctcaccaatttgttgccgaagatgagcaacctaatgcatcttttacctctgtacctcaacttctcttcagattgcttcgaggttcttgatctgttcatcaacattgtcttatggtgggggttgtattggggccctttctcttctcccacctttagtttgtaacctcaggtggatgaacaacttcgagttgcatgtggtcttttgggttaagaatacctaaaaagcatgttagaagcctataatgactcgttagaaacctaaaatgtcgttagcttggattgaggtgtgttatgttctctattctgaattccagtcatatttgtgaggctattggtagattttgggtaagaatttgatttttgggactttttctgtttcggtcagaatttgaattttagtccttttgtagttcagatcgcctaaattgagtttggcccgtttaaccaataacgtgccagatcgtgtgtcgacggctcaacccataggctggtccggtatggtccataattattgggtgctaggttagtctgaaattgaaacatgttggactattttaagcttaggcgaggctaagtcgtgcgttggactattttaagcttaggcgagactaagtcatgtggcctgaatgtagtcttttattctttgtgttctacggttctagaacatggccatatcacatactatgtgattgtctacttgtaggagtgagtgcagatggctgggcacagtttttatacgtagatacacagcgaacgacagtatggcgcgggcctaattccgactccttttatgcacaaacttgacctaatccaatcataaatgtagccaaccaaacatcacataccaactttttttacatgctacaggtcatgtacacacggaagcaggcaactaataagacggatagtcacgtatattgaccgacaatgcgtactcttgcatgcttatttgatgtttacggtgtaccatcagatgagcagcgaacggtatcaggcgcacggtgtccctctgccgcgaccgtgagtctttgatggaggaataatacctaagcggaccatcgtcgtcccgcctaaacaacccttcccgcgctttctcccgccatttttagcggtggcgggaaccatagataacgaaaaggtacagctccatcttctcaatttgtaacaccagctagcgctgttcatcccatcccatttccaatccgcgccaccacaaacaaagcctcaaaggcgaagagtcgcc

SEQ ID NO: 9917 - DNA, 1500 bp, Zea mays
ttgattttaagagcagaccgaaactttcragtaccatggtcacgaaacaagaccgtaaacttaccatcgagtcgtttaaaaactgtataaaacaaaacaaagtatgaaaatcataaaacttgtctacatgtcatgatatcgtatagaggttgtgataaaaaaattaaaaatatttcataaaagttatcgcacactatatgtagaaacatagtcggtctacatttaagttctatataagctagctaaactggtgcgttcagaaacatataaaaaaagaacagtactttttcttgggggcattcagaaacacatatataagctaaactgcacgcgacaacctgcacaacatgcccaaattttaacacgactctctctctctctcttcggtacgtagttacgtgcctctgcggaaaaaccagaacacgaatatatcagtgcccgtggtattgcatgcacttgttggacataaacaagtcctttgattgttattcgaagaagcgtcgacctgattggtatgccgtagagtattgtttattattcttgtaacgcccatccatttttatcgtgtcaggctgtcactgcttcgtcctcgtctgatctaaatgttcgtatgttacacgagtacgtcaagcgaacatgttatatatggccagcgcgccgtagttattgccagcctgagccgtcgcgtcttcggaagatgtggacagaaccataccacataacgaagagttactggtcatccagcacagcagtatatgtgcaaaaccagacttaccccccacagattctctgaaaaccaaaggcaaagcctcggctgcttctggaactggaacatggaccggggacgtaccggcttgcaatttcacgtcggaaaaagagcggtctgttctgacgagctgagagtagcagtactcgctatgcatgtatatccacacgtgtacgtaatacgtacaccgacgtagtccaacacggagatagacatgccatgcctgcgtgacgcacgcgcgcgaacccggcccggcgacagtgacgggttgaccaacagcgagcggagcgaggccgcgagggaatggaacggtcgttggccgttggggggtaaattaacgggcggggttgacctgactcgcctcgtcgtcgagaaggagaaggagaccttgctggcaagcggccggaaacagtgggcagctcatggttttcccggctcgagtcgagctgcaggcagcagcggagcgtccggccggcccacaggaaagcatgcatagctagatcgcccgacgcaattcgaagcagctgtttgctgtccctgaccggctgaccctgtgtcgaatgtcgatcgatgccgggtagcatactgcgcgcatatatatacacgcacacgaacgcctccattattcatccagatagagttccacgtacgacgtagcagtgatccattcccacgtacgttccagaagaatctgcagcagggagggacgagcagctagctagccatccatccaa

SEQ ID NO: 9918 - DNA, 1363 bp, Zea mays
tggccatggccagaggtgcgtgatgggccggttcaacttgcgtgtgctttcaggcagccgtacgggcccgattccttatcctccccaggtcgcatcgccatgggtggcagtggcctccactgtgcatctgcaatccactgcggaaagagaagaggaacttgttgctctacgcagtacgcactcggtttccctctttggtcccgtcctgtgatgctgatgtgtgccactgtttgggcgtacttgatgccaccatgctcgacatgataggatatttgctgcgtgaatgccatgccccgtcgggcaggtggccatgtctgctatgggtatagtataggagcatgcggtccttagcttttgcgggattccagttccagcagtgcaacatctgttgcttgtcttgtttctgtctcccatttagatttgcggatactttagggaatcgtgattcgaacaatatttcattagagaatgccaaatcatacaagatagaagcattcaaggctcaaatgcagctaccattcccgaaacttttgtgtctaatgacgatgcaagctgccaaagatgtaagtaagagcgttacttgattctttgctcgaatttttttttacttgtaaattgttcgattaacaatgacccaacagagaggtggcaagtgaacaatcaaaagctaggaagactgcgaaatgaagtgttttttttttggaaaagaaatattttgttttatcctcagattgacaaaacgagttggtacataaacttagcccttagaacaacatccaagaatttgtctaagtgacagaaacgagttggtacataaacttaatatttaaaatgttttgagcgggacattcaacttaggttgccatttacgtggccgactaaagatacccttccccgtatattcatttggtaggaaggttttcaatactacagtttttggaatttgcaattgcagatcacataaatatcatggtttcactactcgagttaaatcgtggtgttttctaaaactgtatgttgtttggctgtccggttctattaaaactttacgccagggaggagaagacgctaccgagccaaaaacttccaaaactctaaaaatactgcagttttgaagatactatatctattttttagtattattctgaccagagagtattattctatatatcatgcgaggttaagctacctgctgcaggcttgaaccactggtctgtggccccacagaggttgcctatcactgacgcgtggcccacatgggagtctagcgaatcgggtccgttaatctgcaccggcctctccctcccatccggcgttggcgaagccgcgcgtcgacgagaggggcggagtcggcgacgagcag

SEQ ID NO: 9919 - DNA, 511 bp, Zea mays
tgtcagttttatttcactgtcataaattccaccaccctgaaacatgattattggactttccattttcacttgacatgtgttgcatgttgtctgtcaaatagttaccttttgttctctttacaacactatgtcaccagactgttgcattttgatttatttttccaggtcaaatgaacatggtatacgaaaagcttttaatagccgcaattcaacaacattattctttctgatttaggagaatatattcacttacaaaagacgctttctcctataatttagataccctcaaagcatgcttcatttccaagcaacactttctcctataatttagaattgcaatgataagtgtttgaattcacaggttgttacctgtggaaatttcccccttgaatcctcgttccaaagggtcccgagatgtgtatacacttctactagcttgtatgagtacagaggttgggattccaaagctgccaatacagagcatcggcgttttacctgaggctaaagctca

SEQ ID NO: 9920 - DNA, 941 bp, Zea mays
gaggagatagctcaggacttgctgatctctgccttctcaatcttcatactttatattgtccacctcgatctcttttccatcaccgtctttctagaatattttggccgacgacgccttgatgtcaccagtcagaaaacgcatgtcgtagcacatggttggacttcatcaatttctcgaagatgggtgatccgagaaagagaatccgtgaaggtagatgatgacgatgaagtataaaagccgattttaagaatgctaaataaatgcaatacaatattaaactggatttctaatctatctaaatttgaaccaaaacatctatctaattatataactcctcgttgtatataacactgcgatcgatcggtcgagctgaaggtatacggtcgtccatctctagctcggccgatcgagcgatcggtcctagctagcagcgtgctacggccggtgggtttcttttgttatttattagatgttgaatattgccagtacgggcagcgtgctcgcagccagctcgtggcgcatctggtaggggtactagtggcgatcgattttcttggtctgttctcccagcgagagacggaaggtagcgccgcgcaccaagcggccggtagcttttaacagggacaagcttcctctccctgccctcttttctctctctttgttcttgtctcggccactttgttccctcgccctcttcttttgcgcggcctgtcattcccctggggatcagccttggcgttgcctcatatgggggcgagctgaggagcaaagcggacaacaagaggctttcgatcgatctccctccctatctctctctctctgctatcccttcccctgcttccctcccccctagcttttagtagaaagaggagggccgggacgtggtgacaaggctaggctagcttggggccggcggagatcgatcgtcgtcgtcgacggcc

SEQ ID NO: 9921 - DNA, 413 bp, Zea mays
gttttcgtctcatttctcaccacgagtccagccattcttctctccatttttctctccccacattaaggatccatcactatcctatacattgaccaagcccctcccctacctggctagtaccttcctccagtctctcccaaaccgcgcctgttgagctgtctcacagttaactctgtcattgtttccctttttcttcgttgctaggatccgacacaagagttttagtgatgatctcctcatcaacatctatctccatcacaagaagaaggtgtggacaggaagacgacacaagattcaggcgacactcccaccattgctgctgacggcgtccaaattgtcttctttctcctcctacctggctggctggctctctagatcgaatcacgggtcaggcgctccccctgaccaaggcc

SEQ ID NO: 9922 - DNA, 511 bp, Zea mays
tgcaggcggcgttcaaccatgccgccggtaatgccagcgttctccagagctgtcattgcctgcgacggcgacagcagcgtcgcttttggcaggccggcgaccagcgcctcttcactcttctcgcgtttgtaatgtttgcaaatccacgccacgctttttaacagcgtgtcatccacggtggtttcgatacgagcaacagaacgcgcatcctgctccacggcattctgcttctggtccatcatttcccgactcctgtaaacctgacaaaaaacggtggacgcatcgtccaccgcagacttttctttgaattgggaaaattctgacagaaggcagctttcaggccgtccaggacttgtctcaaacggtggagaatatttgtgaataaagcggagaaagcccgattgaatgcggtctggcgaccgatcgattgcagaataatcgcggcgctgttgagcgctgtcctgggcgtgttatcttagctgctcgctttactgcaaccggacaaagagca

SEQ ID NO: 9923 - DNA, 382 bp, Zea mays
tgtacctatatgccactcagtggcacacaagaaatgagtataaaatctgatagcataccaggaatttttccaagaaaatttttagtagaatacctcctactgacaagaactataaccttgtgtgtgttcctcgttacctaacgtcggactagcttccctctgttcctttctttcaaccactgacatagatcatgtggatcattctttattgtgtccttatccgtaaacatggtaatgacactcataagtgcaatatagtaatcgcagtatgattgtatgaaacttagaggttgtacaagctgtactgacaataagctgggaataccgtaatctttcagctacagctaggacagtaggccacttgtccaagagcactgaagtg

SEQ ID NO: 9924 - DNA, 1342 bp, Zea mays
gatgcttaaataggataatattcgattagtttgtcaagtacaagagagacagagtcagtcaacgatgagttaccactttccaaataaaactgaaatttatatacgctatacatgacagaaatcaattgccacccaaaccaataggccaacataaatcaatctcagatcagtcgatcccacatagtatagtgtgacgtaatgctatttattatttacctacttagttatttattatagttatattcaagttatgttgtcaattatttaactttaacttatgaattattgatcgccataaaaatagatgtatacatatattatccgacctttgaaatctgcttccgccacgcttctgctctgaccgcgcaccatttctgatatcctaaaatatccatatccatatccgcaaacacacaacatttgctccaatccaatttcgatgataaaaataggattaagatatggaaaatgtgttatccgctctgatccgatccgtttgcacccctacatatagcccatgttaaagatatgattttgaagaggggaagggttgacggcggcgacacgagtgaggggaggagcggtggggatgggggaggctgggggcgacaggggtcgcgggagagtgagataatggatgatccaaataatagtgaccttgtttggctggcttcgtggcaacaacattgttcctggacttcaccattactacaatgtatttgtgtctgcacatgtcgccagcagcagcacgggcggttggcttaaagccagccgaacagcttgtagtgtccattgaatttgagttagtacgagatagatgattatctagcgatcgatggtgtgttagatctctatgtaacttgtttggtgaatttagtacatgttgagtgtagggtgatttagttagggcaacgattaatatgcaagaaggtattagatgcaagcaagcaagcagtaattttgatccattaaatctagatccaatagtatgtcatatttagcacttaaacctttctaccaccacctgatatagttttataaaaaaatttctaacaaaccacaattatatttaccgttgaatataaatctaacgaactaaaaagtctgtttgcatgcttgtacctacttgcatattagtggttgactttatttagacaagttttttaaaatttaaatggattatatagcggtatagaaaagaagcaatttaataaaaatggcaaaactgcattgccaatgggagtcagagggccgaaaccctaactcgtccacttttcaaatccacattccccccttatgcctctcacccgtcacccctcgccgtctccggcgagacccggaa

SEQ ID NO: 9925 - DNA, 109 bp, Zea mays
attttttccccttttctgttttctataaattcctccaaacctctcactgtttcattcatctcaaaaccttaaacaacaacacaacagcagcaccaaacatatcaaacta

SEQ ID NO: 9926 - DNA, 235 bp, Zea mays
atgcgctagctggcgaatcacactactgcttcgacttcgagtagtggcaggggcaggtggtgtaatactgtaatgtaagatgaggacgcgcgccacgtgccgtcccattggagagcgtacatgtggtgggcgatcacacacctgatgtggacagagggatgtgttggtggtagccggtaggccaacatgtatacgctctgcgatgcacttgtacgcacgttacgtagcatgaatc

SEQ ID NO: 9927 - DNA, 1500 bp, Zea mays
gtggagggcgggtcggtgcaggacagyagcaggcctagctagagctgcaggctgcagcaagcaagcaagcaacggcgaggcaggctgggttgatttattcgtacgagtgacatgagcagtagcagattcgccagcgttctaccaagaaagtccgcgctgacttaatgcagactactgagaatgccaaagtcctactgactatttaaagcgactagctagtcaactggagagaagaggaaccaacgacgacgacgactctctttatctgataccaatgttttcgccatggccgtggctgtggctaagtagccaaggatgtacaattgatgaagaaagtgatccggccggcagcagcaccagcaccaagtggaaggagtggctaatgaggacggatgaggcgcgatagtgaatgcctatctcctgcactgcactaccatggatccatagatacaacataccactcgatcggggtagcaaaaggaccgctgtatctcaaaccatagaacatgctgttagatgaagacttttacttgaaagggcctgtcattcttcaactaaccaactccttccacttttactccgctgaatgcctatctcctgcactagcacttttactcgatcgcgtgtagacctgtcattctttgtctagactttgtccaactcaggtacacagacatactacgtagacaatgtcatacctaggaagattatgcaatattcaatagaaacaagattcctgcctttgttgtctaattgctcgatgcagagaagtttatgcgggggagtaactgtctgcaacattgaaagcaaaggctgaattcaatacatcggtcactgaggcattggtgaagtcccaatcctggccatagtaaaaggtcacaactgtagacctgctcattctttgtctagcctttgtcaattcaaggtacacatactacgtagtagacggtgtcatacctaggaagattaagcaaggtccaataaaaaagattccggtctatgttggctatttgctgaagttcatgttcacgcatgaagtaaactgtctgcaacattaaatgcatcgtaacttctgagattgtgccaagaatccttctgattacaaaagaatgtttgcaaggctaagaaacgagaaacgacagatatactacggcaatgtcactgtatggattatggaagaaccgcaaaaacaaacattttgacaaattctgtatggcggctacagaatgggtactgaagaatttagactttcaatagagaaacaagtttcaaagacgtcctgaactgggatcacatagtcaaccgtctgctacattcggccttgccgtcccctacagaaagtcagagatagatgtccccattcccagctaactggtactcacgtacacgccacagaaagtcaaagattagatgccacccaaccgccagggcactcttgatcaacacatgcgctataagtgacccacccatctttcctctgtgcatctttgccaagcagcc

SEQ ID NO: 9928 - DNA, 1500 bp, Zea mays
gtatgttgtatctatggatccatggtagtgcagtgcaggagataggcattcactatcgcgcctcatccgtcctcattagccactccttccacttggtgctggtgctgctgccggccggatcactttcttcatcaattgtacatccttggctacttagccacagccacggccatggcgaaaacattggtatcagataaagagagtcgtcgtcgtcgttggttcctcttctctccagttgactagctagtcgctttaaatagtcagtaggactttggcattctcagtagtctgcattaagtcagcgcggactttcttggtagaacgctggcgaatctgctactgctcatgtcactcgtacgaataaatcaacccagcctgcctcgccgttgcttgcttgcttgctgcagcctgcagctctagctaggcctgctrctgtcctgcaccgacccgccctccacggcatcggcccggcctggcccggcccggccccgcccgcaaagtggcagcccgtaccaggtgtcgctcttgggccgtgttgttgccgtccaaccaagcaaggcaagcgtgtagatagataagaagatagcgtgagtgagtggcatccagacatccagtacgttagcctggcttacgttacggacacgggcgtggcgcctttgtcgtgctgcgcacccgccagccagcagccatccagcagggcctccgtttgtccgtctcctctctctacaggctgttygtgcccccaagcaagcactacgcgcgcgaaaaaaaataaaaaaaaaaggcacgtcatctggatctcttgctctagctcactcaacctcaccaaaatgtgcaggctgctccgactccgagaacaggacggtcatgccgcgcgcaccggtttcccttcccatgccgctaccacctcccgactcccgagtcacgactgggggaccacccgatggacgatgattgatgcactgaaagcaagagtgggttggtggtggaccgtggcagtctaccaaatgtcgctgctctccccgcccggccggaacgaggaaggaaggcgaccaccactccacgccggtcgtgccaggtcggcagtcagagtcagccgcgcctgcgcgcgtccctttcccaccaacccctctccctccccgcactcgacagccacggccgcgacggcgtccgcgtgcaccggacaccacggccagacccgaggccacacagccctctgaccaaacgcacggatccggccagccacccaccccgcccccctagcggccgccacccacccgtgcgcgcggcgcaccaaggcctggcccggcagtggcagccaggctctcacacgcctcgcctagtcgccttgccgccgcgcgttatataagagccgccccggcaggcacggtcggtcaatccagcaatacccgacgcgcaagccagtgccgcacccagaccagatctccgcgacatatcagtcgttcgtccagctaactgcactgcactgcactgcacgca

SEQ ID NO: 9929 - DNA, 272 bp, Zea mays
agaagatgtttcacggccgctctggggggtgagtactttggatctgaccatgtcgatcgatccatcaaaggcattggagtgagatctttcaagtactcgtcccaaggccttccaaaacttgcacactgcaccatgagattaattaagtcataagactgtttgtttaagttaaccatgcatgagcagaccaggccagaccacatatacttacaaataataactgtcttcgatgagatgcactagacatagctacgaactgtacgtttttctct

SEQ ID NO: 9930 - DNA, 354 bp, Zea mays
taatatagagtaatgaatcttgatgactagactaaaaatattgaaaaggtattaagtaacatgtgctgcggatagcttaaagatcgaattagttacaagtgggcagacatgatttttttagaagaatagcaaaaataaaaagaattccagaataacagtactctttacttgggatccacatgttacggatagcgcaaacgaccactcactccgagaggagtaacaaacatgctcaagaaagtcaaaaccagatctggagttctgcaccgcaccctctcactcatcgacccccgccgtagtagatggctagatgccaaaatcccaaatcccttgtgaacctcctaaacctaagcg

SEQ ID NO: 9931 - DNA, 798 bp, Zea mays
gtacccttgggcaatgttagtcaaagtttatcggcttatgtgattaagtttaacaatttttcacctatgttctttaatcagtttcctaaacatagatagtggcatatctctaaccatggtaccggtatagttttttgaacagtaatagtacgcttaaaatggaagaattataatgatacagaactaatagccctagtatcaaagaaagatgattttctattgttgataatgttatgttaattaagtagggacacgcacttgcaccaacacatctagcttgtcaatttcaaccgtgtgtgtcattttctgtacgatgcaactgggtttagaacgattgtcactaaactgacacaacatccatgcatggtcatgctatgtctaaaaaattctcttaaaacgatccatatgtgaaattgtaggtatcaacaattaatataaaactggcagcagaataaatgtcaaacccgggcgcgtgttgtcaatcggaaaaaagaaacaaaaatgtcctttctgtgaattaaatggacgcttgtacgtacgcccacacctccgtctcttaattttcttcttctttgaaactgtggtacatgctgcaccctgcaaatcgtcttgatggtcagtaagtacaacttgacgttcttgttttgaaacgtggaattggatgccgtgctatctcattagtttcakgaaaaaaatactagtgcatgcctttctctatcggagatgaaaactgttacaagaagctgtgtgctggtgaatatgtttttacgaaattagcgtacactgacttgaaatgaa

SEQ ID NO: 9932 - DNA, 539 bp, Zea mays
tacccctgtaaaagtcaattttttttatttttgatgttacccctaaaagtcaagatccaaaaacatgtttcactaatctaggttactgagggcaaaacaacagtgagcaagcctccaacagagtcgagaaataacacttaaaaaccaagtgttgtatagactcatctaaatcatagaacatacatttttattgccataccaattacgtctagctagtgtttatctaagtgtattataaaataaaaaactaaactatcctgtggttttgaaaggaggagcgagggagtacatttgtagaaagcaacagcaccataatgttagatatgagcaccagatctacctacgcaattcatactcgttgttttgtcggccggaagaagtgggggtggtgccggccatcttgtgtcacgctgtcatgcatattattaaagaggctaaatgccgatattccgtgtaacccaccatatctataaatacaagctctgcagactactctcccaactcccaaaaccagaattaattatctgacggtgcatgtc

SEQ ID NO: 9933 - DNA, 799 bp, Zea mays
acataccgtagacggtccgtagagaggtttcccaagatctcgttcctcacgagtgggatctaaggatagtaaatgcttgtcccgaaagggtgccaacacaagttctatgtagtattagcaaccgaatatatgtaaaaattatagcagtaattcatgcagctgtggttctgccgtgctggtgcaataggaagaagaaaagttatacactgatgagaaccaaatacaagaacatgccaatatgctgtccgctagagctctattcactgttcagcgcggggacttcaaaactgttgaacgcacatgccacatgcatgcatgcagagtgtgctgaaagggtaagggacaatacatccatgcaggcaaactcgtcgtgtgcccgttctcggcatctagttaccacttagcagttgcagtagtcgttgtagctagtaggacttgtacatccagcacggttggttgttagaatccttggaacagtcaaacacaaaagttaataacgatggagaagcgcggcggccggttcaaagttcaatcactcccaccaaccatttcttagcccccgcgcgcttcgtacgtactcctatataaaccgcacggcacgagtgcatcagaacgtacaccccaaggcgccaaagcaaagcaaggaaaaggaaagcaacaaggaggactcacgcagtacgcgcgagacctcgagcttgctcaagtccttgcttatctttcttgctgcaaatagcctgaagtcggtccgcgaaaggacgaccgcaccagctagcattcgttaccttcagcttggacagca

SEQ ID NO: 9934 - DNA, 622 bp, Zea mays
tatatatatatatatatatatatatatatatatatatatatatatatatatatatatatatatatatatatatatattagtttggcttaatacgttgtctagagtattaaaatgaataaaggagatgagagataatatctctctatatataaagaggaaaatcctatctaaatataagaaaagtgacaatttagggtcgctgcatgagtgtgtcagggaataatgatcgaggcaagctagagcagagagagaataaaaaagaagtcggccctggcccattgaagatatgtacagtatacgtgtagtagtgaacatggtgggggttgtagttgtagtgcacttgtcctcgttagatgagcagtagaagcctatatactctttctgaattttacaatctttaactttaataattctgcctctttgattttttgcaatgacccatcccaagctttgtggggggtgactggtgacatacctgcaaccatggcactatataacagagatggtctcctctccctgcgtcgtgaggccgtgccggactaagaagaccgacgactcactcacaaccaattagctcaagatcgagctatagagagaaaagctaagatcgaaacatatacca

SEQ ID NO: 9935 - DNA, 97 bp, Zea mays
gtcgtctcctccagtcgcagtccctcctccccctcgtctccgccccaactctctccagtctcctcgcgtcggcagtcggcctggcagggctgaatca

SEQ ID NO: 9936 - DNA, 67 bp, Zea mays
tgtacgtgtctcccgtctgtgaaaaatttatgatcccgaggatgagtataagcttttccatgctcat

SEQ ID NO: 9937 - DNA, 1500 bp, Zea mays
ttttttatgtcacatcatcaacatttcatcccctacttttttatctcccgcagcggttccccctatattctctccctataccacactacaactatgaaatatcactatccaaccctacttatcatttattaccttttttcacctattaaaaactcaccgtacgcatgaatagtgaatagagggggtggctgcttcacgctggctatggcggtgcactgtttaaatctgctgcctaaggctgcccgcagtggttactggacgccctacgctatgggcgatgcagtcacaggatgcagtaaaaacaagctgcagcggtagactcgaaatccatccctaccgtatagttgcttgtctctcacctcacatccagcgtcctctctctcctaccctatcttctctctcgaggcccacggtggtgcggagtggtgacagcaaaggagtgggtggtgggacccacggtgggtattttggatatatattgataaaaaatgtggtagtttgtatagagttgagatatagagtagttgtggatgcgggagtttggctactgtattttaaaatattgatgactaagataaaatattttttttagagtagaaatttagagtagaatgagtgtggacagcctaaggggtcctgcaggggatgacgttgcaggcttagggggcttctgtagccgccagatcaaggagaggggggctgcctcgcggacgcggctgcggacagcctcaactcaagcaatggcgtggcaaagtactgcagcaggcagcaggcagcaacggcaaggccgcagcatatccgtagcaacgctgcagtactttagtcacttctcaccgtcaccggaaaccaatcgccctcctccccacgcctgtggacccaaaaaaaatcaattcgattttctctcttccgttctccccacacaagaattgacctccgttttattgccgctcatctcaatctaatctctctctctagcccccccaatcgccagatcacagagagaggggaagagcgtgaggaggagggacgagaaaagccgagctgtatagcgagtaagttcagttcagctgagctctgttctgcttttgtcttcctctctcgctggatctactactcccaccactgcctctgcctcggcctcgttgctgctggctgcgtgcgtgactgcgtgcctttgcccaaagcaagcctgcctgctcggtggctcgcttcggttgcagctgcagtgacctcacgctgcttctatgcttgctctcccaccatgtggtggtggtcttcgcgctccaactaacccccaccagcagcacatcacaccaccgcatcgcaccgcgatgccaaccctggtggcgtcacgcggcccggcagcttcttccgcgcgccgcattgcaatgccgccaccaccgctggacggacccgtgaaagagtagttagctagctagctggctagctggcccagcggcagcgggcgaggcgaagggagcggaggtcgttcttgcagac

SEQ ID NO: 9938 - DNA, 765 bp, Zea mays
aacttatctcctttccaaagcactaactcactcttgattagggattaaccattttattttggggcttacaaagttttcagagcaaatggattccaaacagcctcaaacctttaccacacaaatatccttataacaagtctctcaaaaaatttccataatttttggtgttatattcttatctctaaaattcaaataggccttccaagagcactatttaatcgcctaaaatttggtaaccgccctaaaaatcttaaaaccaactctaatacgaagctcctgattttaggtatccaaaacaattggtctcactatttgggatgcaattctcgggtgagggaaggcttcgctcgctcgctcaaaaagctctaacgctcgtttacgagcggagtgcataagcccttattgaagtagggcgaggccttactacacgagctcgtaagtaaagcacggaacgagccttgtctacgaagcttcgcttcatcatcttgcttgcttctgccgaagcttaacgcactataacataggcatgcatgatggtatggtaggaagactccttttaaggccgaccactacataggagtgataggaagccaagccgtcaaaaggaaaggcgagcagcccttattgcaatagcaaacggcctacttatagccctatttataccctttattggggacgggccttacaagctcaataaattgcaattcttcaccttttcctcagacagtgggaatgaattttcttacttgattgacattgacagat

SEQ ID NO: 9939 - DNA, 206 bp, Zea mays
cggattgtccgggattcttgtgaataagcaaagacttagctgaggaacggtggtgcggtgcaggcccgcaggggcacctgtatacggcggttttcggggcgtgcggctgaatgcggaatatacattcccgcacaaatctattttagaatcgcgcttgatcctgtagttttcatccagcatccgccgtttatccagagagccctgcc

SEQ ID NO: 9940 - DNA, 556 bp, Zea mays
ccacgcatgcaatgcaagagagtagtatgtaagcttgatcaacgggacagcgacccccctcgaaggcaccctcgtacgtcctggcaagcatgtatggaatatgccttgcacatattcttggatgttttcggagatatagctcatagccgtctctgacgctttacttttactccttgtctgaagaatgattctcccctgtgtcaccgggccacggttggttcagacttcaggctggagactaacaaaccttgttcagtcacgttgacgttgcgcgccgtaccatcaatccgctcaccttcccttccccctcaccgacccgacctccatgcatggcatatgccgtgagatattccattccggcgtactaaacccaccttgcagttgcactcattaattctccattcattcagtctcgactgcatcttccccccactgcccattcgcctcgctcttgcataagatatcttctgtccagctagaacatcctagagctagctgttgcatgcgttgatcgagccaccaccagctagcattgtgatcgagggaacaagaagag

SEQ ID NO: 9941 - DNA, 509 bp, Zea mays
ggtctttgtaattttgaaaaaaagaaagtatcctctagttaatgtagtctctgatcaaatgcacaaaatcatgactcctatattccatagaaacaaaaccataaattaataaatattttcccagcacttgatgccatcatgtaacactgctacaaatatctttcatggcatagctttcccagcattgctttccaatacgtccaggtatagtttargcaaggtcgaccatttacatggcccaagtttgtttaccatctgagtaatggccccgactttcttaaaaaaaagaaataataaaagagtcatgtggcatataatataattcagtaaaataaccaaaatgacatttgtaaaggtatgcagatggtaaacaaaaataaaaaaacacgacattgccaaaatggtttcaatatatcacatatgcagatcttatttaaatagaataattgtttaaacatacttcaaaattagtctccaaaacggtttcatgtgtattgaagtggacaaaa

SEQ ID NO: 9942 - DNA, 1320 bp, Zea mays
cgccgccgggttttacgctaacggcatcgaatccattattattttttccagttaataataaagatcatcaggataagttggatcgggagacagacacagacccatgcatgcgatctcgccacccagcagctttgatttgatgatcacaaattcacaatccgcgacttcctcattccatataatctccgatcgacgtccccaaaccatggcggctgcggctctaggctacccatgattccccgaccgcctcggactccgggctcaagacgcgccggcccgtccacgcgcatcgtcatgtggcgtggcccgctgcgtctgcgtgggtgtggaagctacaaagacgcaacgcgcccgagggcaagctgggcgcagtttgcgccgcgcccgtgccgtgccttccgcgggcgtcgctgctcgtgatcgcgacgcgagggctttgtttgtggtatgatccccgcacgcgcgtctccagcagcccccgcgcaacgggccgggggcggacagggggatcgaccaggcggatcgatccgcttatagctccggccgcgggcaggggagaaacggagatgagaggggccgcgcgagaggatgcccgcccacgcgcgcgtggaagacgctgcctcctatatataccaggagggctcgcgcatccgcccaggcgcgcacccttcgttttccccagatcgacgaacaacggaccaagtcagggcgggctgcctccgattcgtctcgtcgcgagtcgacgacgacccttgcggatcggccggctctgcatctcgtcgactttgtaacaggatcgctgcacgtacggcattcggcatcacgatctcgtgaaagatcgtgaggttagtcgtctatccatgctctcgctcccaccgtgaaaggttgccctgcgcgtttattattagggctagagatttccgccgagatagtttcgttttcgaataatcaatccttttctcttcatatgtttttctgtgcaaactaaaattgtcgaacaaaaaaaagattgatttgatctgttcttctcggactattcgccattgaatcattgatcgattttgttgatctctattacaactgaggtaatggatcatgatctaaatatttctttataagttgttaaatatctaaattattttttattcaaaaatggatagaaatatgatccgatcctaattcgattcgattcttaaattttatagtgtaaatatgatcattgtccctcctaattacaacatgcttgttctcaaattcatgttctctactttattttaggcattctcctgaagttattaggctcagttggactgtgaacag

SEQ ID NO: 9943 - DNA, 96 bp, Zea mays
cgtaagttacccttccagtcggaaatcctgatttcaattttcaacaaacatagatgcattagcatgtgacaagcccaagttcccctgcagattgag

SEQ ID NO: 9944 - DNA, 1104 bp, Zea mays
cttttctcaagcatgaaaaatggtcgctgttgtacttggcatccatccatccatccatccatccatccaataggcggtccccatgttgagctcacactcacagcagcacaaatcttttgttgccccattgcttgccagatctgtgtggcagtgtgaaagtaagaggcggcctatgcgttgtaaccggcccatcatgggtcgtgcatcggtgggggccatttgactctcgtgctcgcctccgtgtgcgagtcagccccacttgattttttgtgctcccggccccgggcttgttcgtttcctccgtttggccccccgaaaacgctcccaagaaaacgcagcttttccgcggtttcacgctggttgggtttccatggccagacacccagactgcgcttctcttcggcggtgcacgacgccgtctctttcatctgccccggcgaggccagccagatagagcgctagctgctgctgggcttccctcgtagactagctcgctccacatgtcccctccccgctttattatctgccagcctctcgagctctctcgcacctctccctcctcgcccattcttccgccctcttcgtgagtccttcccctaggcgctactcgtctgctctcctctcttctttttagtagctcgctcgccaggccgccaagccacatgcagcatgtggcggagcgcaagtagatagctgctgcgtcttcctggcctgagggtttcggattcatcagccgggccgccggggtcgccatcgccgccgttgggacggcggcggcggagtttggcgtcgagttcttcagagggttaggttaggtgcacgcgtctctcgcgttcctccttcccaactcgaattcctttctttccatacccgtccccatgacgttcgttcttccatgattcccttccatatttgctccagccaggccatccgcgggctgcgtggctgcgctcctgctattttaatgcctgccttctctccctctcacgcctcataaaaaaaactaataattccttgggatctgaggggatccgcgtggggttggtaggatcgcgggcagagattttagccaggactggaggaaaaccagtccgctctctctcc

SEQ ID NO: 9945 - DNA, 576 bp, Zea mays
gcatgcctgcaggtcgacttagggaccccctgatctgtctgcatgagcctacatggtcaaataactcaagcatgaagatgaaaactgttagctgtatgctgtttctcaaatacaaaatatttagtgacatatttttttccaaataaattatcttactagcaattggctgatgttgtacagttcctaattaataattacattttttctgaaactttgttggaccctgctaatagaaggatgcagggcaggacatatcttttgtctagcttgttcagtagcctaaactgtcataccatccgcggttgtgcttcccaattgttaacttatctgtcatttttttagcaatgctagtcgaaggtattattgactactgcttgtgttgtattccattataaatgaaacagctcaatctgatggttgtaaacatgatgcttgcattttaactagctactactgttattttacagctttacgcctctcttttcatagatggatttcgtttgctgctaaattctgagtctgctatatattttcctttccaaagcatttcatggtcgatatttcaggtatcccacc

SEQ ID NO: 9946 - DNA, 683 bp, Zea mays
tacacgtgaattggggttaatattagagtatccaaacaaagtctgtatataaagaacctctacaccccttataataaaatgcagacagaaagaggttagatactcaatcctacatgtgtcttgtgtatttctctgtgtatgtggtttgttgggaagagaacgactttgtacgacttctggtggctctaccgcgtacgggagaaaaaggacagggaaacgaaaaaaagtaatgattttttactggttctgcaaaacttgtcttgtgcctcttgttcgtgtgctctgggctcgtcctgataaatttcttttagcaaatcttgtcggatcgccggtcaccgggccgtcccactgccccagcccagacagacgttacggcagccgaacgcggtccgcgaggcccagttccgtactgtttgtatctcaggagtgtatggcccacataactcacggcccatagctcttcgcctctttccccttcccctgcctctactaaagaaacgcccgacggcagcctccgcttcctcctacagcttcacacttccccagcagagcaggcaaaccgctcccagtcccagtctctcacctgaggtgactggcgtctcttgtcgcaagccgccagaagcttcggcccctgacgcgtgggggccccgtccgcccccgcccccgtccccacgttgccggcc

SEQ ID NO: 9947 - DNA, 241 bp, Zea mays
aaaagcaaataaagaaaccctcacgacttactaggagttcttcgcagtgcaccacagcagacccagatctcaacgcgccccttcagatcccaattcccagatgccctcgccgtcgtagctgcaccccgaccccgcgcgctcgctcggatccatgggcggggtcagggcagcatcgccatcaggcgcaggatccggagccgtcgcgggggcgggatccgatcacggggcgccgcgactggct

SEQ ID NO: 9948 - DNA, 1500 bp, Zea mays
gtcgctggatagtgcaaaattgcactatccatcgacttataaaaagaaacggagggagtaacagaaatcatgtacccacaaaagctaaacataaccataagcaagcagcggaaggttcaccgcctcatatccaggaatattagatacataccataaattgtccgcccttaatttctgactgatgtggaaaaaaaaaatcttagttcttgttatacctcctattctcattgtgtaccgaatgtatcagtcttgaatgtatcagcaggcacaaatgagaaaagtgatgttgagaggcacaatatcaagacccagtagcacaagacacgattaataaaatttaacaccccctaaactgagacaatatcctaacaaaacacgaagggagggggttcatatggtaccgaaacaaacaacgaagttaagcagcggaggtgacgggacatgggaacgttcaagagtgcggccgacaccacagcggtcagcggggcatggacagacagagaaagcaagtatccaccgccgtaccatttgcatgcacggatgacggaaactcatccaccacacgcggaagcacggaatgcacgtacgcacgcaacggccgtccccgtactggtcctggtcctggcatggcaggcggtcaaaccgacccatcagaattcagaagcaytgcaccgctgccggcccatggaycggtgtgtgtcgcccgagtttatttgggccctcaacccgcagcctgcgcatgcatgcatggtaggctagcagcagacagacatccgcgccgccgtgtcgggtacatacctgcctgcccagcccggccgagccgcgttcaatttgacgacgacatgctgccgctgcgcacacgttacttgggccgtgatggcgggtgacgcggaccgcggtcccatgggccagcaggtgggtgtgggcggcgcggcggatgagccgacaggggcggagacccaacttttttggattttagccttttttgagttttttttgcacaactatgccctttacagtttcatttcaaaaaatggaccccaacctcggcgccaatgatgacgacgccgaggtaagggtccattttttgaaatgaaactacaaagggcataattgtgcaaaagaaaccccaaaaggactaaaatgcaaaaaagttggggattttgacttgctatggatttccgactcaatcccacccaatccacgtggattaacgcaaaaacgaactagccctcacgtggattcagtggattcagatgaaaacaaacgtgccctgagtttgattggtgtggaatatctggtatctgaaaaataaataaaataaaataaattggagaaaaagagaacaaccgagcaagtccgtcagacataaacaattcgtgtgactgaggcccgtcacatgtggaggtcaaatccacgtgtttgcgtggaattgcgatagtcgcacagagcacttttgctaaatcgctagttcgtttcctaaaccctagcaaagtagga

SEQ ID NO: 9949 - DNA, 130 bp, Zea mays
ccttccaccacccaccggccaccaccctccgcgcttgcctagttgccttgactgcctgcctcgtcttaccaccaagctaagctagcgcgttccttccttttttcctccctcgcttcctgttgctcggtcc

SEQ ID NO: 9950 - DNA, 220 bp, Zea mays
ggtaaatggggacagcagagtaatacctgtttacgcagctccaagcgctgtcacctttccgttttggcgattggctgtcgtctgcgtctccagaacagagaaaccaacgccatggcctccatttcgtcgaatcccgtccgctcttcgtctacaatggcaattatctccccctgcagtcttggacgcagggaatacttgaaaccccggctcccgatggatc

SEQ ID NO: 9951 - DNA, 521 bp, Zea mays
gtggatctcaggatgaatttaatcttctatgattatatgtctaaaatggtttaaactgtttgaagaacaacgttcaggggtctgggataaaggccgataaaaaagcttgttcctattgcccaattgttgtctgagaaaacctctgttatcatgatgattactagtttagggaatgacacatatatactttagtatatttatatgttgcttgagcagctcattttctatcttccgtattttctgtaactgtgaacatgttgttacagaaggggtgtatttgcaaaaaaatcttagagccgtctctccgtgaagagacgcctctgactcgtaaaccaagtagtaacagacgcctcacttcctactgtacgaatttgtcgtctgttctatcgatctgctgctgtacaaatgcatttaattctgtatttattagtagactacatttatagacactccattgtataatagagtctcttagttgtctcttgtgtttggagaaccgttttggtgtctctccactgtac

SEQ ID NO: 9952 - DNA, 247 bp, Zea mays
gtttttaatgagtgaggtttgggatagcaaattcggcgggtttgtacccgttgtcatctctacccgaaccgaaccgtataaagacggtcacgcactgtataaagacggtcggattggactcgtaccggattaaaaaacgtgcttcagctgggctttcggggttacatcaatatttctcttcctccacttcccatcctgttcgtgactcgtgatttcgccgccggaaagccgagggagagggagcgag

SEQ ID NO: 9953 - DNA, 78 bp, Zea mays
ccaacatgggtacagctgatataaaaagccacatttggaaaaggccagaagcatgaactaaatgtatccacttatcag

SEQ ID NO: 9954 - DNA, 225 bp, Zea mays
ggtgtgtgatttaaattgggtctttgagttgttttaataacaacctaaaatattttagtttgtgaactgtaataaattgtaacctgggcctgatgccatgtctctggttgtctacatagtgtatggcgatgatgacaaagccaaggcttgtttcttgacatttgcagtagccacccaagagctttctccctgctaggcttgagagctagtcctgctaattccttc

SEQ ID NO: 9955 - DNA, 896 bp, Zea mays
ggtgtgtgatttaaattgggtctttgagttgttttaataacaacctaaaatattttagtttgtgaactgtaataaattgtaacctgggcctgatgccatgtctctggttgtctacatagtgtatggcgatgatgacaaagccaaggcttgtttcttgacatttgcagtagccacccaagagctttctccctgctaggcttgagagctagtcctgctaattccttcatgggatgtctgagccatacatatttctattttttagatttcaattgcaagtaatgttcaaatcagggcttgtttctctatattcgcagttgctgttgttgctattgttgtgtaacctgcaactagcagccctcaatctttatcacaggatatattcatcgtagtaatccagcaacactatttttatatagcaacttgtttgtcacttgccaaagaaagttattagtcaaagggagggtttactatgtgttgataatgggcatttggctgtgcgtcactattttcatatagctatctctgtagccaaagttttagacctactacatgtacctttttttgttgtttctacacttgaaagattaaatgcctgtttggttcatgtctaactatgccacactttgcttaaatgcctgcaatttttatttcctaaatatgtctttttatgttaatttgaatacgctattacgcccaattactagatcgcgcatatgctccgctttgtaaacacgtagaccaccaatcctacattccagggtttcaagttgaccaaacagagtggatacagtcatgctcaaagttggcaagctgtgtcaacaagcaggccccatctgctactcgcttcatgggcatgcaacaaagccttggtattcagccgacgcagcttgggaagg

SEQ ID NO: 9956 - DNA, 62 bp, Zea mays
ggtaccttgccggatgatgtagcctttgctactgtgttgcaggcatcagcgtgtatgtcggc

SEQ ID NO: 9957 - DNA, 822 bp, Zea mays
tcaactagttctaaaaataaatttagttccctcgatcacttacaaacgatttaaatatatacaattttaataaaaaggagaaactaaatcaagtggagttgctcaatttcgaatgacactcgaggcacagttttagtttaaagcagcttaattcatcttcattatgaagttctacgatgcagtaccatgtactgtgctctggaaggttttcttaacatagaagaaagcatggtttgcaacgaatacaaatacggcacatgtcataacgtcgacctctacggcagaatgtaagaatgacatgatccgttacatcatcgcaaatcagatcgcgttgggtacgtacaagaaaaagtaagatcactttaccagttgtacatacgtgacaattaattgggcttagcggtatctgcaagccagcgattcgagcgtgcaagtcagtctaatttaaatccaactaacttttatctttcttgacgacaatttataaattttgtaccttttagtttctgtaaagaaatcgagggcaattcaaaattcagtttcaaactaacgaccgccacgaggacgaggtagggtgatggtccgctgtaggaccgaaaacgaacagcggaaaaaccaggagcgccacgagggccgggcctagtgacaactcagcaaacgagccgtytgcctgtctcttctgtcttctcccaatcctgtccatttcaattcaagcacgcacccgaggaaaagcgccccattgaacagaagcaaccaacccaggccaacccgaaccccagaccaaactgcccccttccgcctcgccgccggcgatcgcctgag

SEQ ID NO: 9958 - DNA, 517 bp, Zea mays
atatgatgaactttgctctagtggctgatttgtttcggattaaaaccgggttcagaatggatcatgcacatacatgtgacaacaacaacaacaacaacaacaagaagctggtaaatggaaatggatcctgaacaggtaaaaacacaatgcaatgcaatgcaagcgcacaaggaaaggaaccgacgacatgctcagctcagctctgctctactagctagttgtgaatggcggcgatgcggtcgcacttggccttgacccatcggatgccccggcggatggacgccttcaccttgccttccaccgcgtacgccttgtagctggccacccgcctccgccgcttcatctccgccgggtcgccgccaacacccagcacgctccacgcggccaaccacttcccacccgccttcaccttacgctgctgatcctcgccggcgacgtggtagggccggtacgacggcgccattccttcttcctcgacctcctgagctccttggactagagaagggagtggatttgg

SEQ ID NO: 9959 - DNA, 170 bp, Zea mays
ctgtttgctctttgccagtggctcggcccatccctcgccggttagcaacgcgcagcgaaagtccctgccgcctaaaaccctagcccccgcctctacctccgctgctcgccttcccctctcagtctctcacacgcagccgcacgccaatacttagccttcagacgcctaaa

SEQ ID NO: 9960 - DNA, 544 bp, Zea mays
gagctattacttatgtccaacgttaacctgaaaatgatgtgctgtaaatatttcaatactcaacttctattgttggggttaccattttggtagaaggatacctgctttgttttctaatcattttagtttcttcatcttggagttattcctgtaactttctgttcttcctggaatatgtaaagtttcacattccatcagtgaatgcgataggtgactcctcactttgctatgagctccaacgcccacgaaacaggatcattcggtgaggcaatacaacaaacaggtggctggcacacatgggtatcacacaacacatgcactggagcatgagggactcaccggaaaggccatcccggtggtgtctgcctccagccgcgcctagaggtcgccgtagaactggtactggccgacatcgcctcctcccagtttcctcccgtctccctcacagaaacgactcgcggttcctcgttgcactctcccttgagaaaaaacctttgaaggaggtttcgatcgcgaaaccgcccagggcccgccccgcaagtgc

SEQ ID NO: 9961 - DNA, 1500 bp, Zea mays
ctttatccctacctactaagatgactccagtgtaagggtatgatgtcgttagcttgagagcatctaacctaggatcaacctccaaaatgttataaactcttatttttattatgcaagagatttgatatgttacatgaacctcagattccacccgctaagatttaatcaccctattttgtaatcatgtttttggagtcctgcccgagttcatgctttgagtcgtggtgtagagacggtctagatagagatagagaaaacaaaaacatgtgaagcagcagcccttactacaaaactataatttaataaagaaaataattaaataacgtagatggagaaaagaaaatatgcttggctaaacatagcaagcaagggctgcaaggcgaaggcgacaaccggcaaacatacgggacatcgtgatggggacatctcatcggtataaagggcacaacaaaattattcagattgagattctagtttacatgttcgttggctattggatcattagaagaatattatgaatttgtaccgaatttgattgcacagcagcaaccacggtttattgaacaaaaaaaacgatctccattcccacccgaatcagtgagcagcactggccctagtatcttttaattttatgtcaatagatgatcgctttgtcaagcagtactagtgacctctcattattaccccgcagtggctcatccgctcatggctgacggaaggcgcatatatatataagcgcctcttcctttcccatatgcggatttaaataaccaaccaacagcacacaccagaacaaaaacgagacgccagatcaaaggccacaccaaatcccctccagcacagcaggggaagccgcggggcaccacagaccacgagcgcagccgcggaggccggagacgtcggcgacgcgcgcgcggtcccaccccgtcgaggggactcggccggagcgggagagtcaccgccgtgtggaccggcggctggagcgctctgcctgtggccaatgtcggtggagagaggcccgccagcggtaaggtccctgtcccgagcggtggcggttggtgggaactgtgcgcggtgcagttgataaacttctagctttcctgtgagggacgggcgaccttttcccgtgcgtgcgtggtacggttgctgaacttcatccgtgagtttgtgtggccgaatgttttttcatcgattgtcctatgtgattgagttagtaggtgtctttaggattacgattggatatttggattggatggaacaggggtaggttttcttcaattttgagcggcggagcctgcactgaagactgaagctgcttgagtcacgcctgttccgacgatttttgcagaaatcgcccagcctacgggactgattgggcttgaagttgtggcgcgtacgagagatgcctcatgccagagcttctgttattagagactgaagttctgcaagcgcgtgctgctgctctggagttttagcagctgtgttgagtggttgggagcc

SEQ ID NO: 9962 - DNA, 266 bp, Zea mays
ttgcttgcagccaatctgcaaatgaccgtctgcccactctcatctcgtcactggcgggtggaccaaacgaggatagggccccacctgtcaattatgaagaggatctcactcccaagtttcactctcttcccttctataaatgggacccaaggtgcacagcttctcctcgccccgtcccaaatcccctgtcccgctagcggctagtccgaccaggcgatccccccccaaaccctcccccaaaaccccagagcggagaagagcgcaag

SEQ ID NO: 9963 - DNA, 1195 bp, Zea mays
caagtacaacgactacccaaagatcttgtcatcatccatcggtccaataaggctaaacaaaagctacccaagatgaccgctgtgagaaaccggaagagcatcacttaagcatacacataccaaagtcaccaagtgcaccgaccgagcagagctgactagccaagtgaccaacaaacaagacctacaaagaaactttaaactaggcaccgcaaagttccacacaagtcactgcgaaatccgatcaggactctcacttcaggttgagtccgggacgagcgggagcatgtctatggggatcaaacaaccaaccacacttcatccagacagctgaaataaaaccagacactaccacagcctgcaagaaccaagagagtacctggaggaagttttctttggcctcgacccacggaccggtctgcggaagagacggcgccggcgaggaacgggcggacgagcgcaggccgccgagtcgggtgggtggaggtgaaaatgaggaggtgcagacaggaacggattcgtctgccgtaacgtccggtcgctggcggctggggccagaccacggccgggtccatacgtcagccgcagtcggcctgcaacgttacggcaaaggatcctgccgggtgcagcggctccgctttccggtgtcgtcttctcctctgccatccttcctggcctgggggcgcgtactgtgtcaccgggctagcgtaggttcaccggcccaatgtgttgggctttagcgcatctgtaggcccatctgtggagtgggctttacggccagcatcaattcgtcgcatggccccatctcccgcaacattgctattttttccgcacaacaccacggccatttccttcaaaaaagccagcccggccggcacggggcacggccacagcgaccacgtgacacctctcacagtctcacctcgtcgtcctcgtcccttccgcggccagccaggcagtcaggccggctggccgaggcagccgtgcccacgtgcacgaagcagcgggccgtgacgtggtttggggcgagcaggtgaccggcgagtagaagtagaagtaggctagcaacctgcacgcctacccgtcccacgcacctcccgacttctccggttctcccttcttcatagcagccacccacgcatctcagcgccgaggcgagcgaggacctcgtggttcgtgccctgctcacctcgtgagg

SEQ ID NO: 9964 - DNA, 753 bp, Zea mays
gctgaggacagaaaagagagagagagaacttgcaatggcttcgctggtctcgtcctaagtaggccatggcagtggcactggaatccaaccgtattttgtctgtcaagtcttccctcacctcctctctctctcctcgacatggaggctgagaggtcagaggtaccttccttctgtaactgcagctatcaggagcattatttgtcttgtcacctcaccttaatctctccatgataaagctctcccatcttttacttttcagattagattagaaaaaaggaaggcgaggccagccatacgctgcacgcatacgcaccagcgcgcaatgcgaggtccccatattctgtaatcttcctcacccaagtcacgagcctgcctgcctgcctgcacttccctcctggccatacgccataggaagaacaggacacggacggaggtgagggcaccactcggaaatcctgccatcctgctagctggaggggctgtagctggacagtgactgagagtgagaggcagcagcggtccggtggctggcctccttgctggatgctcgccgtcagggaggtacgacgagcacgaccgcctctccctcccgggagcgttccctctccggcgaggtccctcctccgggaaatgcggcggggcagttacaaatgacatcttcttcttcttctccttcgtaacctgctgcaaaggagggcaacctcctgcatttccgggttctctttccacgagaagggaagggggaaccggagg

SEQ ID NO: 9965 - DNA, 126 bp, Zea mays
gtttaagtaagctaatttttatgttgtttgcaggtggccccaaggaataccatgggagacgtgcctctagagtaatacaagaacgaatagcacattgtgtatgatatcgatggaagatcaagaaac

SEQ ID NO: 9966 - DNA, 238 bp, Zea mays
caaacactcacttacttggattacgcaaattgtcgtttacgcaggattgccatgtgcatccagtggctgcttgccaatgctagttgtaaccgtactgcaattcatttcttttgctatgtcagtggatctactgaattgagcccttctctgatagtctctggtcgacacatctctgcttttccagaaactgcttttcctctctgcgggcgcatctgcgactgcgattgcgttggtaaag

SEQ ID NO: 9967 - DNA, 1500 bp, Zea mays
caccccgctagctgaagaaggacgagcaaacgagttacatataaaaaggggacaaatctccttttcaacccatatttctttgcctttcggtactcctttaaaagcaccagttttttagtttccaccgtcattccttttgcaaaaaagtccttgcacttctttctaatataacgtgcggtccatcgtaattgtgcatcgtcataaygtggacgttacctcctagatggatcgtgaaaaaacaccaagcccaacacaacacgaagatacacctcgctagctgaaggagaatagcggccgagttagatataaaaaagggacaagtctcctttttcaacccatatatttttcggccttttgtctaagataaagcaatatttacagtttaatattttggtatgtgggtcatatgtccatttttttgagagggtgcactttaattttaattttttgtagggagtgtctatcacactggcttaccacttgactctcacgtgtcgtacaataattactatatcatcaaatataattagtgtgacatcacaatgtacaagcattatattaaacatagtcattttttatactcccctccgaaccaaattagtatctattttagctcttggtttttatgtttatattctgggtggtgatgaatttaaatatatgtataagacacctacaccaaatgatgtataaatccattaaaaaactaatacgaattttaatttgggacagagaaagtgtaacttttattttagcaccactatgttttgttttgatagcatgcaataggctctggttggaatacattaaagcaagtgtacctgctagccaacctccgtttccaaataatacttaatataaaataacattttattaaagtacttttgatattttattataagaataaaattctagacatatttaaacaaattttatttttttgcgtctaaaaatatatcaccatggtaatcatgttttgatcgcaactgtcacgtgtgtgtggtggtggtgggggtcgtactctttttcctctctttaataaataactatataatgggattttgcttcggtaaaagaggagatatggttggacctaaccatggtggcgaggaaaaaaagatgactgcgccgaagcgagccggggccgcagcagcaacagcacacacgcgaggcggcaggaggagagtggcgcgggccccaccgcagctatctcctttggcgtctctgtccagtagtgcgtcagcgtcgcttccgattatttaagtagcacggccacggctagctaccatctccccaactccgcctcccaagtcccacccccactccctcgctcaccagaggaactagcggaccaggcaaagccgagccgcaccgcaaccgcgaagatcttgcgtggcctccttttcccagctcgtcactgtgccgctcgtgccctacactcccggtccgcccaaccaataatccatccatccatccatccaccaccaccccgctgcggcg

SEQ ID NO: 9968 - DNA, 391 bp, Zea mays
aggatccccctgcggcaaaccatgggtcttattctccatcacctgcaccaggacctggagatgctggtggtgccaccccaggaggttccagcctttctccatcaaatgagcctgctgggaacagctcacaagcggctgcgataaatcaaccatgccgtttcctcctcattttcattctttctgtgacattgtccttgcgggtgtggattcctgtgtagagtattgttttttttaaaaaaataactatgtagagtatttgttggctgtatttgtattgagcgtggaaggccttattggggccaggtggaacctgaatgaagaatgcagtagcctgtcttcgttagtgtccggtgaaactttggtatgattttggtttctccagaatttgtat

SEQ ID NO: 9969 - DNA, 1500 bp, Zea mays
catcagaaagagcacaactataaaaaaatattgtgtcggggtcctcgcctgggtctctgcaaaacacgccggaagaaggggtcgtcaggagcgaagccctcgggttcttcggcctcttgggttcgaagcccccgctatggatttggccctcattgtcctcttgccctaactagattctgtggactccttactccatgcgaggaggactttgtgtattcaactgggttcttcagacttatcgagctagtgatctgcatacacagataaggttagcatgcgaacgtgatgatcgaggtctggtttgaccttcgtcccaacagtagcccccgagggggaggctcaacttgatgggccgatcccaaagtctacagagaaggatataaacactgccctcaattatcaattgagatgcatcgggggcatgaaaaaataatcattattatagcactgccttttgggttacattggctataaaagcgacattgtctcgaggtagggtttcttcacgctttcgctcgcaatctattgttgcaatttctctcactctagctttctcgctttccatcgtcatcatcgttgctctgccgctggcaactgccatcgttcgtcggccagactggcgaggatcaagattgacagacgccgccacccttagtacgccatcgacaacatgtcttctcctgccaattagagcaattctgctacgccgttaattcggtccagcctctctagaagacgctgttggggtggataagggagagaatttaccctatatttagaggaaagaacactttagaggctattgctagagtcagtcttatcttttctatttgtagcctttcactctatgttttaatcactggaccaaaagagggctagaacagccactatgtagctaaccacttactagttactacagacacatggttgcattggctgaccacttactagttccaaattcttgacaacgtatccaaatttgcttatcttgtcatcatcataattcatagatgtgtcccttcagatagtgaccggtagagatggccaaacgggccgcccggcccggcccggcccgggcccggtgaagcccggccaaaaaccgggtcgggcctgctgtgccagcgggcttaattttctgtccaagcccggcccgtttagcatgaaaaaacggaccgaaaagcgggctaaatgggccggtaagcacgttttagtgtaaaaaaaccgggcttaacgggcttagaggtaaacgggccgtgccgggctagcccaccgtgcctagtttcctgttcaagccagcccgcttattctaccgtgccgggctcggaccgggtccaaaaagcgggtttcgtgccgggctcacgggcctcgtgctttttggccatctatagtccacgctccaaagtctagtcctcgtcttcctcccgtaaaccacctcgtccctatccgcagcaaccgttcgccgcgccgcgaggcccgctgatcccaccgacctccaccgct

SEQ ID NO: 9970 - DNA, 486 bp, Zea mays
cgtaagtactctctctaagaagactctgttaactttttcaatcttcacattcgcttgcaatctgcaccacaaactggcatggatgccgctgatggttggccatcgttagtataaaataatcttccgtacaatggttaatggtgagataagataagcttaagaaaaagaagctcgcctcatcatataccagcttgcgccaacactagttgacatagcgcagagttcaactttgactttagttctgtacaaaaagcttgtgttcaatatagtggttaggacgacagatccaccatgttttgaatgtccatggacagtatcacatgaaggaagaaacgtacaataaagacattgcttcgttaacaaactgacttagaaaaacttgaaacaggattctacatgcataagccatgtggtaactatatcagtgtagaactgtagataagtgtagccatacttgctgtttatgcagaggtgtcatgttggaca

SEQ ID NO: 9971 - DNA, 726 bp, Zea mays
gcttctcttgagtcggtgggtttaggcttgtaaacttgcgtcctacccaaagggcatgaggacggcatgttaggccaagcacttgagctgtcaaagccgcaccgtagccacaaataagaaataataaatcggggccggccgtttcccaatcattgggcatgatttgcactggcctctctagtgacctttttctgacgcctctcgcgctaatgatggcacatgcatgacggccaaactagaaaacctaccgtatatacgcatgcgttggcaataagttgatcgatgcgctgccttcgtacaaaagttcagttcagttcatcaatcatcatggtgttagctagaagctagctctcgctgctggtctgccaacagttccttgccgttgccacttgttttgtttaggttccaggtacgtacttctggtgatgccagggcagaaaaggagtttcttttctttgggctacgcttgtgtgcacagcacgcgtcagaggcaatcaggcccatttgcctctgacgcgagactcctcctcgatccctctcccagacgacccatgtgccggccgggcctttcaataattttcgccgacgttccactttcacgggtatatattcgcacgcccgcattcttcacattttcctcctacagctaactaatcgctgagctcagcttcacactctttggtgtcacccaaacccagccaccacacccacctctagcttccttac

SEQ ID NO: 9972 - DNA, 1500 bp, Zea mays
tttgtttttatatcctagacttctgaataaagcttcccttttctaaaaaaatttgtcttccgttgattcgtgaaaaaaaattgagtgttagtcgatactaaaatactcgaggacttgacttagtaggattctcgcactaattgttttgaggaagtaggaagaagagagtcgggacgacctaggttccctttctgctgcatatcgtccaaagcccaactctgaaataccttttgggcttagaactcaccgctgacgctgagggaagggagcccatcgtccctcgtctcccacatgaggccggccggaggtcgagatcgaagaggcgccgggagcattctccactcccttgttgatgtggagtggatatgtggcggccggctcccgccgctgagggcggggacgcaggctccggcatcctgggcggccgaccggctgggatcctactgctgcggttttgcgccggaggtgaggaagggaaatgcagtgcatagacgatggcaatacataacggaaacccgaataaccgacggttttacccccatacaaagacggatacgggatgatatctccagccgccacgggtatgttaatgggcaagaacctgtatccattgggtagacgagtacgagtacgggttggtactacccatacccatctacacatgggtaaaatatacccgcatcaataccactataaccatctaatagagcctatcttagctaaaataaaatccttttctaactatcatttgtctagctactaagttatgtaattatatgatttgttatatgtgaagctaaactttttttatgtttatttaatattttgagtgattactatattggaatttaagacttttctagcgggtacggattacccgatgggttaaattactcacgcgggtacgagtatgcgtataattttatacccacgaacatatatgggtaacccgacagatagagttctttttaataggtacgagtatagaatgatactaccctatgtgtatgtaccccgttgtcatacctaattgagactagccttaccggttacggcaatatgtaacaagttgcattgaatctgaacgcaatttatggcgggtaaaatgacactggatatatcattttgttgctcattcatgaaccatggtactatttgtaatgctagctactgcaactggtatttgtgcacattttatgctcagctgcgattttttagggtgtgagctacggacgattattattagcctggaaaagcgccagacatttttggtttggggcttgggctcatattgtatagctgtaagcagcccagccaagcccagctactgaggagacataccggacctacgcgttagaatcgtcccaacttgggtagcacaaacccttgggcctagccgccacggcgcctgatgagtgaacgaaacgggagacgataacgagacagcaagagccaagaggtgagagaaggagtgaaggaccgaggagggaaacagagaag

SEQ ID NO: 9973 - DNA, 929 bp, Zea mays
ggccagagagcgtgtcaaatgagtttgcggtatgactgtattatacgccaagagcgtgaaaawtgaaagaccccgcttgtcagtgaatgttgctattctagcaaagggaaggtgttttttcggaccttcggcgtaaagccttcgtccatgtcgcaatctaaatttattatttcaagcaaattaatattgcgaggggctactgttggggaccttcggcatccgaaggtcctcaaaaacatgatttaacaatgttttccaagtatgacatatgaacaggtaccttcggtcttgggttaaaagcataaacggtatggaaagcaggattggaacgaaggattgaaccagcgccgaagctgcgcgcgagaaagcttcggctcattaacagaaagaggaaccgacttaagaaggaaaaggctatctagtcctcgacagtttgttattaagtcaatagtgaatatgaagggcatgaatgtaattttacataggctgcgtcctgtgcctataaatagatgaacagtacccccgtactgttcacgctgacttggcattcgctttttgcgtcacgcttgtattgtcatctcattccgattgaaggtacacttgtaactcagcggtatttctgtttatacctaataataatatataattgttcatgttgtcttttatatcctttatattccatccttcgtcattgtttaatgaatttatgaaggtacgtccttcataaccttcgtccgtaaaccattatatcctaagggaaataatgcttcggaggacgaaggactttaacgattaacattttctatgttgccttgttcttaactcatagcacttgagaacaagtccccaacattggcgcccacctccggtgaactcacttccactctttgaagttttttgaacaccttcggcgatcataaaccttcgtt

SEQ ID NO: 9974 - DNA, 90 bp, Zea mays
agtaaaaacgtagtcttttattcggttcttgggatctctctggtgatgcatttccagcgctgaacctgtgttttttgcaggaacgagagg

SEQ ID NO: 9975 - DNA, 719 bp, Zea mays
gcttattttcgtgggtttttggcccacgaaaatttaggcgtttctagtgaggtgagggagggcggctgctgctcggctggatttccatccaatggacagaaaatgctgcttttacaaatgtggctttatttgaaactagcacattctttatcatgcatccccgacggatatgtgtcggccgctggtcacgacaaacggcagactccatctatacagcccctcagcaaaacgagcctgcatgcatgttcatgttctagagattattttagcacaaggcttttaggtgacacagccaagctgatgagggcagatgcgagcattatagaagcgccgcgtcactttgcccattgctttccccgttctgtacgtgtcccggagccggtaagctcggcatgcatgcatggtgtataggttgtacttacccccgcgaaaagctaaacggaggaaggtgaggtgaggtcagagtcagagctggaaagaccagccatgcgttaccggctcctccactagaccactactcatagagtcatatagtagctaataccgaatcgtgtttgtcatttccgtttcaggcttgtggttttgtcctataaatacgtgcccattccacactccgtcaataaatcaactcgagcaaagctagtaccatcgtgcgagtgtgagcaagctactgagagaactcggaacgttgcttgacagcttgagtaggtaaataatct

SEQ ID NO: 9976 - DNA, 1067 bp, Zea mays
tatatatatatatatatatatatatatatatatatatatatgtgtgtgttattttttgttgcggctttcgagctaatcgagctatctcgagctcgcaaacgatgcgagctagctcgatatctagccataatcatatgtaccagcttaactttgttgtgcaaccaagatcttaaagactagggttaaggaggcccaggccccatggatttgtgaagaccccgtgacaacaacaaaataaaggttagaaaggattcgccggatcgtatcaccatttttaaattaggcgctgaccgaaatgaacatttttttaaataacggaacatagtattgcttagcaagtttgggacaaaaaataaattctaatgcaaagtctcatttgcgtacacaacatagttacacatggcaacgtttacaatataatggcatatataaccttgtttaatatcttgtttttcgagaagtctctataaagttaaatttaaaaaaaaaatacaagagactcttcacacaaaatgcgtctatacacgactttccattctcaaccgtatttatgatatgaccgattttaaaaactcttcgttgtatgatgcagtttcttagatatctttagatatcttttctacgtagcaaaccgatcaagagaatctaggttgttacatactctaatacggcaacaagcacgcagtatcccatcggtgacaggccaaacggaagctgcgactagttgctggtggtgagatcaagtgtagattaagtcacgtgttggtagcccgtgctaaaaacgtggccgacaattttataatccccgcaaactgttcgtcgtcgttagcattagcattagcattagcattagcaattgagggtcgtgtcgggccgtttccgttccagtccacgtccacccacacccagagccacccaacctggccagtggccaccaaccttcgtcatctcctcacaccgcgaccaaccaaccaaccgcctagaaaaagaaagccccgcgcccactcgctgccttctcaaatccaaacgcgaagtagcaacaagcaaaagcccagatcgataatacg

SEQ ID NO: 9977 - DNA, 212 bp, Zea mays
tatgtgtttttcttggaaaaccctgggttggttttggattcacggtgttttacctgagcttgactgtaacagtgaaaacatttaaatcaataaatacacatcctgaccttaaaaaatatatatacatccttatatgtccttaagtgtagtccatgatactgtttccaaaacattcttgtttttcagccctactcctttgtacataaaggaag

SEQ ID NO: 9978 - DNA, 180 bp, Zea mays
taatcgctcatggttcagcttcggttgagtaatggaaatagctatttcttcgttataaaaacatccccacgcttcagactttagacagaaagggatgagagatcatcatcagagaaaaagagctcgtgatgagggaggtaaacacgaggagatcgagccggccggggcgggcaaaccgcc

SEQ ID NO: 9979 - DNA, 196 bp, Zea mays
ctctccaatatgaaaattatatttacagcgcatctgcttctatattaagataacattctgaacttgtcaagggtcatgctaactagtattgtgcttccatgtgagatatgcttatatttgttctgtgtgcaaaattgtttctgatttcattcttatgcatgccattgcgttacctactctataacacaagaatttg

SEQ ID NO: 9980 - DNA, 74 bp, Zea mays
gccaagtagcatgtttttgttgaggtttgtagcatatatttttctccacagacaagtcaagccagtcgttggag

SEQ ID NO: 9981 - DNA, 860 bp, Zea mays
aaagtgttttaggatcatagaccactttatttttcacaattttccctcctctcgatgcatcgtcgttgtcgcttgtttattaatttatccaccaacccatccatactatattggaatcttatcttaatttagtttgacacaagtttatttgagaactcacgtcgaggtattgctcttagactatcctaccttctatctcacttcctattttaaatttcattctataaacaatatagtctaaaaaaagtgttttacacgggtatatgggtacatgtatgttttgctaagcatgaccttagcaagcgaagttgaactatatttgacgtttgccagcatagagttgaaccatatgacgtcaaataaataaaaacggaggtaatactagtagtttcttttatttcggggaggctcagtttgtttccacctgaaaaataaatagtgtgacgtttctcgcattcgtatttgcattgctttagcctcagcgtgagcggggcaaagcagcatgcagcgcaggagcggcgatgtccggactccggacgctgggtttgcgctgctccccacgcggtttactattcctgatctccttccccttcctacgcatggctccccgtccattgctatgctccgccattgtccacacacctgcagccagccttctgcctttaaccccaccggcaatgtcagtagtcttgatttcctagcttccttccttccgctctctcactcctctgtaggtgcatccttgttcttcttgcatcgtatcgatctgtccatgccactggagtctgtacgtacgttgccattatacatgggctctgtttgcgtatgtatgtgcaggtgacctgatatcgacgggaggg

SEQ ID NO: 9982 - DNA, 987 bp, Zea mays
aaactagatacttctaaggccattctcggtcataaactctctcgtcgtagagcttcatgacgcagtttgataggctaacatgcgatatatataaatgttgcatataaataaattgctttcaacggtgcgctttctaataccttgaaaaggggttggcatatagtttggtgatgatgaaactaatttcacctatttcatagttaaatgtattgtcatgtcattaaaaatcctatatgacatactaattaatatcgtgaaatcttccatgaaactcccattcaaaatgactttatgcgacttaggtagtgtttggttgaagaaccaagtagaacgtagtcgttccatccctgattctaagaacggagccgctctgttctgtgtttggtaatctggaacggaacgactctgttttttgtttggttgcagagtgaacggagcggagcgtgactgtgagagcgggattggaacagagcggctccgtcccattgattttttggagcggaatggttccggatctgaggagaatattccctaattggagccattccattccagttactttgtaaccaaacaacaacaaaactagtacagaacggttccgttctacttggctcttcaaccaaacactacctaaatcctggtctggaacagttacggctctagaattgatctcatgctgccgaaccggccctaaacctgaccttatcgttgcctcggactacagcccgtggcggtgggtccacgccacacccacccacacacgagtcgacccaccgcaccggcgccggctcgccgagcggactgataaattgtcccccgctcccgagctgagtggtcgttccgtagaagctttcgtgtacccttcccatccccgccgttctctctctcttttcccactctcccacacttcctccattgttccctttttctctcgcggagtagcggtgatccagacaccgagtgtcctacgcgtcacggaccgtgcac

SEQ ID NO: 9983 - DNA, 1500 bp, Zea mays
ttacgcacatgcagcatgatgagaccattcttagcatggtatattatttattaaaaactaaaaaaaggaggaaatgttagctgttctgattgtgatgttgagctgattggctgccccgtgtgatgcagtgtacagaaagaaaacttatatggataaccttgctgactcgcacattgtctgctggctttgatttggaaaacgccaagtcctgtcttggacattaagatctttgaaatgctcatcccgtctatatattacaccaaataatcgtatcaacacaaaccatatttttttcagttgtagacagcagacatgagacatgcccttatggtacctttttatgatgcagctatgcataaacagaatcctaatatcgttagacttgcaccacctgttttaagaaaatgataaagtcaaggctgtagcaattttattttctgttcctctgccgaatcatcagcatctattgaattgtatatgcaattgtaatcccatttcccttcacagaatgttagcacacccacttattccattccccccaagtgctacagcatgttgctaaaccaaatggtggaaaccgttgctgccataacccctgtcagcttttgtgtaaacttcatatgtaaacttgtgttacttgttaggttgccctagttcaaagctacacatctcagacttcaggtgcaccctcccccagctccccctcactgtaaagcaatgtttggttggtgggatgatccctccttttggtgctgtttggtctgtctacgtcaaacggggccttgattccaggcttacactctttcttaaagacttgttcgtcctcattatccatgtgcttgtgtgcagttcaagcatcgcctgaagtcaaagtcagatgtgcggccaacggaatgcacgagtctggcggctcaggcgcccaacgttttggttcccaccgcttccgatgcgtggcggtaaagccaagcatgcgtggaggcaactgtaggagtagccacaccagatagtactgtactgcactgctgctgccttggggcgtatagcgtttatggtcccgttatttgttgttctgcagtgaaatggaggctttgcccctcgggctgtttgacgttctgatttcactcctttgttttcaaaatgaaggtctccagacgaaaggaaaagtgaaggaattttgaaggattgaaatctaataagaaatttttctatgtgactctttggaacaaaggattgatctcctataaatcctataaaattcctatagaatggaccattttagtaagattttggagaatttttaacacgagatccmaattcttggraatttttctatggaatgcaagtgtcatataacactattcctacattttttccctatccctatgttttagcaatcctgcaatgcaaaggaggctgaagggagtttgtctatattccgtgaagatccaaaggaggccgaagagagtttgtctatattccgtgaagtcgttcgtctaaacg

SEQ ID NO: 9984 - DNA, 589 bp, Zea mays
gacgctgaaaagaaaatgaaaagtcttcgataagaaaaggaacgcaaggtcgcaagcaaagaaaaaaaaaaggaaggcgagccaagggaggaggaaagatgcttttcagccgtcgatagcgtgattcaaacgcgagaagatgccttcctctgcagccgtacacgcgtccgatcgcccgacaaaaccgacggttcagatacgctcaacatatgcacctgaaggcgtccaaccgacatgcgggcccgttttccagcaagccccaagagtcagtgaaacacaccgtcttctctcgggttggaagcggtgggtgcacatgctgctagcagtataaatatgctgaaagcctgaaaccctaggcgaagcttatcgcttatcatccgcgcctctacatttcttctctctctgctcctccgcctccgcctccgcctgatccatccaagacaggtgaaatcctgaccgccgccgctcagatttgcttgtgctgtgttttttgatttgtgatttatcttgtttcctgaaatatggggaatctgaatcgaggctgatttccggatcttgttgtttcgtttttttttgggcagggatcgcc

SEQ ID NO: 9985 - DNA, 1500 bp, Zea mays
tcagccgttttcaatttaactgcgccgaacaatatcgataaattacagacaacgacggtggaaatgcccgggaaactcccggtccgggtcgatcggacaaggcgtgtagcagacggcaatgacgcttgctgttgtcgggatcttcctccctcccctaggtgacactgacaccgtccagtcattataagctgaaaacatcatgtgtggactgcctgcttatatttattagaacggactggatgctaactatgttgatctagtctgaaattgaaagcgtactttgtatttttccagagaaatatgcacatcaaacatgcatcgtaagagaaacgatcccgagcaagtgaacacgatcaatagcttgacgaatttttggatgtgtctctgtgatcgtggagtgtgcgcatcttgaaaaaaaatcataggtgagagcagggcacttgtttgctgtctgcagtctgtagagctggcaacaagggctcctatacgcctccttcttgagaaacaggacatggaaacagtggaccagtctgattacyatttcgtctgtacatattcagggtagcgttgtgccgtccggttcggttcttagccaagaaccgtatagatctacatgtaccttggacctcggcccttagcgttgtgccatcctgctagctgcgtgcagcgtgctaacatttttttaatttattttgagattgaaacgcaaactcattgtactaaatctagtgtacaaaaagacaatgcctggcgaaagttcaagccatcttttatgaaacgaaaggtttaaacctattatcgtgtcgaatagagaaacgcacatgcacagaaactaaaactcacttaggctaaaagaaaaagacgtccacacaattgaactttgcgatttgtctttgatataatattttttttcttttagtagccatggattttagacgaaatctcatcaatcggacgcgtacgtgtggtctcgtcagatcagacattcgtatcaaaagaaatccggtggacgcgagcttaatagaagaatgattcctttccggtggacgtggagtcgtggacgcgggagcagatatcactagaaataaacgataacgttactaaatttattttatgtcgacgtatagatatgcgtaaacaaatctgaagacaccggttgcgccaacggttctggcagtacgatctgagccgtcggccgcgcgatctcgcggtgcaggagccgtgcgccgaccccgcccgtgcccgttttgcgttacgcctcccagtcccggcacagcccacgttttataggcaggcgcgagcgcgaccgcgcggcgcagaacgcgcgggtacggggcgtccttgccatttcccaccctacttgagctaggcggcaggacggacgcggacgggcgggggaggagaacacacgaccgcgacggaatcgcgaggggtaggcgaggcgaggcgaggcggcgaccgagggaggagcagtcgagcagagcgtagggggcgcgaggg

SEQ ID NO: 9986 - DNA, 550 bp, Zea mays
gttacgactgtccagctatacgacacgaggttctacgcgtgggaaatcaagccgtgtacgtttaggttttaccattttaccctcgcattaatagttgctagtgatgaataaaatggccttgattataattacatgctctggtaatggctgttcagataaaactggttgcaattgaaattatcgaaagaacatgaacattgcatggccgtcaaccaaccttccccagtcctaactcaagtcacctgcactgcaatgcaaggtgcaagcccatcagtggcattggtcaaaactgccaagctgcaaacaccagcaactaggaggcgagtaggagagcaagctcgaacaccacgcatggcgtggcgtgggtgcacgcgtccgtcgtgcatgtctccgacgaaccccaacctaaaccttcccatgcagcctatagcttgggatataaaaggcaccggatcgagatgccctccgccgtgcagcaccacgcgcgccgacgaaaacgccgtgccaagaaactaaagcagcctctctagcagcaacgcaacaaccggcg

SEQ ID NO: 9987 - DNA, 1500 bp, Zea mays
accgagaaccgaactagtcggttctggtttctttatcttgctatttcggttctagttttcgaagaaccaaatttctataaaaatcgaggaatcgaaccgaaccgaagaaccgaacgcccagtattgcttcctggctaatcaccaaattgcgagttatagacgtttgatgagcagcatatttgatgtaaaaaaaaagagatcgttcaagtgatcgttggtgtaaaaaagagagcattcgagtgatcgtgctagaactgtcgcgcgcagtgaattgtcgtgacaaaattcatttccaaactcagtggatttcatgtacacaccaataaatactcatcatatgagcctctagattgactcgactaccccgcgagaatcccacgacgccggcgacggcctccacgacgctctgtccgcgccgtcgtggtgagcgacgatgcggtggccgccgccgacagccgcggtgtagcaacctgcttgatccacgacttcagggaacgggctggtcctccgccgctcctcgtccttgagcagctccgcaaggctgtctacaatactgatggttgcaatrcagtggtgaaacaactaaactaaaataataaaatttatgtatagttaggatcataaatggattatgaaacattttcttataacaatataacacatattttgtatataagttatcgtgatattatatgtttctgttacaacgcacgtgcacccacctagttagaatatatgtcctttgttattaatataaaacattatctctgatacatattgtcatgtgtaaaaattattatatatacatcaaaataaatatatttgtaacaatgagtgatctctttataagataattatttatttttatcattaattattacacgaaaacaacatcatatgaaagtctaacgggtctccgctagaaatcaagagagagattgttttccattcctgtttacccatcattttccgtttacatctgtttacatctttgtagagaaagaaacttctctataatcattatctaactaactcagaaattcctcgcgggaatcgaggacgggaaccattgccatctctcctaggcacggatccaatcccaatgcgctggcgcgcgggtctctcttcccgcacaccccttggaattcctccactgagatttgggtcccacgcttacgtggatcccatgctccatgtctgaagcttgaagggggccaggtgccgccgtgtagcgtcgcgcgttgtttttccgtccgcaacggctagcgaagcctggagtgacctaaaagctgggctgggtcggcaactgactgacaagtgaaaatacccgttgggctcggctcgcgcggcgccgtcctctcccactctctacgcacgaacacagcacgcgccgcaccccgctctctctctcctgcgttcccatctgcggcggggagtgagcacattgaggacggtctactcctcgttcgcgtgcggttcgtcccgagcgatccggcaacc

SEQ ID NO: 9988 - DNA, 285 bp, Zea mays
gtccctagaaaccaaacaccccctaaaagcaataaaggaatggaaatatattcggcttgatcaatgtgtttagaagtacaaatgattgctcttttttttcaaccgcaacttttgtataataaaaaataaattaagatgaaaagggaggcagctggcgcgcacggcgcaccgcacatgaagctgttggcaagtcaattattgcgtcccactcccactcgtacttttatgtaaacgaagccggggaacagtcgacggcaaaggcccaaaaggcaggcagccatcacg

SEQ ID NO: 9989 - DNA, 1500 bp, Zea mays
gaaaattagtttatttccacctcaatctcctccaacctcgaaggagatttgaggttcctaaagtaaccctaaatcttgatttattctatccatataagccaccaccggtggtcagtggagaaatggagaatggaccttcaagtcccggttgttttaaagtttgggactaaagtcagcattaattcaatgtttgattgctagtgtcacagacgagcacaaatatgaccttttattctaattggtggctttaacctaaaggtttccctgagtccggattgaagccattaatcgggactaaaggtcttgcgcacatttagttccggggaaaaattgtaatgttattttagaaataattaaaaaaatgttgtagcaatgagaaaccaaacacatatctcgtgtttgtacttagctttgctggatacggttagacaacttttaagtagctaggtagcttgtgttgacaaagggaaaaagctggcccggtatacaatccaattttgataatgattacaaaatactacttaattaccccgtctcaaaaaaaaaaagaaattttttttgtagatttattcaaagtcaaaccattttgaatttaatcaaatctacattaaaatatataccatactagtacattcataaatgctagtattttttctttatgaacttagacatatttttttttatcaaaccagaacgtacgatattctttttagggcaaagctggtgtatgactattatgctaaaatatatgaacagacacgacaatatagtaacgattaggtgaccctaaatctatccgtgtgtgattgtttcatcttattatacctaaagttatgaggccccatagatcgtagagcacacgtcgaggccaacaaatctaaaaaaagacactcaaagtacgcgtgatatagccacagagagaaccaaaattttcgcatgtggacatgtcatgtccacctcattgttgcgtctctcgagcgtttagtttagcttcacttattataagaaccatatgatatgatatcgtatcaaaggaaacgcatgcacatccgttcccacacgtacgcttttagccgacactgaagggcacaaaggtacaaacaatccgaggaataaaaaacgacagcccgaatcacgtacgcgatccaagcaaactgataaaaaacgaacgaattcaaagcgtagcataaactattcccgtccctagcttgttcttccttgtgtgacgaacctcccccttctgggaagctcccttgctttgaccacgtttggatttgcccttttccatcccgggagccgagaaccgagagccgagagcgaagtgaaccccgttcgctgtcgtcgcgcgcggcaccggccgggggcatataaatagcgcacagcccgcccctcccagagccagtcatcagcacagcagcaagctccctcagctcggtcttctcggcaggacccggcaagcaaagccaaagcccagctctttctcggccgggagatcgagac

SEQ ID NO: 9990 - DNA, 367 bp, Zea mays
cacaaagcaggaatccatttttcacggatcgccccatgtatgccaagtcgccagcacaccacccttctctccgcatgtattccagctaataagaacgcagtaacctccttcccacggatcgctctgccacgatccgcgcgctcacacgcatatccaatccagaccgtccgttctgttctaatcgaacgctcgaamcccmatttccctccatgaagtcccgccgctgcccccgagtttcccactcgcccgcccacccgtcccctattattaatcgccccgccgctcaactccatctcacacaacgatctcaatctccctagcagcagatcctcgtgcaacgcaaagcgctagccttcctactgtcccg

SEQ ID NO: 9991 - DNA, 457 bp, Zea mays
ctggtactacaaaaacaaaagcaggcgtcatttttctttgcctccctctccaccttgtttggctgccttcttcttctccctccctccctgtacgagctgagcagcaacgtgactagttttatgtagaacaaacatcacagcgagggaaaaaaaaactcttccctcactcagagattcgccacaagactacaacattttttagttgtttcacttactactgagcaaacatcacagttttttttgttgctattttccttcgcatcttgtagacagcccttccttcagtgtgctacaaacaattagtaggttcatccagcagaaaaacggaatcgtcgttttgttctggtcactctcggtccaatctcccaaaacgaccccgccttcagtagcagcaagcttcccatctttcaagcaaggtgaagattcagcagcggggaaaaaggttaggtctccagcg

SEQ ID NO: 9992 - DNA, 157 bp, Zea mays
ggcgtcgtggcggtggaggtcgaagtagtagtcgcagtttctgtcatcaccgtctggctagaaggtgtagagatgtgccgggttctggagtttgggttatcggtcgaatcatgatgtagttggttcttcacagctgtaatttaactatgacgatgcc

SEQ ID NO: 9993 - DNA, 250 bp, Zea mays
catttcacgcagcgcactattggattgatatgcagacttgacaatgcgcgtttgcacgcacacatgcacgcgtacacatacacattaccgggttgttctcgttgctttttagaagagttgatgagctttcttcacaagtgaaaccagtggcttatcagtctttgtcacctgataatgattatcgacctcaaataatacgaggcagttatcgagatctgacaacgtcttcaaagactccaagagtacatcc

SEQ ID NO: 9994 - DNA, 633 bp, Zea mays
ccataattatcattcaaatattcgatgtcatagaaactaaactttagttggaatcaaccaaacacacctttaattttaactagcaagggatttaattcccttaaatctctttaatcccctagaaaccgaacccgctcttatttttgttttgtcctaaatttaaacgttagcttgtaaaaccaaacaccacctgtcttgtttggaataggagattttttttaactcctgcaattttctactcgctctatctaaaattaaatttcattttaacattttaatagattcatacaatatttaatgcatgcgtcgtgtttatgtgtctaagattcattaacatatcttgtaatagtaatctaaaagtaatcagctagaacgactgtgatttgggactgatggactacgaaggacagcaggttcttatcaaattcttgcctcattgagtatttcttgggtcctaaataaaccctatatatacttctctatgagtgccagattgtgagttttgtattaaataaagtttggggggaagagaactctagagaaaagacttcagggtccatccatctcgatccccaattccattatcggaagagaccatttccttcctcctgatgtctcacggagtttctctac

SEQ ID NO: 9995 - DNA, 314 bp, Zea mays
cgtcctctattttaacagtgcagtcttttgtacgaaacagtagtttaagagaagaagattgtaggatttatatttttccatttaaaattaaataactagaggactttagttaattctattccttttaatcttcttactttaaaataagctctaatgaaaaaattctccataaaaaatcacggatcgaagacgcgagacggctcgcgagccggacccgtcaggccgtcactgcaccacatgacaaacccggaccgaacacggacgcctcccagcaagtggtgacccgtttctccattctcgccgtccgattataa

SEQ ID NO: 9996 - DNA, 299 bp, Zea mays
tgttatgttttcttttgtaaagattaacaactggatggtggaagtcttgaagcaatgagatgggatatgttgttccaagccaaacttcagcttgctggtattcaggaatctggacgtggtctttggctctctgctatctgttccttagaaccctgtcgtgctagcaagatgcattttggtccagattcggtttgggttgtacagtgctgttccttttgcgatggtgttcagcatttagattgctgaaacctttgatgcatgttagttgctactgatacatctatttgtagtattttcat

SEQ ID NO: 9997 - DNA, 558 bp, Zea mays
aacgagactgcggacgagctggctaaaatagcctcgaggtgaacaacggttcccccggacgtcttctcccgggacctgcatcaaccctctgtcaagaccgacgacacgcccgagcctgaggcaccctcggctcaatccgaggtaccctcggctcagtccgaggtacccccggctcggcccgaggcgccctcggcccaacccgaggcaccctcggctcagcccgaggcaccctcggcccctgagggtgagacactgcgcatcgaggaggagcgaagtggggtcgcgcctaatcgaaactggcagaacccgtacctacaacgacctcaacaagttcggcaagcgatggatgaaggaactcccctcggtggtctggagtctgaggacaacgctgagccgagctgagccacaggcttcacgccattctttctagtctatggggccgaggccatcttgcccacagacttagaatacggttccccgaggacgagggcctacgccgaccaaagcaaccaagctaatcgagaagactcgctggaccagctggaagaggctcgggac

SEQ ID NO: 9998 - DNA, 483 bp, Zea mays
acatcttcaaaaaattatatatgacattttattaatgagccggctctttttccatcctaaaaaaaactaaacataggtctattttgaattggatccagatctgcacaaaccaacggtctgaacaaatattatttcatttagaagctacctagctttttccgctaaaactcgtcttcgtcaaagccaaggaactatgaaatacattacttttttgaaaatccgtcctgagacgaaagaataaatataataaatcaaaattttggaaatctcgtgcacgccatcgtgggttcgtggttcgttccgacttgcgagttgcgaccccgtcgcctgcccgttcccccgtttctaattttatgaccgtcgaaaaccaaaatttagataggccacccaaatccaggtgcaaatcccaacctccctccctcccaggccccctccccacctccacctccaggcaccactggtcccacctcctcacctgcgagg

SEQ ID NO: 9999 - DNA, 251 bp, Zea mays
ggtaacactatctgaacacttcaattccatagcaactcttttttattatcaaaaatggctcgcaggcacaaggatggggacagtggccaggacaagctccagcgtcgcagccacccaggaccggtgttgggtggacgcaggcacctccaggcacttggacgcctccaccaccccaaggatcgcagccagtccggggatgggtgccaccggtcttccagccaccggcgggctctcagccatttcaagcgtgg

SEQ ID NO: 10000 - DNA, 1500 bp, Zea mays
gtttttatgcaatcaaactagcacctaaatgtaaacaaaacatgcttgtcatgtatctcctttaagcgctattttgagaactctgtttttacaatgaatttatattttctcacataaatttaattcattttttcttagaaaaaaaaaagaaaatccttgagaaaacagagttcccaaactagccataaagttgcacggagttttcttctagcgagattacatcaattgtttgaggtacaagtatttcgtatatgccaaattattagcaccctagttatttagattcttaaatatgttttggggtaaaaatataacataccatgttatacccaacttttgtcaaagatttaggagagtttttttaatcgaacttgatgtttagcgcctaagaattttattggtacttgtaaaaaaaatgttaacatgcccccattagaatgtaggaaaaaatgggagaaaaaactatgatttcaatccctatgaattgatttgttctatagcctttgttttgctagaatttgtctgaaaacgtaagagtgggttcgttttcacacgaaaagatctactcaaatatcattattccttgtttacacccatagttcattcaactacctattttatgttaattttttctgttttcactcctccagatatctattcttcttaacttttttgtttttcaccccataactttgcatagatatttctatcttatttatgtttttttctattgttgactttttcaatatgacattcaaaagaaggttgctgatatttttcccaatcttgcatttaaagaggaccatacttaaaaagactctagaagctttgagagcatctctaacaataccttaaactagtgtctcaaattaaaatacaaggctgtacgcagaaaaaactactccaacaatgcttcattttataaaatttggtcaaaatttttttagtgcactctcttatatgtctcaaatatactacaccacaatgttctgccctataatctagatttggggttttactattggagcagaatattttattggtgctctaaatcaaataaaatataaccattttaaaattatagggcatttttatagatcacgtgttgttggagatgctctaacaaaaccatttaaaagatgaacgttatcaatgtaataatattttgatctgtagtgtttataaatatatatacaataatttttaaaaacttataataatatcattattgtatcatcaatctataaacaaatttaagttttcattaaaaatagtaagtagtctgacattgacttttttttcattcgagaaggacaaactggaaaagaaatatagcccaggggtagttttgggaaaaaagatatttggatgctggcgaatgtgacggccacgtctagtggaagcgcgtataaatcgtcccttctttctttcctcacccgcccctgatccactctccgcttcccgctccgatcgacctgctccctccccaccaccgagccc

SEQ ID NO: 10001 - DNA, 1500 bp, Zea mays
caatatataaactcaagacacatctaaaaatattcataccaagaaacaaataaataaaaagatacatattatagtattatcttaaaagttattttaacatgtttaaataagaccgggttgtgaacgttttgtggctgctaattattcgacatttcattattaaattattgtgtctgatagtctaattactgaatgtatagctaggttcggggccctatataattgggggcccggggcggcggcccctccgccccactctcagggccgccactgataaaaggtagtgatgagatgtatttaaatatttctcatgcatgcagtagcgaaaaggttaaaatcaaagtagattatggtatctagcagcaggacagagagagttaaatttagggaacgttgttgaagatgaaaacgatgtagtggataaatttttttataaagtgttgtagaggacgacgaatatttctttaggtgataaaatttagaaaatgttgctgaagatagtcttggtactatcactacgacccagaccctgtcttgtgtttggactttggatcataccttttcggactatactcatagcggctcatggagcgctggtgccatgtctcgcattcgcatcccagcaggacacgaatccatgcacacgcaagtagcatagataatgggcgccgataggccattaccatttacgggccatgcgcgcacgaggcagcgccgcgcctgaccacaggaccaggacgtagtacgtgcgtacgttgttctcctccacctggacgacgatcgtgattcccggctgttccgatccagtaacgacacccagctcggtcgatcgctcgtggacctgcccaacaagcgtgtgtgccagtacgccaccgcgtttgcactaatcaatgtgctacacctaataagccaggaatgatggatgcgtgtgttattattggctgcctgttctgtcgttctttgtgctcaaccagaaacgcaggctcttgaatctagcttgatgcagtgtcacaaaggtgcgtcgcctaaataggtccggcccctgcctaaggaaaaaaaaactcccccagcgagcaaatggcatgcacggttcggtggtaccggtctcgccaaatctatcgaagacgacgacatggatcacgcacgcacgcaagcagcaggggctatccccacccctcttagctaccatgagttaatgctgagttaatagtggttgcagggttccagggtcgagcggcattcaaggcacgcaccgtacgcagtgccaagcacggctgtcaagctgtgttgtgtgtgtgttttttccaaatgcgctcatctcctgattttactcgtgtctttttctttacagcaaaccgccaactacgttggtagtttccactcctttaaatactctcctcttcctctcgtcgctccatccatcgtcaaaccgcccgcggtccaaaatccaaaccctgcgagtgtatagaagaagaaccccccaccccatcgcaacccgca

SEQ ID NO: 10002 - DNA, 163 bp, Zea mays
aaacgagccgagtcgagccgagccgagctggccactagtcgagcgagctcacgagccacgagtattttgcccagacctacatgcacaccacggtacaagagaagcacgcacgcatcctgcggcatgcgtgtatctccgcggggatccccaagctagaccagag

SEQ ID NO: 10003 - DNA, 292 bp, Zea mays
ggttgtcattcagaacagaaatagaacttacctcccctccagcttcttccagctccttcacattcttcacgctcctttgcttccttcctcaaatccctctcaacgttagtgtggacactacaattggtatcagattcagcctggggttcttccttctgtgtgggtttcacgacctgattgtgcgtcggtgatcgagccgattttggccatctgttggattcaggcgtgggctgaattggtaatcacgacgccaactcgacagacgatgtataccaagcagttgatggtggcc

SEQ ID NO: 10004 - DNA, 302 bp, Zea mays
ggtgagaactggtccatcaatcattgctattaaggaatgtcgagtcgtaaccgataaccattcttcctattaaagccagatagataaaaattaaaaaaaatgaaagggactttagctgagttggttaggagggttgagtaccatttctcacatttttaatttaactccccacctacacgagtgaactttagacatttttaaaaagcagggagtgaattttttttaaagtccccttaccgctaggtatggaaaaaaaatccgtctcaggccttgttcggttattcccaatacacatggattag

SEQ ID NO: 10005 - DNA, 187 bp, Zea mays
ttgaggctggatgaaccggaaacacagtccgataagctttccaaactatgtacatgttggacgacatttatgtctcacagattcatcgtcccaaagccgcagctaagggagaagcctatcatcaacaaacataggaacaggaaaaaaggcatcatttacttgctagctcctaatcgcgtggtcaatc

SEQ ID NO: 10006 - DNA, 401 bp, Zea mays
tcgccccattgggattcaggacgatgctggtttctgggccacagaatacaatgcgggctttccgatggacttttttgtcagtgagctggccctcaagccatgtggcctattcgtgtacggcccatgtgagaaggcgcgcacctgctcctcacctgtgtttgcttccgccgccggcaagggaagaagatagcaaaaccctagctagagttggcgagtgggggtggaggcgcggctgctcgtcacgacatcgagtttcagcgccgcccgcgagatccccggatttcgttctctacccctgttagggtctgcttcccgtgttgcttctcatctccacccctgacgtgttgtactgagtttctgctctgttggttcgctctgttctttgcaggatatctgcggca

SEQ ID NO: 10007 - DNA, 73 bp, Zea mays
ggtaaggcctgaacgttagtcgtcgtcttccaaaatccaaaccgctcgctcctcaccgaagacgccattagcc

SEQ ID NO: 10008 - DNA, 330 bp, Zea mays
cacagttgtcttgatacaagttataagtccaaagcttggataattttgctaactgttggtcagactttacaataactcaaattttgtctggtgaacatatgcttatcaagggagtatagtagttgaaacatggtgacgtgatacacgtggttttggttctaagaaagatgctcgacgtgagatatatataaacatatcttcatgggccaccagctgtgtctcccgctctataaatagctggcctgctcgytcgatcagccatcaccgactcacactcacayagcaaataccccacaaggccactccaaagacctagtagtggaaccgaag

SEQ ID NO: 10009 - DNA, 1500 bp, Zea mays
aggctatgtattccgtattcgggacgtcaagataatgggggataaaaaggagagctgttggagggctcattttgcactttttttttcccaacaaatgctttacggtttgcgggttttgttggagttgctcttaatctctaatttgtgtaaagaggaaaatcacctagactgctttgatgttttaagaaaataagatcatgtttcaaatagaaaatagacttgctcatcctttaatctttatagtacaatttaatttgtatcagtttagttttgtaataattactgacaaatgttttgtgatatattaaagttgatgataatttatgtgctatccattttcatgcaatcattgtgcactaacatttttatcgaataatttgtatgtcatcgcaacacgcgggcattgtactagcatttattagcgataagatagcacataattttcaactcaactcatttttttattaaaactatctctagcagattacacatctccatctcttatttcaaactttactatataaatagtacaacctataatgcaaaacaatatacaacaatacttttgtatgactatatgcacgatctattaggcataggctaacactaacgccttatttgaaaacttattatttttgcagctttgaagtaatactatgatatttgataatattatagtattgaaagccaaaygatcataagatgtttggttgtatagacaaaatcacatttaaataccatggtttatccaaaattttggtatttatggagttttagaaacttcacctaaaacttcggctttctttgttctctctacgtatactttggtttttctaatggaccaaacatatcttagttttaaataatattgtaactttagtgtaacaaagtaatactgtggtattatgtcatgtacaatcataaactatggtattttaaaactacattaccaaatatgccctaataagttgtatttcagttaaaaaatatcttgtgacaaggtgcgttaaaattattagctatttttattcatctaacacaccttgaaatatccttaaaaggagtcacgactagcacattttaaaaatcatggtatcttttgcaggtgcactataatcacgaggagaagcaatgccgaccacgtttataacggcggatcattctaattttagttgtagacatggaccctcctgatttgtccagttcagcacttggtcacagaatttgaatttgcaagcacaagggtcaagggagaaaaggctgccttctagccgcacatttcgtgtggatgttgatctcagccgttgatgtgtgatggggtgtcgcagcatcgtctcctcttcctggctatccaggccacacctaccacccgctcctatccgtcctctaaaaaatccggaggcttcggccccccttctcgagcccttcgcccaattcctcaatcgacccaaaccctaggagccacatagatttcgatccgatcggaaatctggcatggca

SEQ ID NO: 10010 - DNA, 1500 bp, Zea mays
gagaaaaggctatgtattccgtattcgggacgtcaagataatgggggataaaaaggagagctgttggagggctcattttgcactttttttttcccaacaaatgctttacggtttgcgggttttgttggagttgctcttaatctctaatttgtgtaaagaggaaaatcacctagactgctttgatgttttaagaaaataagatcatgtttcaaatagaaaatagacttgctcatcctttaatctttatagtacaatttaatttgtatcagtttagttttgtaataattactgacaaatgttttgtgatatattaaagttgatgataatttatgtgctatccattttcatgcaatcattgtgcactaacatttttatcgaataatttgtatgtcatcgcaacacgcgggcattgtactagcatttattagcgataagatagcacataattttcaactcaactcatttttttattaaaactatctctagcagattacacatctccatctcttatttcaaactttactatataaatagtacaacctataatgcaaaacaatatacaacaatacttttgtatgactatatgcacgatctattaggcataggctaacactaacgccttatttgaaaacttattatttttgcagctttgaagtaatactatgatatttgataatattatagtattgaaagccaaaygatcataagatgtttggttgtatagacaaaatcacatttaaataccatggtttatccaaaattttggtatttatggagttttagaaacttcacctaaaacttcggctttctttgttctctctacgtatactttggtttttctaatggaccaaacatatcttagttttaaataatattgtaactttagtgtaacaaagtaatactgtggtattatgtcatgtacaatcataaactatggtattttaaaactacattaccaaatatgccctaataagttgtatttcagttaaaaaatatcttgtgacaaggtgcgttaaaattattagctatttttattcatctaacacaccttgaaatatccttaaaaggagtcacgactagcacattttaaaaatcatggtatcttttgcaggtgcactataatcacgaggagaagcaatgccgaccacgtttataacggcggatcattctaattttagttgtagacatggaccctcctgatttgtccagttcagcacttggtcacagaatttgaatttgcaagcacaagggtcaagggagaaaaggctgccttctagccgcacatttcgtgtggatgttgatctcagccgttgatgtgtgatggggtgtcgcagcatcgtctcctcttcctggctatccaggccacacctaccacccgctcctatccgtcctctaaaaaatccggaggcttcggccccccttctcgagcccttcgcccaattcctcaatcgacccaaaccctaggagccacatagatttcgatccgatcggaaatctggc

SEQ ID NO: 10011 - DNA, 1500 bp, Zea mays
tgagcatcagtattcccacaacctctatataaataaatagttatgtagtgtactgatccatcgaactatatcctactagcgtaggtctactactaccctcccgtttgacactaagaacccaaagagagccatggatccctacaaggatatcgaatcaatagacaacgagccctttgtttctccgttgcatgaagcgctgagaggcactgtagcaatgccgcccttcgtaggttcaacactgcacaaccaacctagtagtactactgtccacacaccacaagaacctacaaatttcgtctacccataccaagcggttgaaccgacatcgtcgctgccattagcctataaccatactacggccgctactagcgagaacccaatcatctccgccgccggcccatttcattccatgctctcggcaagcagctcatcaacaagcagcaaccatcagaacacactgttgtttccagagccaaatttcgtgacgacgccagtaagcgactacctcagcttatctgattccatgaggatcaggtctatggatccaccaccacccatcacactcttgctccaaggtaaccccctcgcggttctccatgcgcactttaataccgtcgatgaggtaggcgacctcggcccggtcttcgagcgacctgcgcagcagcaggtggtgcagagaatgccgccgcgcaccgcactggagaataatggtagaggaggagggcgacatgaatacgtgtgcaagatctgctccacgaggttcttctcggcgcaagcattcggcggccacatgagccaccacagcaaagtcaaggcgaaggaagctaaattcatatagcttaaaccggtgcggtgcggagagattatatgagggactaaagtgttgcggttgtttcggtaccgattacgagtgggtttttttttttaatttcacaagccaataatctgatgtgcggtggcatatggaacgatttatctgtggttttttgcggtgatgtgtggtgcttcatgtttttggtaataatacattattatgtatcctgttcaaatcatgtattttaatctagtgattttatcagtggaagattgtctcttaccaagttagttcgattctcgttgcatcgatctgcttgtctagccacgtactccagctttagtatgtgtaggacacgacctcccctcccctgcaggctcaccggcaccgtgagcccacgaactgcggcttccgtcgctgagagagtactccctcgctgccgtcgccgccgtcaagtgaaatgagggagaagaaccggagaaagtgggcacgtgtgcgggatccaggctggccgtggcctatgatccctcgtcaccactccttcccttggtccccaccatcgcgaaactgaaaacgcaccacaccaccagccagccagccagcctttcctctccctctctggccattgcctcgccatcgcgtcggacgggaccgaggaggaggcctgccgtgccgtgccgcgggcg

SEQ ID NO: 10012 - DNA, 468 bp, Zea mays
atcgagaaaaaatgctatgttctaaatcaaaatatgataaatagtgacatcaaattcgttttcgtacgtatgggatccgaatacatctttatagagacacggtcctggaacgttttaaagtttgcagcgaccgcacaccaacaccgcatcgtgccgtacatttcctagcttcctgctctggctgcctcctcctccgcgtacgcgtatagatatttgtgctgacgagaccaattctattttatttgttatcttgtttggtggtggttgtctgccctccatgcatctcgccatcttctatttataatagccccgccttctctctgttacacgccatacaattctcacacgcgcgcgcccaacacactagcctgcaggatcgtcgagcgcgaggcggctgccccgccggccggttcgttcgctctatagcttgagaccgatcctagctaggccaagacgatatcggcggcg

SEQ ID NO: 10013 - DNA, 1345 bp, Zea mays
ttgtgcaaattgattacattatccctaattaatgctatcttcgactactgtttacccacacgcagagctactgttcgtgcgcattcacaatgctgcatgcgtgcacgttgctttggggaggagcctacttcatgcgcgttggttagggagggcatatgaagtaaaaatgtcactttatggttagtttgacaccctcatttttttcaagggattgtattttcacaaaagaaattaatttatttttcttgaaaaataggaatcccttagaaaaaaatagagttgtcaaactaacccttattcattttagtcactcttttggtaattagaggactataatttagttggaggattttagtcacactgtgttgattctttagtgactaaaaatgactaaaatttaatcaattaaatgtagtcacccaaaccaaacagagtcgcgcgtccgacgtgcctcctcaaccggcgcgtgggagtaggtctggaaaaaagctcaagctcgatgagttggcttgggctcacggtaacttgggtcggctcgacgctcaaaacgagtccaagtcctatttttgtggctcgtgataagtgtgagctagctcggctcggctcggctcacgaaccgacaacaatttactacataaaattctgattagcatataatgttagtaccaaatatacarttagtatatgttatttgatatttatatacaaaattaatttatttctatgttatattagtactataattatttattaatttaagagatgtaatttgattatttttgatattttatgttataatttgtaacgtaagctggtgcttgtggttagactctctactagtcgagttttcacgctcgtcaaaggaccgagccgagacgaggcaagctcaacacattaccgagccgaccggctcgtttccgccacgtggtagagcggcagcacccttcccagatctcgtgtcccgcgcgccgtgcgcacagccgcgcacacacacggactgccgcgtccgggcgcgatccgttctcgcgaacacaccggtcgtagccgtccgtaatttgtactagtatggcacgcggaacacgagtcggcgccagcaccggcacgtcaccatcggggccgctggccccatacgggcagccaattaataaatccttgctctgcgacagacgcgcaggggcacgtcacgcagccgtagtcgatcggtgcacggtgctcgcgcccccgttgcagcgcgcagctctcccgcgctataaatgccccggctcggcctcgctcccacagccacagcctcacacagacaccaacgccactgcactgcaaaagcaagagcagctagctagtaaag

SEQ ID NO: 10014 - DNA, 1132 bp, Zea mays
cgaggggtgttccccgttcgtcgtaccgccgcccttaaactagctagtgctgctcggcacgcacgaacaattttttatttttttttacggaggaccgaggaaggatggcaggcgatcgagggccgtacgtggatcgtctactacttgtgatctccttttatatgttcctgggggctgggactcgcgttcgacgaaccaagacaaattaagtacgcacatgtcgctgtatatttaccgctttttgttgacttggatcgtccaaattaaaacggtggtgtccgccgctcacctctggacggtccatggtagggctctctcaaagtcgcagaggttgcaaagcttcttgtctcgttcgtttgacgtagctgacggaaaacggagtctctggtcttttaagccatgcatgcatgcatcgagccagcagccgcagcgaagtgcgtgaccgatcgggtcaaggtgtgggcgcgcggccagtgaaacttgccttttgttagagtgacgggtgtcgccgcgtgtgtctaaatttttggttgcagtagtgatgtcatctggagggaataataattgacagttgtttcctgtcagtcgtttaacatcgcccccgcctgacacttctctcgaaagtttaagggcccctcgctttgttctgcggcgccgcaacggaaaacgggaaaattacgcagggactatctatccctacctacctacctaccatgcacctgtcacgtttcgtacacaatcatctaacgagccgtgattttttcaactaatcttcttccgcgcatggacatgtggcatgagttcagctggatgaccacccgtacatggtggggatagtgctcacctttctttttagaaaaaaaggaaggcgtcttgttttcggtgcctggccacccttccctcttcgcacgcagtcgcagactcgcagccccccttctgatcctcttcctctaccacgcggccacgcccccgccccccgctgactcacgcaacgcgcgcgacgacgcggaggagaaaaccaggaatcccataaaggtttcagttccgcaagccaagccactcccacacccccacgctcgagcgaagggaaccagcaatggcgcgtcgcgggccgtgagagacgggaacaaga

SEQ ID NO: 10015 - DNA, 162 bp, Zea mays
atgataatctcgccgccgccggctatccggtcctactgtgcttgcgacccttgtttgcttactgtacctagctctatttattgggcccgatggatttggcgccggagagcagggtgtactcgagacagacaggcaggacggccacatccgccatattcaggc

SEQ ID NO: 10016 - DNA, 232 bp, Zea mays
ggtattttatactagactttgtttacaatagtaatactatacatcatagtagctaggttgatacaccgtatagtagctagctcgggcatatactctatcgcatgcacagtagggatagtcatatggacgttctttagctgaaaaactgtgtgtgtagataggtttgcctatatatatatgtgtcttccgatccttgtactcttctgcacaacagattcagccgttcacctta

SEQ ID NO: 10017 - DNA, 1500 bp, Zea mays
gagagagatggtgcacttgaaccagccttaagtttagtacgtgtatgtttaaatatcaaatttgggtattgaatataatctaattacaaaataattatagatgaagcctaaataataaggcacattttttaaacctaactaattcataattaacaaatgtttattgtagtatcatattagctaattatagactaattagatttaatatattcgtctcatcgtttagtttttgtctatataattagtttttaattacattttatttaatacttttaaataacatataaacatttaatatgatatgtgctaaaaatttaggagagagaacgaacgggcccacacggagctgctaccggaacattgacgtaggaaagccgcacgacgggtctctcgttccaaggaaaaggcaatatcggacatctgggttgccaacgtaggctaattattttttaaaaaaactcgtaaacaagtggtattactatactgttaggtaaggcgagaattttattttccattgcgagttgaggctgacaaatttctaggagagcgaaattaaaacacatacttctactactaaaggaaatgatggggagagaaatgttaggtgaagtggtccagcgagatgggggttggtggcggtggggtaggtgagagaggacaacaaggctacagctaccgcccagcgggtggcttcaaccccgacgtgggggccatccggtcagtgtcctcccgctgagtcctcacgtgcatgcctacccgactcgccaaatactttccgcaccgtgactcaggtacacccgcacccgcgcgggcccatcttcctccccggacccgctctcaccgcggctataaatggcagccccagcactcccgaggtgccgtgccacacatccgtttgcctcttctccctcttgccggtcccgaataaagagcagcagcgcaaggtcagccatcttgcccgcaccctgcttctctctcgttggttcgttcgtccgtgcgtggttttgcgcgtatgcttgtggagatatatgctgcaaacccttgggtcttcttcctccgtggagggggtaactggtgctcatttcttggcgcggttggatctgatggtcgccacgggatggcagatccgggtgtggggtttggcgatttatccttgttgcagtttctgtatggattggatgtcgtttaaatttgagggaaatggttttaaatttatcatttctaatacagcagtggagaaaatttggcttttttataaaaaagaaaaaattgggtgtctcgggagggttctctgattttcagatctcgtagcctctactacatatggagcagtgtgtggtgctctgatttttcagatctgagggcatcggtttcgtcatccaacaatatataataataataataataaatgagcggtggatctatggatggtttgtgcatgattgtctgaattgctttattaaataaaattgcagaggtcggtagagcgagaagaaggca

SEQ ID NO: 10018 - DNA, 961 bp, Zea mays
tataaagtctcaacaacatactttaaattttatcctatcttatactccatttctttttccagccatattaataaaaagaaaattccaacgtactattttttcattaatgtgtagaagcagtattggactggttgggagtctgacgggaccagcgcattcaccatagctcgtactgtagcatggcaggaggcagcgtatgtcagccaataaccgatcgagcgtccaaccgtcatgcgctaccgtatacagcaagcgccagaattggcggatcagctgcagactctattttagcggaagttgttggagataaaaacgagattgggaaactttaaatttaaagtatttcttgctagagatagtaaatggtactctatgtaaatatcgattaccgatattatcagtatgtattcgaatttgatccgtctaaacgtgttgatatctaatttatatttgagtcggtattcaatattcaattcgtattttatttatatctatatttatacacttaaagttagatattgaagatatcaatatctatgtaaatcttacccgtcacaaatcgataatactgtatcccatttgaataggaaaataaaataaaaattaaaaataaatatgaaccattaatatcagttcgtagcccacacagtcgggtaagaataaaaaaggtcgccctcatccaatccaatccaacctgtccacttccgctccacaaccccacgaccaataaaaaaccaacggaaaatatcgtacagctgactggtccagtagattagatgcgaatgaatttaaaaaaacaaggggatcacggaatctgggcccaccgctccctcgcccacttgtattaaaaggaagggcctccatctcaactctcatccatctgctctgctccggtccgttccgctccttcctccccctatctagctagccttcccgttcccgttcctgcatcgcggcggag

SEQ ID NO: 10019 - DNA, 276 bp, Zea mays
gcctccttgaacagaccgggtcgccaccttctcttcgcgctcactgacaagggagggagggaggccacgcccacgctcgactctcttgcctccgtgtacctcctcgcggcgcgtgccgaggtggaggaggagcaggggaaggggagctacctgccgttgcgtgccagctactacaccttccagctcccggatcgaagcacgggtcggttaaagcacggggccccgagcggcacggccgacttggcagcagccagcaggtgaggcggagggagaggg

SEQ ID NO: 10020 - DNA, 639 bp, Zea mays
accgtccgtgactacgcagagagctccgctcttctctcggacgtgcgcccctcccctgtgtcggctcgaggatgaagaagggaaagatctcttattaggtctgtttggatttgtttggacgtaacagatacctaaatagatattgaacttttaagagatatattttaaaagtttatggatcgtgttgatacaatagcacaagtttagggatcgaaaatacatttttactcgtggactaaaagtacaatcattgagaaacaattttttaatgctataattgcacttatttagaatactgcaaattcttttttgggaatatatcctgttgacattttttttggggtacagttccgatggcttgttctctagcgccgcgcaaagatagcgctagacgttagtccattcctctgatgcaaggcatgacgcatctgtgtcgatgagttcgccttcctattcagccacaggcggctatttatgcacctcctatccacaaggagtgggccgttgcaagcgacacgacctctgagcagtgacactgacagtgcagctcggagctcacgatcgccctgtagctatagccgaccagcagccgtttaccagcacgtcaaactccaagagtgtcttcagccaccctgctcc

SEQ ID NO: 10021 - DNA, 53 bp, Zea mays
ggtaggtactcagcacttgtgatccttgacagttggtttgcctttttcttttc

SEQ ID NO: 10022 - DNA, 454 bp, Zea mays
ggtgagttttcattctcctttgatattttattctaacaacatttgggtaaagttagggtgttatggacctgatatacctgtgtctgtgtctgtgtcagataactagaactttcctataacgagtcagagaagccaccacagctaaccagaaagcatatttttacataccaggccagatcatttgtgtgctacaaccagcttgcttcagaatttattaacgttgtattcctgttcttaactagcttcagcaaaacttgccctaattgactgctcttccatgctgacagaaatattgcggaggacgcggtcaatattacataaactgaaggaacagatcagtgacggtactccagttattggagctggtgctggcacaggcatatctgcaaagttcgaagaagctggtggggttgatcttatagtgctgtagctgtacaactctggacggtttcga

SEQ ID NO: 10023 - DNA, 594 bp, Zea mays
tagtacacgactagcaaacaaagcaaaaaaacgagacggtaaaggggcgattcagattgcccaagaactgcttgctcataagttaaaagatttggcccctaatgttgctgactcacataatgatttggtccaacagcttgtgcagcattttgatcaaccactatccaaaggaaagattgaggccatcaagaacttgctggaaaatgggaagaagttgaagaagaaggtcaggggcaccaaagtcgcgtcggctgttctggcttgcccatctgcgctggtctaatggtggagctggctctttagggtcgtgaccctgtatttatccatgttaccgtctgctggagtgttgacaatggttgtgtgtcagggtctgttcgcttttggtggtttaaaaattaggccttcctacaagtgtgtggaacgtggtaaggtgtcagctatgggggagcaaaatcagtttctccctcccttcctgtcttgtttctgtccttggctttgtacttggtcttctgcggccagcctcatgggaattgggtcagtctctttggccttgttgatgttgcaacaattatctagtagtcgattttttcttta

SEQ ID NO: 10024 - DNA, 931 bp, Zea mays
atgaagcctgaaggaaggaggaaaaaaaaagagaggaacaggtggctatgctggatgagagtttagtaggcagcattgctgatgtgttgattggtttactccttgttcaggcgtgctccttgtatcttatgagctgcctagcacctttttgtgtgaggggttgtttgtattgcacgatattgcatcgaggaatacgtatgtacgtgttgtcaagaccctaggcaattctcttcagggctgtgagatggttggggtactgataccttttttttgtattgttttcatttcaccacttagctgaagctgtcctttttgttttatgaatgctgcaatagtttggcgccctcactctgtttggtctgaacaaggtaaccttttgtacttcccccgtcttgacgcgctaagtttctctcagatcgcagaagtttccataggtacaaaatgtgatccatttaggagttgccagttttattctctataagggctagattagaaatttaaatcactttcataattcctgtgaattaagtgaaaaaataagctaattttcccatcgatccccgaagtttccaaacggagaaatagagaaatagagaaaacggcgcccaagtcttgaagtcactgacttgtgggcccagaggccaaagcgcgcactgcccatcaccgtctcctgaatctcagaaccttatcccctcctttgctccatccctctcctctcttcctcggcgacctccacgccggtctagagccggcagcgctgcggcggagcaccaaccgagctccgatcccaccccgctcccaaccgcgcggccctgtccatggcgcgcgcggtgcggcggcgagcccccatgcattcccgccgccggagcgcggcctgctaagcgacgacaattcctctccctctcctaaatccactcccccacgtgtcttc

SEQ ID NO: 10025 - DNA, 708 bp, Zea mays
tatatatatatatatatacacgctagatgtaatatggctaatcgtattaattttatgtwctttatttattcatatattggtgaaagttattatatatataaagtatttatatttttattctttttatgtgtttagttattgagatgttatatatatatatatatatatatatatatatatattatgtattttaaacaatatacgtggatgtgtattttgatagggacctagataatacactctggtaagtttaggggctatttaggcattgttggtgctaatatgctgccacgctagcaaacatgtctagcgtagatcaattcgttccaaatcttgactattcatgtgagtatcaacgtttcacatcgattcttaaattagaccccagcataatcaaatgttagacagttcctctctggttctcttttgagccaccggagcaagccactggcctctcagcggttgctttgcggccccccatcgccaggtttacggttacctttccccgacacctgggcccatgtcccacgtccctggcccgccacgtggccccctcctcctgctatataaggacccaactctccagcctccgcctttgccacgaccagacgaccgtccatcgtcggtcctcccctcctctgctctgttgagctgctctctccctctggcctctctctctccgttccacttcttgatcgagagacggca

SEQ ID NO: 10026 - DNA, 650 bp, Zea mays
cttttgtttttcgcttattcattcaccttgaatacaacaaaagtctgtaacttgaataaattatatgctaaatctatctcatattatataaaaaccgtaaaaacggtatcatcacgactcgaaaacgaaaaatgcaaaacgatcagaaaactagttaaatagtttttgtaccgtttctaattggtttccgaacaattcggaaaacaatcgaaaaaacagtattcgaaacggaacggtacgagaatttctcatcatgttttcatctctagctattagaggcggatctatgttggttggattgagggcataggcctcgctyatttttcttccacgagtagtagagcataaattttcactattagaccatctgttatctaacttagatgtactcgctctattattttgatgctcgttctcataaacgtgttcgcactctcattttgtcgagtccgccctgagtggcctaagtggggcaattagacaaggcaaacacaactaatactggagtatttctaaataagcaataagccccacgaaagcgcacaccccatctaaaaaaggccgcaaggcaaagagaaaacgaaacgcgaagcaaacccttttcggcgtccggcgtccccatccccaccccaccaggccaccacggcggg

SEQ ID NO: 10027 - DNA, 665 bp, Zea mays
atcgctgtgaaaaaagagaaacgacgatggagatgctggagtaatgtgtttggtgacaaaacagatgaactaaaaaacaaatggtccacatggaggtaggttaggttcatcagaacgtgacaatatacctatgaaaacagcattcattattctattgtttgtactcaggaataatagacaagcagagaagtccatgatttggtttcccttagtttaggaccctgtcctgttttttttttttagtgcagccgtgcaggtatcagcatatgggtttaatgtaggtacaccagaaacatttgccctgttaaattaaacaaagagggcgagggtggcaagatgagtagagctggtggacttgatctgagcagactgcaatgaatcatatcctcaagaggataaaaaaactattacctcctgtgcagggcatctgtgcatcagcgacaggaaaagagagatgaatgaacgaacctaatccatccatcagcagcgtaaccaaatcaggcacaggtttgggtattaatttaaagcagtggaagtgatgagctgggagcaggcctaacccttttccaccaactctagaagagctcccgcgatccagtcaagtgccctataaaatccagccccgcttggcttcacccacccttgggctcgcagtcgcagcaacg

SEQ ID NO: 10028 - DNA, 297 bp, Zea mays
aaaatatgaaatataacctcttttgtgcatagaaaatcttgactaaaattttagtttctaattatacacttctttctaaacctcagtttgataatatggtaggccaacatagggaaaaaagagaatttaatgcttcattacaggagtttaggggggagattctgacatttctgaagaggctactgagatcaaatttattctgaacatagcttccatctatcaaacaatgtagaccgatattcaaactaacattctatccatgattatatagaatcagtttgttgattgcctaaggcc

SEQ ID NO: 10029 - DNA, 1082 bp, Zea mays
aaaatatgaaatataacctcttttgtgcatagaaaatcttgactaaaattttagtttctaattatacacttctttctaaacctcagtttgataatatggtaggccaacatagggaaaaaagagaatttaatgcttcattacaggagtttaggggggagattctgacatttctgaagaggctactgagatcaaatttattctgaacatagcttccatctatcaaacaatgtagaccgatattcaaactaacattctatccatgattatatagaatcagtttgttgattgcctaaggccatgattcaagatttatttcagagaaaaaacatgtatgcagtcacggtaagaattttattttcttaaaaataccgtattgctttcttgttagctaacaaaaatccagaaattaatggtgccaattattgtttcctgaaaagtacaaaagaagttcagaactaattctataactttgttattcaggtgggtgttggcctgatgatttttcagcaactgggaggaattaatgtcttaggtttctatacaagctatattttttcctctgcaggtatccaagctagataaattttgtcctcttaaaaaacgaggtatctacagctctttctagaaacttcaggattttctggaaaacttgggaccaccttgattggcgttattcaggttcagatttagacattttttcaataaaacagtactattccaagatttttgtttgaaattttagtatttgcgttgtcattttgattttcttgtgcactaatttcttggtccaatttatattaacagatgaacgtaacatataccgcttcagatggtggaaatattactttaattgatgggaaaaaggtggactgcatcatacatgttgggcggatagtagagaggcaatcagtttctgatttgcaaaaacagtttcagcacgttgtagcctatgcaatgcatctgaatccaatttatggagactcttttttgttttcattgttgttttggttagcgttgtatgtgcctgttgtaagtttgcaaagaggagaggcaatgatggactcccttaccaacaacttgag

SEQ ID NO: 10030 - DNA, 228 bp, Zea mays
gtcaaatcctatgtgttcaatgccatagatttcttgttcacacacagctgctgcaacattgtacgtacatttcccattgagagaaggcttttgcaaattgtgtgctgagtggcttgcttggctggctgcctgagcctgactactgcacctataaattgacaagcccttccctctcctgctctgcaaaccatacctttcattagcacggtatacgtacgtagcgtagcc

SEQ ID NO: 10031 - DNA, 1500 bp, Zea mays
gcccgggttcgcgcgagcgagagccagggaacgaacgagcggttggtggttgtggctcaggctcagcggtccgcagagagaggccgactggcgcagtggtgctttctccgaagcccggaccggaccggcgctggctcgcagtcgcgcacgacggcgacgcgcgcggccgacatgcaagtgcaccgggtctgctcgcgggaacgggggggattccatcaccattcaacaccagtgcgtgacgaggaagtcctaaccatatgggacaattctggactaatcatcctacgctagaggacaccgaggattggactgctaacgtcgacggcaagcaaactgccacccaccacagggcccacctgtcgggtcgcaagtactccacgctttcgatcggacgccgaaacagaaggaatcgaagcaaccagcagttacgtgctgcacaccgcgcctgccttttttcctcccgtgccgccgctacggcaaagccaccaaatctcagcaggaccaaagtgacatgacaacaggaccaaagtgagggcacttagaacaggcctttcgcgctgtttctacccccaacatttcgattttaaagacggcaatgagagattttctaggtttcgtggttttcgatccaccggtcctgatcctcctattgatagcacaaaggggcccatttggatggatgggttcgacgaaccgcacccatctatctatgtttcgattgcgccacggcaggtggtagtggtaacatttgacaattccatttaaaaaagtctcgtggtcgtgggttgtacgaaaataaaaactgctcattcacgtagagaaaaaaaatcagcatggaactagtagtattaatagccagcattccaggctggcaaagaaacaaacaaacaaaaataaagtcgtcggcaagcgttctcacgaagggaacaaacgcagacaagtaaactacgcacatggcgccatccactctccctggctgagtctgacagcgtgaccagctccacttcggtcccactcatcagtgagacatttatctcagcatcccggtaggtgacacgaggccgcgttttaaaaccccttcacctcaccgcgcgttttcctccgctcggttttattccccccacccacccacccgcgctcctctgctagtctgctctgcaactgcaagacgattcgtttccatcgccatcggtgctgctcgagctcgactgctgcagctgctaccagtagtgagctgtgtgtgtgtgtagtatatacaatattcgtataaactgctggtctcaatcgagtcgtcgcccaatcggttgaatcggggagcagaggcatcgcccccacgcccaatcatccgcccccaaatccccagaagcacccacccctccgcgcgcgagatcccacgcgcgtccctcccacagtcccaccaccccccggggacgcggactccctcctccgtcctccccccccccccgcggtcccagcccagcggtggccctgcgacgaccg

SEQ ID NO: 10032 - DNA, 454 bp, Zea mays
ttgcattgtaaattacactatttatagagtaaagtttagaaagcgtgatataaagtttgttgaatatagtctaaagttattgataggtcagtaactctaacgggtcctggtttgcgggccccaccagacggagccttgggtgctggccttggttggcgtgccgggcgcagcagtgctctgctactcccaattaaaatatactcccaaagaattcggcagcgccgaatgaagaattaaaaagcccccctaaaactgcagaaaaccagggaaacccgagaaaatcgagtatactgaagccatcgagagcagctttcttgcaactcccatggccctataaggcagagagagatagagcaagcgagcggggagaagagattgagcattgctggtggccctgtgctttgagagaggagagaggacttgaggaataggcaggaggctttgtggtggagca

SEQ ID NO: 10033 - DNA, 749 bp, Zea mays
ttattattatgtactttgtaatttttaattcaataaaaaatattatgttgtgtgttttctgagcgttgaaataaatccgcgtgaattacttaattctgaaatagaaaagctgacgtggctatagcctgaggctgtagcctgctgcagcctgtgcactggagcagcaggggcgagagtggaggcgagagctgacgtggcaggggcgagagggaggcagtgcactggactcagccttataattgaacaatggtccctttgattaagaaaatgacccttgtgaaagagtaggtttcttgtactagaagtagaatctgctacccgatccttaatttgacgtatgtgtttgtattcttttggatttatttgaagatttaatagtgatatacttttagttagtctccttcgattgaagatttaatggtgatattttttcaatagtgcagcgaggtttatgtgtttattttcgtaaatctcgacttctgttaccaggtctccgaatgtggtacataatattttgaaaaggagaaaattaggtagagtagtaagttatcacttgacagtaatttggttgtcctcctcaaattctgccaaactggctgtctctgctttccgcgaatcggcaccttctccttttttttaagctgaatccccatcttcgacttccgcacctcgcctgaatcgctcattcgctccccaccccaacgctccgtccccgcggcccaccaaccgccgccgccgccgccacagcc

SEQ ID NO: 10034 - DNA, 113 bp, Zea mays
aatttgcgcactgacatcttcttttaactgagcagcagagaactgaaaagtgcccccgctcgctcgcatcaggaaatcaacgactgagtctccacgactgtcggtcacttcgg

SEQ ID NO: 10035 - DNA, 955 bp, Zea mays
ttctcttctcttctcttctcttctctcgccgttcgcgctgtgctctggttctgctgtctggtcggtcctgctgtcgaggctgcattgcatatttgcatgcacaggagcggctgcagggaaggagtgagaggagcaggatgggtaggtgggcgggtgagggcaaaaggaagacttcgcttttcgctttcccggctgttgctgttgctttccttccccttctaatcatcccttctcctcctccctagttattatcgtcgtgccaccataagcgcggcctcgcgccaacaagaacctcggcctcgggaggcagcagtagcaccgccgggggaggcgcagcgcagcgcaacggccggcgccgggacgagagatcctcgaatgtacatgtatgtatggcgctcgtcttggcctctcagctgtccgcgcgcagattggtctcggcttttcaatctgcttgtcttcttcctccagttctcctcctggtttacgaaaggaaacgcgggttcttccttccttcctttcttcgtttccgttccgatctgttttgcacgtgggtggggttcattcagcttcccgctccgctgacggggttgcgacttggcatttctggacggatcacctgcttgcttcgatggctctttctgtctcaaaaatgaatttcaataaagcttagcccccgaacgatctcgactaagttctgttcatgtccatggtttgtttcggccttcccggccatcagaaacgcgcctcccttctcttctcttctattctcttctcgcaatgcatcttgcgcgcgagtgtaccgggttcggtttggttaccacgaaatggatttgcagaactgacgagccatcacatgggctttctttctgcaggacaaggaaacttttccgtccagctgacccctctctgatctcgccaccgaagcgcacgctggacacccgtggttggtggcacc

SEQ ID NO: 10036 - DNA, 1500 bp, Zea mays
atgggtatcattgcccacccgctccgtctagctacgccacgccatacgcaccggacatggtgctgmtgctgctgctgctgagtccactgttcacaagacgccgccaccatcagtcagtccacggtccacaccacggcgtctcctatccatgtcccgcgtgcatgctccccagccagccagccctggcgtgcggtgcgccgctgccacgggctcgatcgcctctctgcacgctttccacgtcgccttttaccagcggcagagcgcttggcacttgccgcttggctttatttatcggggtgcctggactctggtggagctggcttcacttgctcgtctccgctggacgctggttggtggttgccttcgctcttcatccttcaaccaccaagccttggcatcgttctgccctgcgtgtggcggcggtccctggagaggagacaagccgacgtgtggtttccgttcttggcattgctcaatctccccccccccctccctctctcttgctttgttgcttcttgactttcgtcgtctccctatctttctcatccttttatctgttggttttgaattcgacggcacggacgacaatgaagaaagcgggttcgtgacgcgtcagtcacggcctctcgtgtaatccaaagccccaaacctctgccacttgcctgcctagcgttgccgccgttcatgagagaccatgcatgcacgcacgctgccattcaccgcatggggaaagagaagagcctgtcgccgttgcaggttcgcaagtcgcaacgacggggctttgcattgcagctcggcgcatcaggagccgggcgccaagtggcgtgcacgcccgtcccgtggagttcattcgagcacgcacataccagctagacctactagctgacgaccgagattctttgcgttctactctgcgcgttcgtagcccccctgtccctgtgcccctgttgggctttactcctactgcctcgtagccgtaggagggcatggcatgctctgcctgcgactgcgcgtggcgtgaggaggacacaaaagccgcctgctttcttgggggaaaaaaggcggggtcgtggtcgactggtcgccatggggacccaaacccccaacccacccaacaccatcgcttggaatgcattgctagcagcagtaggcagtagccactagcagctactaccaccgctataccactaggaaatgcgtttgggttgggggcttgggttccgtcttcttcacctggcctttactcccctcccaacctcctctttgcctgctgctcgcaaacagaaacagcttgcttgccatttaacacgctcgtcctctctcacagtggcatgcaggcgtggtagagctctcacttcccctcagccaccaatgctaaagtgcgcataagctgctgggagccgatattgcatccgtcgggagcttggcaccaacaaaagctcgagttttccctttttcagcttcggtctggtgcgtgcggcgcggcgcctcccggagatg

SEQ ID NO: 10037 - DNA, 1500 bp, Zea mays
tccgccttttggacgaccacgctactccatccaaagaagcaggcacgctgccggctgtagcgtgcttcgttcagattttcagaaagtccaggagaaagtagctgttcatgcttttgaagccctactgttctcggtctttctccgcacaaaaagctctggccgtctctatcctctcgtgctcgggtgcaaccacaaggtggtctagaagcaatgcaccacatgagtacatgacttccacgccatttcttcctgcggcggcaaaccgaacctcagggcctactaccgcattgagtactccaacaaggtgactccccacgtattaaaatactacattatttaaagtgtttaggacactaaaaataaattgtgctataataattaaaccataaaccatatactattttaggaagtaattacattatttgaaaaagaatgataagaacgatatagaaaacaatgacatagcactagtctattgtatagtatatttatgtcgttttatggtgtgccttatgatttttaataaaaaatatagaataggttactgttggacccacttttttttaagtcaaggcactgatttaagacactgttgggagatgctccaaccgaaaacacgggagaaatgcaagccagaggttcatgcctcatggcttggtgccaccgagattatctaccaaaagtcagcttcctgactcgaagaggccctttttataatacatataatcaccgatatccatgagaaaaaaggcatagcttgccttccattttgtttctaaaatgcataaaccggagaataaaacccctttccttattcatcacgggatcgtcgtgtgaataaaacccgagacgccgaggcggatatccacccggcagacatagcaccgagggctggtttgatcgcgtctgttttaaaggcttcctagttaaatttaaatagagaaggatttaactcctttcaaccccttgaaaccagacgcaacttgagcggtggcacaccggcacgcacggggcaacagctcccgcggcacgcacgcgcgagatacgatcctgatccctgcgtgccagtgccactgccaccacgggacggaatgagcccggccacgatccacctcccgctgacgccgacctcatcgctgacgccacgccaccggactgctaatccaccgggcggggaaagcgaccggaatccttcaaactagtcgactactagattattacaatcagtgctggcattagcgtcgccgcgaccccctgcttattttaattttttgtacgtaccggcaaaaacgccattccgtcacgtggctccaggttaggaaagttcaacgaaccgcgacgccggtgtgaaccggcctccgcctatataattccccggcccaaccatcgccgttcaattccattccacacacacccgtctcagctcactccctcctcctccagtttcgtcagctcatcatcatcataaaccgaacacagagctctcgattccattccagg

SEQ ID NO: 10038 - DNA, 1500 bp, Zea mays
tttgtaccgtgaagggtcacaatttttgttccgtggcatcgcacgagcacgttcctagttattatataattaaattaaacaaataaaagagaatatcattggatcgaccgcgttccttggctgcaactattatcagcaaagaaaaaagaaacctcgcgcgtcatgagccatgaacccatgacccacgtgcacatgaacaatcccaatcaacatggttcgttttggacatgttcgtttgtgattgttgttgcacagggcctaagctcctacagctctgctactgctcatctgtgtacgtgcagctgtgtgggccgtgtgcccgtgtcgctgcatagagcaatcacaacgttgtttaaaagtagacaagtagtttatatataaaagtagagactagctcgtcgaatactagtccatacacaatcgagtcgaccatatcttttttatttttttaaaaaaactacagattattattaaacgaaattagataaagacgcagcacacgaatactaacagttctcctatatttatggtcaaaactaaccaaacaatggttgaaaaacagacgttgatcaccaaaccgaggtagtgcagctgagaggtcctgcatcaaagtttggtgaaatgaagggcaaagaaacctggcatccgatgcgagatcaccaaacatccgtgtacggtaggagcagaaattacacgagtttactttcatctgttaatgatgaattatcagtatatgcaatgttaggctgtttagtttaagtaggtagttcattattttctaactcctcgtttggcttttagtttgtagaaaaaagaataaattgattcatcgtcattttatttttcatagactataataataaataataatatcatttcattctttatataggctaataattagtaataaaaaaataatgaaattgacctatatgcattatctcacctagaatggatgaatcttcaaacaaacacccctgtatttacggtagggggctacagttcaggctcatcattgcttctgttgaaaaaaaaagattaggaaaagcagcgtgaaaacggggaaaatcagacggagacagcgcgcagccccttttttcttgctgaagatgcgcgtgtgtgcgttggaattttccaaggaggaagaagggaaagcctaggaaagccaccgctcaccttctctttctctgtagcctctgccaccaaacagctttggagtgggatctcctcttccttccccgccctcttccgccgacagcgggagagtacgcggcgcagcggctacaccaccgtctccaggctcccaaacacgtccctgccatccttttttgactccggagtccctcccctccttgcctacctggcgaggatcccatacccaatcccatccaactagcttcctactacttcccccccgtcctctcgatccctctccccgttcccctgaccagccgggcgtcaagtggcagggaggagaggcggcaccgcgtgtgaggctca

SEQ ID NO: 10039 - DNA, 1500 bp, Zea mays
gatatccgaattattcgtatttgtattcgatttaatatgaatgttaaatagacatatctttctctatctagtttaagattcgtattcgacaacattcgacaaaactatgaaatatccgatactattcgtatccgaaaggtaaaagtattcaataaaatcaatttaaacttacttttattactaattaaaaattacaagtgattttaaacattaaataatatactaaaaactgaagtacaccatttaaaattttaaatgttaaaaatatttatattataaacaaatgactgtgttaatcttacattactagtgatatacaacgataaattctaattaatattaaaagtctaatttgaatacattagattattggagttttagagtccaaaatacaaatatacttaatatacaaaaagaatatatttagagtccaaaatataaatatactaggtataaataatttatttaaaaatatgatactcaactaagtttcaactaaatattgtgtatgtactattgttcataatttgcttgtaatatgatttttatcaaactataaatccatcgataaaacaaattaatacttgttataatgctatgttctaaatcaagtaagtatccgaatgtaaatccgaattcgaattatccgttttgtattcgtatccgacagtattcgtattcgtatccgtattcggattaaaatataataaatagtgacatttgaatccgtgtccatgcgtattcgatctaaatccatccctatcctcaccagcttgaaatgcttttgccattcctctggtagccattcaatttcaaatcagcggaagttgtggaaatcagcgctgcggacaggccgaagcccagcccaacccgcaactgtctgagcctgcgggctgcggcactagcctgcccaccacccgagacagcccagcgtggtgcacgccaacatggacctgtcccgacccgcacgcgccctgccggctgctgctctcacgtgcaccgccgtccgtccgtacgcgcgcggagagggagaggagcgaggaggggcccatctcacgtgtcacgcccgccggtctgcctctaacgagatgcgcgcctcctctaccgtcgcaccacgatccaacggctggcgctccacgccgtgtctcacgcccttcgaccgtcgctcgccacgcggcggaaaacaccgtccgatgtggatctggtggcggtagttgcggtatagatggaggcgagaaaaagttaaaagggtgtgtggattacttgacgcgagagtgcgagacggttaaccccgcccgagcccctccttatttcattcgctcctagcgacgccaccgctagctcgcctctccaaccaaacgcaaagcaaagaacagaacccaattccatcgttccccactcgggctcccggtctcctccaccctcctccctcgcctcgcggcctttcggcatttgctccagctccgaactgagccacgcaacacgaggctaacggagggg

SEQ ID NO: 10040 - DNA, 1024 bp, Zea mays
ccttagctgtaaaaaaattcttgggatcaagatttttatggcgatgctctggatgagtttaggagtgaagtaggtgaacttttatctgtttctatcttggagttttcctaaataaactattcaattttcatatttactcagttcaattgttgatttattgtttgatatacggatatactttttgacaagattcgaattatgcgtcggctgcgccatccaaatattgttctctttatgggtgctgttacacgccctccgaacttatctattgtatctgaatatattccaaggtataatagttacttttactacacaatcactgtttatatggaatgtgtgaattaaatatcccactctagacaacacagaaggtatagactcgtgcccgcgcaagaacgcatgggcatattttcatcctttatttctctgacagcgtaatttaagcggtcctctaaatataaagaatgctactagattatctatatagagtttctctgtcatttcctttacctattttaatatttaaaacaacaaacttagcaaaaataaaatatgtaaaatatattttagagtatgacaaatacatatgtatatatatatatatataaagtaaaagtaaaatatgtttctaatatagatatttacatatagagaacaaaatatagaaaacgttattacagctaaaaaagacaaattatagaaccttttagagaagaatgtaaatgacggatttagagaacattgctggagacatagctatgcttcaacactcaacgtctacgagcgatgccctactcgatgggcctcttaccctggtcaaactcatgcaaagaaatcaagtttgttcaagcaaagaatcatttgaatcgtaattcataactagatcgctgcacgaggtcgcatragtgcagccacgactagcctcataactaaagtaaaacacacaaaccactgtccactgagtacttgtgtattcgtgttgctgtcaatcttgatagtacgtccgcggcgaattcttaacaat

SEQ ID NO: 10041 - DNA, 155 bp, Zea mays
ggtagctggactgactcaagtactctttacttgtttaaattttatcgaaatgtgtgataaaataaataacattttttctaatctcaggccagaagcttctcctgcatcatggaagtgatgcgccccttagaattggtcattcaagtcatggaaat

SEQ ID NO: 10042 - DNA, 1500 bp, Zea mays
tttcatgtatctcatcatcgcacctgatacatccaaccaaacacagtgcgcaaccgaacactagtaatattgtgatagaaaattatctccataatataatttagttgtctagtccaataagcttaactatatatagtagtttcaagttgcatacccggaccgtaggatgaaacacaaaggagagcattatgccaatcaggagaaattccgtcaaaggatagaaaattatctccataatataatttagttgtctagtccaatgcaatcccaaaatattctgacgaagcttcttaattgcgatcatttgatgccgagagccgcaacttgctgtgagcctaacggttaattcacactcagtaggacgcgttttgtagcacatagtagtatagattagcagttgtataatatactaagctccagtacttaattagctgttgagatgcaagcgcatgcaacgggcttgcgggtcggtctgtggttcattaaaagaccccacatggcatgggctcgatcgacgaacacggtgctggcaatgaatcgaagattcctggctcgatcgcccgcccaagtcaaggcagcgtgcaacacccctagcatgaatttaatgcacaaatcaggtcaaagctcttgcagcctctactatgctactgcacctaaaaaaattgaaaggagactgaattttttttttcaaattttcctgatttcttaattttttttcttctagtaaagaaaatagagattggcagtacctgtgtacgcagtggccggtgctagtgtgtacgtactgaactagctgttgcaattgcactgcactgcactgcagatctcactctataaaaccctactggtggactccatgaggcttcactctggagtctagagtctggagccggtagtacagcagtagcaaccctactcactactactctccactgtatctctactatcctcaagctcaaccagctagccactgtgtgtgtgagctcgtctctagacaacagagtgtgtgctcttgtgagagtgtgtgcgtgcgaaagtcagtgtgtgtggctctgtgtgcattgcctcgtcgtccgaggcagtactctactggccacaccgtacctttcttggatccgaagatcagaagaagctaggcttctcatcaggttacaaaggtatgtgtaatggatgatctgataccacgtcacttctctctctctctctctctctctctctctctctctctctctctctttgattggagattcgagttcgtaataactggtaggatatggtatttgcaggtgattgagttcatctgtggtaaggaactggagatctagatcgctgctgctgctgctagctagctagcagctagcaccatcacttcactagcacaaaggccaagcagcagaggagtctgttgcgttctcgggagcgcgcgcgcccactgatcgggagatcgatcgatcggcggccgctagccccaacgggcgggtgaagtacgtgcatccatat

SEQ ID NO: 10043 - DNA, 1500 bp, Zea mays
tgacagaattttttcctatgtcatcatcactcccttgcgagggtaattgaaaaaaagctcttcacgagaagtaagtctctacacgattatatatacatattatattatatatacatattatgttttaattatatttataatttaaatatttagaattgtatcaatctgttaactatctcttgtaattgaaaaccaatatggcgcctctttactgaactgaatattcagatcattcacgataaccacatgtgcccaaccgcaaactgtggcctagctgcaaatatctcgtgacccccgtcggtcgcgtgtgctaaaaaaaaacaaataaacaagtgcctctttagatcgatatctcctcaacataatacctttctaaataaacgttttaaattttatcaaagcaaaaaatagacattaatataaatagaaataaaactaaatagtggtgataaactaggagacaccgatttcaaactcccttaaataaacaatattatatgaaatagagaacaaaaaaattacttgccttactcttttataataaaatattatatatatatatatatatatatatatatatatagtgtgaatgtactagaaactattgttccaattgtttgtttattttttcccgttgttctatttacgaggccaaatgacaggtaaggatgaaaacgaacggaaacaaataggaaaacccctcttctgtttctgtttccgcattttattattagaaacatgctcgggtcggtaatagtcgagaacgaaaacagaagcaggataaaactcctcaatgaaaagtggtctaaaggtttaaacaacaccggttgcagctacatgtacaccattaataaacaaacaataatgtagtgttgtctctttttatctatttgtttttttgttactatgctagtcaatcatcaattagccttcaatatcatgtgcatctatattaaataatgaggtttcttttaattttttcgttcatgttaactagaatggtctcttgtgctacaatttatcacataaggataaaagactttagctaatgcagtaatgcatgttgggctattactaaatttctcaaatacaggataaatacctgttcaactcggttaaaatgagctccacaaaaataatgggatagatcctctcctatttctagatttttttcgcaaatacaaaaacaaaccagttaaatatgaaaaacgtagggatcggaacgagattttgatcgtccgtttcaagtttttcgcaaatacaaaaacaaaccagttaaatatgaaaaacgtagggatcggaacgagattttattattttaatcgtccgtttcaagtttcaacgctagtggcagggatccgcggccctagtggaccaggcgaggcagcgagccacagtgaactcgtcgcgtgccccgccttatttaacgccctctccccgcagcagcagcggcacctccggacgaaatctgacccgggccaccgtcggcactgctctgac

SEQ ID NO: 10044 - DNA, 1500 bp, Zea mays
tgtagtcagagagacatgtcgattttttacgtcataattgtaaccacacattcacttctattttttttggtcaattgaacagttccggcgccttcgtgccttggttcatcctccctctcaagtccaagaaaaaaaaagaggtatttgttgtagcagtatatttaggcgaccgcttcctttgtatctcgctcgtacagaacatgaatacagggcgtggggtttctgtgccgttggtagatccaatctgccgcagatctgaatcagatatccagatcacacacacacacaagaggcagacggagcttgcaggtagtgcggaaatcctggagcactccgcgcgtggctgggacggagtcaatttgaccatcttttgcgcggtcaaccgactcgacatggcaaaagcaggaacgctgctggctgctgccctgccactggctcgtacgtgaacgatctggccatctgggattatggctggatgatcgtccgtcagatggccgtggcccccagtggaggaggcagctgggcagtgttgcttgcaataatgctaggaacatgtagtgatgaaatgtggtgttgctgttgctctcctaattgaatctgtcgacatccccatccaaggcgcgagtgtagtgtaggcaccccccaccatctcctccggccactgcaaggtgcaggcagtggatccgggtcaaccgagcactagaacgctcgctcgcccccccgaatcacgcgactggccggagttctccgagcgcgaatcaccgataagaacacgtttaacatcgtctccagagtccagagcggggggaaaggcggctgggcctgggagagtccccgtctgcttatccgatggatccgaggtgtaatacaactagttcggaaccgcccgtccccatctgcttatccgatggatccggtgcggacgtgcgcaatcagtctacctcccctgcgtccatggccgcctccccccgcataattaaccacacatctgctaaccccgcataataattaacgatatcggcctcgcaatttgatgcggcgcatccttatctgcccatcggctagctgatcggtccccgtcactgctccaatggccaaatcacccttgacacgcccaagggttcacgcggggatcaaagccaacaccccccactaccactacaaggctggacgaatcgcagcccactcggctggcctggctccatcgatcgatcgggcggtccctcgagaaagcgagggccgtttccacgagcgcagagcactcgtgtgcgcgtgcgtgtctgtccgcctatatatcggagccttgcgcatgcaactctactactactactactactactccacatcagctcaaccctacccagcgctagccctacgaaccgcagctgagtattcaactagctcggacgaccagcagtgctgctgcgtgcgtacgttgctgttatagctagccactgccccctgcaagaagcgcgcaaggcataacataaccacccattc

SEQ ID NO: 10045 - DNA, 312 bp, Zea mays
ctcacacttcatttttactgcttttttgtcacatacgcagagcatccacagaaaacataaaatgtagggttcagtaccatttacagatccgtctgagctgaagcttgacaagaccccgatttccaagccacgatgaaagcatagcatctagcaaaacgacattataacgtggatgcacgccatgtttgaaagttccacagcccccgacaactcaaactcatcagaattactcgctccattatttgaacatacaggccgctatgatgttaacagcaaacactagccaatacatatcgttctggaatcgtattg

SEQ ID NO: 10046 - DNA, 275 bp, Zea mays
cccgagtccagcgccgaaagccatggcccccgggccccggcctggcctctgccgtacgtacgcgcgtggcgcacgcccgttcgcctcggcaagaatcatggtgccccgaccacgtcgcggccatgcgcctcgtcctccttatagaaccatcgccactgctctgcccccccgtcctctgatctcctcctctcatctcggacacggcaaatttaccggcaacgtacagcgaaagccagaggtccgcagccgttgagccccaagaaggagaggacgaa

SEQ ID NO: 10047 - DNA, 1500 bp, Zea mays
gtcctgtttcttccccccccccccccaccccaccccccaaaatcctgcaaagtcagcttgacgcgctcgatctgcatcctgcaatttcttttcttttttacaggctataaaaaaagagagagaggaaaacccagacgaccaaatgctgcggccatggccagaatttcggagcttatcgtcttatccgatggccttgcttgccttcttcttttatccagcaccagcaccagcaccgccgttttttgtcacgttcacacatgcatgacgcgtctacatctactgtacgtactagtagtgcaaacagcaaacgccagtggccagtggccacggagctagctgccgcatttcggcaacggcaactcgtttctgcggtcattttgtgagctcggatcgagtgaacgtaagaacgctcgtcgttttgtgaggtcgtgtagggagtgccgtgcacactgcgagatactcgtacgtagtactccctccgtttctttttattagtcgctggatagtgtaatgcgtagagtttgctttgcgcagcgaagatccgtctgtatccccgttaaggttttcatataatgaaaaaaaaaggagaggaacacggcggagggagggatgaagcgatgcgtgcgtgccatggagcagattcgtttcgctttttgccgccatttttatttataaggggcaagaggcaagacgagcaccgcaacactctctctcacacacacctggcaacctccctagacctggagcgcacgagagagagatagaagagagacggaccgacgaccgacggcgatctcgatcggtaggcagccgttgcttcttcttgcttggcgggcggggcggccaccatagccctctgtagctcaggtcttgccggctttccttgtgctccttggaatctcgccctgcatatcttgtactacagtagctagctcctctgctactgtagagctacaggcaagagggaagcaggcagcgaccgagctctatgccgctctagctgccgggctgtgcgactgcgagctagagagagagagagagagggtgcgggcgacggacggaacggaacagaggagcctagtacttgttgtccgctgtgctttcgtccgtgcgactggaccttattccctcacacctgcagctttgaggctcggccgtcacgtagtagtacgtgtacgtttcagggagggagccttctgacctcttgttcccttgccgccttttggtcacctcgggcaccgcgaggcgcagcacctgtgcttccttccgtcgtcttcctgcctcctcttctgttcaccgctctggcgctctcctatactcttctctctctctcgctgaggcaggcgggggcagcctttcctccccggtcgccatcctcgtttatatacacacaccctctcttgccgaaccactgctcgcttctctgcctgcttctgcttgagtcgtgccagtgacccgtgaccgtgaccgcgagcttcagggacgcgggcggcggcgatc

SEQ ID NO: 10048 - DNA, 1296 bp, Zea mays
ctgcctcacgcgacgcggcagaagcacgccgtctccctggccgccgcttgatcgttgggcgctatattattttacacgtagggagggtaataggatttagattgtacgctatgaaatttgtgaatcaaattaaattaaaatcagattttatttctattatttttaaactaatattaattaaatatcttaatttattgtgaaaataatataaataatatttagatcgtatctattaccacgtccatgcacacgctccgcttccgataatgctttagttgttgttgctactgctgtaggtgaagtcaatttttattttatgagaggctgtaaatattctggtttgcatacagaccgaatgtagcaaatttttttccctcccgagtcccgacggcccacctcctcacgcgacgcggcagaagtacgccgtctccctagctgccgctggatcgttgggcgctctctaggctctaccggctgatgcttcttcgcctcgccttcgctggacggaggtggataggatcggtaaagggccgtggtcccatcatcccgtggacgggcacgggtgcggcgcgactgagcgggcccgttcggctctcgtcactcgtcagccgccccggacgccggactttcgccgtctgagcgggctgcaggcgtgcggccgctgcgcacacagcagattctgcagcgcggactctgcgtcttgactgatgaatggcctctcgcctcgcagcaaccgtccaatacactgaccggtcgcgcctgccctggccctgccctccttgcttcgctcacacacgtaccgcacccgtctgctcctgccagactccgatgatgacaccgtgtggtggtacggaagtacagtacgtgacgggttaagcgtaagctgccagattcgcgccacggagcgcgctttgctgacgaggggggccggggctggtgttgcttatcttatcgtgctgccttgtaggaacgcaacaaaacaacgtcggttggatcggatcggagcaccggtgaccgtcgatcgaatggcccaaacttcttgcggctcaacaacacacgcgcgcgcgccggtgccccaccaaggccagcttgcgcgatccaagcctgccactacaaatagaactcccttccccatgaagctcacccaagtgcttcactcactcctgtcctctccctctcgaccagctgacctcgctgacggagcacacagccacgccgcagcgccccgcgggtgtctggctatagccttgtaggtcgctcgcaggtaggtaaccgtagcctagctagctcgtcggg

SEQ ID NO: 10049 - DNA, 1387 bp, Zea mays
ggtcagtggatcggcggagggcagcactggttggttggtggtgcagagtagcagagcacacggacacaggtagagagtgttgatgattggagcatcggaggagttggctaggactggaagtgactgacagccaatggacacaaccgaatggccggtgactagatgagaattttggggagacgtggaacggatggaagccatggagtggttattctctattctcccgccggttagtttgcttggctaggctggcagtagatctgaacgggaagggagacaattaggcaatatggtgttaaaaactttattacggttagtttaagaattctattttctcaatagattcattttttcttttttcaagaaaaaatgaactaatatctttagaaaaataaaaattccttaagaaataggatcgtcaaaatagccctgaggactaattttccaactacaaggaattttcattttccaagaaaaaataaaataatttcttttgagaaaatagtattgccaaactagctcttatagctagtttagaaacttaaatcttaaaagagagatttaagtttctaaactagacattaactagagcatctccaacaagttatatttgagtcttaaaatttaaaatataacctgatttgaagtgtttagggccacaaaaacatttgcagatataacagttgagttacatatcatattatttagtaacatttagaataatgtacaaaatgaggatagagctctatcgttatgggcatatatttagaacctgagaatctaaattctatacttatttgatgaattatgaaatagaaccccctattgaggcattttgtgttaaagtcttatattttaaaaatacaacttcatttaaaacttatgttggagatgaaggagtgcttccttgactaaagtttagtttatgttatatcagatatttgaatgtaattataagtattaaatggagcctaattacaagaataagagcatgtttagatgctatgtgctaaattttatcatggtgctaaagtttagccattttaaatagatattttaatatgtgctaaagtttagaaatattaagtgcagtataattataaaagtagttataaaaaacaacactaaactggaagacgaatctattaaacctaatcatgagtaagttaaacttaataaatttatctcgatatttaatcatcatctatatatttagtctagttagactatattaaatatattcataaaattgttattcaaaaccaaacacctcagatactgaaagacggaagataggcaatcacatggaacccaaaatccgcagcatccactgacttcctctgttctctttctcctaccgcttcgtggcttccctgcttccgctcca

SEQ ID NO: 10050 - DNA, 1402 bp, Zea mays
ttggagcggaagcagggaagccacgaagcggtaggagaaagagaacagaggaagtcagtggatgctgcggattttgggttccatgtgattgcctatcttccgtctttcagtatctgaggtgtttggttttgaataacaattttatgaatatatttaatatagtctaactagactaaatatatagatgatgattaaatatcgagataaatttattaagtttaacttactcatgattaggtttaatagattcgtcttccagtttagtgttgttttttataactacttttataattatactgcacttaatatttctaaactttagcacatattaaaatatctatttaaaatggctaaactttagcaccatgataaaatttagcacatagcatctaaacatgctcttattcttgtaattaggctccatttaatacttataattacattcaaatatctgatataacataaactaaactttagtcaaggaagcactccttcatctccaacataagttttaaatgaagttgtatttttaaaatataagactttaacacaaaatgcctcaatagggggttctatttcataattcatcaaataagtatagaatttagattctcaggttctaaatatatgcccataacgatagagctctatcctcattttgtacattattctaaatgttactaaataatatgatatgtaactcaactgttatatctgcaaatgtttttgtggccctaaacacttcaaatcaggttatattttaaattttaagactcaaatataacttgttggagatgctctagttaatgtctagtttagaaacttaaatctctcttttaagatttaagtttctaaactagctataagagctagtttggcaatactattttctcaaaagaaattattttattttttcttggaaaatgaaaattccttgtagttggaaaattagtcctcagggctattttgacgatcctatttcttaaggaatttttatttttctaaagatattagttcattttttcttgaaaaaagaaaaaatgaatctattgagaaaatagaattcttaaactaaccgtaataaagtttttaacaccatattgcctaattgtctcccttcccgttcagatctactgccagcctagccaagcaaactaaccggcgggagaatagagaataaccactccatggcttccatccgttccacgtctccccaaaattctcatctagtcaccggccattcggttgtgtccattggctgtcagtcacttccagtcctagccaactcctccgatgctccaatcatcaacactctctacctgtgtccgtgtgctctgctactctgcaccaccaaccaaccagtgctgccctccgccgatccactgacctaccgcgagcgcca

SEQ ID NO: 10051 - DNA, 1084 bp, Zea mays
tgcaggtcaaacgcgctgacatttcacggcgcgcacgcctcactgtttcctgtgcctggctttggcatcattcttcatcgctctcgcgcggcgcctgtttgcgtgcctgagcgcagctgcacgagacaagccggcaactgttgactacgtagcttttttttaagcggcgtgctaaacaagctttgtattagctagatcgcagggtgaaaaatgtggggatccaatgttggtaggcggcgcgtcaggtgatggctgaggaggaggggcggtggccatggcgtggaagcttctccttgtgcttgcgagcgacggagcgaggaagagagagagagacccacggacgagaaggaaaggaatgtcgtcggggcggaaaaggcagagcggacgccggacggaggcgcagcgcgcgcgagcaagcaaagcccggaaaggaaccgcaccgttgccgtgcttgctgtgccttggattccgaaaccgagagggctggcacggaactcaactcaaccaccgtcagacacgagacgtgactgccatggatgcccactccctttttcgttatcgtactactagtacagtagaaattcaaattactgccggtcaaacgcaaagacaataatcactaggaacaaaatttattaataagtatttgactggatccagagtatttgactgcggccttgtcggagcagagaagactgctggtggtgctagtactccagaggctccacaaagagcggaaaaaaggttttattttgtgaggaggagaaaagctgaatgaataggccggcgggcacgagcatggcagttgatgagagtttggacggggttgagtccatttcacgccaccgccgctacacctataaaacggcggagccgacgcccccctgttttccgctcctccataaccacgagccaagcgcgacggatcccaatccatcttctcctcatccccaccacgaccaaaaaaaaatccggtcgccgatgccgtctgctgcctgacatcggtcagccagggtagatcgcgcaggcaggcagccccacacacatacgaaacccaatcctgcttcgatcccgtcggccggcg

SEQ ID NO: 10052 - DNA, 108 bp, Zea mays
ggtagccattcttccgttgctgtcaaaacgttttgccttttgctttgaaagagtaactggtaggtgaagttttatgtgctgttcaccaaccctgtagacatcggggtg

SEQ ID NO: 10053 - DNA, 399 bp, Zea mays
ttgagtaagcaataggaagtactactaagtaacattcagtttaggaaatgggtgatgcatgaggtgtgccacaaatggaaactttggatggataaataatttcacacaacatattgttttttggcaatgaaaaattcttgcccttttgttgtcaaaactaagctcttgcttcagatcgaattgtgagttaagcatcggaaaaggaaccacaaagcaaagtattcccttcgattggcacaacaatacgagttgatgtaggtgggcttactgaccatccacacatgaagtgttgtcatggaggctacggtgtgtgttttgccaattagccaccaaattcaaatacacacataaacattaccttctacatttttcagcgctggtctccgataggctcgcgcc

SEQ ID NO: 10054 - DNA, 390 bp, Zea mays
ctgccagtgccaacccagtctccaaggccacaaccacggctcccggctggctccaggctctagttccaacctccacctgcgccgcccgatagcaaaacgcagcgacctcgccccccctgccccgctcctccccttttcccggtagcagagacggagcaccgcagcccgccagaaaggaagacgaaacgcgccgcggcgcaacgcaccgcgtgctagtgaaagggcgcagcggaaggccgccgccgcgctgctatttagacaggaagcggggcgatcgaatcgcgtctctcaaccaatcgataaatctgccggtaggtcgatcaaggagagcgcggtccacgtctccgttccgttccgttgcggggaaggaaggaaggagagagaggagcg

SEQ ID NO: 10055 - DNA, 191 bp, Zea mays
gagctccccttgccgtcgcctgtccatttcagcagttctgctactacagtgcttcttccttctcccgcttacccacgcaaggcttctccttgccgacaagaaccctgccgccgtcaatgacagcaaatcattttccatcagagttaggagtgggaagggcggcggccgtggtttcggcgtgagcatcggcc

SEQ ID NO: 10056 - DNA, 854 bp, Zea mays
ttcaccggaggtccatagaggcagaagctagagcttgagctgctgccccctgctaatacaggggaggcaccgcatgttagaatagataagctcagtttttactatccgtaataactttcttacagttgttacaaccatcctagattttttttgatagccgagctgccgaggtgattggatagccaaactagcctttaaggttattcacaatgagagccaacgttgcaacatcattacaggtgctatgaaactatgaataaaacaataacaatatttcacgtcgctgtttcataggttaatataccaaaactttggaatcgagttaacatgattttatcccatgaaactcagttcaaatgctatggcatatcaccaaaaaatctgatgtattaaatgtacatgaaaccattgagaatatatagcttaatgctaccgatccacttctccctatccagaattaatggattattttttaaaaaaaattacaacatagtagatcgtagagctgaattgtcctatccggcagcgagagtagcggccgtggatgattctgccttttcttctccttccctcacctgctctctctctctctctctctctctctctccctttctttcccgcggcgacggtgacgacgaccgcgcgagcgccgccgactccctactgcatcaggtgcctcggccttcgtcgtgctctccgccggcaacgagtataggtatgcccacccctccttccctccccttcgcgtcccttcccttcccttcctgccgcgcgacccaaaccctagcgcaagcccatctgtgtccggatctgatctaatcgccacgtgcgtgcgctcccgcagacgggcgcgc

SEQ ID NO: 10057 - DNA, 769 bp, Zea mays
agttagtgttgtgggacaccttgacagaacatcagcttgctgacattctcaccaagtcgctcggrtgtgtccggttccaggagcagtgtgcgtccagattgatgtcaagcaagttcatgacaccacggagcaggggggagagaaatgttggatagtatgtggtccgtctctattgtcgtattttcttcagtagcgttatcttccttcagtttcgtcagttcggaaagcttcgacagttagcgtgtccggttcagtgtcgtcgctgaactgaatgtgtctaagcagtgtgtgtcgactcggagccgtgtgtggtgaccggttcacgcgtgataaggtgcacaaaagcccaactgtttcacctgagaactgggttctcggtgacgttcaacaaatgagccagcaggccttgtaaaaaaggagccttctcatcagccgtcagctagctcgtgtcccatgtcatttttcatctgaaagaaaactgttgtccgttcgcacatgtagcaagcgataaataaaaaagagaaaactgtttggtcacgtcacttaaggatgtgtttagttagatatacaatgagggatagaaggatgtgtttagttagatatataaggagggatagaaggtcggtcataatttatatataagttgtttggtttgaggaatgatctagtccatcgtcttctcactcctcacttttttgtttggtttgtggaatggattgagttgatccatcatcacctcattccttatagttatttagttagtactaat

SEQ ID NO: 10058 - DNA, 264 bp, Zea mays
gtgaaacactgggggacgatggaaattaataacgtagaaggaggcgccgtggaaactcgctgccgccggcggtgagagcccgccgagaaacgagatcattttttccaatgcgagcggcggcgccaggaacaggcaagcaactgatatcactgccacgtgggcccttccccttcgaggagcggcgcaaccgcgcttcgcgttatccgaattccgaaaaaaaccaacagcgcgggggtagggtaactgacgtgtgggccgagaaac

SEQ ID NO: 10059 - DNA, 128 bp, Zea mays
gtaccattactacaaccgctgctaatctgaatttatccggctcgatccgtgtgtgtggataagatcggacgattcttggtcggttcgacttcgtcgttcttgatcgcaggcgctctggtgtggtggcc

SEQ ID NO: 10060 - DNA, 98 bp, Zea mays
ttgcgtttcctactgaggccaacccatgtggaaaaaatggaatgcccacagatctgtaaaatttgctggtttactcgcgaccaaccgaatcgctgttg

SEQ ID NO: 10061 - DNA, 185 bp, Zea mays
atctaggagtgagttcagtagttaacctcattagggaagggtgttggttggttaagtttagattgtgggggcaggttggtctagtttgctttctttcttctcctttttctttttctttttctttatatttctttttctgttgtgtttgtaattggtctaatttttagacccttcttcttaataca

SEQ ID NO: 10062 - DNA, 96 bp, Zea mays
gtcccgcgacggcggggaaagggcgacagctgcggcggggatcggctgcggcggctcgacgaggcggcggcggcggcgcgggtgggcggcggcacc

SEQ ID NO: 10063 - DNA, 268 bp, Zea mays
gaggagtgtcgactctctgaggctttggaaaaacgtcgacgagtcttctaaaacttgctttactatacacatttatatctgagcaattttaaatcaatcgttagcattcttaaaattgtattgtaagcatgttcagagatttttacaaagctaggacttctgggtcacatgatctacaatgctaggatgtttagttttatgttgcatttttctggttggatgcagatgcaaggagagattattttgagcatgctgccatcagattgag

SEQ ID NO: 10064 - DNA, 112 bp, Zea mays
actgctgagtctgtgtttttgccttgcgcttgtacatattaaagagcctcaatgtgaatctgtaacgtgggtctgcagcaaccaaagagtgaagttgctcgggtttgtatat

SEQ ID NO: 10065 - DNA, 610 bp, Zea mays
gggggcctgcttcgtcgccgaaggtcctctaggcaagttggcacaagcagccatagcatgaaggtacaggccgaagctacgatccagggagcttcggcatagtgacatgccttgagacgaagggctgcaccgacctaaagaggaaaagactgatcggtccatgatagtttgtgtcatgtttgtagtcacttgtcgagggcatgaatgtaatttcgaccgggctgcgtcccgtgcctataaatagatgaacagtaacctcgtactgttcacgctgacttgtattcacttgcacgtcacacttggatctttgccttctgtcaagccgaaggtataaatgtaattcaatattgtttatattcattctcgatgctatattaatgatgtcatatgattattcatgatgcttctcattatttactgagattatgaaggtatgtccttcataaccttcatctgaagatcatttatcctaagggagataatgcttcgaaggacgaaggtctttaaccattaatattttgtgttgccttgttcttaattcatagcatttgagaacaagtccccaacattggcgcccacctccggtgaactcacttccactgttgagttg

SEQ ID NO: 10066 - DNA, 1500 bp, Zea mays
ctgtcacgctcacgccgagaactccagaagagagagagaagaatgccacacggacacggctggtaaaagacagccggagaacgcgtccgtcagacaggccgcagaaacacgcataccatgggcacacgcgacagatctcgcagaagatgcatctgagagctggcggtgatgaatgcgatctctccctccccatttatgccccctctcctgtttcgaattcatcggaggagaagagttgagatcggtgtcggccctctcgatcccctgtttctgcaaagggggagcggcgacctgatgatgagatgcagatgaaggcgcaagagagaccgagaccgaggtgcgtagacatatccacaaatgtctcgccgtcgttcccgaacacccaataccgacaggcagcagcagcacgtgcaacaaggatccactccactggcactggcactgggccgcatccgcatgccaccgtggcttcattaaccgatcaataataataaaccgatcgaatcagatcgggcactggacagttcttctctccagtctttctatactggagattacattaaggaatgggctctgctaacgtttggctgcagagttctgttacttagtttggcccacttgttgctgataaaaccagctagctagaaatttacatacatacagctgagctgacccccttttttttatatgtggttgttgagacgacgaccagcaatcatatatgccatgccaagtggttcagctctcgggacgacgtgcggctattcattcgttgcagtggccatttcggcatcaggttggattgagatagacagaccacacagcacacacgcgaggacagatatcgagccatggcatggaagaaaacaagtgcacgagacgtggagacgtcaagcaattatggcccagttcctcgacctgtctgtcctctagcctcaacagccagagccaacctgcatgctgaaacgattggtacgttgatgatgatgatacggagaacaagagtaattagctgcgtcaagagatcaggcagcccatgctatatttgactagcattgggtggggggccgcgtggaggttcttataggttttcctctttggattaaagtatactactactaaacaggggagcggccaccctagctactactactagccaataatagctgcgcacagtcataagatatgggcaagttcagaaggaaggaaaaaaaacacacaaaacaaaacaaaaactgatggtcagtgatagtagctcctccaagcatacctccttacagctcagtctacatacagcttagaacctagttcctcctctcccacatggccaagtgaaatcgaacgcgccccttccttctcttaggtcaggttctcacactataaatatgcactccccctgcgcacaaaaaacaccaccacaagcctaatacagctcaacacttgctaaaactagagagagagagagccagacagacagacagacacagagagatagagtcc

SEQ ID NO: 10067 - DNA, 537 bp, Zea mays
cggagttaccgtttccgatttctatttctgataaaaaatatgaaaacggtaacggttttagtgtttaccgatcatttccgaccgttttcatccctacctataagcgagtcttgccagcccacggccacgagggaggcccagcaaaaccatccctagtcgccgtgtgaacggaccgagcgcgccgccagccctcttgttccgaagtgcccgagtccgccgctccactcctccgtgattccgtccattggtctgcccgctaggtgctagtgccggcagcccgccactcctccgctcactcaggtcctgaagctctcatccactgcagtcgccggcaccgcttgcagccgccgacagcttgttgtagctcgctagctaaacggtcagagctgctgcactgagccgagctggctccgtacccacgcttactcctatccttcaaaatcgcggcgccactaatctaaagccctaaacccatgatgcagccgccgcaccacctccctctccatcgccagtaccccagcctcgcctccgtcgcct

SEQ ID NO: 10068 - DNA, 67 bp, Zea mays
ccttcgtcctccctctcccactcccgatcgcatccaccctggaaccctagcggcccagcccgcgacc

SEQ ID NO: 10069 - DNA, 258 bp, Zea mays
taatttctgtagatctttgactgacacaaattacagaggttcctactcttacgtgtatgcaacctgatgatattccttgctgccatgatcggagacgacctcgacgacactaaacagttttgcaaagttaaagacacctggtatactttccttctttcgtacgttatgccgcatacgtgccccataaaaacctatcaaaattttgttaggcacctagcagcttttgaagaacgtctcctcgtcacgtagctatcattc

SEQ ID NO: 10070 - DNA, 64 bp, Zea mays
agtgctactgcatgcctcagttagttcataagaaaaacggcgcagctttatttcacgctctttg

SEQ ID NO: 10071 - DNA, 310 bp, Zea mays
atacgtgcatcttaaagtctgagattcccaagggcatctggagcacacgcctccctgaatgcctttcagcacttgaggttgcaagtataaataggacacgtacctgctgcaccaatcagtgcactcaacaagttcacagttgacgccaaatcagctagcttctttgctctctctctctctctctctctctctctctctctctctctctctctctctctagagcttactaggcctgtaggaagactcctcaaggcaaccttttttttttggctcacgaccctcaaacttagcattcttgactaacctaacc

SEQ ID NO: 10072 - DNA, 432 bp, Zea mays
gctgaaagtgacggcggaagagtccgagttttgcattcgtatctggccttttttgcgttacctgcccggctgccccacgagaacgctagtcgcaaattttgcgtttctcagctcgcatcggtcggtccgcgctgtggtgtcgggcatttctgatggatgcgatgagaaaaaaagaagtatatcgtcgaaaccggatccgcacgccgctggagccgctacagtgcacttccctgcataaaatgcgggtcagcctagcatacctacccggctggcagtgccgctagcccgctacagtgccctccatgcaaaatacagcgctcaagacaacagcagcgaatgccaatgccaattaataactagctactgtctcgtccgtccaggaaataggccggagaaggagacgcctcggcctctcattgctgggtgcgctcc

SEQ ID NO: 10073 - DNA, 1045 bp, Zea mays
tgtatttaaatatgaatagaattatagaaagtacatataggggatttgagaaggagaatgattggaggtagcctcacacccggattcctcagtaggcgctatggcctcgaatcggagcccttcccccagcctgcagccttcaactacaacaaataatgaaatgccctaaagtatagggttactcgctggctaggaagcaaatgggtattataaattataatctacttcggaaacctttttgccataccgaaacttctttgttttacctttcgatgcacaggggaagtacgagtactactaccacctttcatccacagcaaacacagcgcctgcagccggaggcgacttttccagcagtccctctccctctctccttctcgcacgaaggaggcgatagaaatggtattgctacaggggcgctgttcaccacaagctttagtcagacactgctatacaagtagataaatccttaatcctcgatcaaaagaaggaaaacgcagtagagaatactagcagtagtagtacagagtactttatactgtagatgggccccgggtgctccctctttcgcttcacttttcagatacacaggtagcagccatagatatttttttttggtgcggagcccaaactccgaagcagcgcacaggcagcgtccgctcccgtcgcgcacgcgcaggcacagacacagcggcaaggcaaggaccaggtcacccgcgcctcgtctacctcctccgccctgacggattgccctctctgcgtcgagcaagcatcgcccgctcagccccagcccccaggcaaacagaggagcagcagcaggccgagaggcgtgttgccgacccattcttaaatgcgtgcaacggcactactccactccccactaccagctgctccctccctccttcccttccctcctacctctctctctctctccctccgttcgtttcttgactcttctcttctccccatcagccagcagtctctctctctctctcacacacacacagaagcagcgacttgctcacagtagtgctccccggacaga

SEQ ID NO: 10074 - DNA, 293 bp, Zea mays
cgtggtcgctgacgaccgggggtctcttcggcagaggcgacgactccgatgagcagcgcttcgaggagcccatcatcgccgacaactggggggccgatgcggggcgagatctcgtgctcacggcgcgcgtgctcgccgctgatgcgtgcgcagctgggatcgtcgacggtgccacgccctttgcctctaccaagcgctcgtcacctccactaaccccaacgaggtgctcgacaaccacggcatcggcgaggtcattgccaccgacactgcatatagctcagacagctccgtcc

SEQ ID NO: 10075 - DNA, 420 bp, Zea mays
ttgaataacaaggggattcctcccccatggatccccttgggatcccttagcaccaaatcagccctaaacgtgttaaattggcaccaataacaatagcgccgaacagaaggtttatttttaaattaaaactagagatggcatatttatagaaaaagacaaaaatgggcaaattgcaaaaaaaaaaaaaacggatcgcaacgctaccgtgacgcatctcgaactgtagggaattcgtgatctcaattccgtgctctcgagaaagttcatcccctttcacctctgtcccgagagccaatccgcctacagatcaagccttacaaaaccccacttaccacgataccacctcgaccctaaycggctaatcgacctgagatcgatctcgagtgacgaaattgacgacaggaagtaagatccggcaag

SEQ ID NO: 10076 - DNA, 1500 bp, Zea mays
ttggcttagctcatcgtgtcacaccttagtcctacgcacgacatggtgatcaggccacgctgaatcgtttttgggccaggctaaatcgtggtaggtcacgtgaggacctgccgctactattctcgtaagccggctgggattttcaactgcttaccctagtggcgataaggcggagaggggacaaggaaggggcaacattcattagggattgttgctgcatgagtcacctcacgggaaacgacgcaagtattagaattatggtttctcattcgtcatataaaatatattttaatgaacaattcaaacaaagcataaattattataaaagtttgaaacaaagcacaaattattataaaagtttggaacgtgtttaaacaactattaaatttaaataagatctatgtgatatataaaaaactgtagtaatgtaagagcacttaactagtaggctttaattagtttttgagatttgagttatgcatttttagaatggatagattattatagttatgaacgggatacccgtgaaaaactcggcccttccgatggccggactgcatcaacacaccggtccaacggacgaccacatgaattggaccaaagaaagaaaaaaaaaagtggccgaaaaggagaccccgtgccgtgcgtggacatggcgcctggcggaaacacatgagccgcatggcagtcagcgccccgacttttccgccttccttgcaccaccccgtcatatctcggcaacaatttctcggcgccaaccggccgatccatcctcgtcgtaagtctgcgctttcatcccttattgttccaggaacaaacaaaatctacaggtttccaagacaccaggacggagacatcgaggaggcggcggagacgccgccgcgtccttccgcttctgagccgtataacaacaaacccctcggccccgtcccctctgtccatcgatcaccttgaccacgtgcctgtgccgcaggccgcagccaggcatctccggcgaatctggtttgaggcgcggagagaggtgagtttcctgatcagtggtgctcttacccgttctgtccggttcgatttgctgatgcggccggctggtttgatcgtttttgggtgcgattgttgtgattgttttgtgagcttgcggcaggcaatgacactgattgtagaattttgttctattggttggcccttctattggggaaaggggatcgatcccctatttttttcccttgccttttctctctgcaaaagagaggtggctttggtctgccgtatcatgatttccccccactgcggtccagtatgcaaatggaaaattgtacacctttagtcgcagtctccaatattgttggatgctcgtatcatcggcctttttaacagtacaagctaactttgttctatgtagtgtaagacagtaggaatacctctgtcccatactgataggctgatagctagctggaacctattccacaggatatttgcatgcgggactgatcaatcaaagca

SEQ ID NO: 10077 - DNA, 501 bp, Zea mays
tccacacaaaagctttagtgactagagagagtgatttgtagtgttcatttgagctcttgcgcttggatcgcttcttttctttggcattctttcttgtgatcaaacactccattgtaatcaaggcaagaggcaccaattgtgtggtggcccttgcgggaagtttgattcccaagtgatttgagaagagaagctcactcggtccgagggaccgtttgagagagggaagggttgaaagagacccggcctttgtggcctcctcaacggggagtaggtttgcgagaaccgaacctcggtaaaacaaatccgcgtgtcacactctttatttgcttgcgatttgttttgcaccctctctcgcggactcgtttttatttctaacgctaacccggcttgtagttgtgtttatatttgtaaatttcagtttcgccctattcacccccctctaggcgactatcaattggtatcagagcccggtgcttcattagagcctaaccgctcgaagtg

SEQ ID NO: 10078 - DNA, 780 bp, Zea mays
ctcattaaagacaattgaaatgagatccctcaattaaatttggagaaaataaaaaaagcatgggcacttttgccgtaatggaagattaatttagaatgtttacccactttctatccaaacttatccgggaacgctgtagatggacagagatggggtgtaacatttacacaccgccttacttagaaacatttcaaatttacaaatttaagaagacatttctcacagttgtgattatacagttatatttaggaggtgtttgtttgggttatataatttgttgttcaaaatttattagattatataatctgtttagattataaacttaaacaaacacccctttaagcatagaccgttcactcaacacaatcattcccaatttctaattgcacaacattgcaacactaaaaaagtattttagtcatctatccgcatccattcatggtggcatcaatttcatatatagtatactgtacaaaaaaatcgaactgaaaaccagcaccgaaattcacaagaaaacggtaaacaagaaaagaattaccaaaacgtctgaaaattaccaaaacacccttctcatcaacctcatcacctacctacactccctcttccagagaatccagtggcctcgcctctcctataaaatggcggctgccggtgtcatcctctcctctccgctctgctccctccgccgtgcgctcgaacgaactccacacgaaattatccgcgtaaagttggggagcagcgaacccgtagcgcgcgccccggatccctccacggggggca

SEQ ID NO: 10079 - DNA, 117 bp, Zea mays
cacaaaacaaaattcttctttctttgggaagatattgaagacatcgtacaggtccctacgaccttatcttcaatgggaagtccatctctgatgattattctttgaaaggacagatga

SEQ ID NO: 10080 - DNA, 400 bp, Zea mays
gcagaaaagaaattctacactcactgtgtcacagctttgaattttgggaaataattcatttttccaaaaatatgaatctcaggacctctacattccaacttaatgtaggcatgatatgaaatctacttaaaattgcatgtttgtgaagaaaaaaaaaactatgcacgtttcaatttacctaccctagatcagctactccctctgttccagattataagtcgctttggttcttttagtacatagatcctcttttgtatctagatatatgttatatttagacacatggaaaaaattatgtaacaaaaaaaatcaaagcgacttataatttggaaaagagagaatataaagcaagtgtgtaagatattgagacacgaacaccaatgcttatatcttctcactt

SEQ ID NO: 10081 - DNA, 639 bp, Zea mays
ggtgagagggaaagattctaacaactaaagaaaaacaaaattgccatggtggcccccacagtttttgttgttacgacaacaccaaaaaatgaagggcaaaaccaagcgaagccaggccaagcaactttcttgttgtcctttcgtctcacagcggcagcaggatccattagatgctcgggtggagcactgagccttttccggcggtgagttgagctgagcagaaccgtgctacctagccaatccacaggaggaagagaggagaacgggagccctttttatgacaagaagggaggcgccaggcgtgtgattaacagtgagctgcttgctactctcttactaccaatctctttcgctgcttgctttccattgaaaatgatgtgatcttgcttaccacccacaccctacaatccgaaggcacgcatgcccagcacaaaaatctcccaaggattcccatgtccccatggtttcctagcacaagatgtgcatggaccagcagaacagaagtgaagcactctggcattgcatgcccaagtgttgttgttatcgttaccaagatcatcgctactactgatgactgatgcagtgcgttcgtgatgaactgtgtaagcaggttttgaagggagagttacctgcatctgc

SEQ ID NO: 10082 - DNA, 1500 bp, Zea mays
caacaataatggatgtagtgctctcatatacagaggagatgatttttatcctagttggaaacaactttagaaaaacatttagtaagtttcctacttaaaccccgattaaaaataaaccaattcggaatctacgaaaatcggcctaattagctttgaaactcggtttggccgaatttttgtagtgtagccggcctgacaatagaaggtggacttgtctgccatgcgagaccgtgtgactgactttaacgactcaatgtttagttgttgacatgatgtgcttctatgttcggacactttttgagtgtcagccgagcgggaatggttgctccagcgtccagcgtcccgagcacaggccgttcttgcccaacctggtgcgccggccccatcagccatcaagcgaaacaggccgttcttgcccaacctggtgcggcagctgtggtgcagatccaatctacgttttgttcgattcagatgtgtattaaatcgtgatgtaaccattatttagattagaagagatttttgttttctgttttcaatagttttagcgacttatgagaaactttttttttgtatgctcaactgagcgcatataccgtagggaccgatggacccggccggagaggcacaacacatgatgacatgaccgcctttctttccgacgacacagccgcctaatccccggacctgccttcgacgccgatcactggtctcagtggctcacggcaacagggagaataatttagcgagacacgggaacgggtcgtgaggaaaaaaagcctggcagcatcatggccggtgccgttcggaccccaggcatggcagttattgatgagccgagtcaccgacctgccaagaaaggataccggatcaagggcaggtccatctcatcttagctctagctcagtcagacgtcgtccctaaccaaacatcatcttcactgcctcactcttatctgaacagtgaccagccggctgggactgggacgagggccggggcgccgtgggatacggctattggccgacgtgcaatcgccgggcatgcgttccccgttgagccatgcatgcagcgcggccggccggtcctgccaccggtggatcgcgtccggacacgtcgcggcccggccccggactgccctggctccatcggcaccatgcacccaaagcgatgcaccccggccctgaggcatcattttcttctccctgtcagatgggacccccatccgggcacggcagccagccagccagccaggtcaggtgcagtcccttcccttctcgcttcgcccccggctagatcgacctcaggctgatctatatatacacccccacgagctctcccacttctccccccacatgcacttgctgcaggagcagccgtagtacacacgcacaccgcctcgactcgactcgactcccacctcccctgttctcaccgtgcttgccctgtttcgacctctgcccatccgcgctcgcgtgcccgccgtacagtacaggccagacagcc

SEQ ID NO: 10083 - DNA, 1500 bp, Zea mays
cctttgactatttgcaaaatgactttgaaaagaatttacaaaagaatttgcaaaaacaaaacatgtggtgcaagcgtggtccaaaatgctaaaaataaagaaacaatccatgcatatcttatgagaatttatattggttcaattcttagtatcctttgcacttacattatgcaaactagttcaattatgcacttctatatttgctttggtttgtgttggcatcaatcaccaaaaaggtggagattgaaagggaaataggcttacaccttttcctaaattgattttggtggttgaattgcccaacacaaataattggactagctagtttgctctagattatgagttctataggtgccaaaggtttcacacaaaccaataaaaataccggaaaagattcaaatatagagggcaaaagtcagccgaagtgtgcctggtctggcgcaacggactgtccggtgtgccaccggacaatgtctggtgcatcacsggacagtgtctagtgcaccagggactccaactccgaactgctcaccttcgggaattctggaggccgctccgctataattcaccggactgtccggtgtgccagcggagcaacggctacttcgcgccaacggtcatctgcagaaggcattaaatgcactacagtgcgcgccagagtcagagcagagctagatggcgcaccagacactgaacagtgcctgtccggtgcaccactggactgtctggtggcccagaagacagaagctccaacggtcggaatccaacggtttggtgacgtggcaggcgcaccggacagtgtccggtggcgcaccggactgtccggtgcgccatgcaacagcagccttcaccaaacgactagtttggtgattggggctataaatacccccaaccacccaccattcattgcatccaagttttccaacttcctacaccttacaagagctatagcattcaatacaagacacaccaaagagatcaaatcctctcccaagtccttagttcattccaaatcaaatagtgactagtgagagagtgacttgtgttcatttgagctcttgcgcttggattgcttctttttctcattctttcttgtgatcaactcaattgtaaccgaggcaagagacaccaattgtgtggtggtccttgcggggactttgtgtcccgtttgattgagaagagaagctcactcggtctaagtgaccgtttgagagagggaaagggttgaaagagacccggtctttgtgaccacctcaacggggagtaggtttgcaagaaccgaacctcggtaaaacaaatccttgtgtctcactctttatttgcttgcgatttgtttttcaccctctctctcggactcgttcatatttctaacgctaacccggcttgtagttgtgcttaagtttataaatttcagattcgccctattcaccccccccctctaggcgactttcaattggtatcagagcccggtgcttcattagagcttaaccgctcgaagtg

SEQ ID NO: 10084 - DNA, 327 bp, Zea mays
tgggcatgtggcaagacacattttgcattagtactacaatagatactagcaatacacaatgttttctgccctttttttctcagctggttgatttcctccctcatgctaccaatataattttgttttgtgaatactatcaatataactcatatatctgactgtatctgcgtcaaatggtacacatcttgcaggtgatgatgctcaatgtaatcttctatatggacactttgtacgcatgaggaaaaattatgctgcactaatattcaagagagaaagctcgtggatgccagtaggtcttttgtacatactgcttgctcaacacatgtc

SEQ ID NO: 10085 - DNA, 149 bp, Zea mays
ggtaaataaggaataacaagtttgttgttcgtttataaaataaaatgacaatatgcgataggtttggccgggtttaaaaaactcacgggttcacgggtttgggtactataggaacaaaccgtactcataaacccgccgggtatagattt

SEQ ID NO: 10086 - DNA, 339 bp, Zea mays
tttaatcttatatatatatatatatatatatatatatatatatatatattgttgttcaaatagtgtgacttagaataaatctaaaacgactaaatcatgtagacggagagatatatattgttgttcaaatagtttgatttagaataaatctaaaacgactaaatcatgtagacggagagagtaactaacatgacctatcatgcagccgcttcattagaggccataatataaccgccctttaatctttcctctctgtcacagtgtcactaactctttcactaaactcttatacgccgtatgcatctctcttgttttgttctgcgcagaggcagagttgat

SEQ ID NO: 10087 - DNA, 139 bp, Zea mays
ggcgaatcgaaatccgaaacgagcattattatgctccactcttgggcagaggctcttgcattgcatgcaaggtaagtagtagcacagcctaagcaaacgacctatggaaagatgagaccatttgcgcccaaaatgacaa

SEQ ID NO: 10088 - DNA, 1500 bp, Zea mays
gaaaaagggggagttattgaatccttgatcaatttctcgtgaaatatctctctttatgtttcaacatgtgtgtttgacttagagataggaaattgagtttgatttgcaaaaacaaaccaagtggtggcaaagaatgatccatatatgccaaaactgattcaaaacaaatttgagttcttatttgaattgattttgtacttgttctacttgctttatgttgtgttggcataaatcaccaaaaagggggagattgaaagggaaatgtgtccttgggccatttctaagtgttttggtgatttagtgtccaacacaagtgactaagtgtcaaatggtggacaaagtacaaatcaagtaaaaaggtatgtttctcagacttagtacattgttttagagactaatgtattgtgtctaagtgctggaaacaggaaaagaacaatkggaaatgtcttggctcaagcagccaagactctgctcagtctgggagcaccggactgtccggtggtgcaccagacagtgtccggtgcgccaggctggctcagccgaactggccgctctcgggaagaatttaacggtgtacggctataattcaccggactgtccggtgaaccaacggtcggccgggccaacggtcggctgcgcgatctgtgcgagacacgtggccgagccaacggtcgggaggcggcaccggactgtccggtgtgcaccagacagtatccggtgcgccaacggctccaaggctgtcaatggtcggcttcgccaaataaggaaggaaatccgcaccggacagtgtccggtggtgcaccggactgtccggtgcgctaggcgacagaaggcaagaattgccttcccggattgctctcaacggctcctagctgccttggggctataaaagggacccctaggcgcatggaggagaacaccaagcatcctttgaacattgttgatcactcacactccattcttgcgcacttgttcgacattcttagtgatttgagctccgttctagtgtgaaacttgtgatagtctcttgagctcaagtctgggtcttatgtgtgcgtatttgctgtgatctttgtgtcttgtgtgagttgctcatccctcccttactccgtgcttctttgtgaacatctcagtgtaagggcgagagactccaagttgtggagattcctcgcaaacgggatattgaaaggcaaagcaaaacaccgtggtattcaagtgggtctttggaccgcttgagaggggttgattgcaaccctcgtccgttgggacgccacaacgtggagtaggcaagcgttggtcttggccgaaccacgggataaaccactgtgtcatctctgtgattgatctctggtggtattgtgttttgttgaaactccttcctagccacttggcaataatggtgcaaacacttaacaagtttttgtggctaaaagtttaagttgtcacaggaacacctattcaccccccccctctaggtgctctcactaaccgctcgaagtg

SEQ ID NO: 10089 - DNA, 1091 bp, Zea mays
ctgctcgtcagccggcaaggtttcccaagtcggctctatgatgttgcttggagaaatatcagagctctcccttgaaccggccattgagggccgatttgataagcttagatatgcttccccagcggagtcgccaaaaagtatgttgacgccttttcggagcgccaaatactcaagaagaaccggcggcggtgctctctggtcaggcgcggacggtccgcggcctggggccggacagtccgcgacctggcacaggggctagggtttcctgcctgacggccggacggtccgcgccctggggccggacggtccgcgccctggggccggacggtccgcgcgtgcgcaggggcggcggaagatcgccgacggcgcctggatctcgctcccgggagggaccccgtcggggaggagagatcctaggggttgtctaggctcgggccggccgacctagactcctccaatcggcgtagagtcgaagagaggcgaagaatttggggattgggaggctaaacctaaactagactagaactactcctaggataaaatgcgaataaaagttgtattgattcgattattgatgattacaaatcggccgtagacctctctatttatagaggaggggggctggaccctttacacaactgattccgagctaatcccgcgaatatagctaacaaccgtagcacaaaactcggaaccctaatctgttctgcgcacgcgcggaccgtccggcccacaggcacggaccgttcggaccgcggaccgtccggcctcagggccggactgtccgccggctcaaaaccggttcgaacaataatttataaacaatatagtttatcagagtgtttgtagtactgtgagagaggctaagcaccacctgactcggctgaaaatctagcgcgaccggcttttaacacggcccggcccatcaaaatgaatgcactgtactagccggcgaggaccacgtgtacccgccaccgcgccgcgcggctccaccgttcggcggcgctcgggcacggcacgccgtaaaaccctagctcttgcgccccctcctctccaccgcgccggcgagccgtggagacgcggagctaagg

SEQ ID NO: 10090 - DNA, 1500 bp, Zea mays
gaataaagtttaaaataaagaataaaatatgagataacatgggtaatctgctgaagataacctctaaaaaattacgactataagaaaagaaactagaattacggctacaagatactatgatggttaaaacattcagcgaggggaaggtatcaagaaacaggtatcaatggataggtcgattgtcgctttcatgtagttgatgaaataaatacgcatttttgtactttaataaatcaaatacttctagatttgactaaatatatatgtaaaacctattaatctttatcataccaaatagatattattaaattaattatattatatattttcataacaaatatacctacatatattaatattgatacaattacatataaatttagtgaaacctgagattttcttacgagatggattttttttttggatggaggttcctctgacgtgttgtagtcttacggacacctcgcgttcaactattttaattggatttgaagtttcttccttctcctcaagtggtgttcacgtataaaccaatcagctcccgtccccgtcccacaccacacacagagaaagagaaagagccacgcattgcacttggcttgcacaagcccggaggagccccaaacgcggcggcggacggaatgcggctgcgcctgcctcagtcagtacgcgtctctcactccctctcccgttccttctccccgcaccgttcgccagatcgtctcttctctcgggacgggcgcgctcggtccaggatctggaggcaggcgctgcctaatcagttcttccttcgtttcctttttgtccttggcaacacgcatcaaagaaacctgcaaaaaatcaggcaggtttcgatttgggcccaaatctatcctgatacagttggtagctgactggccgcgtgcttggagcgccaatatttcccccaaacaatagcgccctccgtccgcttgttgaaatctttatccggtgtggagtggagctgccgttcaaacctgtcatctgattacttgggttgttttccttgccgttgagccttgtgatgtgcagtgaagccgcgaattgtttcattacatttggattttttttaaggcctggtgatcgaaacgatataatacttcatcttctatttggagtttcagctacttgggtgccgtttctacattgcaagatttgtcggtgatagtatattcacgttcgtacgcacataattctactgatatggcaatactcccgggcacataatgatgtcagtaaattgtctgaaatttcagagaattggcctgaaatcttgcatcctgttgaccattccaacttctccgcgttgttgatgttggtaccttgaaatctttgtagaaccagttagcaattcaacaaaaatgtttggttattttatttcagaagcaaagcagactgctgagtagctggacggacattgaacgaatcggtctgaatgctttgctgacaccgaaacctattgcaggtgaacattctgctgtg

SEQ ID NO: 10091 - DNA, 972 bp, Zea mays
ggctaggtgagtgggaatattggtttgaagctccatttgtatataattttagtttttaccatttaaatatggggaagcacgacgactgtgaagatcatgaaaccgtataaactattatatagtagagatgagccatattttaagaatttttcagagaataagtgggtctttggtttctttagtcactcttctaaactttagtccctaggaatcctatttgaaagacctattttagtgaccatgattggcattttaggcactaaaagtaactataaaatttaggtgggaaacaaacactgctagatataaaacttaggtgtcgtttgattcacataattataacataatgggtaacacataacgttaaatcatatttgtttaagttcagtcgtaatcagatactacactgaaaatagatatttgactattcaaacttattaccaatatcactcgagtgtaaatcattaccgttgtcatttacgttacagtttgtgaaccaaacaacaccttagatacactaatactgatatatgttttgtataccatttatatgaaagaattataactctttaatattgtttgtttgatattataatctgtttatattatatgatccaacaaattttgacctaacattttaggttaaaaattattgaattatataataaacaccccttgagttgtacatgctgtgctgttacgggaaaggaacaggagtgatcgtctattttctcatcacataaacgtactgcgtttctactttctagtggagaaggaaaagacaattttctcgtaaccttccgggctcctcttcctctcctcgcgttcccccaccaaaccctaatccgagcacccagcccctacccgcttccgctcgcgccggcctttggggctctcaccctgagcggtaggaatccgcagggctccggttgggtgccagaagcatccaagtcgttggcgggagaccgggaa

SEQ ID NO: 10092 - DNA, 889 bp, Zea mays
gtgagacaatagagcagaaataagatgaggaaaaaataacatgacgaataatccttatttcatcaaaataatgaagaaaaaatatttaccttcacagctctattaagaaaaaatatatttaggatgatatttgtgtaagttagaagtagcctaacattctcaatatcacctctagaatagggtattatggttatgggccctatgtctattagtaactcatctgaagactttctgtacaaacctttaccttggttgatgctaagagaggttcccataacatggtgtcttggaagtggtgatcactattttacttttctcattggaatccttaatgcgttttggctatgactttccccctaataatatcctttgcacatatattgtctcttcgaaaataaatacatatatcgagttttaattaattgaatatttttaagttttactataaaaatgtatccaaataatttcataataaaaatatattttaattttaatttaataatactaatttattataaatattaatgttcttaatatatttgatcgaaattaataaaaaattgattcctcataggataaaatatgtacttatttaagattcagaaagtagtttttaatgaaaataaaaaagtagtaattgtttgcaaacgttttgtgttctgttgttgttattttctactttatcctgttcttttatgaaacgcccacttcattccgtgaaatagaagtaaaatacaaaatctccccggaaatgaccacaactttctctcaaaataaaacctcacccctccttggtctgcggccctttgtcctgtctcctcccacccttgcctccgagtcacctcctcccttggtctccgccgtcgctgcctccttgccggaaccctaa

SEQ ID NO: 10093 - DNA, 150 bp, Zea mays
gccttttagccgtcggtccacagcaccgcgcccgccttttcccccgctcgatcgatcggcacccgcgcatcgcgtcggcattctctccagccgctactccctccctgcctctccacgatctcgcgaaccctgctagatccttgactcgcc

SEQ ID NO: 10094 - DNA, 306 bp, Zea mays
cgtgcaagtgacagcaaacaaatcacacatgagatgcattttatctatatctaaaaggcagatttgaagatggaagctttgggagtacaatgcgcgaggccatttctgttctgttctgtccatgatcaaacagacaaagacatcagcgaattaactgcaccgagatccaatgaaccgaagaacacaaggtcaaatcagtcctcaaaaccatctgcggagcactcgcgcgccagatccatcgtctagccggcccaagatttccctccccaccgcgccgctccaacgccactaagaagccagccagcc

SEQ ID NO: 10095 - DNA, 289 bp, Zea mays
tttcccttccgtctcttccccgcgcgcactttggccatgtcagcgatccgctccaaaacgcatctgagccgtccaaggcaagaagcacgaacgcctcgcgcgcctcctcccccagcgatccgcggcatccaccacctttccaccaaccagcgcgcaccacatttcctctataagtacccgccccacatctgcgccattttctcatcgcagaaatcctccgcaacttcacagcgtatcatcgttttccatcgctcctactcctatcatccagaaaatctgagcggtattg

SEQ ID NO: 10096 - DNA, 234 bp, Zea mays
  unsure (1)..(234): unsure at all n locations
ccatctcataaatgtcatctctgaatttggtgggtctataccataattttataagtctatgtctatgatntgtgagtttaatgctacatttttgaaatccatcagtaataatgacaaaatagtaaatctcttggttttggctaggcttgggattagcaaaggaaattctcagttttttggtaaaaaatcgtgtggaaattctcagtgagaccagagctgccaacacccaacacg

SEQ ID NO: 10097 - DNA, 684 bp, Zea mays
caggccttctcggatctcccacgacggtgtctttcgttgcttggcttgaacttgaacgagatcgtcgcttgttggttgctaccttcgtccttgtagccggacgaagggggtggcgatggccgtgtcctcttgctcaaacgtcgccgccgagacgggttcgaagtggcgaaacgaagaataggctcgagacgagcacaccgacagttgactttataggctacctctgtattttaggtaaactttagttaaactgctggacatatctactatgtctatcgttacctattttgggtataggtaagagtttagttaaaccggtggagatagccttaaaaccggtgaaatacatacctaatctagcctatcccgtagttaaaatacactgatcctgtagaaatacatatacccctcgctgccgcaacaatttttggatccacttccctccccacgtgttttttgattgttcctccccatgttcctcgcgttcccgtgaggccgtgacgcccccctcggcctcgcctcgccatcgctcgcggcatcgccgcctgccccctttcccccacgcgaataaagcgccggaagcgcgccccccaagcaaagtcctccggcgctcaggatcgggagccaccccctagggttagggctccgttttgcctcgttccggcgtcgaccgatgcgcggcgc

SEQ ID NO: 10098 - DNA, 1500 bp, Zea mays
cattttcactagaaatcttttcaaattattattgctacatacaatatgggttaacaatacttgtaataatagatcactagaacattaggttcccttcgagccccctataatgatctgaaggaaaaaacttttgtccttgctagagagtcataggtataaaaatattaaatagtaatactaagatctaacaaaaaaatgttggttcttaaagccattgtcatcaacctaaatcaaaacttaatagatttaacaaaaaatgatatgaaagcttgctacgatgctaatagatctaacactaactcaaacaaatttacatgtgtatatgataggatatgtatagatttatcaagtatcaactatgcatatgttaaaggcgggtatattgtatcttcaatattatttttaaactataaaagtgagacatgtaatgtatttaaaccatgaaaccgtgtcatatgatgcatttgaaccactaattaaatatgttattggacttgtgacaacaatttgaagactttttgctgaaaccaaatttcaaaaaacgcaatggatttcaaacttaaaataatcgaagtgtataggactaataaatcgatgtgtagaactgattagtcggcgatcgaatatgagcttgggttaggagggatttttttctctcttttcacttgaaatcttttttaattaccatggctaaattttgttattggacttgtgataacatttaggatatttttgttcaattgttgagatctaaacatgtttttatttgccaaaaataagagattcggttttaccttatgtgtcgtcggcttatcggttttggaaccgattaataggtggtattggccgataaatcaatgtcaaaccgagcagattcaaaaaactgctcaaaaatagtttgaattttgatttggtcagattttaccggtttacgccgataaatcatgattaatcgtcccacccgggtttggtgaaccctgaacaacacacatccacacataaacgattagtattagctgaagatgtgcaccgtattcgtccaagcgtccagctgttcctgtcatgcaccccctgtgggctgtgtggccttgctagccttagcgtgaacagaggactcaacagtcgcgaggccatatttcccgatagtacacggaagtccggcggcaatggagcctcactcttagcagactccttccgcagccaccgtccattgtcgccactcgtcagttctgaccaatcacgcgactccaaacagtgttatgcggcccacctgcacctgcaatgcaacgatcggtccctctcgagcagtagacgcccggttccttgtactttggcacccccatcacgtcgtctggtcaatctaaagcttggacttgcagcctcctcatcggtcgatcgatcggagtgacgtgctggggattgtaggtgcaagcgcgcgcgacattgcagctaccgagaagaaagcagaggggcaatcgagcagttgacgggcgtgcagca

SEQ ID NO: 10099 - DNA, 853 bp, Zea mays
cgttttttttgcttgctttctaagttgaagccttacgaaccttgggcggatgggatgtggcctgcgtggaagccagatgcacccgaggttccagaagctccacgcgcgactggtcagaggacacggatggtacgtcgagggggaagataagctcacggtataactttacagcctcagcacgggaatccgatgcggaggcaggaggaagctaggaacgagcacgctcggcagaggaagcggaaggtcatatcgcggatggcgtcgagggccagaacgcgacaccggggcttctttcgtgcttgagcgacaggagcgaggcccacgagacggacagtgtggacgccctcgttccactcttatgctattttatatcttagaatgtgaatacttatgttttctataataatcatgggtcattttcactatactgggaaattcggatctgtgttcgcctcaattcctggacccatctttgcagctctatatctgttttagaccatgttagattattatgtgtttccgttgcaatgcacgggcactcatctagtactagagaagacaagagaagaatagaagaaaacaagatagaggaaagagaaattccttataactgctattatgtggaggcgtggaacgctcggagcccaatccaaagaagcccaccggcccacctcacaacggcctgttccgcgccctaagtttgctgcaacgccgccaccaatttgcagctccagcaaacggctcgtcgccgtcgcggactcgcagccactccggagcgttgcctcacctgtgtgctcctcgccggcctcgacaactccccggattgtcatagtcgaggcggttctagtcgctg

SEQ ID NO: 10100 - DNA, 941 bp, Zea mays
gttttttcactgcttgtctgcttcacaaatcacaactagggtttcgcacggtcacaaatcacagcttgtctgcttcacaaaaggcggagcggtggctggacaacgacgtggtcgcgggctcgcgcggtgctccgacggtgcggcctccgggtgagcggtgctgcgaggtgtgggggggtccgggtgggcggctgcggcagcggtggagctccgggcgagcggcgctgtggcctgcagggtgcgggctgctggctgtagctaagggtagagccgtagaggactagctagagggagaatgttcacgggactggctggagctaggcgcctgagcggtcgcgtacgcattcggcctcttcactttactgggccgcgacctgggctacagacagcctatgtcagagatcggcccgtgcatggaataaattattacatgtatgtttcttattaaacttttatgccacatacgcgcggctgacgatagcatgcatggatgggtaaaaaagttcgtgaacgcgacataaaatgaattatagaatatttacgacaacaaataacgttccgaacgaagttgcagtggtatttcgatttcgtgaactgccgccgcggcgccatgcaatggtgccatgcagacgtgaactgccgccgcggcgccgcgcgcccctgccttgttgtcgttgcccacgtcctcgccacacacgcacgttctgacgttcggacgttcccacatcccaccagggcaccagtacacacagcgctcgcgcagtcaaactacaaccggcgatgcgacgcagcaggcctgcatggtcataccaccgtacgagcccgtcaagcccctctaaaacgtgggccgcaccgcttcctgcatcccattccaccccacgcaacgcaccacgcgcgaaggaagctagctcccaccgtgagtgcagtgcaccgctagatcc

SEQ ID NO: 10101 - DNA, 291 bp, Zea mays
ctgcttctctgcagtgaatatatgtaaatggaaatatgaaaatacatttttcaatatgagtataccgtacacgacaagccgggtttataaaaaaatacgacggactagctgagtaggtactcgtcagctacaattctacggtccatacaagtagatcgagggtggtcgagcgtttctttctctcttcggctgaacgcggttttgcacaagcgagcaaagagagggagagagagagaaagaaaagaaaagaaaagaaaagaagaaggggaggcccgcgactgtagtggggag

SEQ ID NO: 10102 - DNA, 445 bp, Zea mays
ctgcagggcggatccagagttgataattattgatgtcaccagtgtaagaaacatgattattatcattgttttctgttagctcaacagtaatatagccatgaattcgtagaatctaatgctgtcaagtgacagcacaaaaaggtcctgactccgaccctactcaattgcacagtcatgctttactcgattggcatcccaggaaaaacatgctaacagaaaaaaaaaaaatagtagttttgtctagcaaaaaatgtaagaaaacagaaataaatcagcttcaattttaaacatgtgttgttgcttcaaaaatgacccagcagtaaaataaaagcatcaccctgcgctctgggcagttgaacctgaatgtacctcatatgtcactatcccaccagaggttgctggttgccgcagtgttgccgtgcacagagcaccatttgccgaaatt

SEQ ID NO: 10103 - DNA, 422 bp, Zea mays
tctgggccgagcccaacatttcggtcggattcaggcccaccgaactgggtctggttagccactttttagttttttctgattgggtggtcccggaaactcagaaagatgccgctgcagcgctgccatcatgggtcccgctgtctcctgcccgaggtgagccgccaggcccccagctgcagcgcccaagccaaccaggcggcaccgcggcagcacgcacgcgtccccaccggcaaccactacccgcgcccgcacccaaaataacctagcggatttttttggtttcgtcaaatccggtctccacacaccgacacgcggagaaaattccgaagcggaagaagttgaaccgacaggtgagagagaaagagataggagagacgaggccacgactccacgggggaggcagggagagaaggtgagagaag

SEQ ID NO: 10104 - DNA, 372 bp, Zea mays
ggtgtgtggagaccggatttgacgaaaccaaaaaaatccgctaggttattttgggtgcgggcgcgggtagtggttgccggtggggacgcgtgcgtgctgccgcggtgccgcctggttggcttgggcgctgcagctgggggcctggcggctcacctcgggcaggagacagcgggacccatgatggcagcgctgcagcggcatctttctgagtttccgggaccacccaatcagaaaaaactaaaaagtggctaaccagacccagttcggtgggcctgaatccgaccgaaatgttgggctcggcccagatggtgtgctgctgggttcctcttcgcgaaggcgcaagagcaagcggaagcaacgccgacttttgcg

SEQ ID NO: 10105 - DNA, 1500 bp, Zea mays
aataaagaggaatttaatccccttcaatccacccctagtgcttgttcgttttgaggttaatccatatggattgtgtgggattgagccggtttaaatccatagcaagtagttggcacatatctggcaccaaacactcggatgaaccgcatggtggtcctctctacgagagtgcggacggtctgtggtcctaagtcggacggtctacaacctccctgcaggagtggctcctttcctgcgtgctttcagacggtccgtgcctggggctcaaatgatccgcgatggcgcaaggtcttctcctttacaggaacctgaatttcacctctcatgagggaccctatcggggaggagagataatagggttgtctttgggttgacaggccactcaagatgcctctagacgacgtcgagccgtagaaaagtgaagaaataggtcaaggaagactaatactagggcagccctaaggctaggttactcctactcctaatgaaagggaataagaatgcaaataaggtaaattttataaatagatttgattggatcgattatagggacgtcaatcggtcgtaccccttcgtttatattatggggcaggtctagatccgttacaagtcagatcctaaacaaatcctgtagattttgctaataaatcccgtaagaaatcaggaaccctgactgattttgttcacgcacggatgcaccgccaccgcgaaccatgcggattgcgaaccgttcgatgcatatttttgtgctcaatacaagtcaaagtacatctcaatcccactcaattcactccaatccatatagaatatcgaataaccgaacaagacattaggcctagtttgggtacacttggaatgaaggggattaaggccttgttcggctatttaagtacatgtggattggagtgtattggatgggattgagatagatcttgacttgctatagatttaaaccgatttaataccatccaatgcacatggattattgttgaaacgaacaagtcccttgaggtctcgctcggtttgatgctaatatatgtggatttagtgagattgagtcggtttaaattcatagtaagtcaaagtctaccccaatatattctaatcctcttcaatccacatgcaataaaaataaccgaataaaacctatatggattaagttgtatcgagggagattgtaatctattgtagatttaaattatgttcaacccttccaaacgtctccaatccaaaagtacccgggtggaaccaaacatcaccaactagaatcactcaacacgcacgggccaggcccagctcagaggcaaaaacccacaccacacttcgttccccttgtcccaattgctcctccacttcccccaccgcccaccagtgatctcgccgccgcgacgcgaggcaccacggccggcgccggccgccttcctccagaaagtatcccccgtgcgcccgaatcacctcttaatttcgttcttagccgctgcgtttcacagaggtcgcgac

SEQ ID NO: 10106 - DNA, 642 bp, Zea mays
agcaaagaggagcgcaaccgcacaggtggctccctttcaaacgagcagtagctttgactcgaaaatcagtctcagatgcgttctccccagatcaggcgactaggcactagggattggtttgcagtcgcaagctcaatttggtcggcagaccgcagatgaacttcacctccgactcgtgggcccgttaccggagtcctctcggcacaagatgtgactgaaagatggccccatgaaagacgggaccaccaagtcagtgacccattctaactcacgacacaacgccctgacaggtggggtcctgtgggccccgggtgaccttcatctttcggtcctcgctccacgttgcccacaatgatctggcccactgacagcgtggacccatacaccgaccaactccgaaccacttgccacggcgcacgcggcatggagcgagcgggcccatatgtggagcagggaggcccacctggcgagcgggcttcccgatcaatctctccagcctctttctcggatcccccctccccgatttccttccccactctgtcagtctagtgccccgcgcgcgctctctcgccgcctcgccgccggcgacgagcttgagctcgagctcgagctggtttctcgtatcgaagacgcggccgcggt

SEQ ID NO: 10107 - DNA, 691 bp, Zea mays
tgcagttattcctcaatgattgccttggatatgccatagggtcgctcagcagtgagctgattgcagtagttctatcgcatttgtgggagtggattggctttactagtcatatatcccattttcatgattggtgctgttgattcatgaacattcaattgtaccaactaataacattcaatcgccttcctaataacattcagttgcttagccttccaatcttttaaaagtttcacattgtttgttcttttgtagttttgttcattgtatttatcacagagcatcaaagtcatctaaaccagtttacgttctctaatattttttttctctctttcttttgatttgcagatggaaagaattttgtagagctgtggctttcttctttccagaactaatatcgtcagacctcgcctaagctaccctgtaaatagtatcactctgttttagttctactacgtttgtcctagtcgcacaacgtatcgatgaaggaagacatgaaaaagaaatctaaaaagaaaaagaaaaaaaaagaggagcagtagaattctgaaacagcatcaattggatatgtccttcctgaggttcccaggctattctactcttgccaagcaaggcgaaagctgagctgcacaaactgcgcgccatcgagaatgattttgccgtcctgatatgtgctgagtgctaacacgtagag

SEQ ID NO: 10108 - DNA, 934 bp, Zea mays
tggtctgggactcttttatagacactagaacctggttcggctgaacctgatgacagcattaggccagagctttcctagccattggaaactcaggcttcgtaatatacaaactatatatatatatatattaatataatcatgctggacaggttcgacagtgcaggttgaatagatatgggcctactttgccggatcgggccacaacaatattaaataggattgtgtttaaataactatcacatttagtcaaggtctacatgtatagtaatatatataaatatagaaaccatatccatacacggacatctaactagtatatcaccgttattttagtattcctcaaaatgaaacattttattatatgctcatagtcatttttctcaaaaaaaaaaaaaattacaaaccgtgcagctcatgcattagcgccttgtctacttgagagtgaggaccgttaatatatccaggaggtgttgatatgcacgttttcgaccatgtcacatttttgttcaatcgtttgaaaaggacattgagacggacacatgatgacaagatctcatatgctagttgatgacagctaattaacagtcctcctctccctttatccctgcaacatcctcgctggcatctgccaagttcgaaggcccaccccggtataaaaggcggatccattccgttaatttcccacgtccaggaaaaatatcgaaacaaggacgaaaaacacgaagaattacggaagagcaccccatcttcggtttctttcctccggacttcttcctgcttgcggcgtccgccaattcccttccctacccaaaccctagagcaaagctgaatggccctcgccacgagctcgcgagagactctgcgccgccgccggtgactgctgatccgcccgccgccgccgcgcccggtgctttgtcacgcaggaggcgacggt

SEQ ID NO: 10109 - DNA, 115 bp, Zea mays
cgtgaggatttctggcgcctctcgccacggatccgggggagaattcttgtttcgttgctgcgaattttggggttttctactctcactcactgcccctgcgcgggcgcgtgtgcag

SEQ ID NO: 10110 - DNA, 1500 bp, Zea mays
aagaacttttatccctctacaaaagtctccatagttggaagagccaattcggccatttactagatgaaacctaccagttaacagacccgctcatttttgtcaggcaaacaagaacccttatatatcaaagagtagtggatttgaatttgtctaatatgaagtttatgggcttggatcatttaaagtattttataattctgaaagacaagattaaactaactatgtatgatcctttagcactgtacagatggtcgatgggacagttacatggtttatatagatggacctatctatattccttcagtggttgagaaaaaggtaaaggtgtgtcacactcacgtgtgcgccgcctctgccgagatgaggcatggcgttgcaaggtgaggcatggcatggtgcagcacgatcgcagtcatggtcgtggcacagtgtagcactgttgtggatagatagataaactattgttgtagttagagtgcatgagtttttgaatgcaacactagaattttcacaatttaacttaattaagaagttatatcttgatgacacagagttacctgaccattgatctcacatgcccttttagctctctcgttctctagactcaccctgactatttaggtctcctgactcgccaatataaacaccatcctatcatttgctctcgaatacttctgtgtcacaactcaactgtcagatgagtactccattacagcactgagcaggcctccgaaatgaatatctactcagatgaaggacgacaatcgtgttctagggaaatatcggtgacacaactccttacttcctccgcttcttcctagtgttttttgttgtgattgagtcgacacagcaacaacactgcactattacaaccagtacgactatattaactagcaatgtcttccttatatgttactatttattttgctcatattcattatgtttaaatcacataggcacctttttgttggcatcaaaaaattagtatcaactttctagattaaagtgaaactaaaagtacctaaatttctatcggtggggatcgagtgattctttaaaccaattattacgcaagttaaccacactaaaattaacattggtgaaccgtgccatgattttttctaatggaaaatagccaaaccaagcaacacatatgtggctatcgttacacatgtgtaaaggtattgcatcacaccattgtcacccatgtatttggacaataccgagaggaaaaaccacttatttattgtattttatcaagtttgtcttgcttacgtataaattataacccaacaaagtaatcactaaatgtcaaaaccaactagataccatgtcatctctaccttatcttactaatattctttttgcaaaatccaaaattaatcttgcacaagcacaaggactgagatgtgtataaatatctcttaaattagtagctaatatatcacacatattattgagaccaactagcaacatagaaagcacaatagtgtaccaaca

SEQ ID NO: 10111 - DNA, 1500 bp, Zea mays
cacataaggtcattagcttggacaaaaacgtttttaagcactagttgtactctaatacccttttgtgcgagtagaatgccctcgacatcaaagaaacaccatttgtggtttaaaaggtgatctattgttttgaattctttatattccaactttttagcaactgtatggtggaaacctgttatcacaaaaggtcattagctagcccaataacgtcttcatccactagttgtactctaataccctctaatgtgaataaaatgcccacaatatcatagaaacgtcatttgaggtttaaaaggcgatctattgttttgaattctttatattccaactttttagcaactgtatggtggaaaagagttgtcttacaaccttaacctatgtttggacagtgcactcacgcaatttggctaaattttccatagtctttattttattttgagaaacgatgtggtataatgatgtgcgatgttttacttgagtggacataaacaccatttaggtatgccttgaatagaggggattattggaaacctggtatcacaaaaggtcattagctagcccaataacgtcttcatccactagttatactctaataccctctagtgtgaatacaatgcccacaatatcatagaaatgtcatttgaggtttaaaaggtgatctattgttttgaattctttatattccaactttttagcaactgtatggtggaaacctgttatcacaaaaggtcattagctagcccaataacgtcttcatccactagttgtactctaataccctctcgtgcgaatacaatgccctcaatatcatagaaacactatttttgtgtggtgttttacttgagtggacataaacaccatctaggatgccatgaatagacgggtgttgggaccttgcttcgtcgccgaaggtcctgaaggaagaaacagtttcggttgaagctgtctgtacgtaatgccgaagggtgtcgcccatgaagcttcggagttacaaaccgacttaaagataaaatgaccttttagtccataagagtttgtgtcgatgttgtaaacttttataaggggtatgattgtaattgttcacaggctgtgtcctgtgtctataaatagtgaacagtattcctttactgttcacgcattcctgtaattgcaaaagctttactcgggaattatttgcttgtcaaggcaaaggtacaatcataccttgaacattatattcaaaatatgtgaatgatgctatttatctctaacatatctatctttctttaatgttttacattttacattcttttatgttattttcaccttcgtaatattatattctatacccttcgtccgaagttcattaaacccttgaggtgataatgtttcagcggacgaagggtatttaatatttaacgtcttcgtgttggcttgttcttgattcatagcatttgagaacaagtccccaacattggtgcccacctccggtcaacacacttccacttttttgagttg

SEQ ID NO: 10112 - DNA, 1500 bp, Zea mays
aacgtggaatcactaatgtgtgtttctccatgatgctacatttttttttttggaaatgtgtagttgccatttaccttcccgttgtgttttcggctaaacagagtggcataatattactcggttgtggtttttgctcaccatcagtttcttgttgctataatcattacttcaattatattgtgtgcataaccaaatattaacctaacatgcaagttatttgcattgtgaatttgaagaatataacatgcaagttatttgcattatgaatttgaagaatatctgctaaccagattaatatttggggagagcagggagttgtttatgagatttactacctccactcttttataaggcgcacacacatatcaaggttcaaacttcaaaatctttgaccaataattcgattaatattttttaattattataacacaaacttgatatggttagatttgtcattaattctaatatccaattatcataagtgtataggtataaataatataaaataaaataaacagatggtcaaagttaatttggaagaccgtgtcatgttaagttgtgccttataaaagagaatggagggagtaatttgttattttttgtagtcatagtacaaagaagcttcctgcagcatatggtaaccttttttctttgatggaatcactgaaattacaagaaaatgtcttagtgaactagcccatgatccattttctagtacattcttacacactattttgtgtgatgggacattggttcctttacaattctgcagagtgcagattgcagcaggagttagagttgtctccagtgtactaagtagtaaatacctctatagtttgaaacagaagcatgaaatatttcgatactaatatgtttaattcgtgatctagttaaggactgcatcttgtaccttgtggcttgatgtacttgcatttcctaagtcaatgtaacgaattcttgaaagagtacgttgatccatctatttttgcaacaaattcagtgtattgtgcaatttctctgtattaatgcctctttgattaaatagttatgaacttatgattacccctttgacacataagaagattaatctgctaggaccgatcccttaccttgttgagtataagctttgcataaaagattcttttccaaatgaagtgcttgtgtgtcaagggcgtagtgatcaagggtaggcggccctcgactacggagttcgtagtctcctgccgtgtcttccaggaccgaaggttatgccccttacggcggctgggcttgagaggagatagagagagagatggataattgttttcctcctttctcaagtgctgattacatctatatatagcccacggctgaaacagataagggtaatcccctcctaaataataggctagataacttctaacagaaaggagtaatcccttcctaaataataggctagatatcttttattgccttaatcctagcggcttaattggtttgggcagccgcctcctgtgctgc

SEQ ID NO: 10113 - DNA, 1224 bp, Zea mays
ctaactcacctccttgattaactcatccaattaccctaagagatcaaggtcttccttctctttgaccatgttcaaactctttaaggccccttaatggaaggttcaaggttctaaactgctcatgtggtcaccttctcctctttctccgttccagacgcggacgccatggagacgtcgccaactcgcactactcatgtttatctcatcgaacacatttagggtaatggactctgtcgagtgctccaccggaggaaaggaagccataacttgtgtaagggaaaagtacctttacatagtagtaattagcagtttgatgatgtgaattctgtttagcctgaagttgatttctattcggcccagaatcggatgcccatccatcaatgttgcagggaataaataaacaagataaactaataagtcagatttgtgactatacaagtgtcgacctaattgactgataacatgatccataaaagctatggtgaaaatgagttatattttagactccatataagaggggagaaattgcgtgtccaagttttcacatgcaattattgtacaactaaattatcaaaattcataaattcttaaaaaatatatacacactttattatatacactaccaatgtatcaaaaatttaagttttattattctatgttaagagatattaaatttttttattgtttttaatttttttttaaatttaatatatttttctggctcttaatatatgatgaagtagaacttaaatttgatacattcatataatgtataacgaaatatatctatatatatatatatatatatatatatatttgagattttttcatgaattttttaattttattgtatgttgattgtacgaaaaacttgattgcacaacagttttataaatatctatctttatattatgctatctgaatatactgattgataaaaatatttttgaactggtcttatttatcaccgaacttattcaagagagtatacgtggcctaaattgaaatatctgggaagtatggcctgggctcttcattggactctcatgtcggcccaacacagctccaagtcgcccttcgcctgcaggctgcacctctcggccaccggcgggcggcggcagtagctgactgcaagattccgttaaaccgcggcttctccctcccagttaagtctcgttcactgcctgtgctgctcagtgctctgctcacacatcctcgtcgcca

SEQ ID NO: 10114 - DNA, 792 bp, Zea mays
gagcgacaattttggagttggagatgcatgtactctagaaatagagtttctggttcccttgagtagcctaaatagttcgtcgctgcgacagttttctactgtatttcaactctatctctataaggtaccgattagagttcatcactgcggatagcctaaagatccattacctaatctctaaaaactaaaaagaatagatatattgtggaaacgactattgtgcacaagacttgtattagatgcaaatgtgttagactacccgcaacggttccctctaaattttttcccttataccgcactatggagccacctcatcctaattctatcccctacttttctcttcccggcaatggttacccctaaattctccccctattacccacccaaccataaaatatcgttttctacacctatttatcatccaacatcaatttttttccaaataccaaactccaacgtgcactgtcatgtcgttgtgcgcgcagggaagggggctagcgccctcacgctgcatctggcggatgactgtagacgccttagtactgtagccggtaaggggtgtacatgtagtagaggcaaacgttgcagggtgacactggggaggagaggatgtcgagcgagttatctccggctcgaacccgtactcctcaagcaaaaccactggaggagcaccaagagttatctccggctcgaacccgagccaggtcctgactcctgatccgcaccgcacacggcaagggggcatcgccgacgggccgtcagcggcgagacccaagccaacacagcccagcg

SEQ ID NO: 10115 - DNA, 165 bp, Zea mays
aatgaacgattatgaacagaaaaaagctaaaacaaaaaaaaaaatagagtagactcgccagccaggcagccaccctcaccctggtctggtctcctctccaagcgggcagcgctcctccaaactgaaccctatcctagcacgagtgcacgtcggtggcagcaggag

SEQ ID NO: 10116 - DNA, 906 bp, Zea mays
agtcccaggctcccatctcagagctctcagcggtggcggccggcgaccggcgagctcctccggcatcggatcccctggagtggagcgttgaaccacgctgcgggcctgcattcaccacctccgtgctttccttcgtcttctccgcctcatctggtaagagcgtccgtctgcttcctctcttccctccgcttttcccgtagcagaattcgtggtggtgggcggtgcgtcgctggagggtgggatcttgctaatgcgctggtacgcctccggatagtgtgggttttgttgctgttgggcattaggaggtgggtttgatacctgactgggggatctgcttcccactggatttgatctggcaaaggaaaggtgatagcgacatgttcagatcgccttcttttgggcgctcttttgcttggtcaaacgcttcagttttgcgagttcacatgggttttttgtgtgcgattttgtggtgttttaccagagttgtttgctggggtttagctgaaatcctagatgcggacccccccccccccccctccctctaaactttaggccactataattatttaatactgccaatgattggggggagtttagtgttagtaggatcattatctgtgtgtttagtatcagtagggtcatttgccgtgtttgattgtatttgttctgctgatttggggatgagttagttaggcataggtaccatgagtgccagtcttgctcgctgcatgtgcggatttaatgcctactttagaccaacatgattattgcgtcactttagattgataaaagcttggaatcatcaagattggaaatgcattttttttgttctagtagtactaattggtaagctatagttctcagaagtagtgtttcttccttccttacaggttgctctggtcagtg

SEQ ID NO: 10117 - DNA, 338 bp, Zea mays
tcgcctcctaattccgccgccgccgcaagcgttcgtggggaagagatagatggagttcggtgagcactgagtagcggcgccgttgggagaagcggaatatatagctgacgcagcgagcgaaaccctaagccaggagcagacccgattgggccaaatggcccgtagttccatagtcctgtaattgggctgaaatgaaccttctgggccacatgggccatatgtgtctgcggtttagtccaagtctctccccactccccaggctcgacggctccgttggttgattctgattcgtctcctgttggctgttgccttcgaccgcctccacctcgtctccgacg

SEQ ID NO: 10118 - DNA, 535 bp, Zea mays
cacacatgtatatacgttatctatactattatatgttttcgttgcaacgcacgggcactcacctagtagtgtataataaagtttaaaatagaaaatgtgatactagatatacctaaagtaagaagtgagatggtagatgggatagagacgctgctggggagaggaagatggtgtctgtttctttgggccgaaattgatttaagggccagcccattaacgctgggctccttttcaagctcaggtccgctagtccaagctcgtgtaccgtgtacgcgtcggagatatatacaccgaggcccgagccaccgaggaaaactcgagggggaataaaatcccagcggcttcccccaaacaaaacctcttctccgccagagtccgcgtcggccagatcaaacgaatcggcacgacgcatcggcatcgcctccgacgatcttgagacaaacaaaacccaccgctgcggcaactccgcctcccgctgacacggggatcgcctgacaacaggcagagaaaagaggcgcagggtttgcccgcgaag

SEQ ID NO: 10119 - DNA, 197 bp, Zea mays
gcttgcatgcctgcagagcacctggttgcagccaatatgcaaacactctgtgggctccttgtgcttttgctctcctccctcccaaccttctccttataaatacaaaggcgtgtgcaaggcagaaccatcagctaagatagctgcaaaacaagcgagttacttacaaccaaacagaagggtagaaaccacctgaagcc

SEQ ID NO: 10120 - DNA, 988 bp, Zea mays
tgtaaagcgtgcgctaccggatacagttagaaatgcagtaaaaatctactgcaacgttgcaccttaccgcccaccttaaattaaaggaagacatgaaaaacgctacttctagagctactccaaatctccctcctcccgtcatggaaacttgtgcgctgacagcgtgaggcgatgtggctgtacgtgtgtggtagcgtggtagaaagaaatcatataatatgtggtagttggtatagagttgagatatgaagtagatatgactgcggagaattgtagtatagagtaaagaattttgctgactaggacagaatattccttttagagtagaaatttagagttatatgagtgcggatagcctaacgcccgaggcgccgacggctgctccctggccgtcctcggaagcgcggcggccaggcgctgaggcgcaccacgccacgccggcggtgggacggaggagaggccggaagttgctggctcaaggtaagcggaatggcttccgttcccccactcctcccctccttgtagcttgcgagagcaaccttgtcggagctcgccgccgcagccacagccacaagtacgcatcctccgtttgaattcacatacagttctccatgggtacttcttcctgcacattcacactcaccacttccttgttgctaacgatggataaataaggctaccactctatgactccgagccaagccaggagcaatggctctcgactgagtcctacctaggtgtatgatgaaatgcctgcaggacttcaaacgctgtcaagcagcattttcatctcagcaaatcacgtagcctaccctgaatttctgtctgcgtctttggcagatactcttcctttatcatgtccggcgagatgaggccacagcagctgggggcgatgcggcgtgccatctggaggagctggcctatcctgtgcttgcagtcacagcacaggcttctaccatctttctgtgcctcaaccaaggccgccacg

SEQ ID NO: 10121 - DNA, 965 bp, Zea mays
cggtcgatcgcgcgattagcgggagacacgtggcccagccaacagttagaaggtcacaccgaactgtccggtgtgccatgagaccagtggctggcaatggtcggcttcaccagaaaaggacgggaatcacgcaatgttcactgtccggtggtgcaccggactatctgctgtgcccacggacagaaggcaaccagagccttacaaatggagctccaatggctcctagctgccttggggctataaaagggacccctaggcacatggagcactgcaccaagtagtcattgaacatccaataacatcgagacatcaaattcgcgcctttgctttagtagattgagatttgtgcacttgttttgagctgtaactcagttgtgctgtctttgtgctcttctctctcgttttgtgtgcatgagtcgctgcaagtttgtctcgtgtgtgtggttctattccctcccatactcttgtggtttaattgtgattaaatgtgtaaggttgggagactccaaattgtggagattcctcacaaagggaaaacttgagataaggaagaaaactgtggtactcaagtttgatctttggatcacttgagagggattgagtgcaatccttgactgaaggaggtcatcacaacgtggagttaggcattggccgaaccacgagataaaatcaccatgtcacttgtgcatctttctattgtgattgttttctttcatagagttctcacttattcacttgcgctatkgctcctaagttcaatacatatcctaaaggaacaaccaagtggagagttctcttctctctatttgtatcaccttggttttaatcctactcacatttattataaaccaagtttgtgttgtttagacttgatttttacaatatcacctattcaccccccctctatgtgctctcaattggtatcggagccgtactcttcattcatggactaaccacccaaagag

SEQ ID NO: 10122 - DNA, 1500 bp, Zea mays
tctgttcctctctgtgctccttgcctaacaatgcacccaacaagctattacaccacatatggtccataagaaatcactcaagcccaacacaacatgatgtcacacacatcgccacgctaccatatagtactacctctctagctaaaagagaacgaacgatcaaatgagctataagaaaagggtcaggctcgttttcaactcatatctttcttgacattttggagaaaataaagtgtaatatttgtttttatcagtttaatatatgatatgtggttcatatgttcactttgatattaaatttaattttataggtatcaaatatgactgtgtgccatcgttaccgacaaaaatgtactattcaacaatgttgaacctcacttccattctttggaagaaacttacggaaaaaagataaaactgatcacctccagggcaaacgctaaacattcaactctctttgatttatggatccagaatctgctgttgccttcttctgtacttttactttcttcatttcattttttgtctcttgaagttttgttgttaaacttttaattttcactcatcttttggtttttaataaatttctacatgggcttcgccttctccaatttcgttaaagaatgtattatatagttgatagttccatatatctttcgtaggatcaaatagtctttcattagctctagtcaacggagccaacattttattagaaatgacattgatagataaactttttaaatgttttactccttgtgtcctaatttattatttattataattttttataagtctgaccagctcgtttcattcaaaattcttaagaaaaaaagaaaaaattaaagccatacttaatgtgtattacatgataaacaatatcacagtaaaaattaataataattatattttttaattagacaagttaatcaaaattacgataaaatttttaaatgaattataaattggaacgaaagagggaaacaacaagggaaacatcccgcatcacatcgcagataagaaataaaaaaactcgcatagcttgaatcggcacagaaagagaagccaagttattcatagtagttgcatgtacgagagaaggaacataaaagtgccaaaattgcatgatgcaatctaggcaagctcatctacagcattgatctgagacttttttattgtaataaataccaaagagtgactttgtttgttttattttaattaacgcaaaaccgcggctgtggccaccggccctccgttctccttccactcgctttctggcgtgcgcctcttgtttgtctgcttccgtcgttccctccccctgtacgcccgtggccgccttttataagcaccagccatctggccttttttttcracaacgccaaacatctggtttcgctgccccgattcgccacgaagccgcactgtgagagagggacgcggcccgttgtcctcggcttgtacgcaatccttccgtcgctgcgaagctgatccctcgtgttcgcc

SEQ ID NO: 10123 - DNA, 1500 bp, Zea mays
ttgcccccctcgtttttataattaaggactagtttgggaactacgtttttcgttttttcaaaggatttctattttcccgagggaaaataaaccaatttccctcaagaaaatgaaaatcccgtgaaaaaatatggtttccaaactagccctaaaaggaaaaaaaaagcaaaaacagaatcgtcgttgccaggctaagcctgctttgctgtaagaaccaatcgactgcatggcaatgacatcgctttgctttggacacaatttgtacttgtaggtttgaagctgggaaaatctaaatggaatcaattagacgctggtgcgaatggccaaaataccatatacccaatcctggaaccaattcaccgaactcggacctcaagtatctgaacctgaaatacctaatcacaattttaagtggtaattgtcaaaacctgaatttagtttagataatatagcacgtgtaatgttccctgctacccaaactatccaaattacacataataacttgaatatttctcttgtattcctaatataaagacatgaaacggcttagtgcaatataaatctattgtttggaatgaattaatgtaaacttatgctaacttaataattggtttgttgttaattaatataaagacatgatgcaatttgaataacatttgtttattgctttaaatgctattagaattcttccaaaatggttggttttatcagttttatgtatatcaggtaaaactcgaatccgaattatcgggtacctgaaattccatagcagtccatgcattcggacacgagtcatggctaacatatcaggtaaaacgcaatgcagcaaaaaagacttagcgaagcatgcgtagttgatgtaatcgacaccggaaaatagactaacatactatgtaaatcagcatcaattccatagcagtccatgcattcggacaaagatagactaacatagcagttcaaattatatctcatcagagtcaaataacagatcatccacggttatctctagagcatgtatccaataaataagagcaaagggacccaaatcaacaaagattttttagtgaaaaaacaacacacagcagacatgtgtctgcattgcattatcaagtctcagatgcccttgcaaaaagcagcatgtgtctgccttgccgtatctctctatcaccaatagctgcagatccatgtcttgttcctctcacgagtcaccgctatatggccctctcttccgttggccattgcacacctcctcctctcctcgtcttcttcttcttttcctgactgtccatgtcctacaatcccttcctggcttcctccacatataaaaccctctcactctcaccccctccatcccatctcatgcattgtggcctccagagagccccaagaagctgaagatctttctctgtacatacacacattcttgtatagatcccaccagcagttccttcctgtgctgttcgtcgcaagaaccccattgttcaaccggtgtctgtccaa

SEQ ID NO: 10124 - DNA, 832 bp, Zea mays
tccaaccatggcgccgccccctgctcttcccttggtcgcggccttctctactcatgcgcgggggtgccggcaggagccttgccatggccggaccggccctagctcgagctgtgagctcgccgtcgcccatggctgacgctctctactccatcctcagcccagcgccactcctttctccccatggccggcacacacgaagccagcagccatggacgcccaggccccaacgccctgcgtgcgttcctccatggcgtccagaatttttccagctcctcccacggcgcccttcttccccaagagccaggagcagccgctcccatttttcttgcagcgccctgttcgtttttcgtccagccggctcccctttttcacatggccgaacacagctccctgtccatggatgcagcagcagcaacctccactcctcccccacaaaacagcagccccggatcccctccaaatcgcgtgcttcgttcgatctgcgcagtcccgacccacgccgttgtgttggtgtttgggacagctccatgccgcgtcatcgctctgcgcagttcgaccgtctacgagcctcacttcgccggatctgcgcagccccaacatcgacgtcgttcacccctggtgagaccacgacgatccttgttcgattctgcatcggcattgttttcctgtgatttattgtgtatgtgtgttgttttgtttttgttttgtggaggagaggaaccccgtgttttgcgtggagaagaaggcaagtcgctcaacgctcgtcggatgttcggagcgatgcacaaatcagaatcgccatcgttcttacaaacactgattgggtttgttt

SEQ ID NO: 10125 - DNA, 1500 bp, Zea mays
atcagaatgacagcagattcgacggtagcaaccggttatcagaaatagtccagccaagctagaaagggaaattatcgacaaaaagaattagaggtttgaatgcactagtagacatccaaacatcctaactagtaattcagctttcgttatttttagcaaattaggtaatagttagctacctatttgttagttagttaattctactggtaatttttagtcaaactattagctctataacattcaaatatttcattaatattacataacagttcaacatagccttctacttaggccccggaatcactagagctaataattagctatctaataaattattagttatattgagctagctaatgaacaaattattagctgtgaagtagctaacaattagcttgagaatatttagaacccaacaactaatttttaatatctaactattagttttagaggttccatacatgaccttatgtaatgtttcaatatagtagagttaatagttagctactaaaattagttaaagacatataaaatagctaattatttgttagagcaacttgttggcaataatctcgacatgagaagtccgatttagaaattcgaggctacatatagaatccaataggctcttctcgtttttcatttttccttcaacgctatttcggtgttcttgcttggcatgcctgtttcgcgcacgtgccttcactcccgccgccacaagaccacacctgctggaggccgaagatttttttttcttgtgtttttcctaccatcacgtcatgtagctcgcctctgagtaccatgaacaccgctgagcaacaggagatcatatgctagcctcaaattatccagacgtctgctaatgcgtgctttccggctagtggacataggctatccctgcttgctttgttcggcgaccagcaacagcatcagctagcaacaaaatgttgggcggcgccggaggcagcatcgaccggcaagaaaaaaaatcatgcgtggtgctgaaagcctctacaatctaaagaatactattgacgtggcattttttttaatatggagactctgaattatagagagtgttggagtagccaactcttttatgcgtgaaatctggctaatctagctaattcttttaactaatctcttgtagatgctctagctaattcctatagcaatttttagttaactattagcttagtacatttaaacaccgttaagatgaaataagtaactataaaattggcccgtttactgacgaccactgaatcaccgatgatgcactatattgagatgactcgtggcattacacgaatcgaattccctccgaacgctgaactccaagcaaccgcaaaataaccaccgtttccttgcagcccgcgaatcttcgtctcccttccccacccgacacggcacaccactctccctccctccttcccttcccctcccctcccttttttccctccgaatcccgctcgcgaaccctagccagccttccgcgag

SEQ ID NO: 10126 - DNA, 264 bp, Zea mays
cggtcattcgtggccaaaccgagatcaactgcgcactgaatgcgatcctcgatctgatgcccaacatccgtctcgaccctgacaaacccgggccgcagatcgtcggcgcacagctgcgcggtccgcactatctgcacgtgctgtgggactgatgggggatgcatttgatttaatatgaacacattcaaaaaatgtgtttaattaagtcgagatgtgcactatgattcaggcacaacaacaagcccgaatgcgaaggggaaaaca

SEQ ID NO: 10127 - DNA, 1433 bp, Zea mays
cgggtgcgctcacgcgcacccaccggaacaaaatacaaccgagaagggtcggtcccctcgcaaaaatccggcagaacctccaagcgagtgctcgcactccctttgaggctcgggggctactgtcgggtaccataattaggggtactgaaagggaaatgtgcccttgggccatttctaagtattttggtgatttagtgtctaacacaagtgcttaaatgtaaaatggtggacaaagtacaaaccaaggataaaggtatgtttctcagacttagtacattgttttatggactaatgtattgtgtctaagtgctggaaacaggaaaaatccaattgaaaatgtcttggctcgagcagccaagaatctgctcagtctgggagcaccggactggtccggtggtgcaccggacagtgtccggtgcgccaggctggttcgaacgaagtggccgctctcgggaatttaccggcgacgtacggctataattcaccggactgtccggtgtgcaccggactgtccggtgagccaacggtcggccgggccaacggtcggccacgcgatctgcgcgggacacgtggccgagccaacggctagaagggggcaccggactgtccggtgtgcaccgtacatgtccggtgcaccaacggttctctggctgccaacagtcggctgcgccagttaaggaaagaaatcgggcaccggacagtgtccggtgtgcaccggactgtccagtgtgccacgcgacagaaggcaaggattgccttcccagattgctctcaacggcttctagctgccttggggctataaaagggacccctaggcgcatggaggagtacaccaagtattccttgagcactcttgatcactcacacatcattcttgcgcacttattcgacattctagtgatttgagctctgttctagtgtgctagtcttttgagcttaagtctgggtcttgtgtgtgcgtatttgctgtgatctttgtgacttgtgtgagttgctaatccctcccttactctgtgcttctttgtgaacatctttgtaagggcgagagactccaagttgtggagattcctcgcgaacgggattaagaaaagcaaagcaaaacaccgtggtattcaagtgggtctttggaccgcttgaaagggtttgattgcaaccctcgtccgttgggacgccacaacgtggagtaggcaagcgttggtcttggccgaaccacgggataaaccactgtgccatctctgtgattgatatcttgtggttattgtgttttgttgagattactctctagccacttggcaattattgtgctaacgttaatcaagtttttgtggctttaagtttaagttttacaggatcacctattcacccccccctctaggtgctctcaattggtatcggagccgttctcttcaagaagggactaatcgcccgaagag

SEQ ID NO: 10128 - DNA, 1500 bp, Zea mays
atctgtggctggcacttacctgcagaccggctttccatcggttcatgggagtgtagtatgcatatatgcatatttcaaaggtcctgctgctactgtcctgttggattgttttgtactctataactagggatggattcggatgtctggaagaatccccgaattttatttgtattcgtattcggataaagtgctaatatggatatccgtattcgtattcgattttaatatggatgttaaatagacatatccgaattcgtttcttctctatccgatttaagattcgtattcgacaacattcgacaaaaccgtgaaatatccgatactatttgtatccgaaagaagaaagtattcaataaaatcaatttaaacttacttttattactaattactaattacaagtgattttaaacattaaataatatactaaaaactgaaatacaccatttaaaatgttaaaaatatttatatcataaacaaatgactgtgttaatcttatagttatagtactagtgatatacaattataaattttaataatattaaaaaagtctatttttgaatacattagattattggagttttagagtccaaaatacaaatatacttaatatacaaaaagattataattagagtctaaaatataaatatacccggtataaataatttgtttaaaaatatgatattcaactaaataatgtatatgtgctattgttaataatttgtttgtaatgtgattttatcaactataaatccattgataaaacaaattaatactggttatgatgctatgttctaaatcaagtaagtatccgaatgtaaatccgaattcaaattatccgttttgtattcgtatatgataatattcgtattygtatccgtattcggattaaaatatggtaaatagtgacatttgaatccgtttccatgcgtatccgatccgaatccatccctaattgatagagcaggaaggctatcgtgttgttacatcaattatatatatatatattattttttcattccttatttattataacaaaccgaggataatttaattatttgaatcgctaaataaattcatttgaaaatataaccaattataaagttgcataattttttaagatctataagttatattttgataatttttatatccaagaccgtttacaaagtttgaattttaagatctacaagttctataaattgatcttatttttagctaatatatatttatatgtgcttatttaagtaggctacgtgtccacctcaaagccaaaagtcacggagaaaagaaaaagtaaccaacctccggtccaacccgatagcccaaaccccctgcgagcacaagcacaaagctaaagctgtgtaagcagcagaatccaatccaatccccagctcgcgscgccccctctaatccctcctccgcaaggcagacaggggccggcgttcactcgggcatccscgggacggacggggagcaaagcctcagcggcgagtgcgggcg

SEQ ID NO: 10129 - DNA, 1500 bp, Zea mays
cacaaattctacttctatccatgagtattatgattgccaacccttaattgcacatatgttaaattcagcaatgcgcaactgaaactaagataaaaagttgaatggttttgagttcacttctttttatatattccagaaaattcccaaagcagctagtagtcctgtgagtactaattgaattttatttttgcatcaattttgtctcctaaacatccaagaaaggcagtaaaccttgtatccatatccaaatatgtactccaattatggttatcctctaccattgtaatgttaagagagaaggtatacatgtaaaagtgatacggtgactagcatccctagtgattaacaacctcaaagaatcataatcgcagaggcatttggaacaaactgatcgtgtagacactgatgaaatcttaacaatgtacctgtgcatgcactaaggggctgtttggttcgtggctaaatgtgccacactttgcctaaggttagtcgttcgaattgaagaactaaccttaggcacaaaagttaggcaaagtgtggcaagttagccatcaaaccaaacaggcccatcatcttctcttctcaccacaaatatcagagggggcatggaaatggaacgcaaaatacaaaagggtgacaagggacaacacggcccatctctggactgagtgagagcaactctaaatgccccctccgacatgacatatccggtgcatatagaagcttagtgcaacgtctctgattgatcattgtaatttataaataacaccttccacaactacaccccatcacataggaggatgtccttaacaaaatatatcaaacaaatagagatgttagatctaagatgcgtaatacttccatatacaccggatatgttttcatctatcataacatgtaatgcgaaccaaccgaccaaaactgctagttgggtaactgttccgtgtgtacttttctaattataattaatacccggctgcttgcattgcatgcgtgcatgaggtgtgtatgttgtattctcttcttcccattatattccagtttcatgctttatttgtgttgactcaccaacttccttaactagattttctacggagacctcaccagatctctccgctttatatatataaaccctagaggcctgccatatgcaaacacagccaaaacgaaccaactacaagcagatcgagtctccagactcttcctgcaaaagggcatagcatcaaaaggctgtgtgtaaaattcgtcgtgtcctgcaaaaggtcatgtcgtctccgatggctaccataacggctagtgccagttcagccatgcaagaaaccagcaacgacaaggctacgacgagtactaccactatcgcctcgccggcgccagtgcgctaccggccgtcgcccttggtcatattaagcgcctgccttgtcctcatgggcgccggcggcccgctccttctccgcgcgcgtctacttcgtccacggcggggagcgcctgttcctgtccgcc

SEQ ID NO: 10130 - DNA, 1264 bp, Zea mays
tgccatagataaaacacaggagaagaagattctcaagaaactcggaataactcaaggatccccataattcaatacaaacatcagttgctgcatcctgtagatttattaacgcatggacttacatgctattctgcatattgaatcagtgatacatgaaggtgaacttaatacttatttggaagtttggtaatcttttcaaaattgctaggatattaaggtagtgtttggttccgaagtacggtggaatggagccgcaccgctctcaacttgttgtttggtttggttccatatatacagagtagctctacaaaagaaaaattatacttaaatgttgaaccatctagctcccaaaatctctcggactctcggatggcgccgcttcttagtatgaagccgctccatcccaattggcttcggaaccaaacactaaggatgcgtttggttgcgggacagctgagaataggtaggacagggatgtccctggctccaattttgaaggacaattatggacagcattgagatagtccttttccaacccctgaccctgaactaaacaaccttatttaagcgatcgtcctatctcattccgtcctgtcattataaccaaacacatcctacctaagattgacaatcatcgtttcctcaaatgaactactgcataaaacactgtagatacatagttgcataagattgatggttacaatgttaatttctgttcttgtggcttgtggttcatcttaaagacttggttagaaaaactrcttttggaatgctaggaagcaaaaatgctaatgcatgatacatgcctagttgacgtttcatcatttactgtgacattcatttatttgctattgagttaatgtctgatcgacttcatgtggcagtctcttggtggaacaaggcctgcctttgcagttcatggtgtatatacttcttttgggcatgtaatttgtccaaatttgcaatatgtatcagattggtcttttttgtgagctctttgatgatgggaatgttgtctactgctgaaagtacaacgtcattaaatcctgtaatattcgctcccattggagtcgagtccaggacctaagatgctactaaggcttttataacccctaggctatagttccttttgctgtatcagattggctttgtaatgtgtaacaatttcttgtcacttagtttattacttatgacatctatctgttcacttagtttatatcttatggtatctatctgttcaaattgaaagaaattaagttattga

SEQ ID NO: 10131 - DNA, 1328 bp, Zea mays
cttctgtaccgttgcaatgaacataaaagcatgaagtttccttgtcccggacggaagctaggagcagataaacactgcattttattggaaaggaaaaaaaaagatctttatgtaagatataaatagtgttggtgagtaatgaggtaatctgaacgaaaatgtttggcattattcagtttctgattgccatgttaaaatgtgctagatgtgcaacaatatgacctgtgctactatagtctaaccttagaacaaaaaaaatataattgcacggaataaaaataaataaattcctgggctgttcatttacgaattgatggtccaaaaaggacccaccctagccaagttgtgatgaatcccgtgttgcagaagcagcattgcttatttcattgatattgattcaaccaaacaccctgaaccatttgctgaccagcctgtaccagagcatccaattggtgaacaaaacttggagaaatgaaatgaatttgaggccagcagaggctcgacgtgttggtggatggcctatgatgatggacgacgtgctggaagtgggcaatataatttagataatcaaaatcaacagttcaaatcactagaaaacctcttaaatctaatgaacaatattatttagaacatctctcatcctttccctctctgtaccgtcggtcctgtccttcccactccccgtgaccccatcgctctctcctctcactcacgctgccttcaccttcgacacttcttccctctcactcacgctgccgtcaccgtcgacacttcttcctttccgggactatagcataagcacgatctatatgccagtgaataataggagaagagtttcctcacaattgggaaaaaacgatgaacaaatcttctatttttttctgtctttgttgttcaatcttaataggcctccatgtaaaagcccatcgacatccgccgaacattcgccgaaacgaaagcccggcaccggaaaaaaaaaacattcgcggtcgcttctttcttcttgcccaatccaactccaaactctccatccagtgggaaaaaaaaaacaaaaagggtaccggaagcggcgaaagcctcgccccccgccgctctcgcatcgtctccggagcgcacgtcagatcaggtgcgccgcgcccccctcgcctaagctgcgacgaccatccatcgaacaggtaccactcgccgctgcccctcctttcccttcctgctgcgccgtggaaccctctaagcgatttggatttggatctcacctcgctccttcccgtggcgatacgactcgccgtgttcttgacctgtcgcggtgcctttgcgttggtgcaggaagg

SEQ ID NO: 10132 - DNA, 876 bp, Zea mays
cctgcagtacgtacgcacgtaggtttcggttgcttcagccttcagacaaggcaaatggcacgtagctttcgcggatccgacagctgattaatccgcgtctctctcgatcgctcactctcgtggctgaaacatcagagcaggccgaaatgcttgaagactagctgatgctgaggtcatcgatccatggcatggtgtcgagtgtcgactgtcttccgatcccctcacaatgcgttgggactctagctgaggcagtataatgccaatttgaccgctgatcgaacctacgacaatcagtccaccagcagtgatagggaaatagataccagctaataaggtaatgtctcagtcatgccacacttattaactagtgctccctccaatttttttatttgacgtttttttagtgtagagttagagcatctccaaaagactctttattttttactctctatttgactctttatttgtcactttataaagaataaactctaaatataacatttcattctaacagactctccaacatgtaataagttagtttggctagcctgagtggctagataaatttggctagagaagggctaatttgaagagccgaatagattgacgaggtagatggttagtcagatggttagtctgttcgagagttattttactattaaatagctaaaatttgacttaaagagtcatttagttagactcttgaacatgctctaactgtataggcgacaaggaacgagtagggtgaggcgaaattgatgcgtggtggtgtttgtgagcgctgcttctaagattaccttgggctcgccgtctaggaagatcgtggaaccaggggcgtaggggaggagggagcggccgttgcgagggttgaagcgg

SEQ ID NO: 10133 - DNA, 792 bp, Zea mays
ctgcagggaaggcggaatgcacagcgctttcaaattcaacagtgacatcatatattgtggaacagtgtgagaaaaagacattacatttctccgtattattggctgtgttttgtacgtatcgggaaccaactgtggtcgtcgcaatcatagacttaaatggagctttttttggaagaattattgtttcctgaaactaaattacatttgtgttccatattcaacacgcgctcatcttttttttctccaaacagatactctatttgttcctttttatttgtcgtgttttagttaaaaataaacctttgaacgacaaatatttaataaacaaagacatgaggtcgacagactcgacactacggtagaactgcacgtgcaacagcgttttttttatccattgcaacaggaaaagaagttacggtacaattaatctgtacagaaacgtttttcacatgggccgagggccggtctcgcacagcagcagcaacacaacagttgactgaatgaatgaaggtgatgtgttctgtatgccctgagaatagacgacctaatgaatcatgtacactaacgacaggattaatatttaattcggacagcatgcagcttgacgctatatgtatgctggcatcggaagaagctgcatacaaacacggtagtacgactcgccctataaattggaaggcctgcgctcacctcgatgcatatcactcactcacaatcacaagcaggcacatctagcttgcttggtttctgattgattagcaggttgttgtttagcgttagttcgagtagacg

SEQ ID NO: 10134 - DNA, 1287 bp, Zea mays
gattgaagattgttgaatgatgcggtgtcacttacagttaggggttgttgcagcaaggctggcaaggtgtcatagtctatttcattctcctagatgaccttttggtggcgatctatcctaaagtgccagaggtaccactttcccatcaactcgtgcttgtgagcttgttgtcagtggaactcctcttcccacttcttaattcatatagtattctttaaraagaaattcctcatgctcagttgtaggagcgactccttccctgcatcgttccggacgattagtgtcctaggccggatggtccacgatggcgcatggtcctcttcctcctcacggagacctagatgtcgcccctaagggagagagatcttgggattgtcttggggacctgcaagccatcaagacaaataaagttgaagatctttagaggacgttcctaaacgtaatggttgaactagatcttgcccctgggtggggtaagattctagggtcgtcttgtagtcggcaggccatgcaaaacggatctaaacgatgtagcgtcgaatagaggtggaggtgggatatgcggaaagttacaactaaagctatgctacatctacccttacggcaataatgataaagaaaagataaataaaataatagattgattcgattgtaatatgttcgtgggttgtcaatcggccgtacccctttatatttataagggatgaggtctgaacatgttcataggcgagatccaatagatctctacgaataggttaggataaccacacatgttataagtattctcgctcatacttatctagtcgcgaaggcgtggactgtctgtccgaccgtgcctaggtgtcaagatgctcaacataaccattctgttttaaactactcttaccatttcagtcttgatcaaaatgttgtttctcgtagttggtagcacttgtggctggaagtggyacgaacaaatggctagctgctcccgtcgttggtagcaactactactatcgttttcggcagtgcactggcatacttatgacctttgtccccacgtgatcgacagtagaaccttcttcatcggtgcygatcgattcattgtctgtatcacgtcgaatatatacatatccaaataaagcctctcgaagaagctgctatatatataatagggagaggagcagattcggtgagcacacacatcctctaagtgctatctaatctacaatctaccaccagacactgtcgtcagtcgtccctcatcaaccgcgcgcgcgcgacttcaagcatcagactaccataatc

SEQ ID NO: 10135 - DNA, 467 bp, Zea mays
  unsure (1)..(467): unsure at all n locations
atggtaaaatcaatcagttcctttccacaaatnaaaggggggaaaactagtaatcagttatcacgcgatattcctagcatgagctaagcagcacacaaggcatacaagtattttcaaccacgcatgtctcattcaagtccatgttcctcgagcattcatcttaacgcatcaagaatcagtcagtcctgagacagctagcacaaaacaaacgatcagacagacacacatcgaccgggaccaggccatgacatggctctctgctgtgtcacaaatgtcaacccttcacgctgttccgtgccggtgctcgtcggatccttgtacctcacgctcgacacttcatcactccagaaattcacgtcacatcctggggtgtgtacgtgtacgtgtacaccccatgatatatacccaccagtttcgcacacgtagtagatatagacacagatagatagctagaacacgagcagagg

SEQ ID NO: 10136 - DNA, 1500 bp, Zea mays
tatagatgaaggggtacggtcgattgaagcccccacaatcgatccaatcaaatctacttatcaaatctacctttttgctttccattccttaggagtaggagtaatctagcgtcagtctagccctagtactagtcttcctcgacctatttcttcaccgatgttcgactctacgttgaccagaggcatcttggatggcttgccgaccccaagacaacccctggatctctcatccctgactgggttgaaagagaaatgtgcccttgggccatttctataagattttggtgattaagtgcccaacacacattaagggaatgagtatatgccaaagggtggacaaagtgcaaatcaatacaaaggtatgattctagacttagtacattggtttttatgtactaacatatttgtctaagtgctagaatcagagaaaagacaattggaaaagacttggctcgagcagccaagactctgcttagtctgggtgcactggactgtccggtgcgccaggctggctctggtgaaaaggtcgctctcgagaattcatcggcggcgtacggctaaaattcaccggaccgtccggtgtgcaccggactgtccggtgagccaacggttggccgcgcaatccgcgcgtgacgcgtggccaggccaacggtctgaagggggcaccggactgtccggtgtgcaccgaacagtgtccggtgcgccaacggctccaaaccttcaacggtcggctgcaccagaacaggaaagaaatctgcaccggacagtgtccggtggtgcaccggactgtccgatgcgctagtcgacagaaggcaagaattgccttcctggaatgctctcaacggctcctagctgccttgggctataaaacagacccctaggcgcatggaggaaaacaccaagcacactttgagcattcttgatcattcacacttcgtctttgcgcacttgtttgacattcttagtgatttgagctctgttctagtgagaactttgagatattcatttgagctcaagtcttggccgtgtgtgtgcgtattgctgtggacttgtgtgtgttgctcatcccatccttacttctgtgttcatttgtgatcatcttttgtaagggcgagagactccaagttgtggagattcctcgcaaacgggatatagtgaaaggaagagaaacaccgtggtattcaagtggatctttggatcacttgagaggggttgattgcaaccctcgtccgttgggacgccacaacgtggagtaggcaagtgttgaacttggccgaaccacgggataaaccactgtgcctctctgtgttgatatccttgtggttattgtgttttgcaagaactcctctctagccacttggctttattgctctaacacttaatcaagtttgtggctttaagttttaagtttttacaggatcacctattcacccccctctaggtgctctcaattggtatcagagccgttctcttcaagaaagggactaatcgcccgaagag

SEQ ID NO: 10137 - DNA, 223 bp, Zea mays
acgcggtggcacttgttgaactccgtagacaacagcaaaaggtgtacatcgacttcagttaccgtttgaatcaaatgttttttttgtcaaatcaccattagtattgtagtccaaaaaaaacgcatattactcgctaccttgcatgtgaatacatataggtattgaagggaaaacggggaatgcatttgaggaagggaccaacaagcagaagggaactcacctg

SEQ ID NO: 10138 - DNA, 114 bp, Zea mays
ggtgtgctagaggcagaggcggagaaagcaacggtgctggtgcctgcgccggagcggcgcaaggagttcgacggcgggcggatcgtggacatcatccactactaccgcgaggac

SEQ ID NO: 10139 - DNA, 175 bp, Zea mays
gtgaccaatcattatatctctttgggctccctgccaccatcagcaattgttattagaatttgtcttggtcgtttaagttttgcacactgaatggagcactttgtgcaactgatttttggtaaaacgatgatcgtgagaattagattgtaaggctttctggaatggttagggtgta

SEQ ID NO: 10140 - DNA, 286 bp, Zea mays
cattaccatgtgctaatgcttgttgtccgtcgacaagcaaatcttcctttgagctagaatttgcaggaataaacgatgattcatatcaaaagctcaaaaaagaaaatgagaggctaataaggagcttgaccttctcaagataaccgtgatcacatggtgaagaaccttgagacgggaacaaccgtggcatgcactaaatcccttgaagaaaatgtcaaggacttgaggattgccaagaagaggaagcaaaagaagaaaatcaatacctcttccaaaagcctcaacc

SEQ ID NO: 10141 - DNA, 1500 bp, Zea mays
tgaattcactgtcagaacgatgcatgggtgattcagacagaaaaccatacccagctcagctgtgccctgcgaacgcgtggcaccttcgatgcgctcgagtcgcaaatgataagctgctgaggcagaatatgccgtgcaggaggaagtccggtccactgagaaaggcggcgacctttggcgccagttcccgttccgccgtgcgtgcaactgcaattgcaatattcgggtccgcgctgctctgctctcgcgacaccgtcgccgatcctgcccttttgaatctcgtgctaataaacaaggagcaggagcagccgccgccgctctcactggacagaaaggaagacggggccttgagacgatctgagatagcgagagatgactgcaggcaccgaatgctcattcaggtcattctgcacagctctagtctagtgtcagtatataggagggcggccagtgttgatcggaacatatcttcgagctgctgctgcagcatcgagtacttatgccttgttctcctatagagcttccttgccatgtcactcgaacttgtaaaaaggaaaacactgtggtttatggagtcaagccatgaagaggtcccaatgctgctgctctgacgaacatgggtttagccactcagcgttctgatgaggttaaacaattgcgtggcgctaagaatcccaatgcctttgactgacagccatccctgccccgaaaggccgaccaagcgcaataaaagatgtgggaagaaaccaaaaccaaaaacaaatgacctgtccgatctctcctactgaactggtttatcttcagcacctcgctttcacagtgtcgtttgcaaagttcggacataattaagcgatcttgatcaggctttagtattagtaacagacccgttttggtttatggattcatcagaaacaaatgccaggtagatgtttgtatacggagcactgtcaaattccgagcaggatagatacaccaaaataaaaaaagatgtctccttcaagcaaagcctacggctccagtgctaaactaggcggcaattcccgacaacgtgaggggcctcgtcagcataacgcaagtgggcggctgtcaggctgtggcccaatgaggccaccatcaccactactactcctcgagtcctcgtcgtcagtgaaaatgcgatcacgtgaaaaataaataaacccgggaaaagggagctggattgttacggtcgatttttttttttacctaacacttggaagttggaaagggtgagattaccagatctaccgcctccctgccactgccacagcacaaatgcacaagcggctgcgtcgactgactgactcaggcgaacacaagtacacctcacacccactccccgcaccccagtgaccccaccacccagcccgccgcgcagagcagcgcagcgcagcgcaggcgccctccaactccgggctccgcaaccgctgctccccctccctccctccctccagctcggcctgcctcagcccgcgccgcgcg

SEQ ID NO: 10142 - DNA, 1059 bp, Zea mays
agtggccatggagatcttcacagggcgtgaatgaaagtccaattaatactgggttggaggacgcttgaaccttgacgtgttccttgcgagggagttcactttggttttactgtggatgtttagttaattatcgagatttgtaaataggtgtacgcaggaaactgtaaaaaggctggaacattttttttgtcttctgtaatcaaattaaaaaaaaatgcacgaacacgaaccatggctgttcgtgattttgaaattgcccagttgatgagttcctgggtttccttccttccctgccgtgaaccaaccaatcaacagtgtgctggctttggtcagggtcgttgccctcagcaagatgaagccaggcgctctgctccatccacgtatggaccaattccctacctagtttgttttttggccgtccgttcgtacacccacggtactgcggctctaaacaacatacaactgcaactcgccgaaacaaaaaaaaaaaaaaaaggagcagagtatgtaggctaccaacgtcaccgagaaacagacgaccacgtggtccggggtcaggattgggggtgcatgattgcagactgcccacgccacgccatgcgatgccatgccatgcatgaaaaacactcacagaacaaactgagcaaaagccccgttcgacgttcgttccaggctttcattcctccttggcatttgtggagctgcgtgtcttttcacccgcctccaccaggccaccccccgccattacgaaataaaagggcgccactgccggccatgccattagggctactaacacaatactaatcgtggagcagcgcagtcggagtcggtcgcatcgtcctgataaagtgccttcgatccatccacaagccgttgccgctcgcccctacctttttttttgcctgcaaagttttagctttcgaaagggattatagaatgtagaagaagagggccggcgggaccgggagctacaagggctactagtagtgtctagataatacacttgcacctccaatggacttcacacttcgatcagtgtcgccaacaagtagctagacg

SEQ ID NO: 10143 - DNA, 454 bp, Zea mays
gaattctggcgcctccattctctccctttcggtggagtcttgggcacacatgctagccataacatgctaaatttgcatcccaatagccgacctttaagtccaattgatctggcccatgaaagaacagcctgagtcagatgactaaccgcaattaggcaacgactatgtttctagtggagccagtcgcctaggtgtcccttgtcaacctgaagggactgattagactgacttatcgtgattaattgaacaactcagaaacactgtttatagctttgaacattcaaattatgtattgatgtacaaggatacctttgtttatcctttctgctgtagatgcactctgagactcttgagtgtttggcatgatccctgcttaacacaatattaaaattgtgacagagaagatggtaaactgagttgtggatactcaagttttagagggaagagagctaca

SEQ ID NO: 10144 - DNA, 497 bp, Zea mays
tcaaatggcgatgttacccttgtgaaatttgtaaactctatatgtaattgttgagggcataaatgtaatagcgcacatgcctttatggttgcctataaatagatgaacaatatccccgtactgttcacgctagattgtaattgcccttgcgtcaacaccttcaaacaagccgaaggtatccatgtaatataaattttgttaatgtttatgtgtatatcatgaaatgaatatatgaatggatgaatgaattacataaagtgtctctttagattccaattctcacaaatcatgaaggtgtatccttcatgaccttcgtctgaagttcattatattcgaaaggagataatgcttcgaaggacgaaggtccttaatctttaacaattgtgttgccttgttctttaatcacaacatttgagaacaagtgaccaacattggcgctcacctccgatgaactcaaatgaccaccttcgacaaaagcttgagcaaccaccttcatc

SEQ ID NO: 10145 - DNA, 176 bp, Zea mays
ggtaagtggtattctttccatttggaaagggtactttgggttaagaacttgggttaatgctaaaacctggctttctactagtaataataacctgaccaactaaaagtaactgcttgacttaaccccacataaagctagtccacttcagccaaacgggacatttgctgagtacgttg

SEQ ID NO: 10146 - DNA, 307 bp, Zea mays
ccacctgtgatgcaggtgccgtgtccccagtggtcagtccccaccggcccacccccaccaccgtccccgcccctcgagtccaaacaaggcgcacagtgcgatcctgtcctgcgtggtttgagtgtttgaccacggcagcacgagcagcccgctccactcctcccctgccgaagcaccacacaggcacacagcagaagcgaaaactgcaggaaggccaatcgggcctggcaggcatgcttgcccgctgccgcaggtgaggcgacccgcagccgtccgagacgcaccccggcgcaagcgcgcatccgcc

SEQ ID NO: 10147 - DNA, 163 bp, Zea mays
ggggcaggggggcccatcgctcccctgcctttgaaccccctcgatgcgcgccgaagagctccatccaccgcaccatcaaaatcagctcgttgagagcggcctcctcaaagccagcagaaaatttcccaaagatcgtcgtcgtccccaggtgaaacaagcgcag

SEQ ID NO: 10148 - DNA, 1500 bp, Zea mays
tcgtaacactgacaataaaacaaattgactcgaagaaggagatgaacacagaagagccaatctaattttctttcttagattgacaagaaagaaaccataaatttagataggaaggactctctcgtgcagccgcccgccgggcatgtcgatgttattaagttgctctccaccttgagcacaaagaagtgatcgttccagctgacgatgatgtacgtgtcagcacgacctggctcgcgttcgtcgtgtcgctgatctcgcgccagatgtatgccaaaaaaatgacatggtaccggacaaggacgtgaagcgcgctctccggctcgaagaagccgacgaagctaggccttgacgccttgtagtgatgcactgtgatgggcaatgtctgggacgcgaggatggtccaggtcgaagcgtcggtccaggaactgcgccttgtcgtcgcggagcttcctccacttcgacgagccatcccgaatgagcgcgtgcgcgcgtccagctccggccgggtggaaatcgtcgcgcggggccgagggcgaggccagaccggcgatccacgatgcggggccggggccgggaccggggccacgcgattggacagacgaagcagagagagcagcgacaaagagacatcgcggtgcaggaaacctcgatcatggcatcaacctggacgtcagtcactttagggccaaaatagcgtccatgctagttccctaataaaaaaatttcggactggttatatttagcaactgcctctgctcttgctgccgcttccgcaggaggtcatcgccatgcgctcaaccaccgccatcgccgctcacacgcaggtccaccgtgaacgtcgtagactacgataattgattggcgtccacctaagatagtataaaattaaaaaaaaagaagaaaacagcatgcctcccctacgattttcctttttttacttttttgttttctagccaaggaaccacccgtcatcttttcttgtcccgctcggccagctccattccttctcctcctcctctttccttgcgcgaaggagaggaggaggaagcgcttcgcctgtattatcctatagctttcaccaagcccacgaaccaccgtcgtcgtcttgccggaggtaacgacgatcgacctctgtttgtcttggatgctgcattggtttcacttgctacgcatggagcacggagcgtgtcgttgactgctggtggtgacgcgcccctttctgcctcgtatcccaccgcgacctctgcgcggggaggccggtcgccgcccgcgcggccagcatcgaccgcactctttttctgggtcattgcttgctagcaggcctctacttgtgccaggcgctgttgctatctcacgctgcattctgcacccgatacgcatggacacgatgttgttttggttgtgcgtgcgtgatgcgtgtgagcgtccagtaatgggttagattgcatgcttgtttgttttcgtgctggatcgacagcaagcaagcgcggagtagagcaa

SEQ ID NO: 10149 - DNA, 208 bp, Zea mays
gtaaatcattgagcctcggcccgagcagagggcggacctcccgttgatatgttcaagcctccagtcgcctctacagctctactcccgttgatctgttccagcttccagtcaccggccatcagcaacgcgtcaccggccatcagatctctccccgccgcctagtcgcgccgccccagtcccccaccaccgcactccacaccaccgccca

SEQ ID NO: 10150 - DNA, 223 bp, Zea mays
agtagggtgatttggtcaataaattaggtgatgtatttatgaagaaacgagggcaacagtcaacaacagtcatggcattattatttatcgaatgaaagtaatggataaggagagcagttaaaccttacagctaactatttgacactgctagtgtatatatatatagtcataagaaagcacggcgatggatcgtatagtatagcagtaggaaatagaagagact

SEQ ID NO: 10151 - DNA, 555 bp, Zea mays
tgacatgtgttcctgagttcgttaaacttcctttccattttttaaaacgctaaataaaatagcttcacctatatcatgatgaagcttttttttggcttctggaggaggccactaaatatcttagcctgctatttaaaaccttggtttagtttgttacggtttatgctgacatgatttgtcactactcacaagcaacccgcatactggttatatgttttctatttttaatgcaatagcagaacatattgtaccacatgaaagccacacgatcaatcaaatatcagtttgtcttgacacttcagaaattctcatgtaggattagtgatttttcgaagctttgccagtttagcacaaaatataaacagcagtaagtcttatcaagtgcaaggaacagattattgctgaaaatgtatatcttgaccttgtaattcactctatcctaataaaatttgttaatatttaactaacagactattcatcaccactcattgattacagtcgtacttgttcatgtagcttgcagacgtatggtcctgtggggtgactctttacgtc

SEQ ID NO: 10152 - DNA, 1338 bp, Zea mays
caagtgttggaagggcatttaatctagatgaaatagttactatcggagagcaaatctccggccgggtgacggagtgcacccgtcctaaatcctaagatgaggagaggcctaggcgttttgcttgttagttggaaaagtgggaagaacacaagaacacacaaggatttagagtggttcgggccgctggagcgtaacaccctactccactgtgtgatgtattgcttgagagcttgtatgaacttgtgagactaagattgggtctaaaagattgagcttgtgtgtaacgtcgcatacctccccttttatagctgaaggggggcatgcacaaaggtactgggccccgacatgtgggcccagggacataagccatcaatgtttgctgctggggcaatcttctcgtgccctgacgcccgagatctctgtatccttgacgtgcaggggaaacttcttgtagaagggacgatgagtactatgtgccgctcggcacgggcgcactgttccccaacagactggtcaggcgtgccgtctgctgggtgaccctgacgccgtctgccggcggattggacaggacgcattaaatgctgagagggcgcgtcgcccgtcagcgtagtggcaggcggcgcgtcctctccacaataaatgcaaaagactgcacagccgtatgggccttacgtcaggctcggtccgttggcttatgtcacgagccacaagccacgtggccgcggcgagtttccgcctgagcggggagcgtagggcaaggcctggacacgtgtcggcaccggacccttgcttgtgccggggtcctctccgtcccgggaccttgctaaggcccgaacctcactcgggggacccgacatgtctcctcgggagctccggactcgtactcacaggggtccggtgttcctctgcggaggtccgaacccaacggtgcttcctgggatgtattatccttcctcgccacgtggtgcccttagacctgccccatgtggtggggtcgggtgccgctctctgtgtgacctggaggtgtcgtacgggtgcagcgtcttcatactatagaagagggtacccctgattcagggtaacgacaatattaattccacatttgcttttcatttaattcaattgtactaataggaggagaatgttaaaggttattttagttttcttatgagttatttagtatatttttactaattttagttcatagaaccaaatatgttagggattaaactttaatgctagactaaataaaccaaatatggactaactattgtctctaatgtatttaaacacgctcatatgataataactaaactttgaatccctaaaccttatgca

SEQ ID NO: 10153 - DNA, 1333 bp, Zea mays
caagtgttggaagggcatttaatctagatgaaatagttactatcggagagcaaatctccggccgggtgacggagtgcacccgtcctaaatcctaagatgaggagaggcctaggcgttttgcttgttagttggaaaagtgggaagaacacaagaacacacaaggatttagagtggttcgggccgctggagcgtaacaccctactccactgtgtgatgtattgcttgagagcttgtatgaacttgtgagactaagattgggtctaaaagattgagcttgtgtgtaacgtcgcatacctccccttttatagctgaaggggggcatgcacaaaggtactgggccccgacatgtgggcccagggacataagccatcaatgtttgctgctggggcaatcttctcgtgccctgacgcccgagatctctgtatccttgacgtgcaggggaaacttcttgtagaagggacgatgagtactatgtgccgctcggcacgggcgcactgttccccaacagactggtcaggcgtgccgtctgctgggtgaccctgacgccgtctgccggcggattggacaggacgcattaaatgctgagagggcgcgtcgcccgtcagcgtagtggcaggcggcgcgtcctctccacaataaatgcaaaagactgcacagccgtatgggccttacgtcaggctcggtccgttggcttatgtcacgagccacaagccacgtggccgcggcgagtttccgcctgagcggggagcgtagggcaaggcctggacacgtgtcggcaccggacccttgcttgtgccggggtcctctccgtcccgggaccttgctaaggcccgaacctcactcgggggacccgacatgtctcctcgggagctccggactcgtactcacaggggtccggtgttcctctgcggaggtccgaacccaacggtgcttcctgggatgtattatccttcctcgccacgtggtgcccttagacctgccccatgtggtggggtcgggtgccgctctctgtgtgacctggaggtgtcgtacgggtgcagcgtcttcatactatagaagagggtacccctgattcagggtaacgacaatattaattccacatttgcttttcatttaattcaattgtactaataggaggagaatgttaaaggttattttagttttcttatgagttatttagtatatttttactaattttagttcatagaaccaaatatgttagggattaaactttaatgctagactaaataaaccaaatatggactaactattgtctctaatgtatttaaacacgctcatatgataataactaaactttgaatccctaaacctt

SEQ ID NO: 10154 - DNA, 247 bp, Zea mays
gccatgcgacggcaccgcttgtttgggtcgattctgttctctgccactatccgtccgaccgacttgctcagcggtcagcacccacgcccacggatcaccgtgtgtgacaactcagaaacccagaagaatgaagaatcccagcaagccccatccgggaaatatttatgttatccccacgtgacggccggccctcgaccccacggcgcccgctccctcgtactcgttctcgtcaacccgccgcagggac

SEQ ID NO: 10155 - DNA, 89 bp, Zea mays
ggtaatctaaaaaatttgccccttactgcaacaactggtaatattgctcacattttttttatttgttacactgctcactaatatgcagg

SEQ ID NO: 10156 - DNA, 1500 bp, Zea mays
ccctagtccaatggcgcctttcggttcagctgcaatcccttaagtagactcagacctcaagccgtctataaaacctgaccgagattgcagaagatcaaggcgcctacgatttgccgggcctgcacgaggcgccagggggcagcagcgatgatggccactgcatgagatgcgagtcagtatcagtaagcaacctaaggtgatgaatcgatcaatgcatcacctataacgtacggtccaaccgaactagctaaccaactgtccggatggaccaacccactacatcgcaaaacaggtccacaacccgcttattgggtccgagcgctgattcagttggatgacggtttccttatacacctcttattaggtcatgtttctgaccccattacttgcactttgtgtctctcgctctccgctcttgcgctctcttccgtctagggctttctcgatggttttgattaagataggagaaacaacaactagaacatcgatcagaacattcgtttcttccatgttactaaagatatcaaggaaaagataaaaaacaagttatttaaaaatgtaatatgcttaagtcattatattattaatataaactcagatattctactcataatcattaagtaatttaacacatttcaaatattggatcattatagtttcaataaaaaaacttaacaatgtcgcagcattaagccattgtattgttttggaaaaagaatttcaacattaaatcatcatctaatatcatacacacatcgtaaaacatttttataaatttcaataaaaccccatgtaagtcattcaatcagtttaaaaatacaacattaagtcattccactactgttgagttagaaattttacattaagccatcgcaattggtcatatcaaaatatgttagttgtttataaactaacatttgcatgaagtcattaaaataaaaaacaatatatataatcatattctaatatagaaatatatcacccatttgtttatgtatttgcaactgaaggctctattttaattagatctaactcttaattgaatcacataaatggacgcagctacctgaacagttgcatgaagccggtggcagctcaaagttagtcgttctcgaatatttgtcattcgctaaattatttttaaactaaacgtggcaaataaaaaagaacgaataaattactaaattatcgatatataagaaaaaattatagaatacctaaaaagtaggagtaggtcgcaagtacagaatagctcagcaaagcccggatacgtccgagccaggccccctggcccagctgtggagccgccagccggggtcggggcgctgggctcgacgcgcgcacgcggtacgcggcgccttatataaacacacccccgcctctgggctctgacacaagcatgcaagtccatcagcttctcggcttatggtgccagaccgacgtgcctagtagcgtactatcttagcttcaagagaccgaccaggcaagatccattgatcg

SEQ ID NO: 10157 - DNA, 324 bp, Zea mays; identical to SEQ ID NO: 699

SEQ ID NO: 10158 - DNA, 945 bp, Zea mays
gcccgacttcatccgaagggtaaaaagactttgcttctgtattagcaggcgcttgaccgtggcatgtccaattgtagctgttgattgttggctctatccttagccgatcatgtctagtccaacgctacttcgagtgacggatgtaggggtggggttctagctctcccactgttccgagtccatttatgtgacccatctgagatttttggaaatggcagacagtaacagcctatcggggagtgctgtgcctgtgattcgtctttctttttcatttgaagaatttgtgttttgctcacatatatatgatgacacaaccgatggtcgccgccgccgcacacggacggacaggcccagcacagcccggaaactgccttgcggcgacacgttttcctgtccggcccagcagcagcaaggaggaaggttcgctcggtcgctgggcctggctccgcgtgccgtcccacctataaatgcgagtcctcgccgagtccactagggcattgggagctcactcgctggtcgttgcctgctgcggattgcccccaggcgggccccactcactccgctgttgatatttcgtttggttctcctttccgtcttgtccgtcgccgaggccttcttcccctcgctccccagctccagcaggcagatcagatccatccaaccacgaacaggaaggtgagcgccgggaacgagccctccgtcctcctactagctgcgatccgtagccttgcgtcgctttcgcgcctagtctagatcgccacgttctagatctgtggtgttttactttcccgggtgcgggtggtcgaatccttccatccaccaggagagctcgtggcttgtctttgattagctcggtctcccctgtgtccgtgatctgatatacgtccggatctgtctgctgtaatcatcaggaaggtaggaggcctgaggggctgaagttgaacc

SEQ ID NO: 10159 - DNA, 67 bp, Zea mays
ggtacacaaaaatctgtactcttgatctggttgctgattttccactttatggtgtaattgtaaggac

SEQ ID NO: 10160 - DNA, 1324 bp, Zea mays
cccgggtatcctcttagtcgacctgcaggcccagctgaacggcgtgtggccagccgacgacgcactcgaacagtcgaacctactctccctctctctctctctagtttaatttaatctgttctgaaagcctcacatgaaatgttaaacatgttggatccggtccgttttttttttatttttattttttgatctagacggttttccaaagttccaaaacacgtagctgtctgtcgcccatcgtgtcgtgactgccgtgccggcggatcggacgctcgcggatgccgccgcggggtttgttttcccgtttctgccggccttgccgttggctggcgatgccgtttcgtcacttgcggcagctggctggctccgtcctccgatccagtccactagtccaggcgttcgtgcactagctgccctggatcacgcttctgtcctgcttcacttggaaggggttggacgtggcgagacgatggaacggatgatgagtccgttgccggcgtccttctccttgatccgcaccgatggccggccagtgagtctgacgaattggcaaccacgtacggagttatcgagcaaagtgaccgttgtttttttataactagaatccaaatacagagatcaattggcttgacaatatgttctttgggttttttatggcatctaactcctgaccgtttcagaagttttgctttttagattatctacatatctctcagggtctcttaaacctatttgaagtggaaagtgaatttagacattcttcttttattctgcttttattatgctgaaaaaggagttcctcgccatttttaaaacacattaattacgtacatgccaaagtgagagtgacagaatttgaggggaaaccgaaacattcgtgagaatcaacagactgtttttccagtcccacaaaaacagccggttcagtcgtcaggttttgagagatcgtacagacaaaacgatgcaaccagcaagcgagtgatcatcaccagaacatgatccttttggtcaagcaccaagacacagatcatcaatcaagtgtcgagattacggtagggtagccactacaatgactatggaccataccaccgactatcaaaacaagaagtgtgaatctccacgcaacactttatccgaattcggagcagcagccgccgcggatgccgttaaaccctaactcccaacctcttctttgtcacactatttctagggttttacatgcaccaacaggagccccttccgtcacttcgcctccaacaacagcagcgccgccgccgccgccgccgccacttaatcgccgggatcgtcgccggaggaaagcgcc

SEQ ID NO: 10161 - DNA, 1154 bp, Zea mays
cccccccccccccccccccaccaaaaaaaagaaagaaagataggagctttatttggtggttagctaaagcaacggcataactatcctttccgatccatgcggtatcaggggaaaaaaaagagcatcgttaaccgtgttctttcgcgaggcgggttttgggcttaaattaacacccacccacccagcccaactagggctgctactgcctactggcctaggccccaccgccgccaaccaaaagcagcaaggctcgagaaaacggaggagcagggcgtagtggcgagagaaagacgggagacggagatccatcattattcattaatgtgtgttgtgtcgtgttgtttgtgcaaatcagaggagatcatggccttagtctgatttttagtttattggtggctgcctgcctgtctgttgatcgttgaaaataactgtcacgggcatcctcctagtatgctgtcccgtcccgcacttgactggagcccggcatggaccgggttgtcgggttcgctcttcctccttcactgccactgctcttggaatgaaacgaaaaacgaagaacctgagctagtggatcggagtcgtcggacggaccctgcagtgtgcgtgcaggacccgaccggcagttggcatggcagtacggcagtacacatgcgatgcgatgggccgcctaacccgtgacccgatcgacccgacgggcactgccgcactggcggagtgcgagaggcggggccgggctgtcccgggtcggcctggccgcgcacggctgcacctgcaccctgccccgcaaccacccccagctgtctgtgtgtgtctgtacgcgcaccggcaccgcacgcacgcccatggcccatcggccgtcggcatcggcgcatgtccccgccttccttttccttctcgcctctgggctccgctctggcacgtacgtgcgcgtgctgcccctctatctcctcctatctataaaacaccacgccggaccggaccacacgcacagcggcatcaccagctacagctagcatagcaaggaccacgacgtgccgacggcagagaagcgcaactcaactcgtcgggcttcctttttcccgttctttgaggcgcaaaggaaaaaccaagcaagarggagaaggctacctaacctagctagctaaggacgagca

SEQ ID NO: 10162 - DNA, 349 bp, Zea mays
cgtcgtcattagtagtatattaaggaaaggttaagacagaagcgtactgtctgggtaagatgatatccatggtccatgcgtctctgtcctttgtatccagttcaattactgccacggacatgtgggtcctggtgcaaaagaaccatgtggcgggtcggcatcgacgatgcaccagtagctctgcccagcgtctcaaaactttcgcttgtgcatctaaagacaagcagtggcgcatataaatgtgggtggcgagaaacgacgaggtcttggtgcgtgacccaatccgatcaatataatcagagtcagtgtgactgtgagcagagcaagcagtatagggcgagcttcagcc

SEQ ID NO: 10163 - DNA, 587 bp, Zea mays
ccaggtgcactataaacctacgcgcttcgaattaaaacggtcgtttgcaaccgcaagaagtgctaaaatagtgaaaaccggtatgtagggctgaaaaataatctcgaggatcatgagccgagcctatttttcaagcttgttttttagcgagccatgtcaaattaaccaatttatagaataataataaatataagataattttatgaataataatttattttttagtctttaacgatgaatatattataattataatttaaattactcataatattaattataattctatatttcaaatttatataatgttaatttactaaataataaataataagtatcaaaaaatagctcaagccaagtcaaaccagctcacgggccgagcatctttatctagccaagtagataagccgagccgtcgtttccagccctaccggtacggattgaagccggtacaatacaacctgcgtaagtagccaggcccaatctcccagcccaaagtcccatcccattgctcgttctgtcccttcgttcacaacctcctccacgaccaaacgatccgggttccagcggcggcggcggcggcgaag

SEQ ID NO: 10164 - DNA, 957 bp, Zea mays
aggagatgaggataggagagaggtgagacgtgtgagttgctctaacaaattacgtcggcggtctacatgttttatcgtgtgacttagtggagagaagatctaacttcgtcaaccgtcaatccacaattcttcaagtatacaactaaatatcgtccgcacatgtggccacaaagcccatcttaatggacgtgtttctttgagttttttcaacttctggccaccaaaagctattgcggactgtcaaactgtccaacttttcagcccgcttctataagaattgttttggtaaaaaccattcaagatcaacatgaacacataatcagttgagttgtcacrataataggaatccgtcattttctagataatgaatcctttgaaacactttatctcacttcacacgtaatctctactataattagattcttttcataaccagattctcgctacaactagattctcataaaaattcgtctaaaaaaacggaactaaaaagatccaatatcttatgttgcccggaaattcaaaatctttcaaacagcaccggaaccatcccagtatcccactacctccgtggcgagcggatgcctaccaccaaactatccaagcagcggcgcgtggaccccatagactggcctaccagaaaggcagaaagtgagtaacgcctagtccccgacaccgacggggaacctaccgctccgccgctccgctcccgtcgcgactccaaactcactccatatttcgttaccatttcccacctccagaaagtgtttttttgcctttttatcttcgctcgttttccttcccccgctctctctccaccccctccgtcctccgatccaaactaccgacgaacgccaccacccgaattcgaaaccctaggcggccgctgtagaacacgtgaggctgtagtgcctcttgttcggtggagccggcccgcgtcggtggcggcagccggcc

SEQ ID NO: 10165 - DNA, 121 bp, Zea mays
attcataaacacgcggacacgccctggatctgctgcaggctgacatggtagtggtacgacgacagtcacgtcgctcagtaggccatgaccatgcgttctgcttgtactgtggaataaataa

SEQ ID NO: 10166 - DNA, 623 bp, Zea mays
tttgcattttagttaactgaatctgaatatggtgaaccccaaataaatgtttgatctagtgctgattactccgtttggttgaataactagttgaatcatgaatttatcttttcaactccgaaattgtcttcagaaacatctgatatatacagttatacacacaaagcaaatggctcaatttttctattttccagacagtgccccccccttgtgtattgtacatacaactgtcctttcctttgatgctactgtcagttaacgtaaaactctttaggtgtttgtggatcagagtctgttccagaagcacaccatggatcccgtaaatcttataccacctgcgttcaatattgtttgacatttcagacacccaaattggcctgcgattagttatattttttgctgtaagaatgccaagcggtaaatggctggagtgaagtcatactatcagttgtatttttgctgtaaataaaaaaatgtcaattgatgatgaccggacggaatactacctagtcacctttcatctccagttcatcaacatttatcatgcacaagtacatctggctggttctgtgtgccttcatgtcctgcagcacagatcgtgaacctgcacacctcaacgatag

SEQ ID NO: 10167 - DNA, 691 bp, Zea mays
aggctccttttgagttttgcacagcattacagtacgtcggacaggctaaaattggtatctgctaccgtggtggtggcctgagtggctactaaaactccgtagcattatttgcttttgatctaaaacaagattctctttctctcgtaataaagaggaaaaaaagagcggccaacgattctttcacacacgagagagattgaatacacattgcagtggtacttattggtacagacatgcactgttggacaaattacggttggtatctaataagtagctgtcatcaagccagcagcgtctcataatttttagacctttatctgagtgttttccatctggagagacatcgcagcatcttgttcttgtcgctaatactacgtacgtacaagagagactagttcaagcacgagacatacagctgattggttcttgctttgccgtcccttatctgcaactgagtagcaggctggctatatatgcatgtaattaaatcaagagcacacgcagtgacgccatggaatcggaagacttgttcctaggtgccgaatcattaatcaatcaaccccccgcccctgaaccacagcgaccatgctgatctcctataaattaccagctccctccatgctgtagccatatcgtcccttgaagaacagctcttggagcttaattagaaaccaagtcgagctagctagcc

SEQ ID NO: 10168 - DNA, 89 bp, Zea mays
gacctgcagctgatgcaaatatggcttaggaagatcctgaatacgaggaagatcctgaagaaatagaaatatatgaagatgatgaggac

SEQ ID NO: 10169 - DNA, 149 bp, Zea mays
ggtgagacgatcgaacgcgactcatctgacaacggaaccgatatatatatatatatatatatatatatgatctgtgagcgggaagatccgacaccgttgctgctcttgttgccgtgcccctgaacctgaagcagacagacaaggcgtcg

SEQ ID NO: 10170 - DNA, 1500 bp, Zea mays
aaggtctgcatgtttagctatgtaagaaattctgcattttttgctcaatcgatctctacattaacgtgtattctatcgtaccaaatatcctcggtgtaaatgcattatgtaataagtgtggtaagtattaaacaactttattttttagacctttccctatatatataaaataacttaaatatcaactactatttatatattataataaagcgcgcccgagggcgcgcgtcaagctactagtatcaattaggagtataaaatatagacttaattaagtttaataaattcgtctcatcttttagtcgttatctatgtaattaattttataatcagactttatttaatatccataattattattcaaatattcgatgtgatataaactaaaatttagcttgtataaccaaacaccgaaaacttacttaaatttccttcgagattctcgaagatcgattaaaaactaagctaatttacctctcaaactagctctaaaaaacatcatatggaacatctcagcatttttctgttttttttcttcgcacagatgcacgtacacacgtgtgcgttttgaaaaggaagaaaccaaacgttatggtcaccgtgcaaacttactgcagcactctcacacacacggccagcgccgtgtacgtgtacgtcggcgtcgcggcgaccacgatccacgaagcctccatttctgattctgaaacgcccacggcttcggcgcctctgtcgccctgtctgtctgtctgtctgtctgcctgtccgtgctgacggacggttttaaaagggccggtgcggcgtaaaggattctcgggtcggcgagcaaccgcagcggagacatgccccgttgcacaggggctggggttgtgccgcgccgaggaggagccgggaggcggtgacgaacgcaacggaagccgcgggcggcgggtcttgttggcagagggcgaccgcgtggttccggggtcttgttgggcggcggatcgtgtgggattgaggtgagttggaacttcccatcccgtttctttcatggaggacttgtcctgctgctactcggcgctctctcttctcgccgactctactctgctcgcgcttctttttatcggcggtgtgccgtgtgcgcgagcggtgccgcggtgggggtacagtggcgcccgaattgtgcgcggtttcttggtgagtttttgctttctttcctgcggacccaagcgaagtgattcggcttcttcttcttctcctctcggttccgatcgacgacgggtacggtttctacgaaggggcgcacacgcgtgattcgtgagcatgaggatcggcctgcgattgaattgggggcgtttaagtttgaagacaaaattgtggaagtccgtccgtggatactgacggttggttatgtgttggtttcagcgaagatcgtcgtcaactttcggcgctcgctgggggcgcagggcggggaggaaagcagatagggcacggaaggatcggcattgaggcaggcgtccggag

SEQ ID NO: 10171 - DNA, 70 bp, Zea mays
tgtattaccctccttctcccactcctcgttctgtcagttttatctgtgttctagatatgcttatacctga

SEQ ID NO: 10172 - DNA, 645 bp, Zea mays
cctgatgcatattccttcaatgcacctattttgagtttttgcaggatgagaaaaatagagaaagctcagaaactttttaatgacatgtcaaggtatggtgtatctccagacagttacacatacaatgccctgataaaagctctatgtgatgaaagaagagttgatgaagctaaagaaattatacttgcaatggagtccatttcctgcattggtactaaacaacacacgtattggccagttgttggtgcacttactaaaatgggtcgtttcagtgaggcaggaatgttcatgaataaactgcatagaaaaaatgcccacttaggttcagtgcttatttaagggcagggtcagatattttggtccagactgtcaaagcatgacttatcagtcacatgatattttgctcggtggatgctgccctctcctgtgatgaatggatctatatcctcatctctgctaagctactatacaactgatgtttaccgttgattcacatgatctatttcaatcatgcttattgtgtccaccctttgttttcctattgagccatccatagtaatggtgacagtgtgcttgcattccctcagcaaatgttgatcaataattggacttcttagtaccttgaagtattgggcactgtgatgc

SEQ ID NO: 10173 - DNA, 277 bp, Zea mays
cggacgagaaaggaaagagagtcccaccctctttcaaaaatacccccacccctaacacacacacacgtcctccctgtcccgggttctcctcccgtcttcgccgcccttgcctcccctcaaggcccaagctctctccatagttcccgccccctccctcctcctttgatcacctcctcccccatatccctccttccacccactgacccaccaggctaccacacgcagcatcagaaaaagaaaaatagcagggagaggtcgacaggcaccgacacgaccc

SEQ ID NO: 10174 - DNA, 76 bp, Zea mays
tcttggcaaccgcgcacttctccggcggcggccgccctaacctaaggtggcgctggttctcgcctgcggcggcggg

SEQ ID NO: 10175 - DNA, 1500 bp, Zea mays
gcctctcagaactaaaaaaaactgtgaagtgtttctgttgttttatctaacggtcgatcagtgaattgactgtcccgcagaataaacatatgtacgcgataccaaaggataagcacaagcagaatagatggaccatatacgaaaaggaaaaatgttatatttacatcgagcgattactgtagcacgtaacatgaatagtagctttattacaatctaatttttttttttggggttggaactctttacatccttctttttaatagaatttactaattctttctgtggagagagaggctatactatatatgttaccagaccaataacagcaacaaggcgccatgcaaattgtgagtttttatagcttgtagattggtgtgatgcccagcagactgaaacactgccgcgtcagtcacgattgccgtcgccgccggacaaagaattcaggtgatctaaacatctggtgaagaagtgggagaagtcccagaaacgtgaggtgatgtggacagctagcagagatagcaagcaagacctggcaactggtgtagagctttgaggatgcttcggataatgagctaatacaagacaggctcgatcgaagcgtatcaaaattgtccacctgttaatctcaattcatgtggattgaactagcaagtcataattccttataatctcacctaaggcctgtttggttcctgagaattggtcacccgaaacaattcctaaccggattgtttatctaataattcatataaggtctgatcaactggaacgatttctaggtgagtttcagcaaaaaacgaacaggtggatcaaaccttatatccgcaaaaaatatctgatgtttagaccaaccttcgtggcctaaacatccggtagtttattctccaatccacatggactgggaataacagaggaagacccgaagggaatgccatttgtggtagaggaaggtggacagcggcgtcacagtggagatcactgcgatagcttgagcgaacttgctgtttaggccaggaagcatgctgataacgggcgctgaatcggtgacggcggcgccgcagtcgtagagggtgtaggcaaggcgtttgaggcgaccacagtactcggcgttggacatgtcgctctagaagaggcggctgtggagctcctgctggctctctgtgcaactcggcagtgcaatttcgtgcagcatcggtgcaactctgcacgccatcccgctggccaccctcagccgctggctagtagattctcctgtaaacaccaccaccgtctctgcgctacagaattttgtcatccggaatcagattcctcaggcaccatctcaagcggctctacgttattccctctgcacttcattgtcagcaatcctaaaagctcgcagcagcagcagctagcagctcgttcttgttcgtcagctctagcctaccctgcgctagctggctcttctttaattctgcagggagttccagtttcaggtagagtgcaggcggagaaccaata

SEQ ID NO: 10176 - DNA, 67 bp, Zea mays
aagagagaacaattaaagagaatcatacaacctgaagagtacaacaaagccatatgcttctaagagc

SEQ ID NO: 10177 - DNA, 1500 bp, Zea mays
tttttacatggtggtaaagaaaatgaccccgcgtacctgtctcgaggatgacattctcgagtcaagggtgctatcactgtatgtgcttcttataactatgacactatctagaattttatcatatgtccacagagtacaaggatctttaatgcatcctactgttaccgttgactctattattaaacttactctagtcttaccgcgcccgggacaggcygggcattcacggtgggttgttggatcacgtggccgaagatgcgtacttttaattggaactttgcaagaaaaaccagtggattctgctttgcctaccatgtcccgttccgttcatttcttttttcctgggcgattgcgcgttattacttacgtatggaagaaagaggtgaagtggttttcttgcattaacgatggaacgtccttgcttgttgcttctccacctgctgcacgcatgctccttgcgttgtgggcatggcggcgtttgccgcgtccgatcgctctccgcctcagcctgatctacgaggaaggatagatagatagatagatagatagatagatagatagatagatagatagatagatagagctgaggtgagtgagtgttggcatgcaggagcaaacgtgctcggagcgacgactgcgtctgcggctgatacacaaatagtattatctttgtattttagtaaattttctaatcttctttttaagacggcggggctagcattattgataaaccatcggagaccggagtcacatcaacgtgcggtctgcagtttgggcgtcggcggcgggccgacgatgcgctctcggcgctcgctcgttgtcgcgtcgcgtgctactccaggacacgagccggctctcgactcctcccaccgcgtggcgcgagcgcggttgtctgccgccgatgaagatccgatccgattcgtctcccgggcgcggccgggtcggcggtcaagcaccactccactccaaatctggcgggcgccgcatcagaattcagtagatgcatcgccacgagctcacgtgcgcctcgagtccatgacaacccagacgcaacgacgacgacgccaaacgcgtgcgtgagcgtgcacgccaaccacgctcatcaacggtcgtaacgcgcaggaaaggaaacccaaccgcatccggtcccggcccgggcgcccaatttccgcgaacagcccaccttcccgccagctccgcctcatccgtagccagacaaagccaacgaggcaaccggcaacaacgtgcccccgcggccctgccggccggacgaacgaacgaagcagtcaaaacccccgcaccccaccgggcctccacacgcagcagcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccttcccccg

SEQ ID NO: 10178 - DNA, 1500 bp, Zea mays
tgaagctagaaaatcgaagttgtaatttttgaagtgaagcccttccaaacagggccttaaatttgggtttgttgcagctattacagcacttagtgcaaaatttaactgctacatcttcagtcaagcattttaaaactaaaacgtgggattggttctagaaacatatgaaaaatttaatacccatacgtagtttagggtggtagaccttgccactgttgacgtcaggaaggcgggagcttcacccttctagttgatatgctgtgccaattgcgcgacctctctatgggaagtatatttgtttccttttttcactactctctggaaagtattttttctagtgcaatgcaagtggacaagaatcaagttgctgtttttttcggattaaaaccagctgttcggactgctacaactgcaatatatagagaaaaaatactgtagatgatagatgaagaaagtaaaatttatatatggagtctgtaagatgtacttggtagcataagtagtagagataatgcctttgatcctatattatatactttctatattttatcatttggtcaacaatcaataattcaagcatatcaacatgagaaaatccctatttaacactaggcaaacttatccttccctattcaacaccgaaacttaaaatcttctctaactgttacaggtagggaggattttaagttttgatgtcaaatagggaaacaaaagtttttctattgtcaaataggaaattttcactatcaacatcgatatctttggtcaagttatatttaagggggtgtttaggagtgaagttgttttatagttttggaaaaatactgcattattcttaaatactgtagtattatatacataatggtttttggcaagctagctaaagtctctgtttttttttaaaactgaggccctgtttggaattgtaggccctgtttggaagtgtaggattttttgcagttttgaaacaatactatggtatttgatgatactatagtattagaacacaaaaggtgtttggtttgtacaggcaaaacacagctttaaatatcatggtttacctaaaaccgtggtatttttggagttttcaaaactccactcaggacctcagttttcttctcttctctctacatatactttgtttttccaatggaacgaaacagatctcggttttgagcaacactgtggttttactgtgataaagtaatacagtagtatttgtgttatatataattgtaaattattatatctcaaaactataatatttcaaaactgtatttccaaacaggccaacattgtttttgttacatcgtgaacagctcgtgggtggcctacgaacaggtctagcggtctagcccatactccgcatgcaaacaacctctcggcctcatcaggcccgctgccctccacctccgcctccgccgatcccctccgctgaatcgaatagaagaatcgagcgccgctactggcgaggggctagcggtcggcgcacagcgcggt

SEQ ID NO: 10179 - DNA, 192 bp, Zea mays
tgtaatttacaggtcagactattttgttaatatctaatttgtctaattgaattctttgttactcaactcaattacttccaaaactgtttataggagactagatggtcaagttggcgtcttaagctttacttttcagctggagcagtgctttggatattgtcaggtcttggaattgtttttctaccgagcaga

SEQ ID NO: 10180 - DNA, 865 bp, Zea mays
aaaactccactcgggaatgacctgaggccaaattatctagttacaattgaacgcttgggtggaaccggaaccattcaatttccgagttcgctgtccaattcaaaagatttaattgcgtctcgataaatcaacaatcaaatgaactagtccgtataattttctcaacatgttttgttttctactagtactagacttcccttcaatgccaacgcgccctgcatcgaatttactagcctacaatgacgcagttttgaatgatgatacagtgacaacgggaaaaaaaaacttgcccccgcgacacacctcacgcaaaacacgatccagtgtcgtgcgcgcaaaggatccgcgctccaaaaactctcctaggaaaatgccaaaaacaaaacaaaacaaagccccaaggagtcgcaggcatgttttacagaaaacccctcgtctctatccaaaacccgctccaccaccaccatcactattcactaggcacagcgcccggccgccctacataaaccctgctctcctccactccactagtctctctcctactgtttacacactgcagtggccttgccggcgtcttcctccccctcctctctctcgctcctctgtcctctccacttgataaagaacacaattaggaaaaaataggcaaaaaaacatgtaccttttttctatctatattatctgaataaatcaagaagaggaagaggggagagggagcagggagggggaggagtagcaaatccagactccatagaatcagctcgcaagaaggggaaagggaggaggagcttcgctggtgaattgattgctcgctgctccagtctcgcattcgtgccgttttcggcaagtaggtggcgtggcaagc

SEQ ID NO: 10181 - DNA, 809 bp, Zea mays
ccagttgtgaataacacgggttagttaacgtggagcttcagtccaatatctgcacttattggctttattgaagtgaattggcagttcacagtactacaacattagcataatagattcacaggataacgctccattccgtatggccgtattttgcccatgtgcatactgtaaacatctaatggtgtaaacatattttgtaaatagctgaccttacacacattaattatgcataattgaacgagagtttcgtgcctgtaactctactgcctgacttcacccagaacactaactgagctgttcccaaataatggtcagcccctcagcttgtcctgttaccgtcttggcatcttaagctcgactgagctgtgttcaatgtgcaggttgaacgctggaacgagcagcgtgaaaatggcaccttccctggacctctgtaatcctacaatgcaaaaagaattaggaactcacgatgttgtgccggccttctccttggtaactggcgccaagttagcagggagagagacaaatcatcctctttggagctctctacaaaataagagattctttttgacttgaagaatgccttgttgctcttcctaacggtcttgttctgcgctgctgagataacagcgtcacagttacatttttgtccgtatatacagttttaaaaaatgattcatgattcccccatctttgcaccgtaacaacccagcttgactgggcttacggtgcaaatccgatgcactgagatcatcttcttcataatagtcggtgcctccgggcgatagacatgcataataataggtgcctgt

SEQ ID NO: 10182 - DNA, 87 bp, Zea mays
gccagccaagaacaggtgttggcgtgttgctatatacactactgcgtacggattggtcgatcgagccgccgcggaccgctgtgtcgc

SEQ ID NO: 10183 - DNA, 845 bp, Zea mays
ggtgggcaggcggccgcggacggacaggcggtcggccggccgggcgagccgcgagcggacgtcttgtgctgcagcggctgtgttgcggcggctgtgctgtgcgggctgcgtgggctgggcggctgaatacctagatttcacttttttactgggccgagttgaggtatggcgcgggccatacttggccataacgggccctccgcccctgctcatcagaacggtgcagaatcattatcaggtgactttctaattgtatagggtgtggaagatgaatttgaacgacattgatgtaacatagtatatagtttcggtcctcacacctatgcttgatagtgcttcacgcagaaaactgaaggaggggaggcatcattcctacacatgggacgatgtgaatgaagtttagtttcatttaatttcatacaatatattgttttgagagaaaaaacaagtaaaaatatctttagaatatcaagtcagtgacttatttttgatctgcagggttctgagctagtatgtcgtttaatctggtactaatgggctcacatagtcatatatcttgcatattttctgagcgacatacacggagagaaacattgtttgcaattgcatttcatgacttcagaacattagacttgtctctttctttggataatttatcatgactgcaaaactgtttcaatggtcattccattcgctttttatacatgtctggtttcacgttacatggctgcttatcaaagttttattctgttgccctttggttgacacagaaacatttggagaaccatacccaacaaaataagcaccagcatttcatcctttgtctcggcattccaataataata

SEQ ID NO: 10184 - DNA, 1500 bp, Zea mays
taaggatttagatacgtttcatgttgctttcttactttttgaaaaaaattggcagcagcccctaaaaacagctagtagtacacatactatcagcaactaaaaacagtgattcagacatcgcagcaattattaactagtccagttaatagctgaaaacaaactgcacatgggcccatctatatctacatatattaaaaaagtaaacaaaaaaacttctgcttttttatcctgtatttgaactgtcggttttctacgtcttctatctatctgcttcgtcacttgtgcttcgttttaatatcgatatgatgatattggtgaggatggaattgtattgaatttaataccaatcatgtatgttattgaaattagatgtaattccaattctattatttggatgtcacgagtttagaattgtgtggtctaattacacgtaataccgagttatgaggcttttgtattgtgagagaggattgctacttatagtccaattctatagaattgagtctcttattttaaatctcaatttcacgtgtaactaaacaacataatttagtaaaaaactgatttcaattcctaattctacgctcaaatatctggaagtctttgcgctagaaggagttccatcagcaatagacgatttttacgagaatagcaaacgaactccatcttctgtatgttccatcagaaatcgacaaaaatgacaaaaaggtcccctcggtctcccaacgcaatacaatcgggtcaacaaagactcgggaggagcgtagtagcgtaaaccgtccgttattgggctcctccccgctctgaccgctgccccgtcgacccggtcggcggtcgcccctgatcgctgcttgattattcctcgcagtgcgtgacccgtcagctggtatacgagagcacgtcctgctgcacaagtaaacaagtcactcgtagccaaccgcgcagataataatcaatccggagtcacggtaatccagcgaccgtaccgcaacagtcaccagcgacaagcaacggcgtggcacgggcacgggctccatcggaccatctccttctcccagagtcccagccccacactcccacgcccgccgtccccgagagccgcttcttctttctccgtgactcggagctgtctacctcaccctcactgcctctgcgtgcgtgcgtcactgccggtctgccgtgccgctgcgcccgctcccgcaataaataaactcgcctctctctgttctccgttctcacctccctcctcatccatccagggacgcgccttgacttctcacgtcgtgtcgtgtgtgagcgccgcagcggtgctgctgatctgcgattcctccacgccacaccctacctgaccacccgacagggaatcctactccctcttgcgcgccgcggcggcggcggcggcatcttcggtctccgtgcgggtgtttccgttcggcgtttactggccgggcgagcgcggcattggaggagtcgggaggagggagaccggaggcgtgatcg

SEQ ID NO: 10185 - DNA, 721 bp, Zea mays
cttttccttcctgttttcctcccctcctcccttcgtccgtcactattcattcatctcccttctcacgcatcgtatgtggtggatccactgcggattttcctgttgtagcacttgaggtcacctttcatttcatttaagcatctttcttatactggttcttaacagggaaaaaaagactgaccattttttaaggtgcgggtgcgttctaatgttttcaacgattctcgtaaacctaagctaccattttagttcatgcattgggctctggaaaacctaagccaccattcagttcaggcattagggattttgtgtcttccttcgaggcacacaaaaaaatggctctcatttttagtaccgtcgtatctttttctattttgtatttcgtcttgttttttttttggtgcgatctgatctgttctgacgattctggcgggggaaaaaaaattaacgacccaaccttggggattggtaccttcgtttggtcacgccttattttctcttactttcatgggttttgcttgcatcggctactgctcataacaaacagtactagtactgtatagtattcggttgcatgcattttgtgcaacttgagtagtttattttgcccagttataaagtgtttgaccattttcttgcccatggcgctcgccacaggctgcagtaggacagggagcaaccgccaccatagctgttcgccatttcttccatcaacaccaac

SEQ ID NO: 10186 - DNA, 1500 bp, Zea mays
attccttgatgctaatgtgctatatatctggtgcgtggttatctcaggttaagtttgtatctatccctcgatctgcaacgcgatcatgcaataataacaacccacttgtacgtgaacgaacttgttaatgcccgcataattaacattgttgcagcaggaatctaaagccccctctgcgcgcctttcgtgcacttgcgctgcgtcacgtatataacttaactaatataatgcagtacttattccttatcatctgctttttgtccatgcatgatcctagtccaagcagtgtgttcatatactaatgtcgggcataaagtcaggtgcacaacttgacccgattcctttttatttttccttctgatggagccgcgccattttatatgtgtgctatactagagactgtacatgtgctagtcatggcaaggccaaatttgtgagatgggacatgattggcctatcctcttttttccagtataaggcaagcaatccggaatgcaaatctagcgtctgtctcggaacttttgctttagctagtcgtagtatatgcctaaggaaatggggtgccgggggaaataatctgtgtagactagggaagcaatgcaaaagactgttcgtccatgtggtgccgactaccgatcgactatatgcatgccatctggtgtgcatgtcgcggagacttttgaagcctcagttacttttttccttaattgcctcttatttgtaatcgtaactctagtaaattttatcactactaataattgaacacattaatccttactataaaaaaagtgtaacgaaagaaataaacactgcctgctggtgcacaggtttgcatcgatcgtatgtattaggtggcggaattcgcactgcattaattgggcacaacgtgcttcacttctgcactgcgtatatatagcctactctgtcgaccgaccgtctgccggtgtccagtaccactactggtccctcccgcctcgacgagtcgacgtacacagccggacacggtcattccggccggcaggtataaagcatgaaagaaagggcatcgatccctctgctgacctggcaaccatttaacagaaagacaagccgcgctgctgttaaaatatataatataatgccatcgtcgcctaaagcctcgatacggctttcttacgtctgtcgaataaaacgtccgccaatcacctcgctcatcggctaatacaatattaatgatctagtagctagagtagcgtagcatcacgactgtttatgctatgccgatcgatttgcagctagcgtagcatgcatatatccgtaggatgttgtaattaattagctagaccgtacccatgttgcgacaaaagcctttctttgtccctctataaataccatcaaccgtcggatgcttggttcgaagcaacacatacagatcaaacctaatcagcaggatctactagctagctagctgttgagagcttgacacaaagaagcgaccgagcggtcgagctagcttccacc

SEQ ID NO: 10187 - DNA, 157 bp, Zea mays
ggtgacctgccactacagcaactgtaattgccgcacttgcccgatatatggctgggcgtgctgcagcacttgctgctagctagctagctagctagtgtgagttcttccgcgcgcgcaagcagcctttgcataccaccccctcttgcttagctcatgc

SEQ ID NO: 10188 - DNA, 903 bp, Zea mays
cttatttttatgagtatcaaatataattatgtaccgtcccaatacagggacattgagtaatactgaatccacctcttcctctcacaagctgtcttggaatctatgagtaactcactctcagctaggtattagtgactagcccaattatcttctcttcatgtatcttttatagcatctccaagagggactctaaacatggccctamccataaaatactcttccaacgatggttctattttataaaatttcatccatgactatagtgatcggtctctcgggtccttaaatataataccctatatgctataaccatatcctcgttttatcttattttctaataatatgatttattttctaaatactattatttaagactcaactgttgaagtgaaaacttttttaggctctaaacacgttaaatatgatactattttaaaatttaggactctattttagagtttattgttggagatgcttttagtggtaggattagtggtatgagaagatagatggcaaaataaaatgatgaaagagaccattaaaaagaggaagcaatagtaaatttgtaaaacacgtgaaatcaggaatcaggaaaggaaaggagcaaccgccgctctctccatccatcgccttccccatctcccccagttcccctcgtcgtcgcttcttccaaaccctagcggcctagcctgcctcctacctcgcccgccgacctatctctgccagtcctattccccgcggcagcgcgcgatctcaacgctcccgtcgcgccctgcccctgcgcttcaaccgctccatccaggcgagatcctgcggatggaacccccggcggcaaaggaggcgccgtcaccgccgctccagcctgcggcggaggaggacgcgatgctctctgcgacggcggtc

SEQ ID NO: 10189 - DNA, 1052 bp, Zea mays
atgaaataatgtagtagtagttagtagtatagagtagtgaagtgtaatgtagtagtaattagtagtatagagtagtggagtgtaatgtagtagtagggaggtcatcaactcataatgagttgatttataagttctgtagcttcccttttatgaagaatgatttcgtctctacttctgtatgcgttatgctgctttctcgctgtttgccaatcttatcaatgcgcgaggagtatctgtgatcatcgaatcacatttctgattgccttgtttgtaatgatagcgctttggcggttgcggccgagtcatccgaaatcccgtcgttgctttagggatgacggctgagttacggtgggccatgacggtgttttggagataacgaccgaacggttgctgatgatatcggcgttttagaagtaacggccgaatccttcggagctatcttaccgatttagtgatagcggccgagtgatggatgtgacgtcggtgttttagaagtaacgactaagcagttactggtgatgtcagcgttttagaggtaacagccgaatcctttggagtcgcgtcgccgctttaggaataacggccgagcgattgatggggacatcggcgttttagaggtaacaaccgagtgatcgatggcaatgtcagcgtttttagaggtaacagccgagtgataacgggccacgccggccgctttggaaacaatggtcgggtgaagtctagtaacattagcgtttttagaaataaccgctgagttaaaatgggccgcatcgaccgttttggaaataacagccgagtggtgatgtggcacgcccacgttttagaaataacggccgggtgatgacatggcgtgcccgcgttttagaaataacagccgagcgatgacatggcatgccagcgttttggaagtggcgccgggcccgggaaaaccccatatgtactacactgtcgcacgcctccgcgtttcgtgccctagtttctgcttttctgcatccaggctttctctgctctcctgcaatattgcttccgctccgctcgctagcaaggttgag

SEQ ID NO: 10190 - DNA, 970 bp, Zea mays
ctgcagcacgggcctatgaccttgctgcattaaaatactggggagctggaacacaaataaatttcccagtgagtcatttttacttgtgtggtgatgcttgtgactcgtgttttaaattgctgtaaaagttctcgcacttgacgtgaagatcagccttctgttaatagaaattgtttcattcaggaagcatcttgtggaaacttttttttttgtaaaacgacccttatttatttctaacattgatcaataagattttaagatcagctttccgctaatagaaattgtttaattaaggaagcatcttgtgggtatcatatttttggtaaaagaaattcttctctttgtttctaacattgacccattggtcttatatgcaaagaaatcttgacaaaagctattgagcaacatggttttcttttccaaattggaggttttgagactgtaaccagatttaagatgtgtctacaacatggttgttgccttctttttgtcctttattttgaatttgacagtggtgctgatatatcatgcttgcacaagtacctgctgtactcctttgtattcacattatgaaatgatgggcaagaagttacacttcccaacatgtacttctattcataaattgtattgttttttctagtgatgtttggaaatggatgtctgcatatcataattgcacagttgtacttgagtacaatgttttctcttttttttggaagattcaagtcggtggactgataagtacaatagaaacaacaatatcttctgtttagtgtgacaaaacaaatgtatcaacatatagaattgcttgaagtgataactgtacgtgagttccaatgtagagtattatgctatctctgttccatgctttatcacagtagtcagttagagctgtgttatatttttcagacttatgttcattatatgtttgcttgtttaggtatctgactatgcaagagaccttgaagag

SEQ ID NO: 10191 - DNA, 148 bp, Zea mays
ctgccctaccctaccgctaccggccctgtcattaaatgcctcccaccacgatacgaaccaaccaacgaaccaaacataaattcagcccaccgcttcgaggacaggacggagggagctcacgcgcgagcaaagcaaagcacaagcagca

SEQ ID NO: 10192 - DNA, 1358 bp, Zea mays
cgtccagtcgtgttacccatatgccacagggtcatgaatctcatacatctctactaaggaggcgaggcagggtagcactacgaggcttttacaaagttcaactagcttcagtaaacccgctatggtttctgagaagggcgatataggatccctcgttcgaaaagccatcacagcatgatcgacccgagaatctctctataccgcagctcctctaccccccttacccctttcgggtaaggtagtcctccactaactttcctaattagtcaactaagggcgtcccataccacccttgtggtagcactgtttttctaggtagtcgctccatgttccaattaacataatgatcttatcatgaacaataattaaaacaacaacaaaattggaacatgatcataatataacattaattttccaaaaccaggtagagcaatagcaaatctacccaatagttcttttgtttgcaaggtgtgggataaataatgctagggaaacctattgggtcccatcaaattaacctcagcatgtcacggtgattaataggaacattcttaggtagagaaaagtgatcaagggcacaacttgccttaaccttgagattcccaggtacttctccaagttaatcttcaagtttctcgtgacctcactgctactcgtagcaaaacatacaaatagacaagaagttcataaaataacagtacaccaaacatgagaacaaatagtgtaaaatattctacacgctattatgagatcgtaggttcgagaatcactaaaatcagagttacgattaagaagatatgattttcagaatattttgatggttaaataattaaaactaggccttagattgattttataaatcatgtgagatataccttaaatattaactctaatataagtcatatcttagttaaagatcatcttctattcaaataataattatgaacatattactttaattagatagattaatctactatacataggataaataagtacgtaattacaaaagaattagtaatggagtgaaaattaatgcggaggctctattagaaccttcaattagtaatagcaagatatatataagatagtagagtatagtttaaatgttggcattgttcattctttcttttgttatttaatttaggctatccacagtggttagtggttacgtctgaagggtccaaacaatgcatgaagagtttgaggacgggaagtctgccctaaaaatagcaatgcaaacacatggtgtccatgccatacatatagcacactaattttatcagcagaacaatggtatttataggtcctagtgcccaggcaacaagagacacgaataaagcatcgatcacgacaag

SEQ ID NO: 10193 - DNA, 373 bp, Zea mays
gatagatttatttttatgtgaaagtgatcatgctaattgtgccaaagaattattagtttgaagaatgtttcatggcactgttcttgggcggatcagttgtatacatctgatgatctgaattaacaagttgcagccttgcagggcgatacaacaaatattttgttgtttgatttatttaccaatatggaaaatccagtcataaagtatgctcaatagaaaacggtatttagacctgcaaaaaaaaaagaagacaacaatatttrtaacttttttctgtatattatgttctgtctagcgattatgttttcagaacatattttagagaaacactctgctactctcactggagcagaaaaacaattgattcatacag

SEQ ID NO: 10194 - DNA, 211 bp, Zea mays
acttagcagtgcatacactcccaccttcttactggtttctcgactccagtggttcacctgggacggggttgctgaaatggttcccttctctgaatactgaaaaatcaaaaaaagaagtatatgaaaaaatgatggtagacgtgtctgggtcaataagagtttctgaaacttggatttgtatgtgtcagtctctgtgttctgtttccaagga

SEQ ID NO: 10195 - DNA, 1491 bp, Zea mays
ccgatagatgtacccgacctattttcacccctaataaaatgcacgtctgatttattttaattttataatttaatcatgtgagggtccgagccgcttgtgaccgtgagcacgactgatatattagttttacactttgcagaggttgcacatcttaacccatagtcatgttacccatttgccaagggctcaatactcacataaatctcttctttggaggtgaggcaggattcactacaaggactttgtaaatttccactagcatgagaaaacccgctacggtttcaaatagaggtggtatatgaacccctcgtctgaaaagcttccacaaagcagatcaacctaagaacctccctatacttgagcaactcctccctgcttgcccatgtcgaggaaggttcttacacaccaactttcgtaatcaattagctaagaccagagccataaaagtaattgtggtcacattgttttctcggttggttctccatgttccaattaaacacggtggccttatcctgcataataaataaaccaacaataataaatcataataaaatatgaccatgattcataagtatcattattcccaaaaacgaagttgagcacaagaatgtctacccaataattagtaacttaggggtacacaaggcacagggaaaacaaagttaggtaacctattaggtcccgtcgggttaacctaactgcaatgcataggtgaggacataataataaatattattaggtaaaagaacgagatcaagaaaacacttgtctttcttagtaaactcctgttgctcaaatgcttttgtaggttgggcttgaaaaccctttgtcaaggatttcccgagggtgaatttatataggttagggtggttcatgctctcgttgtgcgataataccctatgtcctgtgttttgatggctattgatctgttatgttctggtttatgctcatttccatcctaggcactgaggccacgtcgtaggctccggttggaccttgccttagtgatgacacaatccattttggacaaggcttggatttgtcctggtcatgcgataggggcatcgaccatgtcaataaaaaaattaactgtatgtgtcttcatgaattctctgatcaagcaactaacatcaatttcgatctctaaacaactgtctgctttgcttatcatttgctgctacaaccaagtctgggcaacattattaggtacatgctgacatatatgtactacaaagtccactgacacggttcttgtagcagttgttactcgattgttatcgcgatgcagggattatattgggtcttgcttattattcgttgacccggttcacaaacacggttccaagcacattgtataaatagagagtaacatctaaagcagctcttcatctcctctcctcgtcaccatctcgatcgagctccagagctaaagcagatagaaagctcagagtgagagagcagcatctgatcgaccaattgttcaccttcgtc

SEQ ID NO: 10196 - DNA, 369 bp, Zea mays
ggtgaaactttactattttctgtatgtacattcaatcagagtgccccccccccccccaagtactaccatcttgtttctcattcgatatgtcaccaatcccctttttgtttgtgtacctgtacttttcggatactgtactattgtaatactagccatctatgtttctagactgaatattttcttttcacaatttgtccagtgtgctgctgttgaggcattaaagcattttattccaacatacctggtatcttctggtgaaaagattgctagtgatattatctcaaaatatgtggcacttctagatgacccaaatgtggctgcagacgaggagctgcactggcccttggaatattaccattcaaattcttg

SEQ ID NO: 10197 - DNA, 417 bp, Zea mays
tctaaaaagaactctaaattaataatttatacttgtctattttttttaaaaaaatatcgccattgaaatatctctatttctactatattaaaccaccaatgtctccaggttccacggtcgctgtgctcccccacatttaaatagtaaaaataacaaaaaaaatatacatacataaagatttgaactatggttgctagttttaaattttaaaactcacattcacatccacctatccaattgaacaaacattttcctaagctcggacttggaggctcgcaaaacgccacaagaagcccgatccacacgagagtctgtcgcttgaaacggaccttatcagcatcgtcgctcggcccattcgaggcccacagagtgaggaggagtcgaggagcaggaggctagggtttaaggtgcacggcg

SEQ ID NO: 10198 - DNA, 124 bp, Zea mays
tcgcccgtgagcagctccgacagcctcatcgccgcgttgcacctgctcttgtgtcgcaggctcgggttaccgtcggtgctgacaccgaggaaggcatgatccatgcggagcagcccaaggcgcg

SEQ ID NO: 10199 - DNA, 106 bp, Zea mays
ggtccaaaagtgtccatattgacaattaaattgagggaagatacattctaattatgcagacttgatgtttgataaccattagtgtatctatttacattgtatactg

SEQ ID NO: 10200 - DNA, 1390 bp, Zea mays
gacatcgattctaggagcatctattcatccgttgaattcaaacaacgacacttgatagctagcatataaaatctccagaacaaataatatatatagatacaatcttcttcagaaatgacaatatattatatatgccacactacacgcaacagcagacaacgcaaggctccaggacggatgggatccgttgcatggggaatcaaaggacaaaatgatcagctggaaacaagactagaaaaattcaccaatcagggcctttttggtccgtgccgcgtttctttaactggcgacgagtatccgccgtcacatggggcacaagaagggtgccatgctattacaatcctaatcatgcatggaatcatggataaaaaacactcctagcaaaaaaagatcccaccaataatacgcccattgactagctcgttcccagtacattagtcaagagaaattttgcagaggtgagttacctgaaaagcaagaagaagaagaagaaaaaggacagcacttaggtctgacagaataaaatcttgcagaggtgagaagaaaatgaggtgcacatgcacgcacgaaaacgagcagcagctagcacacaacgagtcttaattaggcaatttagcaacagaggaaaggtggacagcgcttcttcccagctgtgtgctctgccgtgcatggagcacccgtgacacagaagtagctgcagaaaagagagaaagaaagaaagaaaaaaactgccttgctaaaggtcacagtcactcaccatggcagcaatagcatcagcccatgtcctaataatgtgaactccgatagacacgtttcactttcactggcttgtgcccgaagaaacacaccaggcctgggtggtctaatgtaacagtttcttgcacaaaggtcacgacaattaaaatatcggtggaggaggctacggggctaccccaccggttttggcaccagacatagattcttaggagatgatgagacagacgcccacacatagccggaagcaaaaccaagggaagggctaaacctcccttggcacaagccctcaaccacctccaccaccacctttaaaagaaggtgctaaagggctgtcctgcagagaaaaagagaggagtgccccccacaaacctttccttgcattccactgaaatcttcctatctgcaaccatgcagttgctcaattctggcytcagctgaagcccaaccatccattgttatataagtcgctgcagcctttgcaatttcccactccttcagccaccatcggtcattgaaggagcttcgtgccaccagagaaggtgttcgccgtgcataatcacagactatatacattccacagacctgtaaagctctgtgaatttggagctcccacaggttctgcattggcgttgag

SEQ ID NO: 10201 - DNA, 115 bp, Zea mays
ggtgagtccgtgagtgacatgctacgccagcttatagttgctagccatgcgcccaagcgtatgttgatacattcctgccaccattttctttgcgcgcgcgatgcaggttgctgac

SEQ ID NO: 10202 - DNA, 1500 bp, Zea mays
ttataaatatgtacacacgccaatttatgtacgccgtggctgcattgtgggtgcccaacagaactctgtatacgtgacacatagacaccacccaagcgggtacgcgttcgcaccgcacctcctcggcgtcggcgagaaccgccccgcccggcgcgtcagagccgtcgcgctacccactaaccgaccacggcacgcaagacgcaaacgaacccccccaagtgttacgcgaatattcgcgtcacccgtccggacggcccggcatcggggcacctatttcatttcacaaccggctcgcctcgcgggcgaggccgcagccgccgtgtgagttccagttccaagtcctccgcgggcgcggagggaggaagaaatcggcaatcgccccaccccatcccatccccccccgccccaagaataggctagcggctggtcctcgaatctaggagcccccgacctgcgcgtccgtccgtccgtcctccctaaatccggccacgcccgccggtgaggagaggcgaagattgatcagccactcccgaatggaagattcatcggcctctgtcccggacccggacgaataataacttagttctactaagtttctcgggggtcgcccttcgcttgcttccgcccccttgttgttgttcctttgtccggctcgatctgggtcgctcggcggctgttcgtccgtcgcccgtaccgccgccgccgccggttggttggattagtactccactcccgcttcgttccgttatctctggtgagcctcttctcactgccgattggaccggtgtcttcctccccgatctgcctacgcgtttctttgttttttttgctcatctggatggttgttctcttctgcaagttccgatctagtgttttggaatctgttaggtcgtcgtcagccagcccaggcggtttctgaacaggttggctgccgcgtactgattccttgctgctccaaagaaaatgcacgccttttcttttgctggtttattctggtagccgtcggaaggataatgctggcctggaaacccataacttgcaaggctggcatctcatctgctgtcgctcattagtttgagcgtgattaatcgctcagccagacatgacaccgtctctgtcgtattcgtggggggcgctttcatgtccacacgcctggcttgatgctggaagctgttgttgctttcgggatcgtcttttcgtaaccctagggaaacgctacttctttgaccgttctggtgtgagttcatctcgcatttcagtatttgcaattttttctcgcccaagatatgggctcatactgcagttaaagtaaaaaaaaaaaactggatcttcatgttgttgttgtgtgctccaaataccaatattgatctcgcctcgactctggaggggcatctatgcaagttgatattaaagcgtgttgcggttcctgcgcaggtctgatatttacgggatattccttcgcgtgctctgcttctgctgggattcaagtgaaggcacccc

SEQ ID NO: 10203 - DNA, 1500 bp, Zea mays
aggagtacgtaatcttgttggagcatgacgtaggtcgcgtgcgtgacctatagctaaatgaggatagggactgtgtggatattttcttattaatctggcagcaccagcttgcgtgctgtgcgtgtgcgccactaattccttttatcagaccatcagtgatgcatgtgatgcatgctctacaatctttgattccttttcaccgatgacgatgacacacaggcacacagccgcacagctatcttcgtacagagctttccatcatcgtcttgtaagggagtgtttggttattagggactaatttttagtccctccattttattccactttagtatataaattgcaaaatatggaaactataactctattttagttttcatatttgacaatttagtgactaaagtggaataaattggagggactaaaaattagtctctaaaaccaaacctttttgccattttggtgcggaacatataggagcatgcggcacggattgtgctatggcaggtacccgacccaccgcatttcttatccgctgctggggtgtgggtgcgcctcgtcgtcggcgacctttctcacacccagcggagacgacccattccgattggcggagggagctctcgtccaatgggtcgcgggctcgcggcgccatgggattcacgcatcccgccgccgggcgtgcgtggggcaaaatcagctcagctaattgggtaaagcgaccgctttttccggtgtgttgtgtgtgcgtggcttggctttggctttggctcgagtccgttccatcacagcaacttgccacttgctgccagtaaacaacacaaaggcgttcaccaccggctggagatgccctgccaatagcgaggagagcccctactgggtttggttcatacccgtgttatccactacagaatcccagctcgatcggcacgagccgactggtcgctacacttgccgacttgcgtagggaggagtcctcttccagttgtcttgccctgccacagcccacaggagattcactgggctgtttgcgatggcagagttagccacggcaacgtacaaaaccagctcttgctaaggggaaaaatcacaaaattattgttgcgtctcccttttactactgtttgctgctgctgtggtggtctggataattgggcatctaaacgaaggcttgtgttcctcgctggcacaaccgagaactcatcgtcatccaatctgcagcaccaaaccttacccaggaccaggagtaggagagagagagatggaggaataaagcagggggggcacgcagcgcacggagggagagccggagggagatcaaaaggaaggaggcaaagctttgcttctgagagagggagagccggagagcgaagagaagcaggccaacccacccccacccctgcactgcacacacaatccccccatggcctctgctccagctgctgctatataagcgcgacccggacggctctgcttccccagtagtcctctcctctcctcccatcc

SEQ ID NO: 10204 - DNA, 522 bp, Zea mays
ctactgatgacactttgtcaagggcgtttttcgtcgaaagtttgatattcgacaaagcccccctttgccgagcgtccgtgtaggccaagggttcagccctcggcaaagttggtttgcgccaagtggatttttcgttgagagtgacactcggtaaagcttattttgccgactgctcaatwwattgcactcggcaaaaatcgccacactcgataaagtgtcggattccaataataactgttttacattgtaaattataatgtttataaagtagagtttgtaacatagagtaagataagaagtgtgatagaaagtctagattgtctatgtaccgactgtcgcatgcctaccgattgccgctagaaccctcgtaaaaaatctgactagctagctacttgtgtagaccgtcccgatgcatgggatccacttgacgaccttcggttcggaatttgagtattactactattaatgaggcgtgatgattgacttatctcacagactcacacacaagtgcacaactgaagt

SEQ ID NO: 10205 - DNA, 928 bp, Zea mays
agcatccggagcccaaacaatcgatcaaataaatcaaattaaatctagtcgttgttgcctgcttttgatttcacttgattccttctctgctggtgatgcctctccgtttgttgtatgcatgcatgtatgtatgtatcatcacagttgtgggtgcttctctggcggcgaaaccgcgagatagatagattcagtgttggaccgaggaccatggatggatggatggaacatgcatgcccagtgattgtttgcgccgatgaaagttcaatttgtccggatttattttctctgaaatagtatatgtttttttttctccatcggtgagccggtgatcttgtcaatttgtacaataatcattatatgcaaccaactgtgctttaatttgctctgatatcaaaatcaaagagtctctcatatagagtttaccttatgatgaatggaagaagaagaaaaaaaacattacgaaaagatcagaggcggacccagcgggtggtccatatggtccacggcacaccctaaaatcacataaatgtaattagcatagtggtgtaagtgctatattttaaacttggtggtcaaggttcgagtcttgttgatccttgtttttttgtttgtttttttatttttttttcttggcacaccctaaacatagcagctgggcacataaaagctaagcttactgggtactggccagtctttctatgaattttatttttcttcagcacctgtactattctgtacctctccgaacgaattctctgaaattttctcgcggtcaaaccacgtgatctcgtggtccaagatttccacgtcaccaagctccggtccaaccgcgcagccacatctatataataagtagttcttgatcgtgttcgtgcagtgagcacaaacataacagtcttacagtacgtagcagcagcctagcacgacg

SEQ ID NO: 10206 - DNA, 1500 bp, Zea mays
agctgaactcaattaacaactagattgttgctcttcaaacacatttatcaatacatttgtttatttatgtattctattacaatataatttcttaaaaacagatagatttaatataaagagttataagtgttatctagtaaaccttttacaattcagaatacataaattatataattttgattatatttttctataaaataagacctcttttgaattttagtacaagacctctaaatttaccaccccgtccctgctctcagcccactgtcccaagacaggtgctgtgtccactgcctccttcgctaaacgtgctttgttttagtagctcttcctttaatctatttttttgttcggccactgccatgaaaaacgtagtgtttcccgtgatataaataaaaatccgttttaatgcacttcgcgatgagccttgctggccgctctggatcgtagacgctcgaataaagatagtttttgtttcatataattagtagcgaagagccagaatagatgaatgataaattacgctttaatattatatatgtacattatatgtatagctattatgtatatagatatagaattgtactcttttttaaggttgagggagtacttgtcgcctgcatgtatatcaacttttggtttgcttggcactgtttttttcaagttatattagtcctctatccattctaaattataaaatagtttttatctttttagacacagattttttatatacttagatatacatcatatctcgatatacagttagagaaatatatctaaaaatatcaaaacatctcataataaagagtgtagcactgagcacatttcttaaaattcattgttcttcaaaccttttattcagacagagttacaggcgcagaagcacacatacatatgagcaaaatcgattaagttaattacaaacgtaatcctaaatgaattccttgtgccgcactatatgctagttgctagcctagtagcctccgtgtggagaggaaccacacgttcctcctaagaaggaaaaaaaaaacaaaaatcacgaagcagacagcaccggacacactgacgcggacttggaaaggcactggaggggcagtttggtcaaacccgcaggccgagaggaaagaaagtgcccggcccacccgctgggatcaactgccgaaccgtctggaaggcactaacgccgtgacaacactcaaattaccaaaacaccctcgtccatcttcgactgagctcggccgtccgatcaccttcaagattcccgaaccgcttcccacggcagctcgctccctatatgaatcgagcggcgcgcgatcatccattaacggaacaaagtacttgcgaggcaacgggaaggaggtagaagagggagagtaaagtagcgcgccgcagccgcagcggaggaaaggcaagggcggcgagggaacacgcggttgcttgcggaaacccgctcgactcggtctctccgcccgcgagttgggttgatcggagggtttg

SEQ ID NO: 10207 - DNA, 278 bp, Zea mays
tgggctccacggcagcggcgagggcgggagacatcacaagtaacgggcggtggctgctgatagtggcgttgaggactggcggctgcgaggggaaggcgcagccggaaaagagggggagatcggacgggggtgctccagtatttagatatgctgcggaaaccctagtgcagcgcgtgaggggcacgtgaccgaccgcaagacaggttcgagtgctgacgttgccactgatatttttgaccgttcacggacggtagcgctagcgccaacctccggctcca

SEQ ID NO: 10208 - DNA, 507 bp, Zea mays
agtagaatgaccctccagtccataagtgcttaggtcgctgttgtaatcctttataaggggcataattgtaatttcccacaggctgtgtcctgtgcctataaatagtgaacaatattcttttactgttcacggattcctgttttcctgcaatcgcatcattcgagaaccaatctttgtcgaggcagaggtataattgtattcaataattagatatattgagtaaatatgatatggttcatttatgattcatttacctttggatactctttattttatgttaccttatacaatttattaaaacacaattacgaagacttaaccttcgtaactgtactgtcatcaaccttcatccaaggttcattatccttaagggaataatgcttcatggatgaaggacattaacatttaacattttatgttgccttgttcttaattcatagcatttgagaacaagtccccaacattggcgcccacctccgatgaactcacttccacttttttgagctg

SEQ ID NO: 10209 - DNA, 419 bp, Zea mays
ttgcagaggaatatacaataaaatagatggtctattttattctattttagtctctaaaataaaatagaggaactgaaaattagtctattgaaactaaacacctcgttattaaaaaatgaacagaattagatttcgatcctaactagatctgtcaaatttagagctaattattatcaccctaactagacgaagatgacctcgtcgcaacgatagctagctagcaagctccttcgtctgccgccgtgcccctctgctgtataatagtagacatgagtgtcacccctcagtcctcactcctgcttgccaagctacagcagcagcagcagccgcagcaagatagtgtagcgtggcaagggcagtgatagttagctagctgctcgctcgcctgggacgacggcgacgacgaagcggcaacgcta

SEQ ID NO: 10210 - DNA, 800 bp, Zea mays
tggggacttgcagtgatgtaacatagtggactgatatgaagtgacggagatattaaaaatcgctagccaagactccaaagggccagatgccaattttctttgtaaaaagggctaaaattaaaaaaaattaggtatagggccaaggtggccttgctctccacgtacagaaaccaaacatgccgatagtgaatcaccgaggaagagtatgtggagaggaatttggggattttgacgacttgtgtcttgaaaataaaatccattttcaaattttaatatcatatacggtagacaaactatacacgataaaaatagaggatcaaattatatgaaaaagagagaatatatagataaccaaattttgtggatgttactaaagacaaagagatataaaaggcaaaatcttttatagtgttctgtaaataacaaagaatatttctctaaaagacttaatacttgttgtaccgtgatattgttatgcaacaataataatgtttttttaagcaagccgatgacattgctatagaacattgttggtggtaaaaaataatgtacctgatttttctagaaccctgatcacccggtgcaccgttcaaatatgaattctgcactggagcctgatcacccggtgcaccgtgcaccggtaaaactgatgctgatcggctcgtgaggcccagttggaagccagagcgaccagtcggaagcccttaaaaacccacgtcgcggttgcgggcgcacccgcaccgcacgcccccacatttcccgcgccaaccgaccaggcgaacggcggccacgcccacgcc

SEQ ID NO: 10211 - DNA, 327 bp, Zea mays
gatccaaattycccgaaaaaaaacttcttccattacacgggcgaggcggttgatggccggccacaattccaacccaagctctaacctacgacttccgccgattccgctsgsgtytgcytccgccctccgcccaaaacccaatccagggccaggccaggccaggccaaccaaaccctaggcactgcgccacgcctagcgcgcgtggtatccatgggctgaccgcgtcccggtggggagcccggatccggagctagggttccgtcctaggcggcaccaccatggagtgggacagcgagtccgacggcgccggcagcgtcgacgccggct

SEQ ID NO: 10212 - DNA, 993 bp, Zea mays
cttatttacatcatgtgaaaggaattttttttctatctctattctctaacagagcgctggaatcggagacagggtcgccattgtcatgactcactcatggctcatggggtgctaccgtgctaggtgcttactgcctcgcctcggcggctcggcctaccttcccgggtgcgggtatcctcgctccccaacccgctccaccagtccatcatcacccacggcccaccccgcgcttctcggattccagctgttccctcggatcctttgcccgtcccatggcaacgcctaggtggctgtggctgccatgatgggcgctctcgccacgccaccccgccaccccgccatgtgcgtgccgcttttgacagaagaggacgaggcagatctccagtccccggccctccgtcccctcctcctgcgaaggctcctccagcaccactagctagagctaaccccgtgctgctgctgctgctactacctgctgccgcgcgccgttcgttgccgtgcgggcgtgttgtggtccgctgatctcgttcgcgggacgccggggggtggtggtggtggcagcggtggttggtggtgcgcggcgtgaaagaaagaaagaaaaaaaaaaggcccgccgctttgcgctgctctgcttccgtaggtgtcacgagatttggccctagcctttcgctttcctttttcatctcgctcacaagggaagggaccgagggacgagggagacgttggggaggggagcgagcgagccgtaacatccgagctgttccaatggcgacccctgccgttgctttcgtcgccagcgctttgttggggcggtggtagcgctaggagcggagcagtactaggttggtaggtggttgtagctttgcgcgtgacccgagcgcgcgctcgctcgctcctgtgcctctctacctcgcttgcgtgcgccgggaaggcagtgggtggctggtcggttctcgcaagaggttgctggtgctgttcctcctcccccggttg

SEQ ID NO: 10213 - DNA, 1032 bp, Zea mays
gttttagtaggcatttaaggggttttgctggttgggttagggtaacagtaatctccactattaattcccctttttttcattttctatttatgaattctagtgggggtttgaactacaacagtggtttaacctttttccaaaaattctacaaaaattacagtgggttactatttgtcactgcaggctgtcctataaatttgaggtggatactgatttagatactacttgtgcaaaattaataaaaacaagtgtaaaagggacttttacactatagctgtgatttaagtgagggttctgttgggggccttcggcttccgaaggtcctcaaaaacatgatttaacaatgtttctggagtatgatacatgaacaggtaccttcggacttagatcaaaaccacagcgtgaagatgcgcaaagaatatgaaggatggcgcagagccgaagctatgcgcaggggagcttcggcgtgatagcagaaaaagaaaccgacttaaaagggaaaaggctatttagaccccgatggattactatagagttattagcaaatgtaaagggcatgggtgtaattttacatgggctgcgtcccgtacctataaatagatgaacagtgctcccgtactgttcacgctgacttggcatttgctttcgcgtcacgcttgtacccctgctttccttcgagccgaaggtacatttataatttgttattgttgatacagtaacgcaaataaaaataagttgataataatgtttaaagtgtttatgttatttttcatatcttgcatatgaatccttcttcatcatttattgtgcttatgaaggtttgtccttcataaccttcgtccggaattcattatatccgaagggagataatgcttcgaaggatgaaggactttaacatttaacattttttatgttgccttggtcttaactcttagcatttgagaacaagtccccaacattggcgcccacctccggtgaactcacttccactttttgagtttcgaacaccttcggcaagcatagaccttcgtc

SEQ ID NO: 10214 - DNA, 1305 bp, Zea mays
atacgttgttacacataaattagcagattatcattcttactattatcaaaaaataattaatattatgaaaaatttaaggtgcgaacataatattttaattttaaggtgagactcacatatggaccaagctgcaccgttacacacaaattagctattatcattcttactcgtttaaaaaaaaaatcaaatagttttgtaaaaaaaattaaagtccaaacacaatagtgaatccactctagtaaacatgaatcttccatgggtttaggtaatgggtttaacccaccagttatgacgggttgggattgtttatttagttaaattattgagatgggtggggtgaagaagactactcatttgctgggttgggatgggtttcaacctattagcagtgctggatcatgatcttgatcaaagggtcaaaaggaatcgagtgtcgaagagaaaaaaaaatgtttagagtatggcgtgaaaattgcagacaagtaattcaggaatatttgtagttttacagaaagccacgccgcttgccatcatcgtctttttgaaccacatgttgctgtcctatccaacttccaaaggagtggtgacttccaaaagagctcgaggaggcacctcgatcagctcagaaactggatgagaccatccgatcctgattccatggtcatccacacgcaccccaaatgttcgcttgcaggacatggaatccatttgctatgtaggctgttgtggctccgcctcatcaggacagctgagctgaggccgacggcgtggagcgcggctgggccgccagccccatcaaaagcaaacgaaaagcacgcgctggttttgtttgcataatcgcacgcgcgtggccgcctgatttgcattgcacgcccagcacggacaagacaaagccgaacaagcatcaagtgcatgcgaaacaaacaagcgtgcgacacgcacacagatatttctcaagcgaggcgcgaacttttggaaggccagggcccagcgtaaagtgacccggaaccgaccctccgctccaaccgccgccgaggagcagcgctgcgtctcagagctccccggcgagtcgtccatcaccatcaaaaaggccgcaccacactaatcacaagcatcgaacttcctaaagcgctctggtcgcagactcgcagtggccgcagctgcagcgtcccctcccctttcgccatcgagcatcacctgtgctgaccgccggcgcgtaactgcaccagggtcactgcttacgaggaagaggaggcgcaacgcaacagtgttgttgggttgtctcgtcgtgcggtgccggtgccc

SEQ ID NO: 10215 - DNA, 309 bp, Zea mays
ctgatgagcctagcagaatgtgcagagagagcgtagtcgaaaatgcgtggatggagtggagacacctgggctcaacaaaagaaacctggaaggttcaaactataaaacacactcccgagtcccgacggtaactctatagcccaaacccattccaaaactgcagggcctctccaaaattccaacaccctcgcctggaaccatctacgagactacgagccagctccgagcggttgccgtcccataatctgagacggtgccgtgggtttgcggcgcctgggtcgccagtaaagtgcggaccgccggaccggg

SEQ ID NO: 10216 - DNA, 54 bp, Zea mays
tttttctttttcaattgttcatttatcctaaaaaaacctacaagaggtccagct

SEQ ID NO: 10217 - DNA, 1500 bp, Zea mays
aactgtaatctctatgatggtaaagaaattggaattattggagtctcctccatttgttgggctttatggaaagtcgggaacaaagtgtgctttgaaaacatagtgattaaatcccatgtggaaattgtgtgtcatgcgtgtacattgatgatgaaatggataggtttaagcaagaagaagcttcaggacttgcttcatgatggcgcaaaggtgctattgaaggcggctaatgctaggatcactcctcagacgccacaagaggatggtggaaacaggggagcaaacgagatggatggtctttgagtctcttttggggtttctgatgtctagtgctttctattgctgaagatgagtgaggagtgattgggaacttagctgttatgtttgtgtttctggtttgtctcagtttcagaacaatttgttgtttgttggtgtgacctgaatcaggtcagtttctggagatgtatcccttctaggcttagcccttggtgcttatctagatgtggataaaaacagttgtatttctattataaaagtaatagaaatggagtgatctctgttcgaaaaaaaattgtttgcacttgcaatgagatcccgatggaattgatgccatgtatcggcttgggggcaagccatttttttaaaaaggagagaatgttagggaatgtgagcccaaatggcccatgccgacccatgttgctaagagacactacaaagaagcagggcggtcaggaggattgggcagagaatattcagaatacggctgttcatcttccttctccactcttccatgtatcctctacctccctctctagattcttctagacccttctagagtggcttcggcattgttctcgtatccttaatcctcgtgctgttcttctttcctggactctaatcctctgtaatcgctactgttgagttgaatcaatacacactgatagtgagttgctaacatcctgctaaacaagtcttgagaattttgccttgcttccgtcagtttctctttcttgtgcatacaccgccaatctgaagctccttccttcgtgttcgtgaccacaacagtttacgctatctctagcggaaggcatcctttagcatataaagcatcaattatgtgctggcgtgtgatgcattaatttgcattaatttgccacagctaccagagaactactactaactagacttctccaacagcactgtattgacgcattgaatttaaaacatatataaagcatcaattatggtatactgctatactctactactggccagcagcagccccattttccgacaacgagttccatatatatgaagtataataatgtgtgtgccttaatttgccacagctaccagggatttctccaacggtattgcgttgacgcattgatgatgacgggggtctgtcggcacacatcatttccttataaattcacggttggaatgaaaccaaaccaaaccaaaccacagcaatccttcaccatcctaagctagccaagc

SEQ ID NO: 10218 - DNA, 1219 bp, Zea mays
aattggttaatagttaggtagttatttgttagctagataattctactaacaatttttagccaactaactattagttcttgtgcattcaaacacccccagtacgccagtttaggttcagcaaatgagcaaatctgattcgaaataaatgccagcacaactgattcaattctgctgctgtaagaagccaagtctaccatcaattattctccataaaaccttatcaagaaccttatcatcgaacagatagcgtcgtaagctttccttagatcgtaaaacctttgcaaacaaagaggaaacgaaagggattaccattccaccaacaagaacaccaaacaatttcacaaaactgtatcgtacatgaaaccaccagaggcatgccaacagttatccaaaatcctatgccaccacaaaggggagccgaggatgggagcagagcagaaaaactgcaccttgccggcgatgatgatccagcagtccttggtgacgttgtgcttggcgacttcctcgaacccaaagaccttattctcgctggccatggcagactcttacgcacctgagacaaaatccccctccgaaagagttagtccttcgcagccaaattccgaaaccgtactgaatcgagccatggagcgttgaagcggaagcagctggattgctagtggttggccgatgggcttggctcaccggggcttcgcctcaagaatcaagatggagctggaggccgtcgggaaggtcagccgtgagctgtcagcgtgtgtcgcgctcgcgaacgggatgcggaatcacgcgatctggacagcttccgccctcggtggcctggccccgatatggcggcatttgagcccggtgcgtcccatcccattcccctggaccccatccgtctgcacgctgcagtctgcaccgcacacggctctagtgtgtggcgttccaaaatgcccctcgacgagagccagctgctggacagggccctttttccatcccgtgctggacttccaggcccggctcggcccataatgctatgagaggttgtcactgcgttgacacgtaagctttccccctccccttccgctgacgcgacgcccacctcggcggctcggcccgcgctggtttccgtccgttcattgcggtgcggagagccggagacagaccaccgggccgtgcgggcgctcgcggctccgctcccagatcccgccgcgcgggcaagcttcgaggagtgacc

SEQ ID NO: 10219 - DNA, 684 bp, Zea mays
tggtcactcctcgaagcttgcccgcgcggcgggatctgggagcggagccgcgagcgcccgcacggcccggtggtctgtctccggctctccgcaccgcaatgaacggacggaaaccagcgcgggccgagccgccgaggtgggcgtcgcgtcagcggaaggggagggggaaagcttacgtgtcaacgcagtgacaacctctcatagcattatgggccgagccgggcctggaagtccagcacgggatggaaaaagggccctgtccagcagctggctctcgtcgaggggcattttggaacgccacacactagagccgtgtgcggtgcagactgcagcgtgcagacggatggggtccaggggaatgggatgggacgcaccgggctcaaatgccgccatatcggggccaggccaccgagggcggaagctgtccagatcgcgtgattccgcatcccgttcgcgagcgcgacacacgctgacagctcacggctgaccttcccgacggcctccagctccatcttgattcttgaggcgaagccccggtgagccaagcccatcggccaaccactagcaatccagctgcttccgcttcaacgctccatggctcgattcagtacggtttcggaatttggctgcgaaggactaactctttcggagggggattttgtctcaggtgcgtaagagtctgcc

SEQ ID NO: 10220 - DNA, 381 bp, Zea mays
tatatatatatatatatatatatatatatatatatatatataagaaggaacacgtatggtagatgattccagatgcttaccatgcatgttatcatagagttaaaatgtctgtgtcgcgtaacatttctgaaaataatttcggaagatgaagataatgtttctgttacgtaattttccgtcccttgttgttcacatgtgcgtacccacgtgtcagagtgagagatgtaccagtataaagaagcgcagagcccccaagagccggagctgccatgaggcccgaacagttgaagctactagcgtgtagctagggaagagaagcgcgcgagtagctagcagacgtacgtaggcagaagcctagctgggtttgaagggccccgatcg

SEQ ID NO: 10221 - DNA, 1500 bp, Zea mays
gcgtcaaatattttagaacagagggagtagttaaacttgagagattttattttagtccttggatcacattatctttgggacagatgtagtaatttaagctaatgcagtaatgctttaaattttgttgtgcttacggttatcagggttctaaacatgagctattcacaatcttgatcattgtttccttttctagaactttatggccgaagcagctgccgcctcccctggtcacagttacgacttcattccatcatatttgccagcacccagatctgcccaagctgatatttttgcttcccctgagacaagtgaagtgtccagtttgccagaacggcgcctgcaaatgatttactgaatatccccaacagttttgtttctgcacataccaccaaagatagccaagcaccaataccggcaacacaggaatataccagagagtaaattgagaagatgttttgatatccaccctgagactatgcaagctttacaatttcaaccctttcatctggattacttctagactctttgttttgttgtagccttgattcattccatggattgaaccttagaaactagagcctgagcatatgcttctgtatatggattatggaagcaaagttttggttgattcagcgaaggggtagcacgatatgtgtgccgggatgattgaacggttgcatttcaccgaaacaaattcgtaaacctttgctccatgagatacctattgtttgttgtctgttagctgctctagtgtcacctgttagtatgatgaatatttgctggtttactgggcctggcctgggtgctgcacaaagtcacctcctcgagaaaatcagggtaggtgtttctatttttctgttgtggcatgatgtggaagaaaacctctggtcccggacgtgaggctgcgctgaaacctctcgcctgccctgttgggcatgcgggcattagagagggaaaacgccgcgtttgggggttccgctgcaaggcagaggcagacgcattcagctcctcgttttttctctctcctctcttcgtccccgcgtggagaaggagagagagaaacaggggagcgccccccactcctcttcgctgccaagaaaccaccattcctaacggatttctacccagtcttctttaggatttccgattcggttctccggtgagagggtggtatgcatcgtaaaccgtcacacttatcgcatttttttttgtcgtcgaggatgtgacctacgttatggaatgtggaagtgtatttttatgacagttttgattttcttttcttttaatcaataacaggaatcttgaccagcgtgtgccacgtaataacgttgctgacttgctgcaccttttttttgcagggaattttattttcctccgctgcaaccggtgcaaacatttcgaatccctccattccattcctctccgtgcaatcggccattcatatgctctttggctgcattgaggcatcggtacgcgaattttgatgtgagctgaccagac

SEQ ID NO: 10222 - DNA, 391 bp, Zea mays
cgtggggggtgagagtgcgcgcatctgacggctgagagactctagagcgtattggatggttgagatcgtcggaaggcagaacaagcagaggcagcctaccccttagagccttaataggtagtatagattcagtcacgctctccatattggcaaaaccaaacacacggttgaacttcatcaataaaactgtttgttaagttaaaatgaaaaaaaaaacagttttattaagctgtgccagacggacttaaaatattttatcatcacgatcgttgtgaaaaatgaatagagaaaaatgaaatagaatggcagaaaacctaaacgtgaggttggcgaaaagagaaaagaactagagcatcccgtggagagaaggcggcggcagcgcctgtggrag

SEQ ID NO: 10223 - DNA, 95 bp, Zea mays
tgtgaggattttgtggcgtgtttcggtgatttttctatgggatttcgatggggattccttgatctgcgtttctactggctgttgatgcctgcagg

SEQ ID NO: 10224 - DNA, 274 bp, Zea mays
tttctttttgagcttctaaacgtttttgaatcaacaagagaaaaaaaaaaacgagaggagagcggagagacagacaggagccaaatctacgtctcctgccaattcgcctttctccaaccagcttccccgcgccgcccgcccgtcgccgctcctccccgccctctctgcccgcatcagatcgtcttccccacgccgtgtgaccgaggtcccgtgatccctcccacttctgcgccggcgaggacccgggaggcgggatgagcggctgagcacgacg

SEQ ID NO: 10225 - DNA, 1500 bp, Zea mays
tttagacctctagtacgtgggtgcaataccactaaacacacaggtgtgtactctatacccaagaaaattccaggtaaatagtgcgtcacccagagctcgaacgagcgcttccggccagtggcctttggcactgcgccgtgagcccctttgctctcagatcaagattaatactactaataccatcagatagcaacatctaacaacaaaggtagggtggcccagtacgcaaggaccttttttccctaccttgtggggccatgctgaggtggatacatttagttggcatatctagccattatgtctcaagtcactctggattaggtttggtcctggtggttgccgatatgactggactggcaatggcgatccagcagcggttggtacccctagctaaccagttacttcctcctgccacaatgcctgccttgtgcaaacaatgtgtggcgccgttgcttttctgcttcgtgagtttttcatcagttgaaacggcgggctggaaaaaaaagctagagttcgaccagcacgttcgggttcgcggcgggtcagctcgggtcagagcaactcggtgcttataacgagtttgggtcgagcatatttttctgactcgagaaaaaagcgagataatttagcttagctcgctgtggctcacgagctagctcgaggctagacacaacaataatttattatataaaatcttaattaatatatattatcggcactaaataaacgagtagtttatgttttttaagtttattgtacaaaactaaactattttctatattacattagtaatatatttattttactaatttaaaatatgttacttaaattatttttaagattttatattatattttagagagcgagttcacgtttatggtaagatttattggctcgacgagtcgagacaactttttagattcactagagaagcgaagcgagccagactcaactcgttacttgatcaagccacaagaagcataggcttgtaacggtccctatatgcaagcatgcagagaaactatctaatccgttagattatgatccaaccacaatgtaattatagtttatttagtttttttataaaggtaattagctggtgatgaaagattttaagtgttaaatgttacttacagttgtattacaatctaatgaatgacatattttactttcacgcttatacctcagggcttcagtcgttgcccataggctgatagcataagtgcccccaccgccacctgccgcaactgccgaccccacccaaatttcttcctctcctccatttcctcccttcgccatcatcccctcgggcctcggctctgctcttcttccctccccggctcaccccgccgctgccccgcgcccgtggagttcttcgatcgagtcctcggagcctggagcacctcgtccaacaatccgggaccgcacgagaagagagagagggggtggtttgacacaagtcaggcacccgtcaagattcggctcgatctgctgcgggac

SEQ ID NO: 10226 - DNA, 606 bp, Zea mays
tctagagggtatgttgttggataggtagttagaaaagaggaaaatctgtatgtataatattgtgtatcatgttcctttcaatttctttgatataaacctcaagttaagcatcgtttgttttcagtgctgaaatgagaaattgcaacatgagagtagactggctttgtcattaagatttataagagaactgaggctaactttgtgcatatatgatgcattcactcgatcaaatgtggtttgtttccgccctgtagttatgttatcattgctctattaggtgtctttctgttcattcattcgatcaaatgtggtttgtttcatgtgcatatttcttcagtttacagaaggcctgaatgtatgcttactcatgcaataactcaacatacatgtgtgtgtatttaaacaactaagctagtgtggttgtgccactcgctgaactgttacagtatacggatctgacgttattcaaattactgcaagtctcagtatggtgagtttaggattggcagttggatcttactgggattgcactagcttttgtaccatgatgtgctcttagcatgtttgcaatgaatatactggaattcataccattttagttgtgtc

SEQ ID NO: 10227 - DNA, 750 bp, Zea mays
cttaatttatatttattgaggtggattgagatgtaaattagtttaatttccgtctcaatttatattgatcggacaatactaaaatttacatgcatcattttttaggcaagaaccgaaggaaggacatgcggcgcctcgatcaccaaacacgaactaccagttcacaggatggatgcttctatcccgtcgcatacagaagtctaattaagctgcacctgcacgaatcaaggaaacctgtgttccaagctttactacttggcgtgaaacgtgcgctgctcatgcatcatctcctttttttaattttattttatataaagggccggtagcagtctcgagcaagcctccatgcatgcatcggcgggccggacgggaaaggggtaaatggctagccgggcggacggggcggttgaacggatctgcagccaccaccagcattccagcatcagggggtagttgagagagatatatggttgctcaccttgattgatcatctctctctctctctctctctgctggctttgcgcgtgcacgtttacccaactaaatctcctctcatgcatcttctggtgccttctcgttcactcacacttcagctctaaccctgcaaattaaggaccgtagtgatgaattgcctctatatataaatcacaagagatagacatgttgtctcaacgtgacactgcacgtcgtcggcccactagagctagctagaaggaacagctagcaggcgcccatagaacgagatcatcg

SEQ ID NO: 10228 - DNA, 737 bp, Zea mays
ggaaactacccaacccacccgcccaccacttcttctcacgcgtcccgccgcggcgccacacgctgcaccggtctcacgccccccacgacgccgtggggccctgtcggtggaccaggcccacggttggctcttcctcgcttcctcctccattcctctccctctctctctcgtcggtgggaccgtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgggtccaattcggtgcctggctgactccgcacgtcttccccccttttccctccctcgaccgacgaccgtccgtccaccaccggatccaggagcgaccctccctcgtgctcgtcgacgatcgaccggccgccgatcgtccaggtactgcgcaagctcatcaccgccgcagcttcgctgctcgcttcttactgcctagctggggtttgtggttctgtttcgtaccgcaactgattcatcatcgaaacggaagccgacaccaccaaggccgagcgacttgctgagacggacaaggtactctagtccacgacgaacgaaattgagcttatggattccctgttcttctcaggaagg

SEQ ID NO: 10229 - DNA, 531 bp, Zea mays
tctgaaacagcaaattaaggatctgaaagaaagcagcagggctggggcatgcattaggtaccttggtttccatacttgacagcagcgtgcagagcgttgtatcccctggccccgccgtattccgacctctcgttgcgcagcagctccatgtagatgctcctgaaacctttgagaaccgcgatgaacatgggtgactcgtcgcgcgcgttgcaggactccgagagcgccggctgccggtggatcagttccagcgccaggtccacgtagccgttgcggatcgcgtggtgcagaacgttgcatttgccagtgtcttgcttaagaagatgctccaccagcagattatgcctcgagtagtgctggtcgagcagatgaagggccagagagacacggccgctcttcacggcgacgagcagcggcgtctcgccgtcgtcgttggtggtggagagcagagacgacgggccgggacgatggagacgcgactcctgcgccaggacctcgctgcagaagttctggtggccgcagagagccgcg

SEQ ID NO: 10230 - DNA, 323 bp, Zea mays
cgtagcagtgaaagcctcgtgccgcagcgagtggcggcggaggcagcacagcaggcaggcgcgacgtgcttgccgccggtaccgggctgggcgcggcgctgctgctggcgctggggcccgtgtgcggcgcggcgcgtgcggcggacgaggaatacgtgagcgagacgaaggaggtgatcgggaaggtgcggtcgacgatcaacctggacaagtcggacccgagcgtggcggacgcggtggcggagctccgggagctgtccaactcgtgggtggccaagtaccggcgggagaagtcgctgctggggcggccgtcgttccgggag

SEQ ID NO: 10231 - DNA, 1497 bp, Zea mays
ataaattacaggaggctattaaaaacatgtttttagaagttattttttgggagctcttgaatatatactctaagcttactagatagttgtggctcgtgctttgctacgagttgttatatatcatataaataggtattgcgaaatttattaaaatataattattgtttatttttaaaaactaaggtacatgtggtctggtggtcagttctaaagtactcgctttgcactatttttgcgcggcaggatcaggtgctgggtagcacaatagctggtgcgtgggggctggaggcgtggggtccacatgtgcctacattaaattcttaatagtatagattgagtgttcacataaaatacatatataatttaatcattagtttaataagttttattagattgagcgtagaatttatttctgtaaaatttatttacagatacaaatattaatatttttctgtatttttaattataaatttaaaaggtttgtcttttaagaagtgagatatatatttgccttgtaacagaaggagcagctagaacggtcatatatgcatgcatatgcaatgcgtgcatgctaagggtcagtgtattatttttatagttttgaatcaatactacaatatttaacgatactgtgatattgatggcaacaagatgtttggccggtatatgtaaaatatagtttcagatactatgatttattcaaaactatactatttttagagttgtagaaactacacttagaaccttagttttttttcttttctcttacatatattttggttttttaatggagccaaacaaatcttaattctaagcaatactttgattttactgtgataagatagtactgtaatatttatattatatataattataaactataatatttcaaaactatagtattttaaaattgcattaacaaacatgtcctaattggtactcctgagatactataccctcctgttttaaaatagttggcattatcgaattatcattttactttttaatgttttctcttcttttaatatattttatgaattttaatgtattttaaaatgttatgcagttcgctctggacttttctgctgcgcctacacttgggtgtactgggcctaaattcagcctgaccgaccgcctgcattgaataatggatgagcaccggtaaaatccgcgtacccaactttcgagaagaaccgagacgtggcgggccgggccaccgacgcacggcaccagcgactgcacacgtcccgccggcgtacgtgtacgtgctgttccctcactggccgcccaatccactcatgcatgcccacgtacacccctgccgtggcgcgcccagatcctaatcctttcgccgttctgcacttctgctgcctataaatggcggcatcgaccgtcacctgcttcaccaccggcgagccacatcgagaacacgatcgagcacacaagcacgaagactcgtttaggagaaaccacaaaccaccaagccgtgcaagcatc

SEQ ID NO: 10232 - DNA, 716 bp, Zea mays
agtcttttagatagcaataaggaactatatctaagtgctagtttgggaacctcgttttcccacgagattttcattttcctaaggtaaattagttcatttttttttgaaaataagaatcttttgaaaaagatgtaattatcaaactagtcctaacagagagatttttgaggggggagaaaaaaaaggaagttcttctgcattcttttttggaggaacaaaaaatttgcctctgcatactgaatcagaggggatgggctttatttcgtgttggctggttgattgatgattggatgagctccagtaagtttggaagagaacagggcacggtcccgacggttggtacgggtgaagaaagggagtgatttaatttatcgccccaaccacaaccacccatcgatctatagttgcagaagaactcgctaatcttgtcttgtccacaaaagccgcactcacgcactcatccgccactgattttatttcccccccccccccctgtgggcgcgcgcgcgtgctgcgtggtggtactactacctgtttctctcactgacacagttgcgcgcgtcatcatgttgctagtaaacgggacggcgggcagctgaggagtcaaacgagagagagatcgagagagaaagaaagggagggcatccatccaccagccgccggcgataagaggggaggagagagaggccagagaagaggaggagaagaagaagaaa

SEQ ID NO: 10233 - DNA, 901 bp, Zea mays
ttttcccccaacccaacgcacagctacgcttcgctggagtgtccctgtcactgggcatgcactgcacccacaagcttaggctgctagctcagattagctagcctaagcccaccacacgtacatcatccgatccatcattgcttcgttcctaattcagctgggaaagaaaggacacacaaatagaccatatatattaatggaattttttgttgcttcaggcaggggagaaataaagaaaaaaggcgggcgtgcgtacgtacgtagtgtggtggtaccaccggccgtgcactaagttaatgatgatattatgatcgacgatgattctcacaagaaaaggcaacccatgcatggtagtagtatgtagcctagctgtacgtgcatggctttggtcttgagaatccagagtactacgtaccccagctagctagattccctggcatgcatgcatggcctggcctggcctatcatgaactgtacgttgctgcttgacagctagccggaaagcttgcttgcttattggaatatactccctccgtttctttttatttgtcgctagatagtgtaaaattgcactatccagcgataaataaaaaaaaaacgtagggagtatatatcttgcgagctgagaggctggcaacggttgagccaactactagcttgtttgttaagccattcacttcccttgtttgttaagagctgagctacatttattctcttcttcttgagcccctggcctccccctcctgccaggctgcgcattctttctccagctctctgataacgctagccaggcgtcgtcgtcgtgtcttgttagttattagctctatctcgccgccctgcagctgctgatcgagtgagggaattcagcagcagcagcagcagcaggtagcatagcatagat

SEQ ID NO: 10234 - DNA, 1500 bp, Zea mays
tggtttctttagtctagggactaaagtttagttaggggactaaagtttagtccctaacatgtttggttctaggggctaaaaatagtaagaatatactaaatgactcataataaatctaaaatagcctttaacattctcctgctattagtacaattgaaccaaataagtggtaaatgtggaattaatatggtttagtcctttttagcacatatgtgaaggactaaagactaaatcattttagtccatattttagtcctagtgtttggcaaaaaaaaagactaaatgagactaaaaactagagactaatctttagtccctctaaccaaacactcccttaatataggctagaccaattattaaattcaaaaacttgtacaggccttcatactgtcacagtacacacacatccggccggacgccgtcacgttgcctgtcgctgtcgtcgtctccaatcatacgtgagctaaatattaagtgtgtttggtttgaggaataaagtgatccatcttcttctcacttctcacttttttgtttggtttgtgaaatagaatggattgatccatcaccacctcattcctcataagctaataattagtatatacattaggagtgggttgattccaccaaaattgatggaatgaacttatgatacatcagctcatgaagcatagagtaactctacaaaccaaacacaccataaaaggaagcacttccttttctctctttttccccatgggttactaatctcctccgcggatcacgcgcaaagccgcaaactgactcacaaacgccatcgcatcgtatagaaaagaagattaaaaarggaagcgaggaggaaaarggcttgccagtttcatcatcatcgatcgcgttccacgtaggacggagtatattcatcggagccgttggcctcgaacctctcgctatccatatccatcggttccatatgatgacttcccggcggggatggataactggcgagacagtgcctcctcgtcaggcgatcaggccgatccggagcgcgcgggcggagcagttctcgtgccgcaagcatatatgaggcatggcaacacgccgtcgatcagtggcgttgggaattggaatcttccacctcagcctgtaggcgcaccccagccccaggagatagctagaggatagcgacggagcttattgcctggcatgacacaggcacagcgcacgccacagctagcgatcccgcgtcgtcgtcctggcttcctccctataaaaggatccggccggagacgcagccacgctcaagagtcaagatacatcagagtagctcattgcatagtttcagtgtgtaattatatatttgtctcctctagtgcagtactagagtctagtctagctagtttagattgagtctgcttgttcatctagcgcgtgttttggggtaggtagctagctagctagacacgcgcacccggacaaacgcacgcagcagacaccaagcaggaatcatcggcggcaggcggaggg

SEQ ID NO: 10235 - DNA, 131 bp, Zea mays
cctcgctggctcgctgctcacctatttcatgtagggggtaggtyttgggtctcttggctcctccatttcactcgtattctatcagctagctacccactgtcgccaactcgccgcaacaaagaaccaccatc

SEQ ID NO: 10236 - DNA, 122 bp, Zea mays
gagtccaataatgacaaacaaatgtgaaaaacacgatgttggcagtctcatttttgtaataacctttacctactggccataaccttggccttctccagcctctctcagttgcgaacaacctg

SEQ ID NO: 10237 - DNA, 1500 bp, Zea mays
caccagttgaacgagaaccaactaaccttgagtgcgacaaacagaaaaggatggtgtataaatcatattgtgggcaacatcctgcagatacaaagtgtcagcaatcataagcatgccaacgaagacccaagattgattacttgtaaggggtgtttggttctagggactaaagtttagtacatgtcacatcgaatgtttggatgccaaatataagtattaaatatagtctaattataaaaataattatatagataaagactaaaaaagagacaaattttaagaataattaatctatggttaacaaatatttaatgtagtatcacattagcggattttaaagcaccatctatgattaacaaatatttaatctatgattgattatatagataaagactaaaaaagaatgtatgtgattatggaaagcaccacctcttgctgtataacagaatctgaaacggagagggaaagatgcgtgtaaagagattgtgatatttagaagcaacagatggaatgctttgcttgtgttggtcgtcatcgacctaaagaaacaggtaaaaattgtgcatcaaacgtataggaaaggaaggaagcatgattcatttacattaggaaccatgggacacagaatgaataatcaggtgaagacatacaactacctagccactgaaatttgtgctcttgaggacttgcaataagcctcaaaaagtgtggttgtgaagctttagggcctgtttggtaatgcagttttaaaataatataattttaaaataacacagcttataattatacatggcacaaatgctacaatattacattaccatagtaaaaccacgctattgtttaaaatcgaaatgtattttagttacttaaaaaacccgaaatatttgcagagaaaacaaaagaaaattaaggcactaagtggagtttccaaaactcaaaaataccatggttttaggtaaaccatagtatttaaaactgtattttacctgcactaaccaaatattttttggcttccaataacatgatatcattaaatactatagtattattttaaaactgtaaaaataataaacttctgatacatgttaacggggcagagaagcatgcagtcgtgcaagtcctgtgatcctaactgattatgcactccaatgggctgcggagcacaaaggggagaaaaacaaaaacgagtgggaggtggccgtgggccatgttgctgctgctgacgaggcggcgcgacccatagtaaaggcgtacaacagctcacctccctcgtccagctccagccgccgtcaggcttctgacgcaacttctaactccgttcgcctccaggcgacaccatcgcccgctggcacgccgccacagcaggttaacacaattaatatgccatagatcttggttttgctagaaattaaggcggtatatttattaatcattaccagcaggttaacacaatttgacccggagcttagttaaatcctgcttccgccactgcggacaacc

SEQ ID NO: 10238 - DNA, 495 bp, Zea mays
cgtggtagggtgtagtggtggagggtgttatttataaattacaataatcaaccatagacattaaatttgagaaatttgagataggtagtgatgatttaatatatgcactatgtacactaagctttcatgtgtaccaaatatattctttaggataaaatagatttaaaattaaagttaagctcttccaaacaggactaaagtaaagctgtcagccaatgtgacggaatttggtacgggagcctcacaccaaaccaaacgaaatccttgtggaccagacagcacgggaatggcgtggagttgtttgtggccaactcagcttgcctctacaaactaccagacttctccagacggatttccctccaaaagccgcacagcagcaaccgccggcgcgcgcacctcacttccatgatccatcgcagaggagagcagcagccagacgtcgcggcgtgaccgtgactccgtgagagcgcgcccgctgcactgcactgcatctga

SEQ ID NO: 10239 - DNA, 1500 bp, Zea mays
tctggtgtcctccattgcttgataccgacccggtttaagtttattcagcaacttgctgcattatccaagtattaacgcacagaaggaagatctccctttcaaatatcaacagctagaacaggttacgctatgcaataaaatattcagagctacaatattgtacttgtgggaagagaaatatgcagtcaaacattcaatcccatgaagcacctggaataatttaaagccagtattgaaacagactctcagtggacgaaacaaataaatgattgcgcaagatggacgaaatggtttggagttcaaatgagttacagattcaaccttaccatctctttttatatatgagttacagattcagccttaccattttacatataaaagacagatagatacacacacacaaaaaaaaacaggctactataggaaaacatcccacatttttcttacttcacataaactagttcttcttattgcagatacacagactgcttgttcttaattcacacaaactgcttgtgactcacagaaacaacatcttggttgttacatctcagaaacagctgtatacacaaattgcttgttcttactacacacaaactgcaagtagcttcacagaaacatctgtacgcacagagaaactaagaacttaagcaccaggggaggcgggaggatggagaggggcggcgtgcttccgtgggagcaccaaagcagttcctgcgccgagaaccacaacgaactgggcggagtcgtgcgagcagacgatggagggatgggcttctattggggttgctcttaggcagacaggcaaattgcgcgttggttgcactctgcttttttgtacaagtaggttgtgagagatctgacgaggctggtcttggattccacattactatatacagtattatattgcataaatacaagtatgggttaatgtatccgccgtattgttattattaggcaggtgctgtacgtgtggagccgtagagcgaagcgaagcgaagcgaagccgtcggtttcggttggttcgcgacggtgcgctgtcggtgccgacggtagttacgccgacgtccgtgccgaactaaccaaagcaccgtaggttcaactccgttcatttatttattactttttctttggttttttttctgtttctatttaagcacgagacaacaacaccgagcagtggcctacaaaatcactgcttcaaagtaccaaacgcgtagcagagccgtaaaagtggcctacaaaatcactgcttcaattcaaagtagtaccatctatttatttacagcagaatagtaaaagggcattaaatattgtgccaaaaaatactagtagtaattattatcgcttttgggacaggccggaaggaagcgtaaagggtagggcggtggttggtgacagcagcaggcctccttcctcctcgctcgcggcgcctccgcctatacctgttgcggcaggcaacaaggcagcagcggagcgccttggtgatctacgaagagg

SEQ ID NO: 10240 - DNA, 1500 bp, Zea mays
ttttttgtcaatacatctagtgagtttggatgatcaagcgatgcgcagccaaccaatcacaccgatagatataactttttccttagtttcaagggtagttgttcacatttgagtcagcgacggtcctaacattttagggacccagaataaggttttaaatagagactcttcaaattatttttaatatataaatgttactaattaaacgctcaaaatacatctaaaaatatttatatcaaataatacataaataaaaaatatatattatagtattactttgaaattttcttctaacatatttagatattcattactttgttgatgagctattggatcacatgactagaattggaccttatgaattcgaggaccgaggcgaccgcccctctaccccaccctcacggccaccactgatttaagtgtaaaaaatacactctattgcttagataggtgttaactcgcctaacgaaaaaaaagaaagcatctaaataggactatgagtatagagagtagttgcctcgtttgactgacagcctggtcttggactcttggtggaagctggatcgctagtctttcttggtctacaagacaaacaacaaatgaggcaaatggatatgaaggatccttttgctttgatttctttgtagtccgcgtagagtagtacgtatactcgtactaccatgcatgtgtgtttgtactcccgcatagagtagcagtctagcacggctatttcgtactaccatggatatgatccacgtgggggtgtgaacggaatatttcaactcaaacgttacaagtattctaatcaggtgcttgtacgtgtcatttttatttatgtttgagcagtataaaacataaagattggtgtgttttgttggctaagtaggtgtaattaaagtcaacaactatggttcaaatcttatttatgtgtaattttaggttttttataatatgaatggaagagaacaggtgacacacaataatagtgaaaattgattcttttttatagtagagtataatttaattaaacatattagtcagttttattcatgcatgtatctagtgggaaagtgaaaatagaaaaacaaaattgcaagatttccatgtctcagtgagacatctgatgcgtgtaccaatttcgcatcacaagtagatacagattttagcgtgcaaaacgttacacgtgagaaccctaatgacacaggctgcttccaaccataagaaaaaaatcacggggtaattaaaaccattcgacttggagaagaagaaaggacctcctgggtttctggaagcccggggaagcaaggctccttccccgtcactgacggggcggatccaccagtcctgtataaaagtccttccccaaaacatccgcctcacttccaaactgcaacgaaaacccacgtctaaaacaggtggcccaccaacgattcacttccccgatcccagggggcggcgatcggaattcgcaacttctcccacgcggcgaacacggcagag

SEQ ID NO: 10241 - DNA, 990 bp, Zea mays
ttttggatggtttttcctgtgttacctggtaagttctaatttgcaactttattttgcatgattaacatttcagttcaactactttagtagttatcacttatcatttagcgcagatgatgtcattttttgcaattatgtttggtgcagatccacattggtttttgcataattgctgccattgctccaccaattgtatttcatgggaaatcattaacgtaagtttcccactcctttatctattgtaatcaaagtcatcagttgttattggcttgggtaatgtgggtaagcatcattgcgtagatagccagtgatgttggctgctggaaaaggagaaatcgataatcatagattgggattacagaacttttggggagaaaccaggttgatttttgcttgatcataacccatagatggcttacccttttatatggatttctaccttcctaataaacaagatcactatagatcgcaagagattactccctaattttcagatataggattccaaacaaacaacaattaatgataatcgggcatgtgtgtggcaccttgttggatggctggcccttgcccatatgattggtataaggtatatatagttaggttccattacttggtgcttatagttgagaattttctgtaaaaggtctgaaataagttctttcatatgcctctgcaaggtctgaacctgaaataactcagtaagttgattaattttatgctcttttaaatgatatggccagtcatgtgccagttgaagacctcatttttcctttgtaatgtctgaatctgaaatttgacaaaatttaattaattttatgcccttctaaaagaactagaacaggcggcgctcttacgggcgccccatcaagaaaatgcacaacttcctatggctaaggtcagcggctacttaggagtttgttggattcaatagcaatagatatacataagtggtagcttccaggttctcatcacaacgcacagaacatc

SEQ ID NO: 10242 - DNA, 547 bp, Zea mays
catattggaacttgcttattcttgctgaacattatatgcatatgaagtttaatattactcactccattaaaacatataaggtccattttaatttattcaagtccaacattatgtgtatgtctatatatattagtagcatatgaataaaatacaaaacaatcagcacattaaaactatataaccggttgatatttaaaagctctcatacacaatatggactatataaattcatacacaatatgagaaaataagggccaaatattaactttgatagtctaggcaaaataaaatataacttatactttgagtggtagaaagtaattatttaagagtaaataaattctaataattatgtttatatcatctattgatttgtctaccttcattaattacaatgtgtattttttttgctaagctaaacttttcttgtcaacatgaagataaaatagtttacttgattgaagagttaaattatttttgaattgcagaaaataatagcaaaaattatgaagtcaaagggcagactaaagctgaaatcaacaaggga

SEQ ID NO: 10243 - DNA, 382 bp, Zea mays
tgcatgcctgcagatattttcaggcccaagaaaaatggaagccattcgttcgcgggacttccagcagagcacgacacgtcttgctcgctgctggacaagcactccggcgctgaactgcaatcgagttccgagtttgacctctgcgcacgcagacggcagacagcatcttctggcagctcctcccaagccgaagccgccgccgccgcccctcccatccggccggggccggaccttctcttcatcttcttggtaacacagtaggagtaactttcttgcgtattaaatccatgttaatttacgtctttaatcactatgctccgttttgttttcagtgtaatagaatcttggaaaccactcagttcaatcataagctgtcacacca

SEQ ID NO: 10244 - DNA, 1500 bp, Zea mays
gtttcttgcacctttgcttggctgttaactcttttgtgcaagaaaagtggcatttggatttagttgtggacatattgtaaatcctggagaaaaggggtgaaagaggtatgatcccaacacctagcaaattgttttagttactaactatgttttgtctaagtgctaaggaacctctcaagaagagccaaaagaagttggagaaaagtttggctcaaaagaaccaaacttggaccagtctaagaccaccggactgtccaataatgcatgtctggtgatgcgtacggtcgatgactccactctcaggaattttatttataaaattcactagacagtgaacagtgcactgtacggtgcattagacaaggacttcaatggctctttccacaagcaggcaccagccgccaacaactggctgacgtgactgttgtccggtgccatgtcaaaaaaggaattatttgtttagttgatttagttgattttgtattcggtggcattgtagtgcgttgtcgagctatattgttcattattcttgtatgcaagacgtagccgtcgtctataaccagtggccaaaatttggattatttgttttatttttattgatatacgtcgaaacaaatataatgatagaatcttgaaaaccagtacaaaacactcaatcgaacccgtatcccccgcccctagcccgccagcctccgaactgctccccactcgtgggccgtgaccgaagcgggccggaatcccaccgcgtccatcgtcacacgtgacgatccacaagcgatgccaacgtccttcccgtgcttctcctttccacaaggttccgtgttccgaggcgattcctgtatgcgcctctatggctctatccctatgaccctatccacctatgcctgtgcctcgacccgtatataaatgggtctagataaatagatacgtcacgacggcacccgttcccatctcaattcacaacgcatctccaatctccaagcggcaagcgcagacgccggaggaagaaagcttgaagcagccacggcaatggcgtcccggcagttcttcacctacgacccctacgagttcgcgtacgaccagtactacaacctttacgagccttactacctgcggcagtccgcgcccacccgtcgagctagagacatctttgcgggtgccgagccggcggccgcgaaagcgagatccacgcccagggcaacggagtcggagacgcagacgtcgttctcaatcccagtcaacgggcctgactcgccggatagggctccctctctggtggtggaagctcgcacgggaccgatggcgccggcgatgtcggcggaggacgccgcggcacggatgcaggcggcggcgcgcgggttcctcgcgaggaagtcggtgctggcggtacgccaggtggatcaagaggcggcgcaagtcgcgggaaagatggcgtgcgaggcggagaccctgctagcggaccccagggcgcgcgtcgccgtctgggaggcgctcatgagg

SEQ ID NO: 10245 - DNA, 99 bp, Zea mays
gatccaatttggtcggtgccttcatatcttctcaggatatcgatacagctccacataattctctctcaaaggaaatgttggatagcaaggttcagataa

SEQ ID NO: 10246 - DNA, 408 bp, Zea mays
gatatatcataaaatatatttcagtaatatgtttatctgatatcataaatgttagtgtttttatagagttaattagatatatagaatagtttaacttttacagattctaggaatttttttttactgggtaatgtaggaccggagaggatatttctatagttcccccacgttttgaactaggcctcttctctgaagatattgactttttcctagccatcttgttcgctgaaaaacgatgaacttttccacgtggaagacaaaagaagttcaagtccgcagcttcaccacccgtataaacacaacacaaaagcccccattttgactttgacattgacctttatcccccataaagcttgagcagaaaccacgaactctgcaggcaagccaacgccgcaggctgcttgtgcg

SEQ ID NO: 10247 - DNA, 1321 bp, Zea mays
tgggcgttgcgctagctagccaccgcctggaccagagggtcgattgctgatctgatgatgtcgacgagtcgaccggaggcacgaattgaaactcggatcgcagcggtggctgcatttatataggcgagaggcggcgacgcgagtgcttctgcggatccccttccgacgttccgacttccgagtgtgccgagtagagggacgcggcggcgctcgaggcttcgtggctcgtkcgtgcccgccgatggagtctttgcttcgccgcgttttgatgccacggagaattaaaaaaaatgggagaaggttctatttcgacttgacctttctacggcccggacgccgggtcaaacgggaacaacaaataataaattaatgattctgccaagttttgaggatttaaagtccgctctcttttgattttttatatatatacagcttattcgtttaactttattctgtatcaatttataatatttttacaatattttgtttttatagattatgattgcaacaatctaaatagactgatttagtctgaaactttgaccgataactatacactactactagttagttgtagcgttttacattgctacggttacacgtgttgtggtggtagaagctgctcggtttgagcttaacatcccagtttcgagtcctgctgctctgtggaaggatatagaaaaggtatatcaatgttttttagtagttttctagtgcaatagcaatttttcgttgcattaattagtcgtccaattttggttgtagggaagacttttgactgactttgttaagggcatgtacaacctacacggtactccaagtataagacacaattaaaacacaatataatgcagtggtcatgtataaaacatgtgtcttaccatatttattgtaccaatcagagcattcaataaattaaagtgaccaatcagctaatctcctgtctcgaacatagagctaagacactatgtcttcgtcaaggtacatgtcttgagtttttttacattcaccctcttagatgcactctaagacacaaattaagacagccattctctacccgcgggtaactgctgcacaaggaacaaatcgctggaattggtcccaccagtggtgtctgaccagtgtgcctgccatccggctgccaaacgagccgagccggtgagggttctcgttcctttcttccccactacaacatctgtcaccgtgaaatctcggctacctccttctgacttctggtacctcgccgccggggacccaactccgatccccaccccaccataccaaagccaccgcggctgcggctgcggcttccgcatcatca

SEQ ID NO: 10248 - DNA, 417 bp, Zea mays
agtcccgtcgctgccctccttgctgctcgtcgaacttctagcgagctgctccgacgacgacgcgggtcaagaccgacggtggtgggtggagttgaacggcccagaggaggacgtcggggcctaggtttcccgtctaagcgagtaagatacgaaataggtactttttaaaaccccttctatttacttataattaatccacagtacaaacctcataatcacatgtgtctgctcagtgcctccacggctccccaaaccacaccagccgtgaacgtgttaacttcacttttggaggcgctccacaagaacctgcacggcatctaccttacagcagtccttttgtacgttcacgggatccaaggagcaaaaaggcagtagcagagcacatgtcaacaaacacaagtgacaaaagaaacgagg

SEQ ID NO: 10249 - DNA, 1500 bp, Zea mays
ataggttattattgcagtctttcccttttcaccctttgtgaacaaagcattcgatctcaagccacagaccaacacattgcagagcactttcctgaccgcaaagcacagatcgacaagcaacgaactcccgtacgttttgcctttctattagctacacatgcgtcaatctatatccttgcatagccaactgaaaactggaagataagacacaccgggccaccaagttcatccaaccatccaagcccaaaggtcttctgtgcagtaatagtggaattgacgatacatgtactacgatgattgcctaatggaaatacatacattaccacgaaaagtagcctgtcttaataaaagacaaaaggttgtagtaaatgcaaaaggataaaaaaagtgcatgggtttgtttctagtgaatcacaaactgtggggaaaaaaaacaatcgcaattaacagcttcgttttcatcttttttttttggcagtacaagtagttggtgtgaagcaatagactcgttacgcattgcagagagctctttcatcctgatcgcatataaaggcgcgcagtaatggatagaaaagcaagttctctttatctatctacgtatgtacgtctctttgcacgtgtgcgccaatgatctcctctctgctgcgcgcgaccgaccgagggatcaatcgacaacgtggccagctgaagattcataaaaatcaccgaaagtcaatccgtgtgcccaaagcggcaaagctaacccaaaggtcttctcgctacatatatacggacagagagaataattggtgaaacaataattgatatataccactcccgttctcaaatatttatcactatctagtttattttgttagttgataaataaaaaacagaaagagtactgatatacatatgatatactccctcggttcactatcttaaagtaatgaagtggtaacgaagttttgtccctaaatcaaagttttaaaactttaactaacaatatctacaaaaatatttttttaaaaaaataaagaaattatatattgtgcttagatgttttaacagtaaataaaatagttttatttttatttagtcaatgtttataaatattttgttattaatagtcacagtttcaaaactttgatttaagataaaccttgttaacctttaagatagagaacgagcgaaatactcatctcgttccttagccaccagcactacgtaatccactgtctttatttggaaatcagctgcatgcatgcatgcatgcatgcactgtacacgtgtcgttatcttttgttcttttcctatctataaaaaaaggacaaggctgcagcctgcaggcacacaacacaactcgttcgtcatctccaacagcgcctatacacgtgcgcaactgcgcatgcacatcttcgcagttgcagctagtacagtacaaccacaccgctcgtgaatatttcacctcctccctccccgtttagttcagccttcagcgaccgagagcaagcaaccgcc

SEQ ID NO: 10250 - DNA, 67 bp, Zea mays
gcagaaaaaagcagcctacgggctgcttttttgtgcctgaaatttgtctatctgccggtatttgtcc

SEQ ID NO: 10251 - DNA, 1500 bp, Zea mays
cttagtaaacaagttagtccaagatgttgtgttggacattcaatcaccaaaacatgtagaaatggctaacttgcccatttgacttttagtgttacccttgtcctgcagaagtcggcaggcatagctctaatcatcgaagcgtggtgggtcggtgcttggatacctttgtatgcttatttgtgtttaagcttgtgctttgttctggtaaagtttaatggacaatatgaatagaactagatgtgtatggtttgatgaatgaatgacttgactttctgagatgtgattgtgaatttgaatggttgtatgagctatggtgatgaattcaaattgttatgtgatcgatgggtgtgaattggatatataatgtacgtgaattctgatatatattatctgcggtttgttgtgctaaaattggataagaaatcaggaaaattggttgctatagcagcaccacagaataatttacatcggctatgatcaagccgacgtgagctaagttgttactataatagaataactcctattagactaaccatagccgacaggagttacgatgctgacgagactctgtttcccttaactctcgtcgatcgaggaggttgacagggagttatggttgaacacaaccacccctatcggttgctagtgaccaatggaaatcaattaactctgttagcggcccactgaatttaataaatctccgacttaaacccccaatagacagaaaccgacggatattagcccattaccagaggaattaattattcccgttagtaacactctaatttccgtcggcttgtgactgtgagttctaaattaatgttgtgatatatcttgacgtagttgggttgatttttaccaagtgcaaaaagttggaagttgagacaaggagttgttggaaaatacttgttaatctttctaaaagaaatcaagattacaatgattttagaaacccttggaagatgctattagccactcctagggctagtttaggagtccaaataccggattcaaggagggtattttagcccctccaatcacatccggttttgtgtctcccaaactagccctaatgatagacatgaccatctacctacttaactgcccaactgatcattacaattcagaataatcacaacaaatgttttctggtaaaagcattcctaacttgatgctgaaataaaggcagccatttcttggtggaagtggaagcggaagcgcacgagctttgaagttagggtatgcgttgacgcatctcctttatgacggttctcagcggggtacggggcatttgtttccacgaaattcccgaagatttcaaccttcagcactcttgactccacgtacgacttgaagttcgtggcgccagagaaagactgaaatatgaagtataaataaatgcttggatggactgagctctgtgtgcgcattattgatacgagcaagctagcattcttgcgttgctagtaaatcaagagctcaaggctcaccaggaaagcc

SEQ ID NO: 10252 - DNA, 999 bp, Zea mays
ctgcacacaaatttttgcatattatgtatgtgaaaccaacaagaatttttttgcatactatgtatgtgagatcaactagaaaattgttgtacattttttcctgggcctctttagatccttttgttttaaagaaattaaaatctattttatagattctgctattttgtttaaaaaattgcatcttacgatttttcaaaaatcaaatataaatattaatctatcttaaatttgacaacaactgttgtgtaatcaagatttttctataatcgttgtgcaatcgaactactaaaaacataaaaatcgatgtacttcattatttattgtatcaatatataaaattttaaattctaattcacttatgttaaagataaaatggagataattttatcaatagaacttttttacatatcttaatatatggtgatttaaaacttaaaatttgatatatttatgtactaaataataaaatatatttacagttttctaagattttttaataaattttaaccgtataaaggtatgtaaatcttaattgcataatatttttgtttttagaattttagaacaataagatacaaataattacatagattcttatatttacctacaatttatcctataaaaaataaatatattatctatttacctatcgtaataagtaatatcttcgttgtcgaatatttatcgttgtatcgtttatttttaactaaattgagaccaataaaaaaagagtacaattaaagaaatataaaatatatattaatatcagatagatgccgattaatatagattattttccgattcctcccgatttttggaaagcgaaggaaaactttcgattgtatttgtggccgtcaggtcggatgattcctgcttctccgatcctatcacatcgcgcactaccttccagcgaatccatcacggaagaaattgttccccacccaccctagactcgccgccgtcgcaactcccacccgatccccaaattctccggcggtg

SEQ ID NO: 10253 - DNA, 436 bp, Zea mays
gacacacgcatacacactctgagccagctctttctgtcgccccgacgccattgcagtagctcgaggagccaatagtagtagtgtgctgacatcctggcagcccaaacatgactccagtaatccgaattttagttaaaaatgaactaagccgacgacaaatatctaagaacgacgataatatattttaagataggatctagtttaacattttttttgttggagttctctaaactcaacggccgacttaacccatctggggtccacgtttcggatgcccctaatttgaaccgggcctatcgtctgcttgcaaattgcaatgcaaagtcgcacggccgcaccctgcgctcctccccaaaactgaattcgctgcgctgcgcttccctcgtcggccccggcccgtgcgcgggcgtaccggctctacctcacaaaatccgcc

SEQ ID NO: 10254 - DNA, 626 bp, Zea mays
tgcagcctgggattcctgtggcttcatgacaaaagtttctcaggtgaagacaaagccctagacctcctctccggctctccctcccctcttctcccttctctctctcccgggatagccaagggaaagggagaacaaaatcgtacaaaagcacaggccacaaggacaagatcttcctctggactgggggattctcacacccatagaagctgaacctactacactgtcatatcacacaagaagagagcttcagcgtgtgagcaagagcaactctctcagaaaagaaacaactagtcaagagtcaagacttgcctgcctgcctgccctccaaggctccaactctccgaggctccaaagtccaagctacttcggcgtccctgactgggcttgtggtctcagtctcagcccttcgtgttgccgcagagaaccctcagtagttccggtatgtgttctttggctccacacctctctctctcttcctttgcatgtggggttttcagacagcagttcgtgaccagcagatttcaatgacgttcttctgttttggatgcggaaagctgcaggttgctaattaattaatcgacgagaagtaggagggagcgctgatcgtgtgtgtgcggcatcgcagg

SEQ ID NO: 10255 - DNA, 1500 bp, Zea mays
aaaattagactttttaaaatttatcattgtatatcattagtaatgtaagattaacaccgtcgtttgtttatgatataaatatttttaacattttaagtggtgtacttcaatttttaatatattatttaatgtttaaaatcacttgtgattagtaattagtaataaaagtaagtttaaattgattttattgaatactttttcctttcggatacgaatagtatcggatatgtcacgattttatcgaatgttgtcgaatacgaatcttaaaccggatagagaagaaacgaattcggatatgtctatttaacatccatattaaaatcgaatacgaatacggatatccatattagcactttattcgaatacgaatacggatgtttcggatctccagacatccgaatccatccctactattgaccgtattcactttcccatctcccgcccaagatgaccaaaattcccctccaaccttttcctctcggctgctcaccaccgcagacaagtccagtcctctccctcccctcaacctagcaccgccacttgcgcccaccacgccgccgcaccgccgctggtgaacgaatccgtccatcccgtacaccagccatgtcctgacacactgacacacacctggtggaggaggaggcgctacctccgtccgccggcggtgcaggggaggagccggccatcctcagggcggcgttgggctccggcaagctgcgcatcgaggggtcgctgagcttcaagcgggcgcagaccgcactgcaggtggagaccgagatctccatccggaccgctgccatgcccgcgccgggaccgggacccctacccaggggaacccccgagaggaacacacaacaacgtctcaccagtcagccaccaccgtgctccatttcctttctctctctctctcggctcctccgctctcttgcccgagtcgctagcttccctgccccgcctcctcccgtccccgtggacagacagctccccccacctccgcttccatagcatccgagctaaggtcaactcctccgtcggcggagcgagagcggggaagagacgggagggtcccggatccgagccgagctgcgctccccgcgcgaccgacacccaggtctcgtcgtcccatgcagatctgctcctcctcctgaggtaaatcttcgatagttcggtggtttggctgctagcttcgccgcttagacctgctctaggaggtgataagcatcggctagtatatctactagccaccctaaatttggtagattcgccaaatggagtggaatccggcctctcggctcggcggatttccctacacagaacgttcgaaatttcagagatctccgcgcgccaaagcgcctagctgataccaagagtgaacatcgctgaaaaaaattctaatttctatagactcatcatgtgatacccttttgtgttcagatctaaaccgaagcttgagctccggttgttggtggttggtcggcggcggcaggggaggctgcgaag

SEQ ID NO: 10256 - DNA, 80 bp, Zea mays
catgcctgcagggactgctgtgaaatggactatccgttgcggtaaagaagttctatgataccattgaactatctgatgaa

SEQ ID NO: 10257 - DNA, 1500 bp, Zea mays
tttgtttttcacattgacttgttaccagcttagatcaagtcgcaacttttgcatcgacatcatccttctgtgtgtcattcttggtattgcggcctacctttacaagtaagtaatatccagtttaatttcctgaaggacaccagggtatgcctgagtaccactattagggcatgtacaacccacataaatgctctgtatcttatggggtatcaagggggtaagtgcaaaaaaacacaagagacggtattttagtgaaggaacgtctctagcacggttctgagttctctaagtctagatacggttctattagagcttgttcgtttcaccgttaagccatatggatggagtggtattaaaccggtttaaatccatatcaagttaaaatacatctcaatccattctaatacagcccaattcatatggaattagaataaccgaacaagacctaaatgagtcgtatcttgaggggttatagtaattaaaataaagacttagatacattgggttgtacgaaggggtttcttagttatatttagtatttggggaaccacaatatagaatcgatgttgtacatgccctatggccattctgacattttctttagtttactttgttgcagcacgatatttccttcgatgtatgtacggcacataatattgctctctgtttgtggtgtgcagtgttctaaaaaagtgaggtggagtcttcttgccttggaaccgctcatgtcgtggtccctttgtcaccatggttctacccagttctttgagcgatttgtgtgcaccaagccatttgttttgtcttatatctgtattattatggtgtccaagttgaaccttgactaggcttgttgaagagaacgctggtaacatgtttgctatatatctggggagtcgatttcgtagcgaggaatgattacacggcaccattcttatcgtcttatcgaaccacgggctcatgtatattcattccgtcagggctttgtctccattgtttctgttgaatcagtcttggtaccaagagcggcgctagtgagcaatcaacgatgactgctacttctttagcctaatgcctaacgaatgtgatcgcagctgcttatcaggaaagatatatgtagaaagtccatttttaggagaattctgtgcgattcctcaaaattttgagaatattaccaccgtctaattaaggctctcgtgcaaattaggaaattagagttcgcttttgtagttcagtttcgacagtcgtcgtcccctctactctctcggcttccgcagaccccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgcagccgccgtgcctcgctttcgtcttttcccctctgctcgagtacgagcggctactcccggcggctgcggcggcggcg

SEQ ID NO: 10258 - DNA, 265 bp, Zea mays
tcaagagttagtctgcaagccaaacactttaaaaacctcagcaacttcaccgtgaagctgatctatggtgaagttggtgaagctgagctctcccaaataggccctataactgcatacatgcctactaacttttgttttccaatagtcacatgccctttactgtggtgccccctgtatttcgagttcagcctggttcattacgtagcatgtgtgattctttgcttgttttcgctccagatttctggtgagaaatttcactccgaag

SEQ ID NO: 10259 - DNA, 247 bp, Zea mays
gaaaatggttgagttaaagaaaaaaaagaaaatggcctgagcccaaatccccaaagccaagttgagcccagatggccctcacagaatcgcccgatcccagcccctccaccggcgacccattctgctcacttccatgcgggccccagcccgccacgaatccccgttcccagtcccgcctgctccgacctcgcctttctccatctagggtttctctctccatttccaccccatcggaccggagcttcgc

SEQ ID NO: 10260 - DNA, 630 bp, Zea mays
agatcgttggctaacaccatctcccttactcaagtttaataaaaaatgttatttaaatcacctcttatccttcgtccctctcactccttcgctgcgacttcgttgttccctcccctttcctcactcgtgtcgcccctctcgttgactcatcctctctccggtattaccgtattatagtgttagcacggactgccacttagatttggtttacatttttttttacttttgctacgcttaatcttccacatgataaaaaaaacttgccaggaaaaaaacccggtgttctagccgcacgcatctcaaaggtgatactgggcggggcgatttggagatgatgttctagcactagcagcacgcacgcatctcaaggtcatactgggcggggcgatttgcgagtcctgtggcctcgtgggccacgtgcacgcagcagaccgcaggaatttgtgtggtccgcgcctcacttccacgacgctccagcggcatccgccacttcgtcgtcgtcgtcgcacggattggcattggctgccccccggccctgttcctcgtcctcctcatcaattcccgtctctcagtcctcccaataatggtggcgtggtgagaaatccttccgtccggccgtcgtcttagaag

SEQ ID NO: 10261 - DNA, 220 bp, Zea mays
gcgtagcgtgcacaaacggatgcgtgcgtggtgattcggagttgtaaatgattggtgactgaagttttagaaccagaacatgcatgaaatggaattcttcgatggttagcttagtttagcttcatagtttgatcctggattcagtcagttttttttttcctttctagagctattgcctattggtcggttcaatccatttgttgtatgtaaaattgtcttg

SEQ ID NO: 10262 - DNA, 1106 bp, Zea mays
gttcttgattctagcatttgagaacaagtccccaacatatactatctttgttatcggatgtttttcgcgtttgaactaaaccatgacaaataaaaaagaacggaggaagtactaacaatctttaattattcagtagcggtgaagattagaaaacatggatcaacttgtaaaaaaatttggtgacagatatccagtgtctgatataatattccctcccactgtctatatttgcccataaccaaacaccacttatatataaactagacagttgcatgtgctttgctacggttattatatatcataggtattgagatatttattcaagtataattattgtttatttctaaacacggtacgttaggtctggtggttagtctcaaatttacagagcagtggggtgtagattcgagtgctcgcttttcattatttcctaaagcaagttccccgccaactgccaactgtagctgcccccttcgctaaaatttacccttttttaatggatttaccctgcagaactcgaggtttttggtgcatacaagtatttttgttagagcgccgatgggcaactaaggtagtgtttggatgaagggacgaggaaggatgaagagggataggatcactctaatttgactcgcgtttggtttggaggtccagagtcagggtcaagaaatattcttcaaaaacagtggatgaggtcattcctcaaaaaataagggacgttgacactgaaccaaaacactacctaaaggaatacttatggtcttcccactacttgatatataagggccggtattttcacttgcggttgaaaaaatttgtgcgtaacgttagattaaagctcctttttaatgcagatatatccataaaactaaacgcactctaaaaatctcccgtgcggcagtccacatggccgcaccgcctagacacgggtcgcgcgcaataacccaccgatcgagctgagcacgcacgacctggcgctcgctttaaactctcgctctcaatcgtcgtcgcctcgggctctcggcagacagctgcggcggcgtgcctggcagtgaagcggtagcaggtagagccagccagtctagcttagccaccacactagtgtg

SEQ ID NO: 10263 - DNA, 813 bp, Zea mays
ctgctggccgaccatcttcttctgatcttctctccaacagcagctagctagcgagtagcgacgcactggactggagcactgctcctgcacagatatccatgcatatgcatatataatgatgagtgagagagagagcgctctgctggatggccgtcctctggctagctgatgctagggcagtgagagagagagagagaggcctgtgggtgggtggggaagaagagaggcagcagcggtccaggtcgtccaggcacagacagtggccggctgacccacacacacgagagagaatatttgaagggaggaggtggaaggagctgagcctgactgagctcgtggggtgggggtgtggtgtgggtgcatagtgtagtacgtgtgtgtgcggtcatatgtgtgcgagtgcgagacagtgagactggagatagggctaaagagcggcagcctttaattcctctctagctcgcagtctcgcacacaacacatcacatacccggccggccctctctttctccccctgcccgcaggctgagctcccccatagttactagctagcttatattgcatatctcctccccctcctccgtcctcgctagctcgtgttcttcttcctctcatcttttgcttgtcctccattccatcgatctcctattcctgtgccgaccgcgaggccatcgtcaaagagaaacacagagcgggtcggggactctcggggagtcgggggaggctgctagtgctagctagctcgaccatatacagtttgtgggcgcggccggccgggcaagctgctaaggtaccagcataccacccatctcc

SEQ ID NO: 10264 - DNA, 409 bp, Zea mays
ggtggaagaggttgtttgtagatgttttttgttttcatatctgaactgtaatagtaaggttacaataatttttcacatagctgatggaacttctgtttgtgtgaagccaacagatggtccctcctgctaattagaaaccaatttttttagactttttcagcctcctctactgctcatgttgctggcttgtaataggtgggctaggggttatctagagatgacaaggccctcaagttggctttccagcactggatcgaagcgatgagtacaaacgggcagtggggattggtgggttttactgcccattcttgctcttttcatggtacaattatcctgtttttttcctacagtgatgttttattttgtggcaccatctttcgaccataaacaaatacactcactttgatga

SEQ ID NO: 10265 - DNA, 835 bp, Zea mays
gagtctatgttgtaatcgttgatgaatggattataaaaatactaaacaatattctctccgttctaatttataatttatttatttttttacaaaatttgtttgactcatcttatttaactttttttgagaaagtgaaaatttcaaatattatatttaaagtatactatatactaaataacaccatattaaaagtttataataattaaaactttttaaataaaataagctaaacttaaagtaaaaaagccagatgaactataaacggtagcggagggagtaaatgaaatgatatcccataggtcgtagcctatatagatgaaggttttattagattcaccttccttcataatctctgtagtatttgattttacagattaatttttagtatctctattttattttaatatctaaatcgtaaaataaaaagtaaaataaaattttactttttatattaacaatttaaaaatttaaatagaataaaatgaagagactaaaatttagtgtgctgtcttaagaaccaaacacccactcgcttcgtcacagtacgccgcaaagacatcagcccagccttccccaattccggccacacccgctacgcctgtggtgccgcctgccgcctccccttcctcttcgcttcccgtgcaagcttcaccgccgccatctcgtcctctcgttgcgatgcttccctttccgcgccgcggttcctctatccccgccttccctgcccgctccggctcttgcacctgaccaagtccgccaatctgttccccttttccgtacgagggtactatcgccggccatttcgattcggggttgatcggatcagcgtaggctg

SEQ ID NO: 10266 - DNA, 340 bp, Zea mays
cccctgacgcatcccgtatctttgcatgatatcgagaacggttatgcaaatatatccggcgtaggtcatcgtacatgcataataataatatgcatgtgctggtcccaacggtggtctcgctgaatgtcatgttgcatgtctgaactgaacgtgagctgaatgaaaggagggagcagaaagcgaatgacaactgaccagcaaatgccgcctgattctctgacaaaaaaaacggggccctctgactatgaattctgaaatagcaattcccctacagtagcctgcagcttcgtcggtgttttcagcccccagctagcgtgctcgtcctcagatcttgtacgtc

SEQ ID NO: 10267 - DNA, 356 bp, Zea mays
aggaaactgaaaaaattcatcaaaacacacctaaggaacagccgctagtcttcaggaaggagggcagcaaggtatgaaaggcctttagccccagccacttcccaaattgtctctcatccctagctaacctaagggacaaagccaaactaggagtacagccatcaaaaacacaaaagtttcagagtttccaaattgtccaagcccccaaggcaacaagggagttgatgccctttctaggtagaccagtgatcgctccggagatttgctcccaccaaatcatgaagggtgaaagccctggctgaggagccagtctttcaaatccaaaaggtttcaggaggttaaaccagaacactctt

SEQ ID NO: 10268 - DNA, 347 bp, Zea mays
cttatgttttgtacgtcgaagaatatttgctctacttgcaagcgttactgtttaggttacaatttaatagctcagcgtttaacctcatccctcatttagcattaagcatttgacatatagctagctagctagctagttactgctaattacctattctcatttgttttgacatcctcacaagcgacaactcataccatcaaatttctcataatctcatcttgcctcagcgttagctataaatgatgaaacacatcgatctcctacagccgcaatacacactactgttcctccgattaacggaccggccggcgacgtgcatagcaggtacgcagcagctctagctagca

SEQ ID NO: 10269 - DNA, 1500 bp, Zea mays
ctaattggaaccaaaagttaaaaaacaaacaaaccttttgcgtcccttccttactaatctcgaggacgagattatttttaaggttgtagaatttgtaacgccctaaaattctaactagggatttaacttgaaactcatacaaagaaaacattatagtagaaaagaccctcaatctatttgccaaaatggagaattcatcgcatgaactcaaaatttcttttttaaaaatatttaaattaactcttgacatagattatacattagttagagtaaatgggtattaatttgtgaaggaacatttagtttaatacacaaatatatatgtatatatatattagagttatgtgtgtacactacatgattgaaatagtggtcaaaatggctaaaataatttataaacatgtataaatgtgaatatcatctcatgctgggttttctttctttttgtattgtgcatttaactgtaatttgaatttccgaaacctaggttgagtttgaacttgaaacccaatttttaaacatggaaacaaaatggaaataaaaaagaaaagaaaagggaaaagacgcaacctgggccaactatccctctcctagcccatcccgttttccccatctctcgtgcttgggccgccgctcggcccacctccgcctcagccgctgtcctgagcccactcgccgtgcgcacatctttagcacttcacactatcctgtggggccctgcgctagtacctacacgccgcgcacaccttttctctctggtcaccgacacgtggggcagggatgtcaaaatcatccctatcctctgacggactcagcgcgtcgcgaccactctgcgtttcggggagatccaccaatcgattaccccccacgcggactccacccgtggtgcataaaagccaagcctgagatcccctattcccctcatagaatacgacaccgagggcaatcgcagcgaaacagaaaggacgaaggagggagaaaagcttccaccaccaccacccaactttgccactaggtcgccctagccctcgaaaattgtatggtgcgagcagcgtgctcgcgttggtcccgaatccgggtggttgccggagcagccagcctcaggggccctagaatttctcgtcattgcggaactccgcccaaatctatgctccgtcatggactaccgtccctatgtgtcgatcgacggtaagacaactccaattgtttttgccttggtgtcctctgcgtgtaacactgatttttcatggggattttgcgctagtacgggtgatggccatccaccggcggagcaccaccgtaggtcgggttcgcgccgccgctctggaggtcaaagggtagaagcacgcctcggaccattggatcgtgcatcgacgattaatattagatcagtggataccgattcggtggggaatcggggcattgttgtgagatgtggtcgtggcagtcggatcggcgttggacgattaggattaaaacatatccccccattttcgtggg

SEQ ID NO: 10270 - DNA, 1500 bp, Zea mays
acaaaatactgtagaagccgcagccgcagttagattaaagccgcagcgaacaagccaaacatggttttagggtttcctcatcatggtttcaccatgctttgattagacgtagatttcgtagaaccaaccaatcctcaacaacaccacttggccatctcatgattgtgtgtagggcatcactacccccccccccccaccccccctctctctctctttctctgtcaaaatctggtcttgtctccttcacagcaccgccctccttttttttacatacagtacagtacaggagccaaatcactcaccttccccgccgctctttttttcaaccatccacaacctcggcgacgggacgcatgggggagtagcaccgccgtctctaacccggcgttagcaaggcgccggagcgcggattattagggcttggtcccgcgcgtcatcaaggtcgcattgactcagagttttgcctcacattccctcgccttggtttctagcttttcgctggggtagagaggagtattaggtcgggcatttaaacctggcagattttagcttcgtcctggttcatgcgccacgttaatggccgacggcgacctggctggctccagcaacaagacaagcgcgcgagaaaccagcgcgcgcgtgctcgctcgtagtgcccacacctttgtctccatgtgtatgtgtgggggtgtgggtggatgctgattgatagcggcgtcgccatgaatccatgccgcttggtccggattgaccttggactgaaggttgatggacaatacagaggctagtacattttttacagtgaaatctactgtgtgggttaaactcgggtggttactcactgctctgtcgtagtattaactggtcaagtaaggaactggaggaattaactccttttcttctgctcatactggagtaggtcatgcacggcagtgtaaatgttgcctggagccagctgcagatcatcctgtcacctgagtaaattgtggcctaacaactgcacgtctctatcccaccgtttattatttcaaacacatgtcagggtcagaacagtgttgtgtacgtccactgctggtgagctcacagctcactcagcctttgagctgtttctcgagcgtgcattggcggcctctgcactctgcagcagcgctgcagcgactagctagctagcaagctttgctggctaaccaccactgacgtggttgcttttgttccccgtccggcatgctaatcactgtccttcacgtagcaagatgctgactgagacatatccgtggtctttgcagtagttattagcatatacttttttttgttcttgttatttcttgttatttctttttcaatcctcatgagctaaagagctaattaaagatttggtctttgttttggcttcgcatggtcggacacatatatacatgggaccgtggatgcaatccaatgcaatgcaagcagcgcgcattatgaggtgtggtggtgagggatgggcgatggcctttgcag

SEQ ID NO: 10271 - DNA, 400 bp, Zea mays
gtaattgaagcaatcctatgatactggtgaccggtttgattctgaactatgctgcaaatatagtcagaagctctttaccgattggagccatgcagtacagtgtattgtgtacacagagactgtagaatcacccaggccccatttggaatgtggggatccatacagtttccactggatagtactgtttctgtgaaatacctgaaaagttcatgggaagttcgtgttaataattttttatatatatatcttggtggggcagaacagaagcagtcaaatatttttttgtgcatatgtgaaattccagagttgtgggtggtgagagataggatacaatgctgtatgtatttcaggaacttctgtaataacacgagaacattcatcatgtgaaaaatgtaactga

SEQ ID NO: 10272 - DNA, 82 bp, Zea mays
gtagacaatttgttaaaaaaaccttaaagtgcacaaatgacaatagcaccttccccaggttgtgaaggaaacaattgaccca

SEQ ID NO: 10273 - DNA, 1223 bp, Zea mays
cccctggcggctggcgccatggcactggcatcgctgaccctgcctgtccctctccgacgggacgcgccatcgagggcgcccagccgcccagccagcagccgccggcgacggcaaggtgcgccagcgttttttttttcttggaagaggcaaaaggggacgttcattcgcttatattcattcacaccgtacggggcacacaggtagattcgttcactcaactgccgaagcaacgtacgttgagtcgatgacccacaacgtgtcagttatatatgtgctcgagtcgaaaatttagccttcgttcaaccttcaacggttcaaccgcgtttacctgattggacacgtggttagccgacgtctctttccccatctgcgcaactacgggtttttcctgcaatttagtacagcagaaacgtgctaactggtaattccaaaccatgggttgcccggtccaacactgcacgcttcagagagagcgacgaggctcgaatcgaaccaacggaatgctgttactttcaagccccaacgtgagacggcatcgccggcagtacatgcctttttttttcctaactacgagtatatattaacgccccacgttgctatcgtcccgaaagacgatggattaaaaagcacgcggatgcaggcaacgtagactacgttgttttgtggtttgtgtccagccggcagctgatggccacaccgtcttgaacaaatcatacatatacagaaaaagaagaagaagaaaaaagaaacagggcgaaacagcgtcccgacttctaatggagtataaaaaacaaatggtgctttcagtacgtccttcgatagctggacagtggcttcgatatcttcaagaccgttatagcaaccatcagcggtccggtcagggccaaattaactgggaactgatggctgttagaacttttgctgcaggtgactatcgattgcgacgtcgagttgtatccattgccagtttcggtttcttaaccacacgatttgcgtgatcatgaccgcatgtccgcatcacagatttcacaacgccgggttttatttgcgctgggaaactggaaactggagttggctggagagtaacactgggccaaacaatttcgggtccaataaagcccaactcgagatttatttgcgcttcgtgagccgcggcatcagagggaggatttcagccattcaggagggccaccgtacgcagcgagaccagccagcaggcggcg

SEQ ID NO: 10274 - DNA, 1500 bp, Zea mays
aactagacacagacaacaatcccttttgttctgtcatcacatcttgggagctggatactgattactatcttcatgtgacgacaactagggatgatctcatgtctgatagctaccacttgaggcaaattttagtggttctttggttcacttaacaagatgataactcgtaattttagtggttatgatacaatgatttcatccccttaacaagatgataactcgcagtttgcacctggaaataatgtgtttgtgggatctggartgtggctggcgggcgcgcgcacagcatgtgcgacggctactgcgactggtgggtgggcgcgacatgcatggagcggatgggtccagggtgcgcggagcatggttgggagttgggttggtgcacgttaaaacataatgcaaatgtgagtggacaatttatcttatgagcatactaacttgaatcgtattgattcaaaccttagacggctatcaaaggagggcattggggcctttggacatcttctcggttttgtactggtgttacttttttttcatcatttcagagcttacagatggatcagcgaccttcaggtcaagaaactctatctcaatcacaaatctccctgtgacggtgatatcgattgctcacacaaaaccgtcatgtttcagctgtttatcaaaaatccctgcatacgtgtaaaatacctattagatagaaatcagtcattcactcccacttgctctgagcacactagaacgaacaactcagctaggaataacagtagcaaccaatttgaaatctcattgggccactggtcattcatatattcatagatataccattttgtgtcgttgtctggtttttactactcaaattctgcatatattcttataacctaatcaaataaactgtaggtattttattcaaaaaaatatgcaggttttatttcattttcatgatgacgtacacaccgagaatttcattttcgtaacagtataacacacatttgtagataagttatcacggtattatatgtttccgttgcaacgcacgagcactcacctagtatgatatatgtctaatctttatgagtgcaggtgaaccgatcggtgagacggtgacccataccacataggtatggggataaatccatctccgcctacaaatatatgtgacccaacatggttatttttttatattaratagtacgcggggatatttacccattgacccacttcagactcctctctagtgggctttgttataggtgtgggccaggccaggcccagggtttcggaccaaactgtcgcggcgccgcggctcatatcgaattccaacacggcgccgagccgatgagaaagccgcatcttccccagcccacttrtgacctaccgatctagacccgcgcttgccgccgtcgagtcgccggccaggccagccttcaccttgtcaccggcgaaatccacggcggtgaggcaaccggcagttgagagtgcgcctacagttggggggcggag

SEQ ID NO: 10275 - DNA, 1042 bp, Zea mays
ctctagtgtcgacctgcagtagaatactcgtggagaacatgaacgcgagtgcagcaagcctgcaacaggagaaatcagtcgaacaaaactagaaagccaaagttagaaaatactgaggacaatgagcttacactgtagagagaaacatcagcagtacgtgagcagcagcatccagcacagcggcacggagggcaagcagacaagtaacagataaacagaatcagtaaaaggaactcctgaagctatttgaagaagaaaggtattggtagtctaatacggtacgagccaatcggagcactttaatctaaacataatctctttcggaaaaaatgaactcgtcaaaacagaaggtgaaaatcacgacgaaagcactatgagctaactgcgtgcatttcacgaggtttttgcagaaatcggattcaaaaactgctgcaaagtggcaacacaagctccgcctctgatccaaaatgagcacctgcaaaccaacctcgaccgaacgagcaatccagtgctggcgctggcgctgccagaggtaacttacagcgcaccatccttaatctattcgggatctccaaagccctgattccgaagagagcaaccgagtccatccatcggactggaacggaaccctagcaacaacccaatcggcctgactccatgcacgaatcggcgtcccaaacgacgggaatcgaagctggactacaggaaaatgttggaagttcggggggagaagggtctaggcgcactcaccttcgacggtcatcgccatcttcgcctttcctctgcagcgagagcgttgggaaggggaaggagaggggggactcaagactttttttttttgagataatattcgtcccgttccgtttcatcgctgacgaggcacgtgaaggagccaacgcgataagtccaatgccaagactggcacgtgggtcccaccagtaagagaccgtcaacggggcgccgttagggtatcagaaggaagaccaatcaaagggaggcaaacgccatagcggccaatcacttggcggcggcggcggcggcg

SEQ ID NO: 10276 - DNA, 431 bp, Zea mays
cagcctcctctcctgttctcctgtctggccacgacaaccccggttcgtcttcatcgtcctcccagctcgttctgtgatctcgccggctccaatgacatgccttccataatcttccttctgacagttgtacccctgggccattcattatatattgctctcatggcaccgtggctcctgcactgcagctgcatcaccatcattcataggctgccttcctgcctgctgatctcgcacctcaaacccacacacagcagcatgtatgtatgcatccttgcctggtcgtttctcttccacccttcgtttccctgcagcatgctggctctccattactcatctcctcctcctgctgcatgtatggactttttctgatgcttctcgatcttttgctgctgtgtttaatttgttggccggatcagcagaggttgagatag

SEQ ID NO: 10277 - DNA, 828 bp, Zea mays
atttcccctggcaaatattttgaaattcttctatcctttcgcaagctgaccaaggaacaagttcaatcaatcatagatagagtggctgaccgtcttccaagttggaaaactgatcttatgtctagagttggtaggaggattattgtacaacatgtgctcactagtatgattgtctatttggctatggccactgatttcttacttgcacattagaggcaattgataagataaaaaagggtttttttttgtgaaggtcataaagatgtcaagggaggacactgtctgattgcctggggaagggtgtgcgggcccctccatttgggaggtttggaaatttctagcttgaaggaattatgctgggcacttcgtatgagatgattgtggctacataaaactgatccagacaggccgtgggcaaaccttcctatacaggtttctaaaaaggcaaggtctttcttctctactgttttggtttcagaagtgggaaatggagcacacactctgttctggacagataaatggctattggatcagaaaatgagcaatctggctcctagattattcgccatcattcctaaaatgactgctaataagagaactgtccttgaggccccaaccaacagaaagtggatatctgatataaaagatgctttgtctgtcggggccttagtggactacctgaacttttgggggctcctatcataaatagtgcttcagcccgaagtagaggataaacatgtattcagtattgctgcagatggcaaatattcgtctaagtcgtcttatgaaggtctttttgctcgttcaatatcttttggtcattaccat

SEQ ID NO: 10278 - DNA, 1500 bp, Zea mays
aataatcaatctagaatgtgcaaactaggttttgtctaagtgttgttatctctaccgcaatggctaagtttcaatactaaacaatcaaagtgtaaagacaagattgaaacttaaatcctttaatataaatgtggaagctaaagagcaaggtagagatgcaaactctcgtggatgacgccgatattttttaccgaggtatccggaaccacgcaaggtccctactaatcctcgttggtgcccctacgcaaagggaagcccacgtgagggccaagcacctcggtcgagtaactccgtagagagtcacaggccttctccactcgcaagtggtgctccacttctggctcctctcaacgctccccgccctctccactaacgagctttcggccaaaatgctgcgggcctcattccytccggtacacggtggtggccgtgacacaaacgcggttgtcacggtctcgcaaggctctcgccccactcggtacaattacaatggctcgcataagagccgaggggttgtgtgatttttctaaactcactcaactaactasgattctcctagagcaagcgttaaagcggtctaactaacttaatcacttcacaaagcacctacgctaatcaccgagtgattctattaagcacttgggtgtatgagcacttggaaatgtctatactatgccttggtatgttccttgggctcccacaccttcaaatggccggttgggtggagtgtatataggccctgttgggggccttcggtttccgaaggtcctcaaaaacatgatttgacaatgttttccaagtgaaatatgtgaacaggtatcttcggaatcaggttacgggtatacaagtgtctggtcaagacgaagcttgagcgggacgaaaggcgatcatgacgaaggataagatgatcacgaagctatgtgcagaaaagcttcggtatgacggcagaaaagaggaaccgacttaaagatgaaaagccaaattagacctcgaagaattattatagagttattgataaatgtaaagggcattaatgtaattctacatgggctgtgtcccgcgcctataaatagatgaacagtactcccgtactgttcacgctgacttggcattcgctttttgcatcacgcctgtacttttgctttccgttaattcgaaggtacatttataatttgttactacatatttgataatacaaacaaaaatgagttgataataatatttgtattattactcatatttcatgtatgaattcttttttatcatctatcgagcttacgaagggtttttttccttcataaccttcgtccggaattcattatatccgaagggatatgatgttttgaaggacgaaggactttaacatttaacactttttatgttgccctgttcttaattcgaagcatttgagaacaagtccccaacattgggcgcccacctccggtgaactcacgtccattttttgagttttgaacaccttcggcaagcatcaccttcgtc

SEQ ID NO: 10279 - DNA, 116 bp, Zea mays
ggtctgttgccatgtatggatttatgattggttgctctgttttctgtccataattagttgatatggtgaatcgaggacaaatgagtaaataacacaaacttagacatattcttatc

SEQ ID NO: 10280 - DNA, 1450 bp, Zea mays
gcatttgtttgacgcagcatgtcgggcatgtctggctgatgagtttattactcagcatatttcgcatatatctacggctagattacgctacgttaccgaacgcccgagtaaacatatacatagcacctaagcgaagttaaacaaaaaggaaaatataagcaatgatatgatcaacccactagcaggtccaatgtttctctggcgcgaaacgaggagacaggacacatcacgcattgaaggccatgtgagccccccgcatagtttattatcccgtcatggatctcgcagactggttgattgattacgatcgagtgattagccsggctcctcccgcggggcggttggctaacagcaaggttagctgaatgcacccaggtcggtgcggtgctgtgcgggttggcgtcggagtccgccaatagtttttttttttgtgtgtgtgtgttgttcatgccgggacttgcaatccgagagcagtttactggcatgacgcatgcgcgctcccacagtcggtgacgttgattgtgtttcaaatggtctggctggtgtctgtagtttctctcgtgctgttttgtttatagctgaacgagttttttttaaaaaaatccggtagcagtgcaaaagtccaagccatgagacaaaagtatccgccttttatttttcaccctcggtagccgcggaagtattgggacttgggagctttggtactacgtactacaatacaatatatacttcttcttcgcgtaatatactatacgtacaatacactgtactgctgagggggaggcgatcgcatctctcaactgacgaatcgaggcagcagctggcgtggcggccccggcctggtttgtgctgtgctgtgctgtgctgtgctgacggcagcgcggggggcaagaaaatcattttgacgtggttgcttcgtgctcatggaaacatctgcatcagttgtcggtactatgtttagtccgtcacctgccagcgagttaacaacacctacctagctatatgcctatatagcccgttgctgcttcggtgacgggttgcggggcccgcataaacaactgcgactagtatacagtacgatggtggtaagtgtagtacagaactgtacaaagacactacatatatatttgtggtggattttttagtgttttttcttcccacaggcggcagtgttgtgaaagccccgtgaacatcatcacttttcacaatgcaaggcccagtgaagcgtggcccagcaaaacgcatgcctatcccagtggactccacaaggcccaaatatacatgccaaatccgcttccagttttctcccccactggatacagcacacgaggcccgaacaaagcccacccagcttccttctgtctccaccgccgccgacgacgagccgcgcaacccaactcaccgcacgacgactcgcactgatcggagagccagcgagcgagcgagcgag

SEQ ID NO: 10281 - DNA, 127 bp, Zea mays
ggttaatcaaaactattcttttgattatttttgcattccgttcaattccaatgctcatttgctttcaattccactcggtaaacctccacactttgatggaagagactactctttttggagtcacaaa

SEQ ID NO: 10282 - DNA, 1500 bp, Zea mays
cttggattatctctctttgtgcccaaacaagtgtgtttgacttagagataggaaaatgaatttgatttgcaaaaacaaaccaagtggtggcaaagaacgatccaaatatgtcaaatcttgtcaaagactatttttgttctcaattgcattgatgttgcacttctatttgttgctttttgatgtgttggcataaatcaccaaaaagggggagattgaaagggaaatgtgcccttgggccatttctagtatattttggtgattaaatgtccaacacatattaagtgggttattatatgccaaatgatgaatgaagtgcaaatcaacaagaaggtatgtttctagacttagtacatttgttttgggtactaatgaagttacctaagtgctagaaacaggaaaagaaaaagattggaagagagtgcctgtgtgcagctaagactcagcacagtttggcacaccggactgtccggtggtgcaccggacagtgtccgttgcgctaggctggtctccggcgaactggccactctcgggaaactttggcgacgtatggctataattcaccggactgtccagtggtgcaccggactgtccgatgagccaacggtcggccgcgcaatccgcgggcgacgcgtggcccgcgccaacagtcggctgggggcaccggaatgtccggtgtgcaccggacagtgtccggtgcgccaaccagcccgaagttgcaacggtcggctgcgccaggaatggaaggaaatcgcgcaccggacatgaacagtggctatccggtggcacaccggactgtccggtgcgccacccgacagaaggcaagattagccttccaagaatgcctccaacggctcctagctgccttagggctataaaagggacccctaggcgcatggaggagtaactcaagcatactttgagcattctaagtcttccacactccgtcttcgcgcacttgatcgaccgtgttagggatttgagcttcgttcttgtagtgaactagttgtgcttcattttgagctcaagtcttggcttgtgtgcgtgtgtattgctgcagatttgtgtgtgttgcgtcccatccttactcttgcgctttcaccgtgatctttattgtaagggtgagagactccaacttgtggagattcctcgcaagaaaagtgataagcaaagaaaagctgtggtattcaagttgatcattggatcacttgaaaggggttgagtgcaaccctcgtccattgggacgccacaacgtggaggtaggcaagtgttatacttaccgaaccacggggtaaaaaacgtgtgtctcttgtgtgctttacctttgcttatccgtgttcacaagaactcgtttcaagctacttagccattctaacttacataacaaagttttgtggctattagtgttgaatttttataggaacacctattcacccccctctaggtgctctcaattggtatcagagtcgttctcttcacgtaagggactaatcgcccgaagag

SEQ ID NO: 10283 - DNA, 244 bp, Zea mays
tctaaagatagatacatcaacatttgtaaatagacaattgtaacccatgtgacacaattgacttacagacagaaggttgtacccaagcgactctactagaaatacattcgatattgagtgctcgttagtgatggcaatcttgcccaagcctttgaccttgccttggttcccatctccaaagatgatcgtatccagggaatccttgttcttgacataggaggtgaacatcttcttttcccccgtc

SEQ ID NO: 10284 - DNA, 697 bp, Zea mays
gagcgagtgtattccatcccacagtggagattgttgtattttgttgtgtcgaattgctgcccccggaatttgcttgcaataagatagggttggcacgtgtttatactctgtactgttatctcagcacgttacattatacatgtattgagtgagtattgacagtggtgaaagaataatagtgttccatttgaaacaaattatttcagacttgttggcctgatgtaggttcatgaggtctcggctcttgagtcgagttttaattgtgtctatacaaagccaggctccagatgaacatcgattgaatgggtactgtttgacgattgatcagcagtaggacgaagcttcttgggcgaccaatctctgaactaacctataaagaaacaggcgtgaccaaaaaaagcatttagcttgagcagggtgccacatttgtgagctgcaaagttcagaaacaaccgatcatgccatgtgagccacaaagccaccaccatcaccaaccaaacccacttgccttgtgtttcagatcagattcgcctaacagaccccgacgacttccaaactccaatccagcgttgagctcgacagctcgtgccaaactaggccgcagctggaaataccctccgctccacttacctgctgctggtgagcaccgcaagcaccaactcgcgcccaccgctccgctacaccagccgacgccatc

SEQ ID NO: 10285 - DNA, 724 bp, Zea mays
ctgacaccgtgaaacccgatgatggccaagggctccgtctccgctcttcgacgaaacggcccctccaaaatagtcagaacagcaacgcgcagaggtgtgccgtgtgcgcgactagccatcttctccctcggtctttccgttctctaacgcctggacggaactgaagccagccggggtgactggagaccagtaaaatctccccagggccgcccagtcgacggtctcgccggccttctcagaccacaaacattgcgcttgcggcttgccgcccagctatataagtactctcgggaataggcggtcactcatccatcccatctccatctcggagcaaaggcaatccagcaagagtcgctcctttcccttttcgggatacagccagcagaagcaatccggctaacaagtttcttcttcttcttctttcctggtaaggacgagatcccgcggccctgattcgtcgcgttctcctctgcgaaatgctttcgcgaggccactggcaaaggggaatcctctgcgggcctgcgcatttgcggcatatctcggtgacgcccgctgctagcgttcatctcttaggtcataatgcgaagacattgcggtcgcttttaggtccaagatttggtcgttctatcattcgtttagctaagcccaatcagctgctggctaacatagtaacatctcggtgttcgtgcgccaggtgacggtcgcagggctcaccgaagtgacg

SEQ ID NO: 10286 - DNA, 536 bp, Zea mays
ggtatattgtttctttggtggtcgcatcacataggagtttgcagaataactatcaccctgcataaactaaaatttagtaatccttaaagtttgtaaagtgacatggaagaactaccatcttttagtttttagttggcatgtttattccacaatatggaaaacccatagaatttttctactctggtttgagtttcataccaaaacatggaactgttggtctgttcagttattgtttccttgttttttcgtatgcagaattgatttattaatcatttttatttaatctaacttgatttgtacttttttttacaatcatcagtactaaaacctatagtggccatgtcattgattgcattccattatatatatataaaggctgaattgatgctaaatttgatatttaaatttaatttgtatagatacaccaaattcttgctgaaagattggttgctgcacaacaagaaattgcagcagctgagaaagaaaatgctgaaaaggaggctgctgctcaggcagtactcgatgaacaggaaaaa

SEQ ID NO: 10287 - DNA, 935 bp, Zea mays
agtaaactgagtgggctgtgtccctatgattgggccgtgggccttgtaacaagatataagaacaattcagcgtaatggaaaaggggggaagaaaatactaacaaacctgctgtctctcttcgactgctgtctctcttcgactcgttcttcctctgcttcgtcttcctcgcctccgacaagtcaccggacgcccagtccgctgacagcccacatctaggttcggtaaaattcctctcgcgctcttgttcccagcttccgtgtcgctgtcgcttgactcgcttcagcatgacagcattgcaggttgctgtggggattgctgatttactagcttggtgccacagtgatggctagtgaggcgcgggtaaaattatgagcagtagggagactgtcctgccatagtgccatgtgatcctgctcctgttgcccgccgtcggtgggatcgtaaaatatggctctctcgcggcgtcctcggaaagcaggaatgtcaacattgccatgagtggttacgctggtatattcgggctccttgtctttccccggccagtgtgatccctcccgatgtaggagtagacgacactctaaccaccatcctaatcacagcgctgggccccgcaacgaacgccgcccgcctccttcgccacctagacctacacctactagagcaaccactcacttgctcgacagcgtggctagctagccccgctccacgtccagatgacccgagtaggccgggtgggtcgcttcaatttctctcccagttccttttgttggttttgtttgttttcgatgtgggcgcgtttttctgttgcttataatactgtggtcttggcagatggcgtagagggggcagggaacagcgtagaggagggggagtaagaaaggagaggacacacacatacacagagagcgagagagcgagcgagagagagagatag

SEQ ID NO: 10288 - DNA, 1500 bp, Zea mays
gtggccgtgaccgtggccatggttgaggcatagggcatggtggctaccaaggtccattatcatcttcatttgatggacgtccacaagcttagcaccactgacatgatctgtcaagtctgaggctaggtaggacgtattgcctccattggtggtattgctacgatgagagctacacctccaacacgaagactgcagctgtggccacctaccaggctatggtatcgatatcaactagtacatctacatgacgtcaacagatcatattacaagtaatctggacaagctagcagttcagaacaaggggacaaattggacctcacagccagcagggcaggtatgagcattgacaacattggtcatgctgttattgatacccatgttaaaaccttgtatctcaacaatgtcttgtccccatgctcatcaacaaaatggccctgctttcacatagtagaggttagcctatctttgcttgcgcgtgcttcaatgccactaaaattttgggatgaagcatttgctgctgcataccttataaattgtacagtcatcaagttgcttgattatttattttcttttgagaaattatctcaataatatcttgactgttctttcttcaaggttttgggtgtgctggctggcctaacttgcgtctttagaacacttgcaagctgtcatttaggtcagtttgttgtgtttttctagaatacaacaccatgcataaaggatataagtgtcttgaagtattcactggtcttcgagatgttcttgatgaaggtttttttttttcatttgttgagcttcaccctaatgttggtgctagaccaatggccaaaatcaatttgttgccttccttttaccttcatgtatttttgatgactaggggacttgtaatacaattattcctttgttgtctaatgattcatttggcaatgctattaatgaaaattatgaagctactattggtaacaggctagaagggtggtgcacaggtacaacagttgcacgtctgcacagaaatgtgctattccacctcatctggtgtactagtggcgaaccaaaaagagcccatatgaagttggactttgtatagatcgcgcaatacctcaaagtcttgtagatcatgtttataatgcgcctgatcaccatgcaacaacattactgagctatgctggtcgttaagcaaatcttcagatcacttgacctcatcatagagcacggtttcatcaggaccaacgactccgttatctgggatacatgttcccactgtttacacatatcagttccgttggacaagatcacaagatgaaaaattacttgtataaaaaatggttttgaccatcactactcactagtgaacctcgagacctgtttgaagctctaggtgagacaattgcaagaatgccatgaatgctaaatttgacacacttataaaaaactaacacttggcatctagttcctgctgattaggccaataatgttattgactggctacatagaatcaaa

SEQ ID NO: 10289 - DNA, 517 bp, Zea mays
cttgtaatcatctcactggttttattaagtttcaaaaacctttagtgtgttagtgtgtggctgtgtggaggggtatgtcccttcattgagcagtgtgatgtaacaatttgtgttggccctaacctcttttgaggggaaagccggaactttctctccattatcaaaaaaaatctggtgtggtgtgttgttttaattagcctctgtctgtgctggtgctggtgctgggagaagaagtgtcttggaagctgcatgcaattaaattagtaggtcgtggcaggggatcattagcctttattttctgtgtggtcgcttgactggcaaaccggatgatggaagcctgcatctgcatatgcaaactaggtcagtcaacggaccaaacctagttcgcccgcccttatattctcccagaccccctcctttttcacatccatttgtagtggctgtgtgctggtcgtagctatcatccggatatagttaatggggaactgctgcacagccggctctgcaaagtgtgcca

SEQ ID NO: 10290 - DNA, 441 bp, Zea mays
gatccctttgaattctagaatagtacattggattttgtgcaaaatgagatttcaaaaatctcaagcaaaccaaacgccattttagaaaaaaaatcaacaagactaagtgtatagatggcctttcaaggcccacaaagcatcccttgaagcccaagtatggaaaccgtgcaggctgtgctgtacggccagtcgtcgactcgtcgtcttctctacctggcgctctcccagatcagatcaccaccaccgcccaccgcccaccaccgctcaccgagctcgcggtcgccggagatcaccgttctccggcggccccgcgtacgccggtatcagtaaaggttggttatccacatcgaaaccccagctcgcgcctcccacccgagtcagtcacgccgctaaatttggctcatccgccattcagaccagcgccgctagggttttggacct

SEQ ID NO: 10291 - DNA, 448 bp, Zea mays
tggagaacatttttttgttcacttcttaaatttaagatttagagagttatttagagaactattggagttgctcttgtatgcaacctgctgctgacatagagggtgaggtgcccatgtggcgatgtcccgtcaactcggcaagcaaaaagcaaacaaacccctcttgcaagaaaggaagcgaagaggatttcgcacggacacacggcatctactagtagtactagaagatgcgccacgatgccctctccttcccccttccccgcttcgacaagtctcgtcccccgcccccttattccattacgagcaactccgccgccgccgtaaagccatctcccccatccgccgccgccgccaccgctgctggtgggacgggccgtgcgtccgttccagcgaagaggagcagcgggtcggaggagccgccggcgaggtcgggccgcgggggatcgag

SEQ ID NO: 10292 - DNA, 713 bp, Zea mays
agttacttacgaaaccaaactctgacctaaaaaccctggagtcgctcagagccgttttatttcaactagctctggagtctggaccaaacactatcgccgtataatgagatttggcaggatgaatcaacgtgccgcatgcttgtgctactatttgccatctgaaccatgtcgtcgcggcgacgccagtcatcctcgtggcttcacagtccatcgacgggacaaagctgtgaatccatcaacggagtccccggattccttactacattcgttcgttccacgccgccgtagaaagcaacccgaagtccccaacgccaccggcaccggcacggcgaactcgggcacgcaccgcagccagccggccggttcggcaggcaggcaggcagagaggattgcattgcactgcttccatctcccctgcccgccccgccgcggcagatcccgaggcggctcgcacttccaggtcaactcaaagtacgcccgcgcccgcctagacgttgtcttccctccctgcactccccgccacgacgccgcagcagatccaccatcgacgcgcgcgccgcgcgccccgacgcggaacgctggatcccgcgcagcaggaggcggccaaccagtcgccgtcgcccccggcccccaccccgcctgccgcagcaagcggcgtccgctaccgcacgccctcgtccccggacctcctcctccccgccgacgccgccaag

SEQ ID NO: 10293 - DNA, 624 bp, Zea mays
ggctccccaccaccgccgtccttgctttccccacgggtagaagaaaaggcgagcgagtaactgtgactgagtgatgagtatccatccggtccggcagcggcagtagtagcatttggtgacgccgattgacatggatctctagcagtagccggcaccgagcagtcaccccaccccagacacacacaactactcctagaagtctacctgaagtgacgggtgaggaggcgagagccgagaggtggaggatgcgaggctgctagcacgtgcactacttgagtcagtgtacgcagctactggctactgcccctctgcctgcgtgctctccggcctcttctgtactagcctcctgtagtatggccgtgcacagtgcctccttctcggcttctcgctgatccattaaacttgacgatcaggttgcctgaggtagccgcgctgaggtttgagcgggagagggacgcagctagaggcggggggctctatattacaatgcagcagtgaaggtgcgcagcgcgagcgcacgccctcccccgtgcctctcggtttcctagatttggttgcctgccgacgtccgcctctacacagtttgctgcggcggcttgaaaaagaggagtttccctgcagacc

SEQ ID NO: 10294 - DNA, 1500 bp, Zea mays
tcataatgttgaagatatccacatagtcatcaacttaacaagtaatcaaagtgctaaagtgaaatgcaataaagataaggctttcacatgcaactgactaggggttgccactaatctggtctagaactccttgaagtcgtggaactcttgaaaccatttgcatcccttttcttactaatctcaaggacgagattatttttaaggggtgtagaatttgtaaaaccttaaatttctatgttgggatttagaaaaggtccccaaacattttgcttattattttttgcttcaaatttctatttctgtttttgaattttcaaattcaaatcwgagtttggatttcaatatcaaattaaatgcacaatcaaaatctagcatgttgcaacaacatattttatttatttgttactcattaactacttttaccatttacataattgtttataagtgttaaataaacatgaaattcgcataattatgtaataaaaaatcctttatattggattctccaaatttgggtattatatatatttagtatggttggtgtttccgaccggtactaaagatttaaaatttagtatcagtttttggatagaaccggtactaaaggtattagtacatgttcttatattgaatcggtattaaattacttttattatcggttggggacaatagtaatagtatcttttgtacggaccccattatttgtatacaaatctaatactatagctacaaagctgggaaaatggactagctgcgagctgcagcaaataagccaacaagttaggccccgtttgttttggttagaatgactaatctttagtcccgtttaatctctattttaccaaacaaaatgattataataggaactaattagatttaatctctagtctctcacatgggtggtaaaagggactaaaggacaatatttactctaattgctcttgtctagaaaattggcgtgaaaccagaaaaaaagtattttgatatttatgtgttgtatttaacgtatttagaatttatttagtccctacaactaaaaaggtaggaaagtttagtcgctatcggcgtatagctgcacgcgctgaatgttctcttcctgcgttgaccctataaacattctttatttccaaataatccgaaatcgccatcgacacaactttattttaaaaaataacgcgtcacaagacacgatcgaagtaaacacaggccagaatgatgcctccgttcccttgcgaaccaattcaaacacccaaatcactcccctgattgattgcattggtggaggtggagctttggcaataaacaatcacttgacacctaacttattctgctatatataatccaacacagtacacaccatccaacatccacggcaccaccgcttctccttgtaataatccttcttctgcctcccgagctctcgccattaattgtccatcgaatcgatccatatatacagctaaccagccaattctcagaaaggagctatcccttgcggct

SEQ ID NO: 10295 - DNA, 1500 bp, Zea mays
gggcacatactgtggtattacggagtattacggtgtacgtgtagtgtgccgcaagagagactacgcgacggcagcagtgcgttttccatatgcgacgggacgggagcattcgaggagatgatggcaatggcatggttttgtgtactgtacggtaacatttgtcgctgggaattaataataaaaaacccgtggctggctgatgcagcagcagctgtcttattatccagccacgcatgtgaaaatttcttctcgggcagcagcagcgtgatcagtcgccaccttgtcagcttgtatccctctgctgtaggctgtagtaccatgtggtctgaatccaatgcgacgacgacgacgacgccgcccagtcggtctctgatgaacctgagattacctacctgatcttgctactgccagggcgcgcgatcaacattccatttgacactggtaactgttggcggtggtgcacagtgctgactgacggacctgcctgtcatccagggtcagggtacatggagatgaggatcttggatggatgggggagaggggcctgcatctgcatcagagccagagggaggcgggcgaggaggggggaacaagcaaagcatgcggtgctgggctgccctgcccacgcagcgtcgtacgctcgtgtcggtcgccggcccagtcgaatggaatgaatgatgactctctcacccgtcccagatctagccgcgtcagcgcgcacggaaccgctccctttttttttcccccacacctccctcccttgctctcccgtgcgtgcactgacacacacacacacacacacacaagttggttggtgagcggaattaagccagctcgtgacgcaatccaatccgaacacgctcttttgcctgggaaggataagcgcgtcgtgtttagtttacagtggtctcgtttggaagttcttcactctctatagactcgatagctgattctctactaatgtaatttcaagtgattctctagtaaagtgattctctagtaaaagtaaatttaattgataaaaaccgtttgataaataagatgtgaagtgcttgaacagttagtggggagtaggttgagacttgagagcggtggaaagctgatttttttggctctcactttctagtataaaatagaaactagattaactctactttcatcatagagtaatttagatttttaccggtttgactctggaggagtaattctgggagcggagctgtgagctctgcaaaacggctcctgtgtgcccaaatgatccagtccacagactcaggctcaggctctaggacgagtgatgagctctgcagccagtgacccctgtcggcggcggtagcttaaattggccaccatgtcgccacgatccatcggactcctctgcaaataaagccatcgggggagtgactgactgagtcagtgagtgggtgtgaggagagctttgaggggaggggagctagctagctactgcctactggaggagggcttcctccgacgccggac

SEQ ID NO: 10296 - DNA, 134 bp, Zea mays
agtgagctgcaatgtgtcaattgtgatggaggagcactgctactctctgttctgatctttcttagtgaagcccattagaggaacaggtttttctcttgggtggagactcttcttggacgctttggttcctttgg

SEQ ID NO: 10297 - DNA, 898 bp, Zea mays
tgcagtgctgctccgtctagagccggcaggtactcgtcgctatatagaattaaaatttcgtttatttttcattataaaatgaaaaaagttaagttacacggaagaacctttgggcaattttctggcgcctgcttgggttaattctctttaatgccagaaaggagcccactgggccctgtactgtgctggaagcagcagaggccgcgacagctgcgtctgcgactgcaacgacggtgcagcaagccagcagtggcagcaggccgacagacaacagctcacgagtccagactccagaggatccaatggagaggcgaattcatactaggccggaaaaccataaaaagaggaattgaattattctatccttgtggaaggtaaatcaaacaatgcaatcgaggcatccatctttgctagtatctcctgttggtgaagcaaaaaaaagccaaatttctactcccccgtagcatatatatataagacaaagccagcaccacacaagcaggcaggaagggaagccctcgctctcgctcacccctgtctggcgtctgcttatccctggagcagaccggagtaaggccagccaaccaaattgtctatctactgaaggaaggagaaaaaaaaagaggtaacttgaaactgtcagtctcggcattgcctaatcgcattcccaggtcccttcctttcgattccgtaagctgttgtataggacgatggtagggtaggcagagttaggaacatctctattctctgtcggaaaaaaaaaatctttttttttaccatgaactgttccgtcgatctaccaggaaactggagccttctgctgttctacttatacagaaattcaaaacgccatgtgtagattcaacaagttgttgcagctgcagctttaccgattccc

SEQ ID NO: 10298 - DNA, 1175 bp, Zea mays
ggtttttcttactccaacagcttcatcatttttctcttaaaaaaatccgtgttccgcatccatagcctcctcttccttatattttggtgtgttccatcctcaacgtatcggatcatccacagtctcccgatgactttacaaattgcaccatatgacacatttagaggaactgttgaagtatccatcattatttactcttaaaactttttagcctacttttaataatcagttttttttggtaaaaattgtaacatcctttggagttgctctaagagcaataatggatgctaaaaatgtctcaaaaaatgctggctaaaattatttaaggataaattatagtgtatactctaacaatttctttaaacaaaaatgctaaaaagattgaaaactagccaaattaaaaaagaaaacacctccatctagccctctttgtgtcggcctattaattagtcgtatgccttgtttggtttctaggaattgaaaagtaatctaataataaaatgagaagcactttatagctattgattccaattcatgggatccaaacttgatagattcttcttgccctttattaatcgtcatctgtataattaattttataattcgactatatttaatacttctaactacgacagcccagctctggctcgagcccttatcaatccttttcaaaatatgtgcaaggaactggaagagatttccacccagatatagcttgaccactctctgtgaggcacgctcgtgggcagcaaaatttcttgcggcccggcccaaaaattgacaggccctcgtatttacagcggagcggaatggagttttctggaaggatttctcatgcacgagacgagactattcgctggcaggtgggcccggttggcgtgcggatcgcagaaataccacgcggcttatggcgcgagcccacgtggcggccgcctcatccacgaaagtcacggcgctgtaagccgtcgtggcggccgttggcctggtctctgtctctctctcctctggtggcagtggcacccgccgcgccagccatatatgtcgcggaggcgcgcgcgttcctgcctggctcgagattccgtccacgccattgcgtcgcactgcctccacacgacgactccacgaacacgagcggccacaagacgagatccaggcggctgtgtagctacgctgcc

SEQ ID NO: 10299 - DNA, 1500 bp, Zea mays
gctcacagcctgcaattttatgcgttacaaaacaatactgatcgacaacctacaatcaacctacatgattgttgtggtggtagaggttttaactgcaagaaatcaagcgactcttttttgggcaattgttgtagcctctacaacgctactagcagtttactgaaaggagggatccgttcaatgaattgaaatgttattactcagatcacttggcttccaaaccgagtaccactgcaccacctcgaatttctacttgccttgggccatgtgatgtgctgcttacatttgtaattggtggttcagtgcagtggtacttggcatgggtgtcatactgctgtatgcatagcactgctcttgtttgaattacgtactatttaaatgttctttgttttttaccttagattctagattttacaaacttactaatatgttggtctaatagttacaaacctacaacatattgtgcccattttacaaacccacaactatttttgtttgttttgcatgaaactacaactttgtaactatccctctttcaaaatggccaattgrattcacatgtcaatggcagtgcatcacatttggcaggcaggctttggtcatgagcatgtagctgacacgggcacaagtaagaccatgaaagtkgaacaataacaaagttgtttcatgagatgaaatcccaaaatattggtaggcttgtttaatatactctaggttgtgtttgcaatgaaacataatcttaaatgaagtatttttgtttagtggtaatatatgttagaatatgctatacataagctatggacttagttgtccaagatcctcttgagctagattagaaaccgacgactctgattagaagttagagataaaatagaacatgactgcatgcatcttgttcatttagagtcaaagtcggttgggatgttgtaaccgagtaggattactcttgtaataggcggctcatgcctgtataaatatacaaccccatcaatcctagatgtcaagataagcaatttaatatcctggtgtcatgtttcattcatggtaattagagccacctcctccatctattagccgatgtcctgatcaagagcaagtctacatcaacctcaccaatgacaaggtcccatggcgtcgtctagttctgcagtaccgatgcctctcctagggcaaagctttgctttaaagtttaaaccacaacgagaccaacttcacacttttgaaagcgcaagttccgcccatccttagacatgcgcaactacaaggctacctagatggcattactgtagtgcgcaatgagaagatcttcgtcaagcaacatggcaagaggatcgacgatgtcaacacataattcgatcgatcgcgctctagcagtaggtccttggctttctcatgacatccatgactcaagaagtcatgagttaggatgccatctaccaaacatccgatgaggtgtcggaactgtggaatacttacgtgtctcagtcaagagcccggacc

SEQ ID NO: 10300 - DNA, 288 bp, Zea mays
actagccctaatagagcaaaatccaccgggtttcgggtagcgggtacctattgccatctctaaatgtgtcttttcctagtcgttagcacgggctgggctttcgtgggccgggagtgggcgacgaacgatggctggctggccgtccgtgattgttttggaacgggcagcgtgtttggttggtgcctgtgctgtgccgccgttcgtctctgggtagcgtagcgacggcgccacggcggcttccggctcgtgcgcgcgcgcgcgtgtccgggcgagaagagctgccaaggg

SEQ ID NO: 10301 - DNA, 923 bp, Zea mays
agtgtgctcttaacactatcagctgtggaagtaatgcagccaagtgcacggggctccccgggtgccggagctcctgataacacaacaccaatggtgagctgttttacgagcggttaacaggaaacaggacagaatggaaggcatcagctgtataggaagacccacaatgattctgagatccttgaggttgggagagctgttcagcaagcatgagaytagagtagcaagaactgcatggttgtggtccagagtaaggctgagtgatttcaagccatgcaggtactttgcgttgagctgcatgctatgctgatccgtagcagagtagcggaaccgggaaattgctctcagatcactcggtgaagatctggagatgacttcaagcagtgaaatcacgttgtttctgttgataattcagacgaaatgtggctcaaacatctaattaaccattttcctcaatgaaactgccccctratcctcctacccaaataggagtrtggtttcagacgattcatgtaatgggtatatatacgtgatatgtttgttggccataaaaaaaatgaaacgtgcatggtctgatctctgatggtagcagacaaatttacggcctatcaagtatcaagataatgaataatttgtattatcagctagcaccaaagtttggttatctctgtgaattgcttgaaagcttatactcgcatgagtcgagtatcagttttctttaacacggagtcaagttcagttgcttaatcatgaacacttgtgcaccttagttttggctgatgactggcatgttgcaatttggtgtcatcatactttttatgtggggtttacctgactccatggacattttaacaattaacactgccacagatacattcaaatacattctgaatatagcattctgttgcagaacactttgagaa

SEQ ID NO: 10302 - DNA, 836 bp, Zea mays
atgcctgcagaaaatttcggttaatatatccatattccgtttgaatagactaacttaagatggaaataaagtacattcctcaaagtaaacaggtttcatgttcataggtaccacaagcgaaaacctggaactcacaggactaagactgtgtccaacaaggacctgtatgtggtcctgtccgccaaatttacaggacgccgagctctattgctggtccagcaacagacggtaaagccttcggtaaaataccggacgctgtctacacgtgctacatttagcgttcctctgtgtgttcgctacgcagccggccagcaggggcatagtgctgatacgacgaggatggcccacatgcagctcatgggaccaggagctcataggaggaggcaacgacattggagcatgggtcggacccacatctgtcagaaaaaatatagaacatgggatatagaggacaaaatttaagaaacgttgctggagatggtagagatatagaggatgaaattttttagagtgtactgtaaaggacgaagaatattcttttagaggatgaaatttagaggaagttgctgaagatagcctgaggatgagtactagatgtctggagtctgaacctggtggagaattccccacagaaggagaaggaaaataaactagggtttagccggggccacacggcaggctccacggcgtggttatgtccgcctttattctccccccactcgtctgcttcgcctccacctatccgccgcctcccaatcatcctgcccccaaactcccaccccgcagcatccccacgccaccacacctcgtcgcgtcgcgtcgtcaccggcgtgaag

SEQ ID NO: 10303 - DNA, 462 bp, Zea mays
caaattgtggagattcctcacaaatgaaaaacttgagataaagaagaaccatggtactcaagtttgatctttggatcacttgagaggggttgagtgcatccctkgaccaaaggaagtcaccacaacgtggagtaggcattggccaaaccacgggataaaatcactatgtcacttatgcatctttccaatgtgattgttttcctgcatagagttctcacatattcacttgcgctattgttcctaagtttcatacatatcttaaaggaacaatcaagtgaagagttcacttctctttacctctattcatatcatcttggtttaatcccactagcatttattataaaccaagtttgtgttgtttagacttgatttttacaggatcacctatttacccccccgcctaggtgttctcaattggtatatgggccatactcttcattcagggactaaccacccgaagag

SEQ ID NO: 10304 - DNA, 1500 bp, Zea mays
ttataataccctctgtttctcggatcgcactgcagtattgacttaagtccaacaatccttggagctgcccactgtatagtttcaaacactgcttcattttcaatccctgtcgttgttacttatcgagcaccaatctcccgttctccatttgagttatcatgcactttgtacacacctccactttcatccacttaccgtgtgattggttacctgaaccgtctcgttccgcctcaccacgtgcactgagtttatgtttggttgctgcacgtgagaaacgcagactacatgaatagacgcaaaataagttatgttggctgcattgacacatacgcctaaaacggacgtacgtggccggacaggctcgcacgagattgtacgcgtgggtgcggtcatccaatcaggtggtaatatgtatgtgctcctgctaaatatgtgggctctgccattgtatttgtaatctgcgtatataaacagatattatgggcctaaaactcagtaacacgcacggacaaaaaaaaaactcatctgatacagagtctccaaacaaattaagggaaacttgtggggatggcagatcaataacataaacaatccattacataagcatgacatagaaattagcctggccctggcaaattacaaaaaaaaaaaaaacttggatacctgtttgctttatctacaagcagtagtgacgtgtacgttcatctgatacagactctccagacaccatgacttggcaaatatcactgcagccttcatttgttttttttttggcacaaaacccatgccacctggcaggttctcatgttgttaagtaaaaaagatgatcatttaggcattgattaggtcaaaacacaaccactaatcagttttttttctttcacaaaccaactcctgttctgtgcacctgtcactaccagacccctgttgttgacttctcgacgcctctttcctctgaaaatcttgggcatcacattcacgtttccctcaagagtgtctttatatacaattgcgagaactactcatcacttccttgcacttcagttgagggtaggtccttactcctttacagctagtaagctaaatattttctggtggcccaatgttcttctgtggaacactttgattctgtccaagatttcgtccacatatttagtctcctcatgtacagctgcttttttttttctgagcagggaggggatgctacaaatacttattggatcctaatgaccgagagggtcagttctatggttgtccaggagacagttagccaaattctgtctggtctgattcacagttacgagggcaaaggagactcaaatccaaatgataacttggagaggcttgagatggcgcatatcaagttggaagctgctcttgagacatgcagcaagtggcacatcactgatttgtcgttgttgcgttggcgcaagaagctgaagcgagctgctcaagagtgtgatgacacgctatacaaatacaagaagatgatccttgaag

SEQ ID NO: 10305 - DNA, 1500 bp, Zea mays
ctttttttataaaaacatgtggataaatatgtgttctagaaattggttcaggtgaggtgtttatagaccatactaaacgacattgccttcaatattttagtctgtgggttggtttcagttgaaaccaaattgattaaaaattattcgatttcggctctaatcatctccggtccaatttaattttgcattaatacttttgtcgtcgagtcctaattaatttaattgagatgaactcagagggctgaactaaatttttagattcgtctttgcgccgatctatgaattttaaataattaccagactcgccaattttcagaacaattacattccgaacttcgcgaaaactttaggaggagtctaactagacagagaccagatgcgatgttaaaatcgggataggcgaaaatgatcaccatattgagattaataatcccatccgatatcccgtgctttagtcccgactcccttgtacgcgtataagaaaccttgggggggtacaatagataagtagtagtagaagtagtattagtaatagtggaataatgtagtagtagttagtagtatagagtagtgtaagtagtgtagtgatgtagtagtgtaatgtagcgaaaaagggaaagaaggccgactcataatgagttggtctttgagtttgtgaaagaacttcccttcttaatatattgtagaaaatttcagcttgttctgagtatctcctttgcttttccatcgttcttttatagtcaatcaatagcttatattcatgcccagcgttgtcgttgttcttagagataacactcaagtaatgactggtaattactgagtcgtatttggttctgccggaatttccatggagaaaacggctgagttatggcaggcattgccgacgtcttttagaagtaactgccgagctgctctggaccatgccgacgttttagaggtaacagacgagtcacgctaggccacgttggcgttttagaggtaacagccaagtggtgcttggcgacatcggcgttttagaggtaacagccgagtgatcgatggcgacgtcggcgttttagaagtaacagccgagtgataacgggccatgccggcccgtttggaatagtggccgggtgaagtctggtaacgtcagcgtttttagaaataaccgctgagctaaaatgggtcgcgtcggccgttttcaaaataacggccgagtgatgatgtggcactcccgcattttagaaataatggccgggtgatgacatggcatgccaacgttttggaagtggcgcctggcccgggaaaaccccatatgtactgcactatcgcacgcctccgcgttccatgccctagtttctgcttttctgcgtccaggctttctctgctctcctgcaatattgctttcgctccgcccgctagcaagtttgagatggcgcccaagcggaaagcttcgagttcgtccgtcgcaatcattccccccatcgatcccacagtcagttgcctttcgcaggtaaccat

SEQ ID NO: 10306 - DNA, 230 bp, Zea mays
cgtcgcgttcttgggctggcctctgtctggtccagtaatcagtacacgcctcggggttgggccccaaggcacagcggcctgtttcttccgctctctgctcagtgctgagtctgctccgtccgtctccgtgccgtgtgctggcggtggcggtccaggccccgctcgctcctaccagtggcccgtgcgtgcggccgccggcgccctgatcgatcgacccgcgcctcggccgg

SEQ ID NO: 10307 - DNA, 270 bp, Zea mays
acttcatcacacaaatattagtaagagatgtatgtgctctagagtccccaaggggtataaaagttttgataaattgattgtgaagtgtgtaaattatgcttagtgacactcaagtgaccactagttttgaaacattatagccactactcacgctacaaaacttttcaacacaaacttctaccatcacacgatttcaaaacatctgcctactgagtaggtgtagcctgaggcaaaaattccgcagggaggcgggcatccagcattccagcc

SEQ ID NO: 10308 - DNA, 329 bp, Zea mays
ccatattttcagtcactgtgcatgatcatggattagtaacgtcattgttttttttctcgttgtgaacatgaggaatttgagttttttgcatgaagagggttactcaagaatttataaagctagttcaaatttaaaagagttcatccatattacaggttccaacaggaaaccactaaaacatgatttcctgttggaacctggtagtttctttcttttatattattcctgcatagaatatctataatgaaatcatcattagtaatactgtacttatcagtgtgatagatatcatcttgaggtcttcataagtcagcaacctakagcagaaa

SEQ ID NO: 10309 - DNA, 1500 bp, Zea mays
gagttagtgagggcacactacgaggcctttacaaagttccactagcttgacaagacctgctactacggtttcaaggaaaagaaagcataggccttttttcatggtttctaacccatcataggaattacagttagcactatgtttgcagcgattcacttcctttttgcccctttcgggtaaggttatccctcactatctttcctaattaattggccaagggcagtacatcccacctttgtggtagcactgttgtctcgggttagcgctccatgttccaactaaacattgtgatcttatcatgcacaataacaaataatctagcaatataccataatgaaacatgatcataattcataagtatcattaacccaaataccaggtagagcaatagcaaactacccaatacttcatttgtgtgcaaggtgtagggtgaacaaactaggtgacctattaggtcccatcagtttaacctagtagtgccactgtgatgaatagaatcataaatattattaggtcaaagaatgtgatcaaggacacaacttgccttttacttgcaaatccaattgctcagatacttccacacagttgggcttcagatttctggtcgtaacttcgtttctatttacaacaatacatacagatagataaagaacagctacaaataacattacacaacaacatgaaaacaattttaaagggtgttgacgttctgagcaatatgaatagatataaataccattacacaacatgatcacattcttatattgcacaaataacataataaattgaagagtagaaatatagcctaaaaatacataaaaatcaattttcatccgtgcactcaataaatttaagatatcttatatttgaacattgtaaagtggccaaatatgaaattctaagctaaatagcctattccaaaataaagagatctaaatggcctctaagatcttatctaatatctatacgattagtgtatagaaaactactgtcactatcgactttgatgagtagatttaggagctgtttgttttagattatataattttataatttttaaattaagtgttagattaaaatttattagatcatataatcttgatagattataacccaaataaacagacacttactgttcttgtgacgtgtaaccttaataaaaataaactctgttatgttctgcagagatagggttacgagctagagttaaaaaaacacttacagcacgcagttgtcgtcgtcattgtcttcgactcttcgtggcacctcccgtccataaaaataaacgtgtgcccacaaatctgttcgctcgcattggcaactgaaccgcaccaggcaccacagtcccgtgcggcagtggcagacgcacagcagatcagcagcgcctccctctgcggctctgcctcttgccaaagccccccacagaattcttctccctccccgtctcctctcgcgctcgcgcgtggtgaggtgaggtggagttccgaccccgaggccgca

SEQ ID NO: 10310 - DNA, 1097 bp, Zea mays
tggcttggcatataaatcgttgacgcctgattcctgatcgacaaaatgtctgacaatcaatatacatatgaacgatgttctgtccaatacgaattcattttagaaaactgagttggttagcttcttatattatttgctctaatataaatgtctggtacattatttgcttaaatatgtaataattttattttcaccacaaaatcaatatgtactgtatagcgtattttaatttcgcgacatatgaactattttttaagcggtgaaaaactaatatgtattgtgaaatctggtagcactgtagatatagaggaccgaatttagtggacgttgttggagatgaagaagatatagaggacagaatcttttagagtgtgctgtaaaggataaggaatattcctttagggggtggaatttaggggacgttgctggagacagccttagatttcaccggacggttataggtgtactgattcgcaccaagaaagtgcccaagttttagcgcatgaatatagaaagccatccatacatctaattaattaacacatgatggagaggggtcaggagagcaagagagatgtcttttctcgccacttttatctcactttacccttgagacccctcaaaatcttcatgagcctagacaaaaataatactcatgctgtaaacatataaaaatagaagtgaaaatagagaaaaaaaacggattgctcgttagtaaccaactgtgagtgagccactcatggactccaagacattccgtagaatagagatgacgcaagtattaaatatacattacaatagagtaattatataagtataattttaattagctacatgtgataatgttaatatcatagagtgtactatgggctacattattaaactttagtagtagcctgaaaaagcgttccgattccttccctcgcctatctgcctccggcacggcaccacacacacagtctcaagtctcaactatagtctccagtcccccgcctccacgcctccggctccggccagccgcagtaattgcagcgcagcccaagccaccaccaccaggcaccagccaaaggtgcggcctttgaccccgcgccggcgcc

SEQ ID NO: 10311 - DNA, 1500 bp, Zea mays
ctttattacaggatgtgatattttacataatatatgtccatttgtggcatgtgtgatgtcaactcctgaatattaaaatttgaatttgaaagctccataatcctggcttataagttgtggagaggaaacactagcaaaggctccttttttttagttgtggaaacctttttctatgtgaagaactgaagattgccagcaaaaggttcattcctgatcaagttgagttgtccattgtcatctgctgcttttcagaatgtaactctgaattacttagccttaggccttaacatatactcatcgtcgaaatgtaatgccctacactaatgatatgacattatcccaacttgttgagccagaaaataaaagtagtaaatttaactcagataaaataacttatcatccaagctgcaacgttgtgtgtctcaaaaaactcggtgcagctcaagatacacattgaaaaaatcctgatcrgtgtttccattggtataacatcacggagtgttatttttatgttaatatttttttgtaaggcttcacatggatctttctgttagctgcaaaatattttaatcactagccaaaaaaaccttccaaaataagtatactagattatgtctagctttattgtaaactgagatttcttgtatataccttctctaggatccaaggacaaaacaatggcatcttgttaaggcaaataaatagataccaagttaaattcagtgaatggtggtaccaagtacaaacaagaagaaacaacaaccgattggtctaggtatggtacggtacgtttgcttgcaagcgaaacacaggcgttgttgtagatctactcggccgcggccgggcgttcgacgatctagctcgtagtcgtcgtagctggatgcgtgcgtacgtgcatgcatgctgccgagtgccggctcaaccggccatctcctcgtctcatatcatatatatacgcggtggtcgggtggtataccttggatatctcttgcaaggacatgggatgactggggagcagcacggttggcggctgcatggaggagccgggccatcctcgtctgtaggtcgtgtagccttttttttactcgcatcatcagagatggccatgcctgtttttgttttgtatctggtctctggggagcatacgtactgacaatgatagcaatgaaggcacacggatacaggctgtctctggtggtgcgcacctatgtgttgagctgagctggttggttggcggtttgcatgaacaacgcacaggcagaggcaggaaacaagccaacgcccaacggcaacaagagaaaaaaccccaagacctttccaagccagcaggcaacagcgcaccaatcccgacgcgaatcgcccagaacgcgaggcggaatttcccatcctcttggacccccccccccccccctctgttcttcctccttcccccgctcctcgtccacacgctccgctccgattccgcccgcgtccgcggacccagatccggcgcccgcgccc

SEQ ID NO: 10312 - DNA, 272 bp, Zea mays
tgtgagctcccatttcccacaaccctcgaaagctactgatgaccatgtaggcatgtactcatcatgtagcttgcttatttacgcccatttcttaagagaggatttgatagcctgtcagaataaaagagctcgaggaaattgcggcggccggaaattctggtcatggtgccacacaaacacgataatctgcttcatcctcgacggaattgccgtcggggtcgggcgattcttcggaggacaagcgcctctgtttcgttgagctagctaggtcc

SEQ ID NO: 10313 - DNA, 1500 bp, Zea mays
cgaccgcggggtggcaagcacggcagatggccccccggacccggtggtggaagatgtcgggggcgggactgaaactggcggggaagtcgtgcgttaccgagattgttaagtggcccagaggagacgtggcgcgggagtaggacggagcgtctgaaccccagctacgggaaccgcggcggcggcgggcgcggccagttgcagttggaattggaacggaaagggggaagaagacgcgagaagccgagaacggggctggggctggggctgggtgctcgtgcggggctcctggcccaaacgatgtcgtgggccgtcggcctgctctctctctctctctttctacctccagtccttctcaggttacgcttacgcgtacagtgtacattgctgctaatctgaggggcttctctgcaagattgacgggtgattggggtccacggacgcgttgtgatggatatttttgtttgggcaggccacttgggtccacgaagcgccctgcatggatgccacgtagcgtctcagccactcctgcgcacacacgtagcaccgggtcgcagtccccatgctccgggctaaaataaaataaggggtgacgtggcccagcaacagtcgtgacgagattggcctagccacagtggccaacgtacatgtcggatgtcgctgcacaggacccttttgacagattggcctagccgtacagtggctccgcatgggcgacgtacagcagcatgcgcatcagcaagctgcggcggtgccggtgcgtgcacctctggccgctggccggtacggcggccccggtgcgtgcattactgcattgtgaactgtgcggtgccggcggtgcatggaatcgggatggacgtacatacacacgacacgacgcatggttttccttttgcacccgggcgacgccgtactaccatggattttgattcttgaaaatttaacaaagtttatgaaagaaaaaaaaacatattatagacagacaatggaacgggaaaatggccccggggacctattcatgattccaacgatgccaggaggtcccgggcggaagaatgcatgcgcatgccacatcgcctcgccgcagcccgggaaagaaaaggaaatgccgtgcgtgtatcgattcgctacaccacacacacgtacgcaggccgcgtgccggcgcgccattgcactgcaccaccagcctgcctgtgcagagagacggaggaggagacacacagggcagcgaccagcgaaggaccgagaagctagcaacggcaacgagcagaggcccgagcccgacacttgcgctccgcttcccccgccccctccgcctctcccgtctctccaggccgccaccaacaccacaccaccacccgttgccacgctgccggccgcccacgcctcgcgccagccgatcctttcattccatcctccctccctccgcccccgcctcccaattttagccgcacggccgccgccgccgccggccggccggagagcaggagcagctaggccgcc

SEQ ID NO: 10314 - DNA, 896 bp, Zea mays
catttctttttcgaaagaaagttcattggttttcgcgccgtggcaaatctcttgtctttgtttgctttgcagtcttctcttgtcaagcacatatacttctctagtgcacctggttagtggagatcccaaacagaggtttctgtcaaataatacttgtgcctgtagttagtttgtcagttagcgtcgcattgttataggagctttctgttagccatgcacaaagggagagcctggtcgtgcgatcgtgtgcgcagtccgcacgaccggcgcgtcgcacgctgtgactgaggtgagtgggatggcactcaacgatgaggggcatggcgtgcaaatcagggtgatcgtgccccacatttctttttcctttctttaagcggtaaactgtcaggttgtaatctcatggtctgtacacgtctctttatatacagagaaatagagtctgaaaaagctgttggttgttcacagcaccaaatcagagtgtgcctacttgtgttcgtgtgtgtgcgtgagtcttttctgtgaccagcagggtgagctcgccggcaactggaggttgcttctccggcgaggtctgacaaccactacacgggcgatcgagggcggggcgacatcaactgcaggcgcaccgcgcgcggcggctaccaggccttcagcggcgagtccgttgaggtcatggccatctccgtgcgccgcggccaggcgcgcgtctgcaacgacatccagacctggtgcttcaaccccacctagctcacggttcattggcaaagtacaacagcctgtgggggatcgacctctccgactcgtagttccggatctccgacgaggccaacctcttcgtcgtcgtgggctgcaactcgctggcgtatgtgcagtccgtcaacgccggcaccgagtac

SEQ ID NO: 10315 - DNA, 1500 bp, Zea mays
tttcgattgttgaagcattagattataagttgcggtgaaggaggaatttgtagcaagattggtgtggtgctattgtgcctaatggtgggacctctggccctgatggtgtgactactaggggcatcggattttgcagatgttcctctaggttttggcattggatgttgtgatgtcactatttatgcgactactctagtggctttgatggtggtacgaataacttaggtagtccaaccatggagtagaaaacgtgtgaaagttctctagtttcatatgtgcatagcatatggttcgattctgagggtgctcggatcattccgatggacccctagacatctagtggtgaagattgaacatggtggtcggactagtagtagttgtggttggactaccaatggagccacgctcccactaacgtgtggaacctgttggggcaggtagatattggaggagcacaggcgaccattagcaccctgatctagaatcgtcgactgtgcaaggctacacaaggaagtcctaaacaactagttttattgccccctctataaataaagcctaaaatttgcttccatgggagactcaaactyagaacccgaggaatgctacttacaccatctaatcaactcagatagtggcacaaacaaatataacacgggtgattgaacagacaaataaacataggtgattgaactacgacaaaaaaatagtaaaccaacatttggatatatgacacacagacacaaactcaacaaaatgaattagaaacaaaaccgtaatgtataaaaaatctataagacaaaaagatatgtggcagtttattttagtttttttactctaggtaaagcaaaaaaaatcaatctaaaggtaaaggcaaagatatagctaacagacaacttaggctctgataccactttatgtagatgcagccctatctttcgacggatatgataactttcgaggagaactcgacattcacgatctaaactttgaaccaagtctgattcaaacctccacaaccgttacaccactattttgttggttatcaaccacatacaatatgattgatctcgctgagaaggctttcccgtaagctagccgaaagcacaagtaaaaaagagatgacaataggataagagatgctagtagctacaaatgaacaagattacaaacatggaacatgattcacaacagtcgatctcggcgatacacaagcaataaacaatatttgtttcgcaataaaaaaggaacacaacaaaatcaaactctagcgaaagtgacgacggttgtctatagtcttcgacttcagccttttagacactcctaatgggctcttttttttagataatgggaaccaaatcccgacctacatcagctgatgacggccgtccacacaccacaacataaagtaccgaaacaacgccacatttggccacaaaacccaaacgcagttgggagaatagacaaacatcacatagttaatctattactgaaggtccaacc

SEQ ID NO: 10316 - DNA, 49 bp, Zea mays
accatgatctatgctgtttcaatgcctcctaatctgtgtacgtctataa

SEQ ID NO: 10317 - DNA, 1329 bp, Zea mays
tgacgaattttacccaatatgaaggcgggtacgagatgatttctttacccgcaggcacgttaatggacaagaacctttatccattgggtagatgggtatgggtacgagttggtactacccatacccgtgtacccatggataaaatatacccacaccataccactataaccatctagttaaaagaaaatccttctctagctatcatttgtttagctatcaagttatgtaatcatatgatttgtgatattttaacttgaacttttttgtgtgtttatttgatattttgagtgactggtatattagaattttaagacttccctagcgggtacatatatgggtaagaatctataccgttagtgtatatgggtagcccgacagatagaatttttttgatgggtacgagtatgaaatggtactacctgatgtacccgttgccatccctagccctatagccatgacttcgtagtacatgggtattatattgtaacaaatggtatgaggaactgtaccgagcttcattaatatgttgttcacactttgggttaacccttggtttgtaacctcacggggtatgattatactaacacatgctccatgattacaatgacaacatggtatggagacaattgatctaataacaagtagagcccacaagaagcatatacatgtaagcttgacactcctttggactataaaatgggatggtagagcagtcttccaagatgtgagatcaatccatgagccacttattttgtcataaaaatctatagtataagtacggtgatattggatatcttgatctaacctatgcaatagaattcacattaaaataagttaaatgcacgtgtggtccctaaaattgagaattttttaaaatatatttctcaatttaataacttggtgttctataaattcgtactaccctcgtttcttaaaccaaacaatatcaccgcatgtaagtattgtagccatttgcaatgaattgggattgcaactttcttaacttcatctttatgatcatatttgcaaagttcatttatttttacgtagagctgcgaagtttttttttatcttcatttcgggtcgtctttaaacatttgcaaggcccacggacgacggtcagcgtggtccgaaatcacttaccgccttctccgcactgactcgaggtggaactgggccagccagggactctggcccgacccgagaacctcaaccaaaacctctcctcagcaccgccgcgtcgctccgcgtcccgtccacagctctccgctgccgtccagtgaccccgccgcgccttgcagcggcgacggaggggccagcaagtcagcc

SEQ ID NO: 10318 - DNA, 1500 bp, Zea mays
agttctactacttatttagacataatgtatagtagttactccgtatgcaacaaaatttatagaaaattctttgagtaccactggaccatatactcatctttatatgccactgaaaattacgcatttcctttgtcttcatcgatttataacttttgttgccttatatgcaattatcgttacatctaaaaaaactccgttacctacggcgcacaaagccgggacgcggccggacgcatgccacttctcccccacgggcagctgctgccagtgtgagctgcgaacggtgcgccgtgcgcgccatcctgcctctagccctcgccatgcgcaggttgacttgcgtatttgctgttggcggctgccgacccgctgcacgcctgcacctccctggctccctccccggctcccgcgccggtgcctctgccttactgcgtgggccgcctccgtcgacctcgtgcgctcgcagctcggcctcgtgccatcgtcatccgcgtgcgcgccaccgcgtggaccgcctccgtcggcctcgttgtaatacttggcrgtgtacacgtgggactaaaaggaaaaccagcaatagtgacacataggggtcaggggaactaaaagcacaacccaatgccgacgaagacaacgcataattttcagtggcaccattaaggaaaatttatatattttaacggcattctaaaagatctcttaaatttatatgtctaaaacaaattagaatgaaatttatatgtctagacaaattagaatgacttataatctagaacaggtactacaaaagtcggtccagtgactccagtaggctcttctggactaacggtaataggacatgtttttttatagaatatacacaagcatatttgttaacgagcacttagcagatatgagtactggactaacgataatatgtcacgattccccgataaacttcgttccaaagaagtcataaccgtttggttcactaaatgtaacgtaaatgataatgataacgattcacactcgaataccggcggtaacaaatttaaatgagacgatatccatttgtagtatgatatcgattacgattggacttaaacaaacatgatttaacgttatcggttaccgattacgttaccaatacgtgaaccaaacggcacctaacttccatcaatttgtccgtgagatgaactatatacaggtatacagacatgaaggcaagaaaaatgctgcaccgatcaagtcgctttccttcaccattctcccccctaacaactctctcgacagctaataatgcgacgacttggaaatgtcttagtatttttctgycacggaaatagttaagggtttggactaatgattgtaagtgagatttttagataacgagttgttctaagtgagatggcatgtgtggttgacatttgaaggatttctctatataaatcccggctactattaacatctcaacctcaccatcttctcttgatcgaggcagggatcaagcgaccgagacccgcc

SEQ ID NO: 10319 - DNA, 947 bp, Zea mays
gagggccattgaaattttttgaataatkgctagactaattatgggctaagcccaattaatttaatagatgtaacacaccaaactcccacccaccytatattatatgcagcaccattatctttatctctacttttataaagcacaggtttggtggttgtttttacaaaaagtgaatacacttctttctaatctaatccacagtccaaatattaacttcaacgtccatgaccaccagtttacacagttatgcaaaaataaagtaaaattatataccaataggggttcgaattacctaggttgtcaactttatattcacattcatctaaccaacataacacatatatttgtgttttattaaaacaaagttccaagagctgaaaatcatgtgctatactccacgcatgccaacaaccgaagacacgtacgggcatcaagcgccagtatacaggcgagctggcaacctgggctcggccacgaccatgagcgggaatttacgcggtaccgcgagcttgaaggcctcatccatgctcagctcctctgccgtcacgccgtccggaagcctccactcgaagccgtgtagcagattggcaagactcaaagccatcacctttagcgcgaggttgatcccggggcacattcgccggccagagccgaacggcagcagctggaagtcatggcccctcacgtcgatcttgctctcgacgaaccgctccggccggaactcctccggcgcgtcccacagtccagggtcgcggccgattgcccacacgttgatgaacaagaccgtgccagcgagcacgtcgtatccgtccacggatgtgtcctcgcgggccacgtggggtgccagcatcggcgcggcagggtgcacgcgcatggtctccttgagcacagcctcgatgtaggggaggcgagggaggtcgctttccgtcaccagtcggtccggccct

SEQ ID NO: 10320 - DNA, 246 bp, Zea mays
catgtaagtctgacttcttgctcaagtgtgccgccagaatgtgaagaaacgcctgtcttgttcttgtgttacgcacagcgatgacgaggctgtcatcgggtcagatggcgccgtgtaggaaccatggccctggcggcacttgtggtgccagcgtcgggctgacatgcatggaaacagttgcgctaagataaataaaatcgatttatcgtatttcacacataagcccagcttgttactgaggtcgtc

SEQ ID NO: 10321 - DNA, 133 bp, Zea mays
gtgatgcctgtatactaataataatactttgtaaacaaaccatggtgccaagtctaaagttcgccatgttctttaatttgaattaatttaagttcaaaataggaaagaaagaatacactatgtaagcttttac

SEQ ID NO: 10322 - DNA, 439 bp, Zea mays
ttctgggaccgagtcgtgcaacactgtcaacaccagagcttctactcccacaagcatggctgttcgtgaaggagatttgctgccgcctgaaagcactactgataatgtcctacttaacattgtgaaaagagacgccctgcaggatggtgtaactgaattggcggaaagctcctgcgctgaaggatatgcggcaaactgtgacaccgtctcagggctagactgctgaaggtaacaagacgctcgctgctgacttgagcaatcaacaattagctgatgattagattcttcttgattttgatgatgaaaggtcatttatatgtagctcactacagcaacgcagtgtaggaaaattgtacctgctcgatttaaactttaaagagcatgccatgagtagctttgttaatgttaatattcacatccattgtggaattgttggttg

SEQ ID NO: 10323 - DNA, 412 bp, Zea mays
ggtctatttctttttgaactgcaaaatacaacatacaggatgtagctggaaactcgcggtctgagttttttagtggcctgacacatgtgatggtgaaactaggatttgtcagttaaaatattgagagcatcaatgctaaatggaagaaattgttgggcttggatgtgtagcttaggcagcttacttattatatatatggcttaaaggctaactggataaattgatttgtaaacctctgcatgagtaagttttgtggaactgaatatgtatttaccttttgctcctggtttaagcttttatacctctgttaatttaagggtaggtgctaatctatacaggcatataataytatttcgtttaaaaaaatatttttatgctatattgattacagttcaaccggggaaccagtgct

SEQ ID NO: 10324 - DNA, 212 bp, Zea mays
ggccacccacctagctcggctccgctcagcggcagcaccgcaggccgcagcagcacggcatgggcgcaaacactaaaaagaagggagcggccgcgcctccaccccaaacccacctcgcctcctagtcccccccttcgccttctctcccgagtcccatcggagcccggagctctctcgcctcccgcgaggctgtgtggtgaggcgcggacgag

SEQ ID NO: 10325 - DNA, 160 bp, Zea mays
ggtaagctcaaagatatatcgtcattattgatttttaaagaacaaaaaataatttgttcaccaacttcaatatggattataagcaagaaacacctgaattgtatttcacatctgtgaagcaatggaatttccagcttcaacgcatctcaacaaccattga

SEQ ID NO: 10326 - DNA, 1500 bp, Zea mays
cctttggtgttgtattttgcttcgttcaaatctatctttgtgctaccggttggttaacagggcgtttatttggaggaaagttttgtttgaattatgatggcattatcgccccacaggaaaagaggaacgcactccggtctccatcaacgtacaggagcgggccctaaaagagttccggtaataattatggagcaaacaaaaacaaatggatcggggagatctgcactcctgggctgtcgcattgttagggctatagtttgtaatccacaaaacctaagagaattagggacttattcatttttgaataagagggggatttacgggcccgggccggcacgacctgtttagcggaccggatatggacagatacagcggcccgcgtgcattggcccggcccggcacgataaataggtcggcccgcatatttgaacacaatataaatgcatgagaacagtccgaccaaatataatataaatgcattgataaatacatacatttaattctctcataatatgtaatactaaatacgcggccaaacatatataaaatgcatacataaatataaaatgcatacataaatattgatacatttaattctaagaagaataaatgcatacataaatacagacgcaggctgagtgatcatttcatatttgtattaatatgacattatcttgtgaattgataaatgaattttgttttcttaatatatatataaataatatgttattatatatgattaattctgttaaatgtatgtatttatatactgctctactattggtttgggccagtggtcggctcggcacgttgaggcccaccgggccaacgggccggctcagtacgattttttcctgtacgtgtcgggtttgggcatgtccctagacacgtgggctagcacgacccgacccgaagcattaacgagtcgtggctgacttcgccttatttgtaccgggtcgaaacgggtttgggccgggtccgtaccgagtggcccgtttggacatttatacctttgcctgagtcaggcgaaacggagggtcacacgtcggatcccatggcgaatcgcagccaggcaggcaggcatggcccccgcgcccggtgcgggctgcgggacacggacaccgacggcaggccccatccaacatctcctcctccccgtccctctcctcaccttccttccctccccctccctgctcggtgctcgcacacgctggcgcggcttgcccccacgctgcgctcccaccaccaccactatataatccccgatcgcctcacgcacacgcaccgacccaccggccgacgaggggcgaccgccgcaacacaaatccacacgcccgccgccaccgccgccatacggacccactcctcctttgccctggtgcgagcaggcttcggcagcaaaccccgcagactgctcccggacgagggagaacgcgcggggctgggctagccgctacccgctagccaggggaccggggcggaggcagcgaggaggtacgt

SEQ ID NO: 10327 - DNA, 1394 bp, Zea mays
aacgccgccaaaaattcggttccacaaacgaattcgataaagcaagtgacaacaacgatttcagtgagattttttttaaaatacactactctactccaagaatgactaggacaacatagatagatagtgaagggaaaaatagtggctgcccttgccaacatcttttggttatgatagcaagtgtaataaggtgatgtagatggactacatgagacgccacgtcagatttaaaaatgtggaacaaagagaagtggagaaaaaaattgggttgctcgctagtagccaactgagagtgggttggacacggactccaaagactccctgttagagagagagaggggttgaccaaatattaaatatacaaccggtatcctcgaagagttattatacaaatgattgtctatacgtgacatgacaacatcacaaaccaactatagactacatattactctatctatactaaaatataattcattttaacgctaattacatatttattaattaacttatgaatgtattttgtatgtatatctacattcattatcttctattcgaatgtagatagaaaaagagcaatagaactatattttgggacagaagaagtattaattagagagtatttggtttctaaagacttagtccctcaattttattcttattcagtccctaaattgacaaatacaaaaactgaaattaagttttagattttatatttgacaattttatactataataaaatagagagattaaaaattaatacctagaaatcaaatatactcttaaacttcacttcgtgccagaggctagctgcgactagctgcgagattggaatggatccggtttcgaccgtacgaggaaggacgctggcccaggcagtggggccttgtgatgggagatgcggtggggcccgacgggtccggccgcggggcatcggctaatgggagttcgacaacggcagcctcggaacccatcccggtttcgcgataccccctcactgctccagtgctccctcctcccctcccctccgatcaagtcggggcaacgcgcatcactcgctttaaatccgcacctcccggccggtccccttatcacctcaccttctcctttgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttctatagctgctgtcgtcgtcgtcatcggcggcggcggcgcctgttcttagaggataaggttgtcctagcggagagggagctagccaggatttcggttgagatcaagagggggagcaggcggcggcggcggcg

SEQ ID NO: 10328 - DNA, 139 bp, Zea mays
cttgcatgcctgcagcagcacagggggggagaaggggcgggcgctcgagtgaacctccactacactactccgcgtctccctcccctggctacgaggctataataacgagcgcggaagacggccggcggcgcacgcagcc

SEQ ID NO: 10329 - DNA, 1018 bp, Zea mays
aaaccaaacaccctattagggtttggtcctaggaactaagtattagtcccatctattttagtcttatttaatccctaaattgacaaagagtggaaataaaacggaaaaaactgttgtagtccctagtccttagtctcgtttaatgtgtattgaatgtttttagtccctaaaatcaaacatgataaaaactaaggtctgtttagatctcatgtgctaaactttagcaaaatgctgaaatttagcacatcttgagaaacttaaactgttattattggatgctcaagtttatcttcacttttagcagttattttttggatgaccgagtgccaaatttagttaaaaagtatagtgctaaactttagcaccattgatctaaatagaccctaaactttagtcgagactcgactaaagaaatcaaacgagcttttatcacaacagatcttgacacaatgaaacagatgatatttataagaataaaaacacagttaaaactagctttaaattttctttcaaaaagttttaacaaaaaaccgatatttataaggatcagtccagataccctgtccccgtcaattcccgttggggcgttgcatacatcgccgtcgccgcctgtctcgtatcgtacccaaccgacccgaccctgtaaacccttttttccctgcgtttgctagagtccacgacagcagcgtacatggccacgtagcgccgcctcattggcctggagcactgctaagctgtcaaagaggggggagagagagagagacagacacaggcagtgagtgggcagcagccactcgctctccccacctcgtctctcttccactcatcccctccctcgccccttcgcctcgcctctcttcttcggatcgagcagcagtactgcactgcatgccgccgatacaaatcccatcctctccctcctctactgcacctgcaccacagtagctagctagctatctttgctacggcggctctgtaatctggtccactagcgctccattcgaccccacccacagcc

SEQ ID NO: 10330 - DNA, 1500 bp, Zea mays
ggtaaatctcacgattttttcgttgccgcaaaagttcctggatctgaacaagcctggcacaacaaaaatataggaaaataacaaagcgcggttgggatgggacgatgaggacgtttctgacacgaacgattgaactgccgcacagctcacctcacctgacggatctgtccgtgcgtaaagtgcyggtaaatctcctcacttccatttttttcttccttcccccgatccggcgtctggatttgattcttgttgctgtctcctatttttttctgtgttgtttgtacaaccagtaatatgttttctgtttggaggatggggagacgtctgcagcccatctgaagggctagagcgagcgacatgcgatgcagatctgtagatcgctgttcctaaattcgtacagatctgttttgcggccggatggtttcgtgtagctagctgttcatagtagggattagcgctgggaaaaaaattctagggtcctcaagctcaatcgaaccagaagggtctccagaggataatccgttccgtatgtgtcccgcctcgtgtgattttggttttattcgtctgattttgtttcccgttcgtttcgtgatttcgcagcgtggggggtgcggattcgtcgctgccttttttctttctttctttctggtactgctatctatccatctctttccattttcctcatgtccctgtttctgtttgaccgcatagccgccttgttgcattctattttggctcatcataaatcataaagaaaaaaaaacactcatgaacatccgaatccggttggacgtttggaccaggggctgctcgtggatctgcttctgggtctttttggtttgtgcttcgtttggcggcattcaagccagatcatctgctgcggtttttctgcattttgattgcccaacctacgataaaaaggctctgttgctgtttgattgattcaaaaacaaaacaaaaaaaagaggtctcagctcctgcatttttgctccgtggtctctttagatttgcgtccagagggcattgattcagagatccgtttccaatttccatgcccttccgctacctttttcattcgcaagcagtgtaaaaatcgcagagatatgagatgaggaaaagcaatcgttcatcgatttgggcgcaagagaggagaaaagatgcggccgcagcgatgcggtgtgcgctgagcgctgtgccgagacagatgcgtgcgacggtgcgagggagactcagcactccactcacctggcgccacgtcgccctcccgttgggcctctttgcctcgcgggccgactgggccggctattgtgaagagagaaagggtcttgtgtgggctggctattccaggccatctggcccgtccatctacgtgacggatacttctcgtttcccctcctcacgcggccgcttctgctcggtgccccctctcctctacagctctactctcccctcccgcggaggcgtggacggcatggagttgggggagcccggggcccgtgg

SEQ ID NO: 10331 - DNA, 1500 bp, Zea mays
tctccaagagaccatgttaaaactccccaaaaccagttttgggggtaaactctgctggttcgtgctccaacataggcccgttcgtgagccgcatttatgcgcgacccggaaaaacacgcgaggataaaaacttccccaatcatgtgagcgcgtgaaacctggtgagttcccaccgagattgcgtcggtggatcctcgaaacctagagagcgcgcaaaacctggtgagcagcaaaaataaatatgtccatccacatgcataattggaccaacggtagaggccaactaggccagcaacaacatctggaatttttaaacagtagcccagtttcgtttgagcgttcttttttgcgagaactgctggaattatactttgtatacaccatgaaaaaagatttttgttcgctccccataatcatttttggggaaaaaatttgcattttcttttggaaatgctctaaggtgattgggggattttttttttgttcacgtaaatatgagggagtgaagctaccgataaggggaggcgaaaaaactggtgaactattggcagtctattggagaggagatatcagcctttttcccttaaaaaacgttttggaggcttttttagctttctattggagttgccgcgcctaaacctagggatgacatgtcaatttaacttgtgtatttagatatctgatccgacgaagccggttatggatagatattttaacccgtgagtcagacccgaatctgagccgaagtcgggcgagtacggattagaatattaactactacccgcgggttatccttgggatatatgaaaatcgacccatagtgtatttttttggcctagtccatattacatagcaaacaacaaatcctaacaccataaacccccacgcctaacgctcccaatttcccactcttggctaccacttatagccttgctctgcgctgtgccgcgtggccccttccaagtctcatagactgtaacaccactgacggctgtcccttccaagctctagtgctcctaaccgaggcccgcagactcataataattcttttattaagttttaattgtgtatggcggtgaactgtgaagaaatttgactaattatgttattgtattgttgaataaataattatgtctgtcatatccracggatatccgaaacccgtccgaaatccgatggacacgggcatagatataaatttctacccgcggatacgatagcggatggatattggttacaaccgcagatatagttataaacagatatttgcaatatcggatctgaaatcgatcccggctaaaccaaatcgcaccgccacgtcaacacatgggagccaatcacatccacatgaccacgcaaggagtacgaccccccgcccccgttccgtacccacgcgattacgcgattagccgagtcctttattgcaaaaacacgcatcacctccgtcgccatcccgatccctgataccacgctgagggcggtggtattaggagattagcg

SEQ ID NO: 10332 - DNA, 215 bp, Zea mays
tgtgtgtgtgtggacctggacctatggggtgggccgtggggacgtggggtgggtggggaagggatggaagaaacacagaaaaggccggctagtgaagaggagggggcgtaagttctattcgcgcaaccgcgtagaaaaaaaaaaggtccagtcctcaaactctacagcgggggcgagccgaggaagaagaggtcgccgccgccgccaccgcttcc

SEQ ID NO: 10333 - DNA, 85 bp, Zea mays
agtacttgtatgtacaaaatgcttgcatatgttgcaaacttgcaatacccgattccctgaaagctgttctttgttgtaggtggac

SEQ ID NO: 10334 - DNA, 1500 bp, Zea mays
aacggatccaaacctttctgtttatatcatgttattttataataacctgatgtagtattattttataataacatgatataaaacttaattgttgaagctgcaaaagtttttgtttgcctaaacgttttgatgttctattttaaaattgagaatgcatatataagatttgttttaattggagatgctcttacaaagacaagaatactactcaccgtgatctagattttaattggagatgcttttacaagaatactgtgttcagggcttcgggcaaagggatctcaggtatgctgcctgctgtggacggttccaagtaaaatactagcatatgatgactgtatgaaatagatttcacgagcaacgactcgaatatatatgttctttgcgaacgtatctggtgcaaaccaatctctttttgtaaccttgcaaacttttaatctaaaccacatgatgttgattcaaggggacgtgcggaggagtgggagatgatttgaaaaagtgtgattagcaggagtgattaagtgtaaaactatccacacccctatgtcacttgtattaacatcatgtgacatagattagaagtttgcacggttacacaaagatattggtttgtaccaaatacgttaccatgtttttttttgtttagagttcagactcaaatgatctagaactagtgttttctttcctcggtcttctgatagctgtcaacaggaccagggggttttgaagatcgtaggagtggcgaaaacggaaagaaagaagaaggttcttctactcggcgccttcttttgtggaatggaggactgggaatgggatatttgaattctttctcctctcaccagcgaaaaaaaaagacaaaaatattctagaaacaattagaggctgacaaggattaaaccaaaccaagcgaacatagagggagaaaacgaccgtgatgacagaaaaatgaaaacgaatcgaggaaaacgaagggcgagacgagaccgcgaaagcaaagctgtattcaaaacagagggccaggtcagatcccggtttctgacgtcgccggttttgccgtccgtttggcgccgccgtccagtgcggtgctgtgccggcagccgccgcggcatatgctgggtttcgcccaggaatcgccatgacggggcgaatcccactgtccgctacagcagcactgcgagccactgaccggtgggcccgccttgctctctgcatgtgtatatgccggtgggaccacgtgtccagcgactccatccagtcctggagcctgcgcggctgcgccttgcatcgcatctccgtcgtcgtcctcgcccacggaatccgtccaattccccacgccgcccgtcgtccttttctataaaattcactccgccaccaaatctcgaatccccatcgcgctgcttttccaccgaccccgacgccgacgccgacgccaccgccgctccctccccagtccccactccccttcccgggccgcggagcagagatccggggcgccgcgcg

SEQ ID NO: 10335 - DNA, 1500 bp, Zea mays
caagcctacatgtattccaataagtgtcaccattagtgacccatatagtggccctggattagtgctgggaattggaccggatcagagcgatttggcctgagtccatcgtgcttcggaccaaacaagtttagactaaagaaatcgggtcaagatataggagtcgaaagggttctgtgtggaatatagctttggttcatgctgaagcgtgtatttaatatttatgcagatagaccgctgactacgatcaacctagcttgccggtatatattttttttcagaggtacctttgagcttaattgactagctcaaactccttttcattaatctaaattgatcaataatgtcagcgtggtttttttatttgatcccggtcttccgactgacggatctatggacagattatatagatagagaggctgacggcactgtgccgtaccatggtacagtacatgcagcagaaatttcggtctctgctttctggtggtcaaccctgatgctaactcatatattctcacaaaaagaaagaaaaaaaaactgagtttgacttgagaaccatgatatggtaatatagtagagaagatgtactatgcatcatgcatgtatgccacacattctttaggttgatcattgatgcaaactgagagcatggccccatttttttcagcttctggggcgcttttagcctccaaaagctgattttagataccaaacgcacaacttctcgatctgattctccggcaagcgcttggcgtagaatttgctgttacacaggttgagagaagcgaccatcctgccgcgtctggaggaagtcagccggattctcgatgcttggccaatggccttccgtaccttttgtttctaccattattatatttgtccactgtactaccatcaataattatgatgttgtttttttaaacaacctgtagcacgtatttgtacggtatctgttgcatgacatgcaaagttattttaacaattacggaataatttatattattgtatggcgattacgaataagtaggcaagtaaaaatgttacttacagaaactgatcacgttagtgtgataattgacacatatgagtattttggacattttgtaatgggagcttagaatcagcccacgtagaatcaatatttccaaacgcccagattatctacacatcgattctttccagctagattcttataaaactagtcagaaaaaaaagtctaaacatacatgcccatttgtcatggctggccttgttaccggacacggcacctacccactgcgtactacccctcctctaccaccgccgcctacttgccgggaaaccgacccgattccagtggctcggatgtaaattgatccaaacggcgtgcctcatgccgcacccgccgcatccctctattaaaatctcaccggtttctttcctcgccggcaatcctcctccttctttcccctcgccgatcccaggtcccaatcttttccttctccgccctcgccgccggccaac

SEQ ID NO: 10336 - DNA, 1250 bp, Zea mays
gacagtattgcgaacatctgcctccatcaattgtcgcctgctacttcaagcaatatgcaatgtcaactcatgtaaatggagcatggatctctttgttggatatatttttctctgaatttgttaaactcaatattatttcggttatagtcagaatggtttgcttatatgtatccgctatattgcaagtataatattgtatacatacatatacacgtcgtaacaaatttgctgtattatttctgaattaaattaaacgtgaaaatgactaaatttctaacagttaaggcattaatggtaatcagcggcaaacagaaaatggggggaaaatctgtttgcataaaactacaaaaatgctgcaatatttcaactgcaggagaaacgggctatctcaattccacaagacagcacttgcttcgagcacaactgcacgaattcaattcacagattctccccacctttcgggttaatttggtgaccggggatgccgaggggaagaaatcctcttgatattcaaaattgaattgcgaggggattcctcccccatggatcccctagggatacctaatcaccaaattagccattcacggttttacgaactctaccagtagctacagttaacgaaaccggtgctttatcagctttagattcacctcctcaacaagtaggacctctgttaaccagtaagtaatcactaattcttaaactcgataatgctgtagggagaaccggacaaggcaataacccaggcaaagcaaaacctaccaggcttcttggaggtaagggcaaggcgcttgcggcggacaagcgagttgagcagcgacgatttgccgacgttggaccggccaacgagtgcaaactccggaaggccgtcccgagggcagtcatcgggacgcacgctgctctttacaaaatctgcgttgaccacctgtgcgtcgccgcgcgcgtatgggcccagcacgatgttggagcccttaagcacccgtgcgctcacggcctcctggtcccccgcatccattgttgccccgggcggcacgaagagatggtcgagcgggagcttgatctgcccctccccctggggtgccccctcatcgtcggagtggtcgacggtctggggtgccgcgaggtggggcagcgcgtagaagcgtggcgagagggagaggcggcgcggcaaacgggaggggcagaggagtgtggaggtatgtgtggaaggaacaagaagtaggcgagggaggaggcggtggtggagaagc

SEQ ID NO: 10337 - DNA, 434 bp, Zea mays
cctgtcatcggaatttcaaaattatgaaattttcctcgctttatccgataatccaatgcattttgtgccaagacgttagctctgcaattcttaactctaaatatatgccaaataccaaattcgtcaaagaagcggattatgtcccaaaacttctcaagataaccatttaaagtatcatttaaacattgatactcctctaaaatttgttggacgaccagctaataatcaccaaataccttcacatgtttcactcccatgtaatctaagagttctaaaccgaacaagcaagcttcaattgtttgtgcagtgagttttcaataggctagaaaactcaaaagtggtattccttggtgaaacaagcacgatgccaatccatttcccttcattgcagactgatccatcgaaatatagagtgcagggagcaacgataaggt

SEQ ID NO: 10338 - DNA, 124 bp, Zea mays
tcggcgccggcgacgcggtggggggcgggggcgggggcgggggcgggaggcgaggctttaattcgccctcctcctccttccggtttgagcgaatggaaggcggacgggacggaggtgatggttg

SEQ ID NO: 10339 - DNA, 1500 bp, Zea mays
aggggcgagcgcccgatgactacattacagttaagttcctaaaaagctaactgtaacaaggtagctcatgagactgctgtgtttaggtgtaagcgctcaagtggcctccaaaccacttggaatggtgcaccttacgggcttgttcgtttgtatcggattggtgggtcggaacgattcctaaccggattgcttctctaatttatataaactttgagtagctggaacgattccgggtgcaatccgacagaaacgaacaagccctacgttgtctgaggatttggtgtccagcgagtctgctgagaccgatgggttttgcttaaaaaaatacaggccatatactccagaatccagcctaggttgaggcaagctgcttgctcaaaaaaaaaaatctaagtagctcaatgatttagggtgtgtttggttcatggctaactacgctacactttgcctaagtttagtcgtttaaattaaaaaattaaccttagacagaaaaattagacaaaatgtgacaagttagacagggaaccaaacaaatgaatccaaacaccggggtgaatttagtttttttttttaaaaaaaaacttagattggcaagacggtggataccaaccataccaattatcccgtgtacagatcggtatggtttagctccagtatcgactgagctgacaggtcgacagacccactgtctagctggccgaacagtcccacgttggagctaggctgatcggtacagaccatcagctcggccacatcacattagagaggagagagagagacaccgaggttgaaaatagcttctcgcgataaaaatgcatgcatgtcgcgcctggtgccgcacgatattttagttgcacccgcacgaatcttgatgcaaacaaagccgttggataaaatgtggtggagcacgtggttgttggagaaccgcggctgcttctgctttggctctgcgactgcgagtgggaaacgcgtctccctccaccggcgggcggggccgtccgaaacgagacggcatgaccgagcgcgcggctggtgcggtggtccctgggcgcgcgcactgcaaatgcggcggcaggtaggccgcgacctccagtgcaagcaagctccagctgcgccgtccctctccctccctcccttctcatcgtttttaatttccatcacctgcaatgcaactgcagcccacgccgcgtggtcaaggtacgctgaccgacaatgcctcacgcctgcagctgccgctaccagcggcggtcacgggtcaatgggcacgttcacacgcacggctgactgcctgcctgccatgtcccgccgcgttcgccggcagttcgaccactactagtagtaccgaatgaggatgaatgtgcctgcctgccatctcccatccccatcaccctcctctgcacagactgcactgcactatccaactcggagctgcattggcactgccactgctgcaccgctctgcctacgcacgccacgccttgaccggttccagttccgtac

SEQ ID NO: 10340 - DNA, 274 bp, Zea mays
cgtcgatcttttactattttttttaacattgtagtgttagcaagagctatacgatattaaaaaaatgaattcgtttctgttctatagaatcgtcccatcatgacccaagtcaggcgcgtatagcagcgtcctccggcgggaaacggtaaataaaaagagatgggatttgagggccccaaaacttccctccccaaatcccccaaaccccatcaccattgtcaccattgctcgccgaaccctagagagggcgcgggggcggataccttagctagcc

SEQ ID NO: 10341 - DNA, 187 bp, Zea mays
agtacgcgtagcttttgtgccaccctttttactttggttgatttctgcttgtgctctgaagatgctatggttgtcttgttcatatctggcttcttggtatcgtgtgtcggtgtttccatttcgatagttattcattctttacagcacatgttgtaaatagcccagatttgtgaacagaaaataatac

SEQ ID NO: 10342 - DNA, 411 bp, Zea mays
cgtgcaccgacgattgcacaggatatggcctccatcttaacggaccggggtaactgttgttcttgggggtactacatgggtgtggcattacctgaatgggtgtggcattacctgaggtaatgcatacgctgaacgattcaactcacaaaatcgcgccgccgtgtactatcacaagttgcaaacgcgttagggacaagatgagttgacttgacttggggcactgcactgcactctgggtctggaagagttgcatatcctatccttcttccttcgctccctctcattcatccaacactactccaagtttaatttcccacaccaaacctcagctcccaccgatcggttccatcaacctaacaatccctcgcttgttagcccgcgcgcgtgtgtcgtgtgcgctgcgtgcgtccc

SEQ ID NO: 10343 - DNA, 1500 bp, Zea mays
acgtggtccaaggaatagaaagaggttcggcttgaccactgacatgccacgcctacatacatacagtcgcgagtctgacggagtgcactgcactgtacaccgaaaggcggagggggtgctgcatgattgatgatgcttttcgttgggtggcgattgaaatgtgattcagcagcggtgggcgcgaaagggcacacagtgatggacggaacgccgaacgcctgctcttgccttgccttagccttcctgtgggctggctgtgacaaccttgccttgcattgcagcagcatggtgttgtgtgtggggaacgcctagctagctgccacgccacggggcggacgagacgagagagtgggccgccatggggacggacggatggcgacgtacggccaaatctacctagagtcctagacacacgggtcggagtcggagtcggagcaaccttttgcgcccctctctcccacatgccgctgccggccggccgtcggcgttggcatggcgccctctcgccaccgcactgcgcccttttcttccttcctttctctatctctctctaggtgtggccaccatgcggcatgtccgcttgggaaaaagctgtggagaaggatcactgcactggagtggagggatcgagatcgaccgtgccgtgaccatacgcgcgcgggagtcgggagataaaaagcagcccgcgcgcacgtgccgctgccgttgccatcccgcgcccgtgctcctgaccaagattagtggctgcctgctaaccctttgcttgcctcctcctttcgttctctctgtctctctgtgatacttttacacggtcgatgctagcgagtggtggtggtggtgcctgcgttgcgtggtctcgtcggggtttgggcatggcggtcggaaggatgcttattacacctgcatcattgcatgtttgcactgaatgaacaggtgaacatcatgtccctgattgggcctcacaccaccatgtgaacatcacgcacgccgagcgaatctcttctccccttcttaatttaactagtagtactaacagacgacgatgatgatgccatgtttaataagcgataagctccggccggcgacgattctctcgcacgagtggttattgtcgacaagggcggttgcgtctggtctaccaatactatatataaaaaacagatgccctgcttcgtgctttgacgcatcgatactctctagtataattggattggaaccaacttagctttgcatgcatgcctctccgtgtcagcttgttcaagtggcccccaccccactgcactgatagcaacctcaatgtctgcaaaaaaagaacggttttcagacaacatttggacaatgaactttataaacattttgcagctaactttataattggaaccaactttataagctcttggttgattttatttacttatttcaaagaaaacgaaatggaaatgtcgcagcagctgacggtttgctggttctcccgcgtgtgtttttttcgactgggtgatc

SEQ ID NO: 10344 - DNA, 504 bp, Zea mays
gcagccatgaacgcggcgagtattgtttgccgaacttggcgcgttccaacgccagactaacatggagacctacctacctatctgtctgtaaacaaccatttattgcctcgccgaccgacgacggatggattagaatatgcaagcaagcaacgtacatggcggaaggaaagcccaacagctagctgcaacaaggtcaaaagaaagaattgccgcgtctgtctctctgtctgtccggccaccggcgccaccaaccccggccgcgttaaccgtgcatgcatgatcaggcgtagcctctctgaggctccgacgacaccttcctttgcaatttgccccggttcgctccatctatataagccaggccacccagtatgctggagccacacaaaacaaacaagcttcggttctccgtagcgactgcgctgcaatcaggtcgtcgtagtacgtaggtgttagccacatacgcatcaggaagctaacgagaagatcagatcggaggtaacggca

SEQ ID NO: 10345 - DNA, 198 bp, Zea mays
cagatttgaatcgtaccaaaaattacaggccaggccaaattcatcttcaactgcaaacctcatcaggaacggaaggatgtcggaacggccagcagccgctttcttccttttacttttttctgatatttctatcggctacgatctcatgcgttagcgagtgccgccccgcccgcgctatccactcgtctctccgtcccc

SEQ ID NO: 10346 - DNA, 497 bp, Zea mays
gaaaagaaaatgggtcagctatagacgagaagacagcatgccaaacaacgtcacatgtgaactagaatagctgctttgtggcatgggattcagtcacaagacctttgaagtatggtgggcttgggatccctaatttacaacacatgtgttgggcccttcaagccaaatggctttggcttcaaaaaacagatcgggataggccttggcttggcttgtccatccccattcagcaacatgttaaagacctttttgctgcatccctgatttctcatgtgggaaatggctctaataccttgttctggacagataagtggcttaatggatgctccatcagagatcttgcttcagaagtggtgtccaaggtggctaagcgagctcttacctctatgacagtggttcacgctcttgaaaacaggcaatggattgcacatatcaacccccccccctttccttgattggaattcagcaatttcttttcttatgggatactttaggag

SEQ ID NO: 10347 - DNA, 176 bp, Zea mays
ggtgcctatgctacctcatcagtcttattttgtgctatgtcctaatgagtttagtctcctgtatttcttgttaccgccttttaagcactagaccaataactatactttccatgcagatgatgcggaggttaaatttctttgtggcattctgttgcattgggcatatataatagagc

SEQ ID NO: 10348 - DNA, 898 bp, Zea mays
ggtaacttaaagcacttactacaccttgtgaacttatcatgttttttttcccacattggtaaagactgaacttcattatcaaagcaatgaaatttcagttttagtgagtagcaaagacgaacacgaaagtgagaactaaaacccagcacgcccataagactgatcactgagggatcagtcccaagaacgaaaactactgctacgactgaagcgaaacacggcaacgaccaaaaacccacctgaggtgactctcaggagtttgactccagcccaggtggcacgcatgcctagaaacgacgctacctacacagctaaccaactaatgacacatgctgacgatcctcttgtttctgcagctccagatcttttttgtgaacttaccatgttatacacagaaaagaaaccttccatactaggccagagtaattgtgtttattttcagccgctcttaaaaactcttgaaatttgttatgaaatggtgcttgttgatatatgtacttacaattctagcaatcatgtctttgttaactgctaaactcttttgatcaagtggccattttgcacaagtacctcttgtttgtcttgttcagatgttcatttattatgaccagaatatatttgatcgcgagagtaattgtactatgcattgcgttcctaattccacattaatgaccactcttttgatcaagtgtgctgcttagacctgtttccatataaccttttctgccatcgaccatctacctataactttcagaacccttttcagctgtatttccttttctctgaatgtgtgacatatgtacatttcttgctatggattttgtgaagctaccgacagttgtatcaacacttaattttacaggtggaagcagaaaatccggtagaattggttcttgtg

SEQ ID NO: 10349 - DNA, 1500 bp, Zea mays
tcgcgctggtcgcgtgctgtttcgtgtgtcgtcggcgtgctatgtcgagcgtgtccgcgcgtctttcgcacgttgtcatgttgtttcgctcgtcgtaaattcgcctcgcttagaatctctcgccttaattaaattactggtttaactgatagccgctaatgtaacaagttaatcaaaactaaatggtagatattatttatatttgataatgtcgaattaaacgttttagttaatatttatttagtgtaaacgttacgacttctcgaatgtaactttgaccgtcacgtttctcatccccgcgtaaccgtagaagcgctctctattttatgctgcatgtttttataacatcttatctcgtatggtgtaatgttcttatgtatatgtttatttgcttgtgcctgttcatctttgcttcgcgtgcgattagatcgcgattcgtttatgagcttcgaggaatcgatgatcaagcatggcgacagagtgatcgaactcttcgagttctacgtgattgaagaccctgagcatctgtttggtgaaggcaagtgtcctctgacccattatgtcccatttactttataatacactgtcccacatactatgaacaacctaaggatttactagctttctatttaccttgtccttgatttaccttttgggttactatggttagctacatgctagcgctttactttaatcaatgaacatgatgagatacaatgatgatactatgattttattctggatatgatgatatacttgtggcatttaggggactcgggctgtttcccgagtacctctccgtaaggacctgttcgttgagagactacccgggataacagtgcaaccatgagggtgaaatggggcgcccttagctaattaattagaggaactagaggtgtagttgcttcgccgtcgtgccgtcaatggggtccaggcacagtgcttgctctgccgaggctgggtgccgaagttctttcgttttgcttttgttagtcaccccccttcggggagaggtactgtgtttatcaaactggagaaacctaacgggcagctatgacctctagggaatctttgtaaaagctacgtagtgataccctgccggaccacctaggaagtgatcaatggggagtcatgatccccgggcaaaatgggaatcacggctcatgggtaaagtgtgtgacctctgcagagggtattgaaactgatatatcagccgtgctcacggttatgagcggcattgggatcctctttgattagagatacttgatcagagatggttggtttacaggtggtgacaaggatgatggttatgactatggtaatggtaagtggtattctttccgtttggraagggtactttgggttaataacttgggttaatgttaaaacctggctctcaatgagtaataataacctgaccaactaaaagcaactgcttgaccttaaccccaaataaagctagtccactgcagccaaacgggacatttgctgagtacgttg

SEQ ID NO: 10350 - DNA, 394 bp, Zea mays
caactcagcccattagcccagttgggtccacgcgctaacctgccgtgtcagacgagcagtcacgacgacgcagcaggcgaactcccgcgaaaagcgagactgaatccatcacaaatacatcaccgccgtccactccaacccgccggacaaatcagacggtgaccgcgctcagcacgctccaaaaggagagaaaaaaacgatatgaaaaccaacacgtcaacctctccttcccgaagcaaccccaccgttccacccccttttctgccttcctttccccgtgcaacaaacgcaaacgcgacctaacgaatcgaatcaaattcgccgtccacctcgtcggcgtcggcgcaccggcctcgagcccagccccccgtccgagtccgatcagccaccagag

SEQ ID NO: 10351 - DNA, 1500 bp, Zea mays
tcgtggcccgcgttgaactggaactaccgtggcccgcgtgacgccgccgcggttcccgcctgtcacaacctttgctgcgcgccttctcttgcctccccgctgcctgtctccagctgtccgcgcgcagccagcccttcacgcaaggctgcacggctgcaccgcaatgctcgcaattcacaaaaayatcaaggtccgtgtgaactgtgtcttgtggtaatttctgaattctcgcccaaagccgaatgccaaaaataatcgccactcgatcgatccgcaagggtttggttagtatactgctaaccaatcgtgcgtgccacgacgccaactcgacggcgacagccacgcacggtacgggaggagcagtgcaatcgttgtgttccaaagagctaaggaaatctaccacgaataggcaagccgcggggttgagttgggcgcaacgtacagtacagttgccagattcgcattgcacgcacaccaagatagtgggggagaaactagtacgtatagaaagtagagacggcacggcaaagcgcccgctttccgcaaagccgccgcgcatgcatgcagataaagtaagcaaatcccttgggcaaccaggctcatctatctctaccatagctaaggctaagctaaacgttctgattccttccgttcggcgtctttgttccagctcagtttcacctaaaccaaatctaagaggggcttccagatgttgcgttgatgggaggaagcaatggcgccaggcgttggatgcaggaaagaacaaggtgtcccgctcctgcaggtgcaacagatgactgtagttgtgtgtactactcggcatacggcatgtattgtacagtacgtaccagatgcaacagcttgtgactgcccggtccgggtggcacaaaccgtacaacacaaactgggtgtttaaatgataatttttaggatgccagcgacacaagaatgtctctctccgtgtgtgtatatataatctgccatttggccacgccctggatcctgaaggtgttaaaaactctgacgaaacacatgttttagtacatttacagcccataaaacaaagacccggcaccaaacatgcatgtgagcaggaaaggaatcaccgcatgggccgttcccgtacgaggaagaccggggtctcatggtcatggcaagaaaacaaaacaaagattatcgcgtacagtacagtagtcagcaagactagcatccatcgccatccccagttccccacacacccaacaccacaccacactactccaaaatctatccgttaacaaaacaagccggcagccaagtacagtacagtacagcagacatgcgtccccatccgtgatatcccgtcccgtcccactactactgggacccttccttcccaccgccaccgctcactactccggccgcctctcttccagcaaatccctcccacctcctccccgccgtctcacgaggagctagaggaaggggaggctctgtaccagcctgttggaagggggcgag

SEQ ID NO: 10352 - DNA, 1500 bp, Zea mays
ggcgcggtagtagctcttgccatctcgcagctacacatcggtggtaacttttagaatgccatcgatccatttgagagttcgtcttctgcggatcagggcccattgctgggtgatttcaacgctgctgagaacgttatgctggggacgacgttttgtgaagggagtaattgtgcattcgtagtcccgtaatttgttgtcctgcataacttgtagaacggtaacatagtatctaagggtctgtttggttggactttggctgtgaaaaaaagctgctgcgggctctgagctgtggaaaaaactactgtgagtcataagctgttaaaaagctaaaaatcgtttggtggaaaccactaaaagttgttaaaagttcttcaatatatattttcacagttctatccaaaagctactaaaaacatgtcaagaggtgcttttaatttgcactgcgaaaaagtcagcttttagaaaaagctgcttcctagatccagctctttggtttggcttttagcttttagggggcaaaagccaaagccaaaagccaaaccaaacacacccttagatgtctctctttgttctcatacgtgagatgagacacgaggttttcacaatttcctcttgcgatgtttgtatttacaaaagaacgtccagagccacaaatgagttctaaccattatcttacaggccacttagctacgtaattgaaccccaaacatactcatactacactctaacacaaaactcaaaacatctgacatacattaaattatgtgtttatttatcaaaaggtttagaaagaaaaataaatagaaaagaaacgaacaatatgggctttttctttatttagtggcccatctaaaagccattaattcaggacaaacctacgttccaccacacccacacgtttctttaccctagccttttcactgctccagcgaaggcacacagtgacacagcccgacaggcgacagccgccgccgtttcttcgtctcccatcttcatcttcctcgcagcgcaggcgctccatcttccgctccctctccgactcgcgctcggcacgcaggcgacggcggtggcggcgctcaggttcgggctctcagcgacggcggggcaaccccagactcgctgccgtcgtcagcggctcttcctcccgcctctcgccaatcgactcgcaccctcgcctccggtcctcgtcccccccgcataccggccggcgaccctgcatgcgcgcctcccgctccccttccgcctccggtggacagtcgacggcgtccggctccggcggctgcactgcgcgccgcgtgcggccgtcgggcagcaggagccagcagccgctgctccaccaaggcgggcgcgccgctttagtaccgcttattccccaaacgaagcgtgacccgtccgcttagcgctgaagcgtgcgcttagtgccgcctgttggaaccctgatctatagttggtcttcttataacttctcatagtacactttcagcaacacattggactaca

SEQ ID NO: 10353 - DNA, 468 bp, Zea mays
aaaaaacggaggtcgggtactagcggttggagagcgcagtccccggwyytgaccggtcgagtccttcggccttcccaaaacgcggaggtcgggtactagcggttggagcgcaggctgcgcagtccccggacctgaccggtcgagtccttcggccttcccaaatcgcatctcttgacactgcttccgtcccgtcgcctcgccgccgcgacgagacgaccccgcccctacaaatacaccgccactttggccgcgtcagccgccgccacttcccagatcccgatgtcccgcgcccagattccactcccttgttgcatcgctactctgttcccagctcggggcctctgacgaggcccgaggcgcaggcgccaacctcccggcccgccctagggtttggggctgatcgatccggctaggtcttggcgggagctgctccaacaatggggtcgagaggaggacgaggagctccag

SEQ ID NO: 10354 - DNA, 213 bp, Zea mays
cggatcaggtgcacacgaaaacagccataaaagaaagcgagctcgcagtcgcagcgggtcgaccgggagaagagaagaagagctactcctgctcccacactcccagccgagctcacgcacgcacacgcgcacacgcgcgagcaggagctccggcaagatccaaaattgtcccaagcccgcgcgcgtcggggccgggcgcaaagggatcatcgg

SEQ ID NO: 10355 - DNA, 701 bp, Zea mays
gcctgagctgcgcgccagaagtcgcgcagcatggatgtaattatgtaaaccaatgcattacgaaggagacgctcagatttcttcaacctagagcgcagaagtttgtcgactctgaaatgaaatggcttgcgtggcgtcgttgttcgtcaaccgttttttttttcctgcatgtttgctaaagtttagtctcagttacatctgcagcgtttgaatggcaattacgataattataaaactaaaattaatcgcatagatgaagactaaaagatgacgaatttattaaacttaaataaatctatatttaatttaatgtttataattaattttaaatatttgatgtgacacgaaaccgaaggtaactggacaactactctaacgaaatgttggcgattccgttttgtgccatggcccccgtaccgcgtgaacgacgacatttcaacggcgagcaaagcacgaagcggttaaaaggacgcgctgcggcctgcgcggctgccttcctccgtctccccacctccgctcccactttccccaccaccaccattatcgccaagaccacacgcgtccagactccagaggcaagcaaaagcgaggcaagaaagcggcagcctcctcgatcgatcgatcgatcgaatcgaggtctcaaagtctgacagccccaccgacaggctgcgccgccggcggagtccactccgcccggcgct

SEQ ID NO: 10356 - DNA, 1109 bp, Zea mays
gttcgtggtccggactgtccgccatagcaacgcagatcgtccgtgcatgcacaaaatcagttaaggtttcgtatttcttacaggatttgttagccaactctacgggattaactcgataaccgacttgtaatgggtacagacctccctctttatatagatgaagggttacgatcgattgatccccaataattaatcaatcaatatacatctagttttttacattttgccctaggagtagacaattacttagattcctctatctaatcttcacctctctccgactctgcgttgtttagaggcgtcttggatggcctgccgatctcaagacacactctaggatctctcctccccgacggggtccctctcgggagcgagatttaggcgccgtcggtgaactccaccgaccctgcgcacgcgtggaccgttccgccatcaggcgtagacaatccagctcgtcaggcaggaaccctagcctctgcgccaggtcgcgaaccgttcaacccctagctgcagaccgtccgcgcctctgcagagagcatcactatgggttctcatcacagtgattaacgcccggataagcgacaacaataaagattaaggtcgtttaacaaatgccaaccgctccgcttgaattgaatggccataactagactcccaatcaaaattgaaaagccaaccactccgagttggactcgcgccttattcgatgtggttttaatccgactacggttataatttatataggattttattattatggattgtagctgcagcagtgcagctgaacagctgaacaaccggtgcctatcagaactttgtattttttctgtttttctacacatataaaagtatactaaaacgtttaggatacaaaaacgcaccattcaaacgtatctcatgtcatgtcagtgtgacggcaaaaaaacatatttatatattaatattttttatatacattaataagggatagagaacaatatctgtcgtttagggaccgaggaggtatagcattcttttcataaaacgaccccaccccgaaaatctccccgctcacaaagcagtcctcccaccgcacgcaacgcagcctcgacctcgacctcgccgtcgcc

SEQ ID NO: 10357 - DNA, 1500 bp, Zea mays
gatcctaggagctaaagcaaaaatcacttagcaaaccattctagtcacttttagcttttcctatttggatctttaactactaagtgactaaactttagggcctgtttggacctaggagctaaagcaaattgactaagtttagctcaaccttaggagctaaaagtaactaaaaggatacatttttactattttagttacttttagctcttcttatttgtatctttagcccgaaagtgactaaactttagccacttttgtgttagctcctgggatccaataggctagtcacttttactttagcttctgggatccaaacagtcacttaggatatgtttggaagcacaccgacatgtttggaagcacaccagttttaaaaaactattttctatcctcactttcttgaaaatgttttatgaaaaaaattgggtggggtgtttggaacctagtttctagtttttttataaggagaatagcttcttggttttagttatgggagagtagcttcttggtttttaagaaactaagaatccagtttttataaactgagacataaacaagtatatttggaatcactctagtttgtacaaaccaatttcttagaaattggatgcttataaataggccctcaatgtccttgttgggtttatgaaatttacatctattaccattattttaaaaatagacgaagaatatgttagtaattatgtataaaaaactagaaactattttaaaaaaaactgagttccagttacctttatctaattcttttataagctaatttttagacactgaggatagaaactgtttttaaaaaactggtgtgcttctgtttaactcttcgtaagaacagtggtacgtcccgtgtctatatttggcttttgttaaagccaacagtacatgcttgcgtgggtgaaaatgtgaaatgccatcgctgtgctacaacttttcggctccctcctgcttcggtgcttccacatgcccctgcacggcgtctagaaatcctaatgattcagcagcacacctgtccgcctagccgcctacgcgtacacagaaaacaatttttttgtccacacacgcgcgcgctccgagccgcagatccgagctagcgcggcgcatccgacggccacgacagcgcagtgccgtcctccgccgccaccgcttggcgattgtccgcaccccaccagtccaccacctcccccacgagcgaaaaccacggtccacggaccacggctatgttccactccaggtggaggctgcagccccggtttcgcaagccgcgccgtggtttgcttgcccacaggcggccaaaccgcaccctccttcccgtcgtttcccatctcttcctcctttagagctaccactatataaatcagggctcattttctcgctcctcacaggctcatctcgctttggatcgattggtttcgtaactggtgagggactgagggtctcggagtggattgatttgggattctgttcgaagatttgcggaggggggca

SEQ ID NO: 10358 - DNA, 753 bp, Zea mays
ttctagaaacctaggaaatccatatctccttcgtttaaacaccgatttaattcgttctagttgcgctatattcgtataaatatttactacgttgttgcaaacattattatatcatatcacatacttttatggttagctatttgttaccccaatgtttagtagattagatctttctaatcaaggttagtcggcttatgagtgtagtctaactaaaatatgatctagaatcaagttataacttagatcaaagttgaattatttaattctttgataggttttctcatatgatttacattaatcaacatagaatatagtttacttatttaatcatgaaaatcttccaaaaatcataactctttaaccgaaactccgattttagtggttctcgaatctacgctctcgtagcatcgcatagaatattcttacactgtttgttctcttgttaggtgtactgttatttttatgtacttcttgactatttgtatgtattgctacgaatagcggtgaggtcacgagaatctgaagactaacttggtacatgggatcttaagtataaggcaagttgtgccctgttgggggccttcctcttccgaaggtcctcaaaaacttaaccaacatatttttcagtataacagactgttacaggaggcttcggctttgagatgaaggtgtgcatggtatgaaggtgcggtctaaaggaaggataaaccggctccgaagttgtggctgaaggagcttcggcttaacaccagg

SEQ ID NO: 10359 - DNA, 746 bp, Zea mays
ggatgctttctagaggcgtgtccaacccttcagggtacggtatgcggtcaccctgggaccggctgacagccgtctcgacctacaggccctcgggttccgaggaagatgacgagcccgacttttgttgggatttctccggacttggtaaccccagtgccatgcgggacttcatgaccgcatgcgactactgcctttccgattgttccgacgatggccgcagcttcggcgacgaggactgcggcccaagtcgtgaacgtttccacgtcgatctagggggtcacggcgaaggcaaccatcttggtataccggaaaacggtgatccccctaggcctgcgcctcgtgttgacatccttcgggagctagctgtggtcccagttcctgcggggggtcaggactcacaactcgagcaaatccgtgagatgcaggccaggctcgacgagggagcaggaacacttgagccgttccgccgggacatcgagcaggaatgggcatgccaacctccggccggagaagcgcgtcatctaccccagggcatccagcaccgcatcgccgacgatgtcagggcaaggccgccatcggcttccagtggggtcggccagaacctggctgcagcggcaatacttctccgcgcgatgcagggagagctcaagaatctcctggaggatgcagcggtccgacggaccgaaagctctgcctcctgaaggcagggatacccctcggagcatcgcgccgcgacttcccgattc

SEQ ID NO: 10360 - DNA, 172 bp, Zea mays
cactgtgattttttatattaaattaaaactaaaattgtttattttttatcaacctaaagtcctaaagaggcaagccagagaaagtatgtagccgaacctccgcccgcccgcgacccaaaagccgaaagcccgaaaccagaggcgggtagggttctagctgcaggcgacggcc

SEQ ID NO: 10361 - DNA, 225 bp, Zea mays
cgttacgcattgtacaggtgcgtggcgcggacggtgctgtgccagtgccacccagtgtgcgtgcccacgtctataataagaaagagagtgcctcgcgttgcgcttgcgccgaggaaaacagaaggaagctgaagctagcggccggcctaccgcacgcaacgcaagcagagtgcagaggaggattacagatcgaggcgtacggacgtcgagcgaggagtggtacat

SEQ ID NO: 10362 - DNA, 973 bp, Zea mays
gtagagaataacaagatcaaaacctattatgaataaaaatagatatattttcataaagtatctctctgtatttatgtaactcgtgacgtcttgttcgattacacatggatcggaagagattgaggctttgttcggttattgatattatatgtgtattgaagtggattggaatgaattttggcttattatgaatctaaaccggctcaattccacccaatacatgtgaattatcaccaaaacgaacaagcccaggacgattaaatccctccctattcaatattgactagaaagagatttttaattctctccaactcttttcaattatctccaaacagaacaagccctaagggtttattcggttctaccccaatccatatggattgaggaggtttcaatccatagtaagttaaaatttgttccaatccatatcaatccccttaaatccatatggattgaaaataaccgatcaaggctcaaatgaattctaattttctctaaaacgagggatccaaacgcccgtggtgggaattcaaaaagaggaggaagagtgttttgacgtttttgctgcaacgtgtatatacaaaagtgtgaagctacggaaaaagagttacaaaatcctctaatccagataattgtctaaccatccgaggaccatttcgcaaaagcacactaagccatgactgatcagagctaaacataggggaaagcagatctgtcgcaaactcgcaacccaatacgccatctattcccgtcgctgtcgtccacctgtttttttcgttgatccgcagccgccccttccttctcccatttcggcgtctcgaagccagtagattattcatttctcgatccacaaatccctccacactctccatcccgaaccctgaaatcgaggagcgcgggaggacgccgcaaagcgcgttggctcttagggtttgccggtagggttgggaggctccgatccgggcgcgcaggc

SEQ ID NO: 10363 - DNA, 819 bp, Zea mays
aaatgtgtgttatcgtaatatactggtattatatatttccgttgcaacgcacgggcattcagctagtaaattatagacacggagtgacataatatcacatagtagtgacatgaatgcaaaaagcagaactgcagtgcagaaggcaacaaacaaccacactgattgaggcagttcgtgaacaagccgtcacacccactcgctgctgaaccaggagttccatccatcgccgctcactcccacgatcagcgtcgtcgcttatccgcaaatatctctcttcctctttgcagtcggcaccatgggttccgacttcaaatcgatccccttgatcggtacgtctcccttaattaattcttcaattgatcccatttgctctctggatgtgatttctcccttcaaagattcagattcaggtatcctgatcagattctgctctgcgctgccctgagacatccaaatttcttttcctcgcatttccacctcaatcgcgctgtaacaccttcctcccatccccaacctcaagaatttggtatccccgtttgggctgcacgttccatgtgggttcaggcttgagagccagctgcccccgtttcttgttcgcctcctgccgccgccgccgcagtgccagtaacttctgcaagcgaagggacgcaactcctcaaggatttgattcatatatttgactctggcttcagtagatacagcttctgttattcgccctctctctgtgcttcgatctctcggttttataacgagcgtacttgtttgttcccaccactgccagatatcggcccgcttgtcgaaaagattgatgatccaagc

SEQ ID NO: 10364 - DNA, 132 bp, Zea mays
ggtttgccccaacagcattgattattggtctattatatttcacgggaaaaaggatgcagagtggtttcaatattggaggtggtgctggcaaaggaagaggaggtattttcaacatttggaaaagctacagtg

SEQ ID NO: 10365 - DNA, 723 bp, Zea mays
gtgcggagacatagcaataaatgaaggggggagcgagaaataaatccgctttagtcccttttagctaccgtttaagggactaaagactaaagccaattagtctatactttagtcctcctatttgtcagaaaaaagactaaatataactaaactccaaggactaaagattagtcactgcaacaaccaaacgggaccttaatctaacaccactgctatgtatacccccaaacaaacatatggaatgaaataaggggttcatgacaggtcagaagcatggaaatgtgttctcatcagaccaagaagtacgtaataagaagcatggaaatgcgttctacgacttgtagtacgtactagcgcaaatgtgtcgtaaacatgacgtaaagcaactgcaattagggggctgttctcatgcataccactatagcaaatgttgtattggtgcatgcatttgccatgtctctttactctctaattaacaagggccactatttccacacttccaagtgccaggctagggacgagaggtgtacacgcgcgcagtggcaacgaccgacgccgcgccctatatatatatgcgcctcgcaagcgtctcggaacacaagcaacgagagctactagctagctagcagcactgcgggtacgtacccaactactacacattacgtacgtgagctagctagctagcagctagtgatagagaccagatcagctgcagcggcgacg

SEQ ID NO: 10366 - DNA, 1049 bp, Zea mays
gactttcccttttgaattagacacatcgatgagcaagcagaacatgtggttatattctggtcgcgagcccgtgatgctcaaatccgtcgcgcatggccagctagagacgctcaaacacaaagtggtcgttgtggtacaacgatataggttaaacgtgaggggacgtgtccttggggttggggagggccgacgaacggacggaggaggccatcgtcactgccgggcacggtcctcccaccgccgccccgcccatagagcagccggatagcctctcgtcaagcaagaacatgagcagcccccgacgtaggcgagcgtgaggagcagggcggcgaccgcgatgcttctccgtgcccaggcttccttgtagcgagtggcggtagcggactggtgcgcggctgccggtcctcgttgagcaaaatgattgcaatacttgtggtttcttcaacagagtgataatctttgagcttcaaagaaaggaatggtcactatttgggatgtagctactaagctaaatcgcttggtttctctgagtgatttgcttatcaagtttgttaagcctatgtcatatacaagcacacctagcatatcctctcctgatctaattggctacctcatttttataagaaagaatttaccactgtatcattgaagccttccagcatccgtcaaagttttgttgttctcgtttgatctaatccaggaaactacaaactgtccacgttccccgcaacttgtttgtctacgattcatctattgctactgttgcaatcatccaataggaattggaattctatttacacggataagtactggtagccaaccacactgcgtcactgcccacaaggaatactcactgatccccgtccaaaccttcagatcttctgtcctctccccaacgatcggaacgggatcaaaggaagcggaaacgcgggtattgtacctggcggggccaatggctggcggagtcgggggcacgggggaagaggccggcggggtagagaaacgcgcacaggcagccgagtgcgacgccgaccactaccgccgcggcg

SEQ ID NO: 10367 - DNA, 509 bp, Zea mays
atacgttttggagaggctgagggcgttggggaagagatgacgatagatctaaataatattatatattagatttttttaagtaagagagagtgggttgtccaacaatctaaaccgtgttgattttgatggtgtgttaagattgagtataatttatttgataaatttaatagaagttataggtgtatggtgatttggtttgataagttttgtaaagtttaaaccagttagttgaccacccaaaaagcagctgaatcctgaatttggctgggcagcggcgggtgccagtgtgccacgcaacgaatcccactatttcgcatcagttcgtcctgactcctgcgtccggctccggccgtcccactcccactcgaaagcacgacgacaaaacctcgaacgccaccgtcacgctcacgccttcgcccgaacttctccagttcttccggggagacgagaaaggaaccgaggatctcgttcctttggcgcagcgggtagcagaggcctcgccgagggag

SEQ ID NO: 10368 - DNA, 368 bp, Zea mays
cgcgagaggaccgctgaaactgatgctctaagtatagctgtccgaactggtgctttaatatgaaccgcccgcaccaaaaccaaaaccgcggacaggccacgaaccatgggctcgttcgccagtcgccaacccacacgctgccacgcacccacggtccgcggaccgcgacccacccgacccgcgatcgccatcgcctcacgcactcgcatcctcccggtcccggactacccataaaaccaccgcgacggcgacgggtccttcgcttcgcctacggcatattcccccgaggccccgaaccaaaccaaaccaaaccaaaccaaaccagcccagatcagcgaaacacactccgctctcccgagaccggacac

SEQ ID NO: 10369 - DNA, 1396 bp, Zea mays
accggagtgtgtcgctatttccgcgtgatttagtaaggacatccttgttattttctggttgggagttgaattcctcattctgcatttattttgtttttagagaagaagaaaacacgtgaggatttctccatgtcggaatacggaattgaactaattactaccactactaccattaggtgcctttattttagagaagaatccagtctttcttatcattattacactacatgatctctgggtgggatgccatcagactggcatcctagatcctgctcatagatgacgatggtggtggctggcctggccgggtcttcaagagagacgggtttgaccgaggtttctcttcggcggctgacatggactctgcgctggcaaccgcagggcgcagaggcgggcccatgcgccgggtccacggaggacggagcagcgcgccgctccagtccagaccagatgctgccytgccgctgtactcgtgcgtgcgtcatcgtctctactattccccggactacccttctgacgcgtcccgttccatctctgcttcctgccggtgtctggccgcggcccaccgcaacagaaaaaaacaacgaaacacgcaacgtgcgggggcagatgcggcaattccccgctcacggcgcgcacatggaacgccttcgctttcctcctccctccctccgtcccgtcccgtgcccccttctgccttctctcaccgccacggccactggcattggccgcgctcgccgcccaccgcccaccgcccccgcgccgctgtaggagcgcgcgcttgctttagcgtaggccatggcccactactagcgggtgattagccttgattagcgggcaccactccactgttacgggaggcgcgttgttttaatcgcgggcgcgcgacgcccgtcgcctgtctcgaatatctgctgccgccgccaaaagtgcggattcctcctcctccccgtcgggcggcctcgccccccctggtgcctactgggcgctggcggagtgggagtggatcgacgtgttgcggccgcggagtggaggcaataaagggaaagctgggcggagtgctcgggtaccgtagccggattagttattaatgcccgcgagcagctagtcgtaggcgtaactattttaaggcagctgtcgccgctggggacttgcgaaagcttcgcctcttttgagaagctctgcaccacgcctggctccgccccgctccccctccacctccaggcttccttcacagtctcgctgttgctagtgctgccttgctgctagtgataggggtcccggggccctcaagttctgggtgggcggcaaacatatggtgggcaccgggcgggggaataaggaggaagagaaagaggaggaggagcggcagtagatttgggccgcacaggcaggg

SEQ ID NO: 10370 - DNA, 1179 bp, Zea mays
agtcctgacctcatgttatagtcactgacagcaccctacaagtttggcaatttaataattccttgagttgaaatcagtgtgctgctgtataatccaaggtaagtgatctttaccttttacttttagtgaaaacatgcttgtacatttatattgtgatattgtcaatagatctgttgatctgcaatatagtaataccgctctcctgctacaactatagtgtattgttgtcctgcagtcctgctgcaactatatatattgatatatatacacacacatggttctgttataggtggacgactaggagtcgtctaagctcgactaatcaggtaaatcgacgactaatcgcgattagtcaccttatcgatgctcagacgactagagtcgactagccgactttaaaaccttgttggaaatacggtgtagccgagcaactccaagagattagccaaatcgtttgtaaagataaatttaactattattagaagaaaaacatctctaatgaactctataaacgactctttaaatttagtagctctctattttttatagcttcactcgctatgctgagttctaaatttacagtctactatttttcttgtaaaatatattacagagagtagctaaatcagtaaatttggctaatatatattttttttgctaaacttagagttgctctatccctatgcatacgccccaacgacagaaaacgcccggttctgtgatgcttctcttgcctactacccattcgcaaatcgcaacctcaaggttcgagaccttgactcgcggacgcgttttctgttcgccgagcgctgcagccgtcgagcgggagtgcgggccgcgttactgcgttagccgccccccgccgtcgcctgcctcagcggatccacgctcggcaggttactgacgccgcccgcctaacttccaccggtctggtggagtggtggggagatctatctgccttggatcgattattctctactacttggtaatcaagttattatctacttattggtaatcaaggaatgagtcctcggaccagcctttgttctgcacgagcattataaattaaatataaatctgtgttggcctaccttttctttgcgaagataaccaaatccgagatttaccttaggttccccatgatcgcaggtagaagagagtttatccacacaggcagct

SEQ ID NO: 10371 - DNA, 907 bp, Zea mays
  unsure (1)..(907): unsure at all n locations
acccctgatggcaaccttatctagttcttctgaatctgaaaatcaatcttgatcataccggccacaccaacatacacttgctgctacttgcttgcttcttctcatgcaccggacatcatggggtgtatggattggcagcctcttcaatgcccctggtgatgacgagctgtgcctagcaaaataaataaccacatagcagcaggagctgctgtggagacaccatgacaagcggcggccatggcaacaactgagtgactgacctgggtggcacgataccatttcgggagccggcaggcaatgccgccttgtggcctgttcgcgatgtgcagcgtgggctggcccggacgtgggcgagcactgagtcagccgcaagaggacactacgggttccctgggtgccggtgcccgacgggccctctgcccccatctcatcttcagcatccaccatgatccttctttttttctgaagaagttggaactgattgggggggggggggggangggaagaaggcgtgcacgagttctgnccaggtctggcaggagaccagcatgcaaccaaacatgaggggtattttggtacttctgaaaaaacctgacagtcaactaacggatggatggcttaaatggacggcaacatgatgtcagataaggaagttcaacttttctagtatcttagaaagaagactgattcgttccagtgccaaatagataattctctcttctttatatgaccttccgaatctgagcatatatttgtccaatatttttaatggaaaaaacaattatccatacatctgctgtctttatattcctggttaaggcttgaagataattattttaccagatttacttgtgttacttttcttactgcatgtgcttgtcaaagtgaacatttacatctccaggtt

SEQ ID NO: 10372 - DNA, 256 bp, Zea mays
gatcccagccgtccttgatccggaagcctccgcagtccgcacgaggcctggaactttccacgggtccaaaacccctctctctctatcgctcctctccctttctctctccgccccccatcccctcgcgatttccacctcctcccccacccccacctccgtaacccacttccaggtgggccccccacatcgccgccggtgacacgcacctccctccctgcctcccccgctaccgaccaccacgtccacgcccccggtc

SEQ ID NO: 10373 - DNA, 625 bp, Zea mays
tgacggtagcctaatctgcaaaccctagggttacagaagtaggagagctcaccagcgtcggcggggcggcaatggatcacaggcgcaggatccgcctgaggcggaacctgctcagcaggggaagggcgagatccggtggcaccacagtgcgcgacgaacagagccgagagaggaaggagggaggaagacgacgaccagtaaaagaacagagagactgaagaagagaatagagaacggcagaggatgacgacgtccaggggagtaacagcgcgagggcacgcagagaagaggaaatgtgctaatgaccattaagcgggctcgatgctaaatgttcaaaccgtgaaggattataatgccacgattttaattgccgtgatgaagcctgccgtaggtggtgcctcctcgacagtgggcgcgcgcgcacacacaagggctgagcccaacgcatccgaaccaccgacccaacccaaccttcacccagcggcgctgcccctgtcgtcgtcttcccgcacgcttccgagcgccgccctccccttctttccccatcgcctcccttccaccccctctcatctccgtctcccgcgccgacgacttaagtagggtttggccttagggttcaggcaag

SEQ ID NO: 10374 - DNA, 1500 bp, Zea mays
aaaatttgaattcctaaatcttggaatttgaattttgaaaaatcaaataatatgtgaatatctcatttgactaagtaaataagggatatataaaataaaataaaccatgtgtaacaaattagagttttccttgagcacttaaatatactttaaatatgaaccttgtttgcatttaatttaagatttgaatttgaattcaaaatgaaaatacagaatataaaagaaaagaaataggaaaagaaaagaagagaaccattcgcattgggtcgactttccctgtcctcggcccagcaagccatccccttttctcgcgcacggccagccagactccacgggcgcgcgcgcactggctccgggggcccactagccagctcctccactggctaacggatgtgttcgcggtgccgacatgagggaccgggcggtcagcccctcgcatcgcgtgcgcgtgttccctcttcgcctcttttgtaacacctcaaaatctcattttgagaattaggtaaaaaatttccaaagatcttgaattagaatttttttagagttcccataacttttgaagtcacatctcctaaaataaaaatttttataataaagattcaataaaagattcttctataaattatcttttgttgaaatgtataagaacatattctaataagtaatcatacactagaaactatttgtcttaaaataattatatgtgtgctatacatatccaaaaacattttcttatgtaggataataaataaatgaataaataaaataaaatgaatacttgcatctcatgctggatattttgtctatttgttgtgaattttatcaaagtctaaaacctagaataaaaatttgaagttaggatttaaaaactgaaatcggaaaatgagaaacaaaaaaaaaataaaactactactccatacgtgccacataggagacatgaatttccactttctttattcacctagacggagcttatgtcaggctgatgcaaggagtgacgtcatcatgcaaattcaagccagcacgttagcgagcgcgcgtggggctcctgttgctcacgtcgttattcatctcgtgccgcgaaacggacatcaacagaaaatccagagatcgtaacaacccgagcagttgtaaccacctaactgacgtccgcctcggccggaactcggcaccttcggtgtatttatacgaccagccgagccatccctccaaatccccagttcttccaaaaaaaagaacgctgtgttctgcatcctcatgcaagcgccatcgcatgggagatagaagagagagagagagggcgtacgctgtggctcccgttctgctgccgttcgtgggagatgtccatggaacaatcgacgcgtcgcactgggagccgaagaaccaaacaggtgatggcgccggcagtgtcttccctgcgctacggcaacaacctctcggtggtgggaatcttcgcgcgcgacggccgtgctctacgggggcatctaccgtaccatcgtc

SEQ ID NO: 10375 - DNA, 274 bp, Zea mays
ggtatagtagacgttacaagagcctcacacttcacacccccccattccccacttgcctccgccggcgcatccctaaaccccagtttagggtttctcgcgcggcgctacgctccgctccttccttccgctccccgggcccgtcgcctcttcctctacctcctcgaagcttcgactgttccacaaccccccaccccattcaacccctttcccctttagctccttcccactgatacgctcgccgcgtgaagcattcgttagccgagccgccgcaacc

SEQ ID NO: 10376 - DNA, 295 bp, Zea mays
gtttcgagtttcggatacccattgccatccttacacggaccggggggtttgccgggcagccggcgccgccgtcacgccatccgcgcaggccgcggcccctctcacgcctagcagccgctgtagctgcagcaggcccgcccgcccagtgacacgcacacgctatttattctactatattagtattaccaggccatccgcgccccattagcaactgcgcgcacctcctgagtcctgacctccactcaagccgtctcctccctccgcgtccggctcccggttccgttccgcttccgcg

SEQ ID NO: 10377 - DNA, 521 bp, Zea mays
gttcgttaccgcccatgcgtttacctgtatgcaatccatgcataagcactccctcctatatacatacatatatatatagtagtatatatatatatagtaccaaagaaagtcagatattagtatactagacctgtagcagtgttgaacaaagatgctgatgattatactgcagccgattcatatacgtacgcaaaaggaacacgcaatccaatcctttgtccgtcgggaaagaataacagcgagaacatgcctggaatacataaaaacatggactgcggctctcgtcttctctatcgccgtttgttgggcacatggcatgcacgtcgtcgacggtgccggtagtggtcatgtcatgccgaccatgaactgcgcgcatatccagcaaggtcaacggcagccaccgcggacgaaggaacattcttcttccattgctggcctataaatacattgcgttgttttagttggtgtttcattccctggcaggctcgacgtgatcgtcgcagtaatatccatcaaccgcc

SEQ ID NO: 10378 - DNA, 1500 bp, Zea mays
tttggcttttgcatccacataaatatataatttatcttgcaagtggtgtttccttgtgctgattgtacatggcaattattgttttggagtaggtgtggtgtgtgcattcatgatagcttttatgtgcataactgcagatgcatcatttatatttgatttcaatctagatattgtaaaagttgagagcctttcaacattaaagaactttgtggactgcaacatgatcgaacagtgcatggtccttcgattacttcatgtagttgttattgattataaagactaagcgtgtagtgtggacacgagttttttcagtagatcatttgatgaaaacttctcttggaatctgaaactaagggtaacagagtcgccatcatatataaatttgggagttggcaactcatgaagtccagcacccagcttgcagtaacatttgtacttctgcgacaataacatgaagattttttttggcttttgcatccacataaatatataatttatcttgcaagtggtgtttccttgtgctgattgtacatggaaattattgttttgtgcccactgcccatttctgttttatttcctgagttgtctttgtcaaaggaagtcctgtttcttatgtgctcgctggctacagtcgcagttgcatatctacttattatgttggcagcataatcttgtgttgatgttgttagttattctttcatatacaattgttacaggatcggagtgatttctgggaatgttatatttgggccaccgcttcagaagtactgggcagagaagcagcagcaagaggcagcaaaagaaggccaagctggttcaacctgacaaaatgtcctccccttctgcagttacacggagaaatgtgtactcctcggtcctgaactagcatcggcttttgttagcattggttacatttagttgcccaagttttcggcgctggaagaagacaccgtgcaatgcacagaaagatttgaaaaacgtttaaatgctggttgatctcattctgaaatacagtacctttgatgaatgcaccgtgcaagacacggtggagacaccttcgaatgatttcaagcctyctttgaaatacctttgaagaagacaccgtgcaagacacggtattgtagtttgcatatctccgagtgcaggttgatttctgaaatagctagaagtcaggatcacagcgctgtatatcctactatcctagcctctttttcgtggcttccggatcttgctgggccgaccgttcgtctgagttctggcccaaattggcttttccggaatacggctcggccctctccagtacaacctccaccgctttctgaacacgaattagaaaaggacgcgatattgcagaagctcccgcccatttttcaccaatcaccagccctagccgcccattttccccatttttcaccaatcacaagaacctttgcgtcctccggcgaggcggcaaccgccggatccctgaacgtctgaatcctggagtgaaccccgcacagg

SEQ ID NO: 10379 - DNA, 90 bp, Zea mays
ggtacgctgtcggtagacacccacctttgcttcgattcagcattataaatgggagaaatgaaggagttcatgcttttgtagctcaaaatt

SEQ ID NO: 10380 - DNA, 206 bp, Zea mays
gactctatagatccctttgcatcatcggcgttgctaacactgtcatgtttggagtcagttaggtcctagtttttttgaccctgttatgctatggaatttgaccattgtactttacctcttgcgctatggttgtgcatggattttcaggcttctatttgctgtcctgataagatgcttgttatcacagggcaattgttattctgaac

SEQ ID NO: 10381 - DNA, 1500 bp, Zea mays
tgtgaggtgtctatggtctatgagttaaactaatgattaatgaactatgtctatgtgttaaattgatttaaatataattgtgagttaaactgatgaacatgtatgtgaattgtgaattgataagtgatgaattgtactaatttgatgttacatttatgtggtttttaaaactgagtataattattattttctattgttaaattagtttaaaattaactaaaaattaattattataaatatattattattatttttttgctctggctcattatccatctctagcgagagtgccacyttggctgccctgcccacatttccgatatcaacaagtcaggaggactgtratgtatgtatacgtgtatcgtgtgcgcctataccccctagtgcaaggctttctcttttattcgtgctatatgattagattctaagcatctagattatataataaatttaatattttagcatagattttttttacagaaaatgtatcattttctttctgcaacgaaaaagttgaaaaggcatctgaattcatatctgtgtccgaagtttacattaattatttaaaaatatgtgtatgaatattaaaactcaataaaaaaataagaatataaatttgtatagtaaattcttagttttttatttattcataattaaagaaggaggtaaaaaatttaacattcaaattaagtatccaaacccatccagatatatgacacagtcgagaatggtttggactggactccaatacccacgtctatctctatacttcttagagggtgtttgggaacaaagtttttctgcagttttagaagaatactgcagtattttcaaatactgcagtattatatacataatggtgtttggcaagctgggtaaaatctctgttttcaaaactgaagtattgcaaatgctgctgttgttttaagatattctaaacttaggtctggtcctcagtttccaaaattgtagtattttaaactgtggtattgtcatgactaaagtatactataatatttcagaaaatatagttttcaaaaactttgttcccaaataagattttattctaaaaaactggaataaaccgttctattctagttgactccctaacaaacacacatgctaaaagctgagccaattagcaacgctatgcatgcgggtgcgtataacactgttttgcactgtatatgcactgtttacatatagaagtttaaaataaacagtgagataatgtgtgatatagcaagtctgcttatggatgaagggcttcgacagttcgactccctccgtggagcacgacgctcaagtgcacagatttgcaaaagcaaattgaacttgtgtaacagtttttttaggtttgtgtaaatgttttcaagatgttattttgctgtacttttcaaattagctctacgagattctacttgaatttgatatactgaaccgacggctttcaatcggaagggcccctgtccccctcctaagtcctaactcctatccaca

SEQ ID NO: 10382 - DNA, 80 bp, Zea mays
ccatcgagacagctagcccacatagcccttccagcaacgcgcgatcgaagggttgagagctattggaagcaagtacgtgc

SEQ ID NO: 10383 - DNA, 1500 bp, Zea mays
ccctctccactatctttttatagcaaacatccattaattaatatgggtaaaatagtcattattgatagcaattaatgatctttagtccgatttagtcactggaaccaaacgaggtaccttagcgactaaactttagtcactaaaatttagtctagctaaggaaaccaaacagggccttaatttacacttggaacctagccgacgtggaggtcgactgtatttggcatttgacaagtcttgcaaccacgaagacgacgatgactttcctcccagcttcaagacgagaggaggagagctccagccattttcagtctgaatcgtcgacagtttaaaggcgtctttcagtctctaaaccatgggctcgagatgcacgcgctggacgggaagaagtcgtcgaggcacggtggtgaacgtgcaggcaggcaatagcgacacacatatctatatccatcacacctggactggtggttgccttccctgctggctagtctagtctgtgtttgttagaagcagcggcagcagcttttgtccaaatttcttcctcgagctttcccactataatgtttaaatgagagtcatacgatgataaagtaaacagcgaagtattttttttggcgacgtgatcctaaaaaatcgagcaaacgatgttattctcgtctcatcctactttaacctaaaaccaaacacatctagttaaaccaaccacccgttagggtttttctatagactagacaaaaaaagaagagagagagaaagtaattgtgtttctggaccaattgcgtcacgacacgcctcgttctgctgtacaatgtgtagcagcagacttgcgtataacaaggcctggagggctggaggaggtgattaggacaccagtccgtgtccgtgtgccagccacctgcgcagcaaaagacactgcccactggcccatcaccatcagcggccggactgcgcaagtgacgagaggagaggtacactacaccgtccctggccggttggtcccacgatgccatgcatgcagagaaccagcgccaggtaacgggacgcgacacggtggctagccaaatcgatgcgcctgcgcgtatgggcctgctcgctcgcacggcacagtgacgggcgcgcgcacacgcatttacgcgcgcgtactgcagagccccgcatgcaagctgtcctcaacaacatccaggttggcatcctctctcctccgtcttctccccttcgccgcactagccgacgcgtccacctcggctatatatacacgcgagccccggacacgccgcctcgcttactcatctcaacttctccaccagtcgtccagtagtccaccagccagcagctcgccggctgcctcgctcctgctctgcactgcactgcactgcactggtcgccgctcgagctacccggctgtagcaactagcaagattcgttgggtccgtgaacgtgcagacgcagcacactagactgtctagacacacattatcagattcgttctgcagtacaata

SEQ ID NO: 10384 - DNA, 1500 bp, Zea mays
acacgcactgagagacttcggggttaggcaggccgcaggcgtcaaagaaggcggcggtcaccgtggcggtgaggcgcccgggcctggctagtgagctagcggggaggaagctggccgcatgactgacaaaaacagtacctctccctcggttccacaaataagtgtgattcttgctctatactttacgtcccgtttggatcattggaattaaattccactctaataataataatttaggtatatatcaattaagctaattcatttttttatataaaatatgtttgtatactattattagcaagatgttgaatatatttatatgctacatttttattatagaggagcaaagagtgtcatataagttacagagtagaaacaaattctattaatgtataaaattatttctcatcctgcatcctatgaatttgagatagtcttatatctgaactttggaaggtggtggaatgtcaaattccaaactaaataagttactttattgagtgaatttcaattcctctaaaatgaagggattcaaacgcatcgtaagagaaattagttcattttccgatgggaaaatagaaaactcttagaaaattgaggttcctaaactaactctaaaggtaaaaaacaatcaagcgaaatagaatcagaataactgtacaagataaggctaaaaaattgattaggaatcaagagaaatgcagctcgattgggattaattgtttatgctgttacatggacgggatggcggagattcactcgttgccgtgcaagaaacacttggcttctaggctcagctactcctcacccggtcactctttttcccgccaaagaataagggcagctagttccttgttaaggacggaaacatgtacagtgacacgctgttaccacgagttaaatgaaagcaaccacacaaagattagacttagacatgtttattaattttccataaaacacaacaaataaccatgactaaactccagtgctcctaagtaatatccatcactatgaacaaacgacggcagccaatcactcgggcacgcgacggccacgtatccgtgcggcagccgcgtgcgcgcgcccggaaacgcaccgccagcacccggtcaccagaccaccccaccggtggccgccggtcgcctccgcctgcgggaacgcagacgcagacgcacacgcacacgctacggataaatgacaactacccccctcccttctccgcatttctcctctcctctcctctcccctcgctcgttcgtcgcgtcctcctcagatcaacaaaccgtgtcctgctgctgcctctggaaaccaccgggggatcgccccgccctttccttcccgcacctcagatcctccgtccgaaaacggcagcttccggaggtgtcccgtctccctgctccttccggcgcgacgggtggcacggctcgcggatccggcggtcttcggtcgacggcgaggcggcgctcgtcttggatcgggagtggttgctgaggcgcggag

SEQ ID NO: 10385 - DNA, 582 bp, Zea mays
gagagaacaatcgaaacggtcagcaacagacggccaggccgcaggtgcgtggagaggagaggagaggagaggcgagattgcgagaaatgcaccatggtggaggtggcgccggaggcgtgaggcgagcgacggagcggaagcggcggcggcgggagtcgatgcgtgtcggggccagcagctggtatatgagttggaggctagggttttgagctggctatgcgtgctctccaccgtctgatccgatcggagggctgggactacgttttcgccttttcggggaggcatatactcgtttacgcccccgtttctgcaaaaattgaagcaccactatgcatgcatgcagagtactccatgttttatttagttattacgtaacactccctaagaaggacttgacaagtgctcatgcaaatgttttaggagggtcaaaattaaaacgtaggagtaggtaggacagctttattccgttccaacttccaaggtccgagggctccagaaaccggcaaggggatcgaagcggagagcaagggagcggtcgagcgggtgacatcatcgtcatccagggtttctcaatcggcagcg

SEQ ID NO: 10386 - DNA, 393 bp, Zea mays
gtctagatttatcataatctatttgaatatagatataaaactaaaagctaaaacgaatactaattctaagagtatttagaagttaaggtataaaattaaaactttgaatatttttgtatttttatatataaaaataaaaaagttatcaacaaagactgccaattcttgggcctgggcccattagtggattggcccatccacattgagcgagccatcctagttccttcctctcgtgactaacacctcacctcctccggcgacgcacgcagcccccggcgtgcgctcgcctatctacaatcttttaccgtgctgccgcagaggtatcgtcctcaccatccccgtaggaagccgaagtacagccagaagcgtcgtcacaactcacaagcactgatc

SEQ ID NO: 10387 - DNA, 414 bp, Zea mays
ccactcaagcatacaagtttttcaaggttctcattcaatacaagagcaagtgcattcactcctagacacaaatcaaaagaatcaaagcctctccaagtgccaaatccactccaaccacttagtgacttgagagagagtttgttcgtgttctttgtgttagaaatatgccctagagataatcatagagatgagcatatttctttgtatccatgatatatatattgcttaattgaatatccatggaaggcaccttgtattgattagcaattatgtgaattgtttgtgagattctttacttatatggttattctaaatgatgtccctagtcagagtcgatgactagcacatgtattagttgatgactacatttcacaagtcatgaacatggagatgttaaactaataatgtgggcgc

SEQ ID NO: 10388 - DNA, 187 bp, Zea mays
atgctgacggcatcaacgctgatgtatggaactgggtgttcagggaatgttgttcttgtgtcgatataataatgtaggctccttgttgctgtagctgtactggtgactgtaatgagaaactaacgctgctcatgttcaggctgtagttattgatgtaaccttttcatctggacccaagcaagcactt

SEQ ID NO: 10389 - DNA, 205 bp, Zea mays
ccactgtgtctactgcattgtttctctctgtggtttctgtgtttcacaagtactcctctccagctacttgatcctattgcactgacacttaaccaagttcttgtggcaataagttttacaggatcacctattcaccccccctctaggtgctctcaattggtatcagagtcgttctcttcacgaaagggactaatcgcccgaagag

SEQ ID NO: 10390 - DNA, 109 bp, Zea mays
atcctggtcacccagtactttggcaccatgagattggggcctcctccaagtcatcttttcatcccccatggtcttggagctgtcaaggatgtcttggcgtagataagag

SEQ ID NO: 10391 - DNA, 67 bp, Zea mays
atcctggtcacccagtactttggcaccatgagattggggcctcctccaagtcatcttttcatccccc

SEQ ID NO: 10392 - DNA, 277 bp, Zea mays
ttcggtaccattttgcttccgttacaacgtaaggtccatatttgcgggtatacatacaaacacaaccttgaaccttatatagccgtatacgatacttgtaacactgacaagtgagtcccacattgcagttctggcttcwaccatgacccaatccagaagcagaatgggtaaataccgcaaaaaccagataagcccggtgcgccgtctccttccttctcggcgctctctcgcccgcgcctccatcactcgctagtcgctccctccgcctccgtccacc

SEQ ID NO: 10393 - DNA, 190 bp, Zea mays
aggtccagcgccgtgtgaccatggtgatgaacactatatatataaatgcacgcaaccggatggcaggagtatctaatccatatcacagtatcagagaggtgtgggataagatgggaggaaggccacaagcctgcagctgcggaggcaggcctcagacctgtaaccaatgtagtacacccataaataaagt

SEQ ID NO: 10394 - DNA, 455 bp, Zea mays
agcgcggccccggtggcacggcggtctccgtccccggccccagcgcgcgcgcggagcgcgactccccggcggcgcgcgagaatagttcgtcgttcaggggcgcgggcgcggcacccggcctcacatggcgcaggcgcgcgacccagcgtgggcttggccagccaggcgcgtccctgtgcgggcacgcggcctcgccacaggcgtgcggccccggccaggtcccggcgcggtctcgacgctcggtgtgccgctgttaggcgggcgaggcctcgacggcacgggtgcggctggcatggccccgtccggccgtgggtgtccccggcgtgggcacgggcccagcagccccggtggcgtggcgtggccccaacagcccaagcggagcgggcgcgagactcctctggcgcaagttctggcgggcagcgctaccaccgtctgtccgcaagattgcagcacac

SEQ ID NO: 10395 - DNA, 555 bp, Zea mays
atcagtagggggaggatagactcttcatttggattcatgtccttcccggtcaatttgggtcagtttgtttaccatagaaaggtggcatcttttggcttctgctctttggtctatgtggatccagtgccaaattggaccgaccgaagctgattcttgctggcagaaagtgcccaactgtgctaccatttatttccaatgaatccttggctatctactcaaataaacaccgagtccgtgaggccatttcgtctctgcttatgtaggattcttatgttcatgtggacatgtggcgcattgcctggcctttcgcaaatcagtttcttctggagtgcccaagtggttcttctcttcccatatcgatataaggctaacaccgtgtgatgcctgcctcaatacatcttggccccaagaacactctgattctgtgcagttccatacggtgctcaacaagtgatatccagtatttggagggtctttgcaagaagcgttgctctgttgctcttgctcatattttgtgttctgataggtccaagcatcatggggctcttaggtatg

SEQ ID NO: 10396 - DNA, 401 bp, Zea mays
cgaatcgcctttttgcaggcgcacatctatgaggcctttttggggctataaaagcacccgagacctcctttagcaccccaagcactccaacaacaacatcacttcgaccctctgctgcaacacatattagtgattctactttgttgtgattttatctctttcttagttatccttattcacttgtaatattggttaatttatatctttgaagagcaatcaagggaagataactttctcccaaattctctctcaaacttgatttaagtattgactaactctcattatagaccaagtttgtgtttttagtgattattttacaggatcacctattcaccccctctaggtggtatcaattggtattagagctagtctcttcatattgggtttaatcgcccgaggag

SEQ ID NO: 10397 - DNA, 487 bp, Zea mays
ggttaatgttatttctcaagttaatttcttcctgtagactgtatatcctgtttcgagtatccatccagagttatattatcgtagtgtgttctgtatcgttctttcttttaaaagtaaattcccatttttttgctatttggtataaaaatctgattcattcactgaaaggaaccaagttaacgacatggcaatactgcttgtagatcataatttctactgggttaacccaaatttaaaaggaaaaacttttttaatcccttgagaaccaaagataatccataatgcttatgcagttttttaggttcatcaatgcaccgatattctttttgtgtatttcgtcaccgcaaaaggataattgacttctgcccttgataggtaccactataatgtggctgatgcaaggttagcgcaacatgtggagaaaggaaatgaggatggtttgttgataagttcaatatcatcatgcgcaaatctttgggcaatcatt

SEQ ID NO: 10398 - DNA, 1024 bp, Zea mays
cgccctattgtgcatgatagtgcacgtgctcaacgtaaaagaaaagagatcagtaacaagtagcagcactgtacaaggtaagccgtgattcaattaaaactgtttgagcaattcagttgctagatcgttccaccatcgataattcgatatgtacgatgatataaaaagagcccataagtttgtcttgaaaaggttgatcaaataatttaaattagatgataaaaaacatggaagatgtgggagtggacgacggctatgaagaatagtactatatcaggtttatacgtaaaatttatttttgaaatgtttttataatctgtttgaattgtattttttgcttaattatgtgattggatgttttttcatgaaatgtcgagttttattttaaataaaattytgtaaagagaagttgctgcgctgagaaaactataaatcgatagtaaaggctgtacgcaacgtttaagtccttgtttgaatgcgtatgaatctgagaaagttcagaatgattaaatcttttttatttaattttaatttgagagagattaagttytctccaattctctttaatttagacgtaatcgaacaagctggttgccaaactagatgagtacattttgtccactgccatagagccatcgactacaaaagtctagaacacagtggaaagcaccagacaacgcgcgaccaaaagggcccaggccccagcgccccagtccgggggttgtgttcgccgacctgtgcgtgcctgctcgtcacgtcacgtccctatttgcccgtcttcctcccctccagacccttctcgaacgccccttcgttctggatccaacggtcggtctctgccgggctcgaacgttctcgaaaccacgtcacccccgataaaaccccacgcacagcctcctcccttcctcaaccatcattgcaaaagcgaagcaagcaatccgaattctctgcgatttctctagatctcgaccacccctactagttttggttcctcctttcgttcgagagagcgtttctagtggca

SEQ ID NO: 10399 - DNA, 393 bp, Zea mays
caaatcctcatttatgtatattatgtatagttttagcttttattttatgccctcgtgaatgcacgaatctattttatgacaaatatattttttttaacttatgacacaaaaaatactttacaaatggaaagattttcctagccgtgaaacctttgtgtgggcgttttttggggtaaaattaaacccttgtccatagaaaacggtggccaaaggccaggaggggttgtggcaggcggatgacctgatactcatctgcggcacgcatgtccagcacgccgcggccaagacgagcagcaaagcaaaccgtatttgtcccgcggcggcctcttcgtcccgcaaggtcgccccacctagatccggccacgccgcacgttccccttttccgccgcagcg

SEQ ID NO: 10400 - DNA, 1500 bp, Zea mays
ctgtgtgctgtctctctatcttaattgattttatacttgcacttcaatacttatctatgttataagctatctttcaagtgcagggtattttgagacaggaacttcatttccgttgtggcctagtcgaagtgtctttgattccactacgatccagtctttgagtagagtaagaacttccagttttttaaagtaatattttttactctcctattcacccccctttatgtgacatccaggtcctgttctcggataaagggaactttcaactatggcactcaagttcgatctttggatcacttgagagtggttgagtgcaacacttgtctattgggacaccacaacgtggagtaggaaatcattttaggcctgactgaaccatgtgaaaaacattgtgtcttgtgtgcttatttgcttgtgatttttctccctcttcctaagtctctcaaattcacttgtaatattgctcttaatctattctatatcttgaaagagcaatcaagtgaagagtacttgttttcatcttctctttactcaaacttggttttagtttgcactaacttcatttttagaccaagtttgtgtttttagtgttaattttgtcggatcacctattcactctctctaggcgccctcacctagtataaattaaaaaatgtcgattgagggttctgaaccagcgaggatgaattcttcgttatattctggattcgcgtttttttaatcacccgatccgtgtcttcaactkttatgaaatcatgaaaataattgtaattagcaggtacacgggcaagtaaacagtggaactgtagtcagaaagataataaattcgagtaattctggtggagtcaattatatgatgtacagtgtactagtaagataggttgaagcctgttgagtgcaagcaaacacatggtggtacacacactgacacacagcacagggggcgacgtaacgggttgccgggttggtggcctgctgaacccggaaacactaggagacaacatcgtttatttttcacgttgttgtattgtaatgtcattagaacggtggccactcagaactgcagattgcggccgcaacgtatgaaacagatccacgctttggtattatatacaggagccttcaagacaaaaaatgaaatcttattggtttttaagatctccaggcctttcttggaagcaagctcacaagttttgcttgccgtgcgtgctcgcagtctttgcccccaagacacaagctagccacaccatcgatcggtaccgcacggctacgcgtacaactcctgagcaagactcataagcaagatcatgatcattgctagctggccccactgtaactagcaatccaaatgaaagcgcaagccacaagccatgagggcagttcagtctgcacagatcaactccaactccaaccaagaaatagcatcgaaatgctaaagcaatagcaaatgaagcctagtagctagggagcagaaagcctgaagagagacgagacgagacg

SEQ ID NO: 10401 - DNA, 517 bp, Zea mays
gattagattgtccgtaacaaatcatataaaatagaagattttatactataatttaaattatttattaataaagtttaaaatagaaaataaatagaagattttacactataaattatattatttatttaataaagtttaaaatagaaaatgagacacacatagccaacgaggagcgcggtgggggcggacaaccgcgcaagagccaaatgactctatttctatcgcttcgaggtcgatgcgacctggcgtcctggtctgttatactttgaggcaagtggcgagggcggcagtgccgggtggccgcagcagccgcgaaccgtagcagcagccaaaggccggtccactttatttactgctcgtctagacgtctagtgcagcctgcagcgcagaaaaaccagcggcgcagtgacaaaagcccacagcttcttctccctactcctccagtcctccgtcatccgtttcgctctctgccgccgccaccgcacaagaagctagctcctgcctgtaccgccccgtc

SEQ ID NO: 10402 - DNA, 324 bp, Zea mays
aagatttctcaaaaggtcgagaagaatacgtcagaggaaaagaacacgaagatattctccaacctttttgacaagaaggtcagcatattttcaaagaagaatgtgagatcgtcggaggtgccaccggcatccacttcatcttcttcgccagggccatttgacgagagtgagtggacgattttgtagttggaactcctgtattgtttcttttgtacaacatgtagaggggggggtgccccggagatgtcgggaataatcttaagctgtacatattcagtctaattcattgaacattttgaaataaattgaaaatataaaaattcc

SEQ ID NO: 10403 - DNA, 1500 bp, Zea mays
ctcctgcatttttttttttctacataaaaggtttagaaaagtatgcctgaagatggacaccaggtgagttctgatttgcaggaagatagaggttgcctttatcttttcttttcttttgtgctgtgtttaattggtctgaggttgacggcatcatctgttacactttcagccatttaactagaaattttaatgggataggataaggcaagcagcctctagggattggctgctgatgttgtgcccatcagcctggaaaatctcacacatgtaaactaaacccaagggaatacatagaacttttcatgatataaagctttgttggtctgatggaatgggactggtcaccattcatcaaataggtaggtcaggcatgtgttttccaaaagatagaatcaaatctcacaaccctagtgtctacttgatgttgtgctaatctcccagatctgcatggatttcatctgctcatgttacatgtaagctttatgcacatccagggacatttggagatgagatttcagcaaagctctgctggccctgggtctaggctttgctgctaccagcaatgaaacagtagtatgcaatgctggttggaagtgcaaaggaccatgaggcacatgtgagattcactaacagatttgagcaaacattgggcctggaacctttaaggctttgtgtagttgtgccgttgatgttagtttcgtttctacggcgaatcagaaaaaaaaagtggaaagaacttgacggttgacagttaaaatttcagaagggacaacagtccagctttcttcagaaaaagaagttgtgcccagtctctccagaaaattatatagcaaaataagaagttcaactactaactgagtatatatgaatatatgatggcgtcaatgatttcctattgacatctaaagaaatgatcaccacataaacgaaatccaagtacagctacaagtatcgtctatttttttctttcagaaaagcctggttgcacttacagaataaaataaaagaacagcagcaacaggagttgttcccaactaacttgtcaccatatttaagtaggttctatgctaccttctcggaagatttagctccctctgcttcctacccctctaaaccgaactgcttctgttttgctcttcatctttggagtgaactttggtctaacgattcagaagcgaaagctgctaataggagctgcacaactgagagaataattccagaggtgagatggaggcggtgcttcgcttttttttttccttctgtttgcgctccattctactgcatgaggaaatcttttcttcagtatgaacattcaggagatatgtgtatccttgtcattcatgcaaattgtatccctgttgtctccttttcccttccccacgttttagtgtatctttttgtagcatgaaagccaagaccttttctttgtgctccaagaacatttgagcttattccacattcttgcaggagctctttctcttccgtcaaagggttccaccg

SEQ ID NO: 10404 - DNA, 383 bp, Zea mays
ggtacatgcatccaccgccggcacagccaaccacttcaacgccaaagccttctacctggagcacttcatcatcctttgcagtttgtaggtcgtacatgatcgcgtgctcattgccaaatctaggaccaaaagtgtgaacttgtgttctccttcctcttagagcatggtaaggtttctagctcccacattctatgctcttgtcgttctgtgtcctcgaggtgttcgatgaaatttcgaggtgcgacggtggcatgtggtgcccaagcttctgttaccatctggcttcaccaccgacagagaggaaaatgtgttcaaggatgtggatgctatgttcaagggggcaatagtaggtgctaggagattctacaacagactcttatgtg

SEQ ID NO: 10405 - DNA, 759 bp, Zea mays
gctagttatctggctcggtcccttcacgagtcgattcaagtgttatcttaacaagccagtttggtctcggtcgggtcgagtcgagtcgagtcgagtcgagtcgagtcggctcgatatccagcactaccaaataatatccactgtatgcattattttccatccgttcattagttttagttcaatgataagtagaaacggattccaaataaataaagaaaaccgtccgtgaagcgtgaacgctgcgcgcaggtcggattattcagactgagtggtcccgccgtgccgaccacaagtccacaacacacacaagccatgcatgcatgtcgagctccctgtcactctccagctaaacggccctacttgccttccacacctatcaaccccagccggccgctcgttaattagcttccatgtcttgcagcaggctgcggcaagcaagcgatcactcgcttcttgaattgcacgattaggtttccgtttcctttttcttcgtccccgtgggaatatgcccccgcgcgctactgccattttgttgccatacgcatgcgtgcgcgccaccgtcgccttgccgtggatccacatccaccctagctgcctcccgatcccacgcccaaagcttcctataaattcgcacccccagcgcctcgcaaccttcatctcccacctcgatccctgcgctgcaagcaacaaagttctactctgtccacccgtccatctagctcccaagaaccaacccgtaccagcgctatccggccggcc

SEQ ID NO: 10406 - DNA, 81 bp, Zea mays
ggtgcaaacttaatcttgctggaagtctgtaaagatttgtgtgttatctgtgactgctatttttttttgttggaactacag

SEQ ID NO: 10407 - DNA, 1500 bp, Zea mays
gtacgttttagagtacaatcgttttttttttgtcacgatgcagtgcaacttgtttaatgtctatgggctgttgataccaacagcttaactagtacagggaatgggaggataaatcaaataatttgagtggtgcgtaccaaatgccagcacttgtgcccttattaagacaatgtgaaactaccaaatctgacgacggtgcaatatgtcaactggagtactacataatcagcgcatattttttcttccttctgatgcgttactgtgtcggtggaatgtacgcgaaggacagccggtggtggaaggagaaaacacgaaaattggttttggaaacgtccagattagctgtagatttttgacaccttcacttatccacttgctcttgtccgtaccacacaggaacttttattgaagtactcactccgtccaaaattaaatttcgttttagttaattattgcgtacaatgtatatgttttatatgagtatgggttcatcgttatccatttaaacgtagacataaaaacgcagagctaaaacggctaataaccgagggagtattaggtactgctagtgtaagaagcacagaacaaactggtcatttagctaccctctgttaccaggtcaattgcagcccagcttataattcctcaaacgtgcagtgcagtgcagcgagtatgaaggagcctggaaaagcgctgtatattgatgcgaagttttgcgcacagtggtacggaggcggactgctccaatagatttgatcctaagcaaagtgtccaacttgctctctgtcccccgccatttatgctgattttgacgaatcggggtggggtgaaaaaaaaaccccgatatttatccatcatcgtcgtgcttattcttcgttttcgcaaacaaacatgctttagcccataaacccacggcctgatgcaaccaatgtcgcgcgcttgtccaagtgacggcacaccaagcaatcacacatgtccagtcgcgatgccagtcggcgcccgcgcggccacctcggacacccagctgggcaagcaagggccacggggccccactgagatcgcgcgatggcccccctccggcctccgcatttgttgggaattcgacccggggaacgaacgaacgaacgcaggcagaggctctgagatctgacagtctgacagggggggtttggttggtgaggggccgcgcgcgagcgcacacggccgcgctctgtgttgtgtcacctgtcgcgcgctgtcggcgtcgcgcacgtcaagggcgcgcgcgacccgcacccggcatctcaccgtggggccgcgcgcgtgcgttcgtgtatatatacgcctggccgtgccactgtcctggctgcagctccgcacaggtccctggcacagggcgaggcactgtcacgcacggaatcgagcaatcgatcacacagagacacaggtcaggagcaggagctcgaggtgtcgccgcgcggcagcagcagcagcagcagcagcttgggactcgggacagcc

SEQ ID NO: 10408 - DNA, 1500 bp, Zea mays
ttgcatggatatgtgttgtgaattcgcaccatgtgcccacgaaagcagcatggggatcgccccaccaatttttttttaccagctctaactctcaaccagaaaacatgcaaatttatttgtcattgcacaccagcaacctagggatggtaatcccaaaatgcaatgatttttagagcatagatgtgggcgaatttacctaactatggatatgttaattgacaataaaacaccataaccactgggttcatgggtacgagtatggttttgtacatgaaagaataaacttatgagagtgtgtatatactcaacatacaagtataattcccaaagccatctccaacctattgtagtccaaaatatgcatggtccaacaagcacacctattgacatgcatataagccatcacatatatatatacactaatttttactattacatatgttatatatttatagatatatgttatttgtttatattgtcagtgtttactgcgtgtgttatattttttttcttaggtacggtgtaggtaaccaccgtgtctatctcgacacgcgtacgggcacaaaattacatcaacacatggtatgagatttttcatgtgtcaaataaattttgatggctagtttaaaaacttaaatcactcatgagattaccggagacgattgaggggaaaatttcctagtattacggacggaatttaagtttttcaaactatccctaataaaataaatatgggtatgtaggtatgagcgcgataccatagggtatatacctgttgcggcgggactgcaggtcttggtgacagcgtagaaaacatgcatttaggtgttgaatcttgattatttgcagttaatcgtgcttgctgtgttgccgcaaacacgagattcacaccctgatgagcggagccaggctgcccttgcttcgattcacggtggccgtcgtcccggccaggccagcacaccagtccaatccacatagcaacaaccgcgcctcggtcagttatagatgcgtggccttctgaaacaaaccctcatatggggtcacgccgcactcacacatgcatccataaaccctcagcagagccttgtgtcgcgtcctctcctcgataacccaggccacatcgtccttccgcgccgcgccgccggcgacctaacaacccagaggcctcagcaccgcacgcttgcacgtacgtccaggcgcgctcgccgttacgcccacggggatccaggctttccttcgctgccgttgctggtcgagtgcgccacgccgaaaggtgatcgagctgacgagcgctagacgccaccggccggcgcggcgtggcaaggcaagacgccgtgcgggtctcgccctcgtcagctataagaccgcatccccccctgcggagggaggcacacacacagacacagcgctctcactagcctcgcattccgtccctgcagtgcaggggcaggccggtgaggtctgggagaggaggaggaggaggaggaggaggaggaggag

SEQ ID NO: 10409 - DNA, 261 bp, Zea mays
cttggagtggtttgtgctgggggctacctgcattctggttgaattcgtagaaggtcggtgggaggacgtgggggtcaatctcatggtttggttttctgcgggttttcctgggtcaaattcgggatgaagatctggttccaagagcaaagctggcttgattagccacctttacatgcatttgggctaaatggtagctctcctgtattctgttgattctgtgtttacaggaggtgttctattttcaggttgcggtgaggagaa

SEQ ID NO: 10410 - DNA, 141 bp, Zea mays
ggtcagtgcattacacactcgggccgatgctagcattgtctgattgcgttttggttcgtatttctgacggtggcgtctcgcttgattgcgcgcaggtacttcctgagaaagctcaagaaggtgaagaagagcaatggccag

SEQ ID NO: 10411 - DNA, 208 bp, Zea mays
tgcagatatatgcccgcccaacaatttttctgttctgactgggattatatagtattcggattattgcttatcacattaaaatggctatcattttttatatatgatcatacgcttcgagaatttttttttatccgctaaagatcgagttctggcatgggtggacaaggtttgacagcttcaccacacaccgagccgtggagacgatgag

SEQ ID NO: 10412 - DNA, 82 bp, Zea mays
ggtgcatcccccaacccaagatgatgaacagatacctcaagaagaggagtgtgatcaagggggagcataggaagaacaagtg

SEQ ID NO: 10413 - DNA, 572 bp, Zea mays
aaattgtgctttatagaagtagagataaagatagagatagagaacagtatatagatagagatagcgatagagaaagatatataaacatattatatagacaatatttttttttacgtagtcagatgaactactctagtttttacacaatacatcctaatcaggtgtgtttggtttctagagactattttttattaatcctatttatttcattttaatgtctaaaccgccaaatataaaaatctaaatctaagatttaattcatatatgtgataatttaagaaataaaatagaataaaattgagggactaaaaattagactctaaaaactaattagctaaaaaatgtttatagtatgtccaaattcgtatcaaatagatcgccatattatgtccaaattgtaaaccgccatgtttcacaggaatgtgcactactgtgacaatttggagaaaataaaatcaaggggcgagctctacaaatgtcgacaccttgtctgcaagggtttttcgccgtcttatcccttcgtccacgctccctgcagccgccgcccaaaccctagcaacccgtcctccgcc

SEQ ID NO: 10414 - DNA, 696 bp, Zea mays
aaggaagaacgtgatgcttcacaggatgttgcactcgagcggaagagtctgtgtcgtgcttttctaggacatgtcatgcgacgtaatggtagaacactcacatgtacctagcttgtatagctgcaacttgaaactatgcagcctcttttattctttatcgttttctttagtctcgctgttgtgttatgtagctctgccagagcagcaagaaattttggggttctaattttgtaagagatgatggctgtttggggatatggatgtcgaggatttctcaagctgtgcaatgatgaattgcgatggatatctcaagtaggtaggaataccctggggaatttatgctgactgttggtttagtttggatactctagtatttattttaatccacatgtattaaggtagattaaagtgtaaattaagatgaataatagagtacctaaatggaaaaagcacaataaaaattgaactgattgtcctaaagtggccaggggaaaagaatctgctgaaacgcgcggcacgcgtgagttgtgaaagttgagacgcctcagaaaaacgcaacccttttttgggctttggcttttgctgcaaacaaaaggcgacgcggctgggatctagcacgctagcgagcgagagagacgcacatctatctgtcaagcgacgccgcggcctcgatcagagtcggaggcgaacaccccc

SEQ ID NO: 10415 - DNA, 365 bp, Zea mays
agtccctgtcttgtcctatcctagtaaaagaaaggacagtttgattgcacaggtagcccaccgctcaaatcatccgcttcccctcgcccttcctctctcacacccaaaacaaacaagcctgctggatcgaccgagttcagccgagctagctaaccctcgcaagctagcagcttctctcaaccctcgacttccttctacctatacaaccctaaatcagtttgcttccttcggttcttgcgaattgccaggaacgaaagagctttgccgctctcgtgttacagaagactcggaaagagagatcgagaggaaggagtaccagatagacgtaccagcaggcagcagctagctagaggggcgagcgagcc

SEQ ID NO: 10416 - DNA, 857 bp, Zea mays
ttgccgctgctcacgagcctcccgcctcgcgctgccctgccctctacggatctgccccaggagagccagacagccaggtaaaggagccgtcaaagcccccgccgaggagagcacgcaagggtaagcccacctaccaacgaagccccatctcttcgccttgcccttcggcttcgattagattggatcccggccgccgtcgctgcaggtgggatctgcccccttttttttcttcctcgccgcagctccttccctcgggccgtgtgtagatctgcacgttccctggcttctgctcggtttcatgccttcattcatctccgtcgaattcccagtagatactacgttccatactctgtacggttatcggattatgcaggcaatttgatctagctgggtaggtcgataggttagttatggcaaataggaatgttggcctcattttctcaagagttggcaagtcagtgaggcatagacctacgcctgctctgagttctgtccatatatactccatgaatgaactcagcaattctgttgaacgattcgcgttgttatatactgcgtgccagaccgactcacgaacattttttcatatattaatgcactgttactcaaggtcatgatggatctgatattccgactcccagtattcgtgcgtgtccctagttaatctattgatgcttggaagaaagctctttttaactcctgttctatatcgatcacctggtggtgatacatgtttcattcttggttattactgcttctaaatctgattctttaagctaccgctctgtctataatctgttacctcacctgagtatcgtacctgatggaacatttttttttttttgctgcagtcagac

SEQ ID NO: 10417 - DNA, 788 bp, Zea mays
gcccgccccgacccacgttagggcgttcgcgccccaagggcccgtgccattggctcagcccgcccggccgacgcgccgcggcgggccgcctcgaagctcccttcccaacgggcggcgtgctgaatcctttgcagacgacttaaaacgcgacggggcattgtaagtggcagagtggccttgctgccacgatccactgagatccagccccgcgtcgcacggattcgtccctccccccactctacgcaccgcctagcgactaggtttcgaacccacgggagaggggcaccggtcttccgaacggaaacggccaaggcgcagcgtgggaagaggccgaagaccgccgtgggttcgtgcacgaccaaaaaaaagccaagtcccagcgtgtggaaagacaccgaagctgctacgtatgccttgggtgaagggcaggatggcgacggggcgacatggctgttcggccttgcgtttgggccgaaaacgaggggttcgcccatggcgcacgggccgaaaaccgaggttcgggcatggccccggaaataagctaagtccaagcgtgtggaaagacaccgaaggtaatatttatgtcttgggtgaacggcatggcggaacggagggaaaacggcacggaggcgcaaggcgacgggcggcatggctgttcggccttgcgtctggaccgaaaatgaggggttcgcccatggcgcacgggccgaaaactgaggcccgggcacgaccccgaaaataagctaagtccaagcgtgtggaatggaaagacaacgaagctaaggtgt

SEQ ID NO: 10418 - DNA, 1500 bp, Zea mays
tttccctccgttcctctgtgcccttcaccaaagacatacacattatggttcggtgtctttccacatgcttggacttagcttattttcgagttcgtgcccgagcctccgttttcgtcccgtgcgccatggcgaacacctcgttttcagcccagacgcaaggccgaacggcccagccgcccgtcgtcgcgtgcctccgtgtcgttttccctccgtttcaccgtgcccttcacccaagacttacacattagcttcggtgtctttctacacgcttggacttagcttatttccgaggccgtggccgaaccgttgttttcggcccgcgcacaatggcgaacgcctcgttttcagtccaaacgcaaggccgaacagccctgccgcccgtcgccgcgcgcctcctcccgttttccctccgttccaccttgcccttcactgaagccatacatacaccttagcttcgttgtctttccattccacacgcttggacttagcttattttcggggtcgtgcccgggcctcagttttcggcccgtgcgccatgggcgaacccctcattttcggtccagacgcaaggccgaacagccatgccgcccgtcgccttgcgcctccgtgccgttttccctccgttccgccatgccgttcacccaagacataaatattaccttcggtgtctttccacacgcttggacttagcttatttccggggccatgcccgaacctcggttttcggcccgtgcgccatgggcgaacccctcgttttcggcccaaacgcaaggccgaacagccatgtcgccccgtcgccatcctgcccttcacccaaggcatacgtagcagcttcggtgtctttccacacgctgggacttggcttttttttggtcgtgcacgaacccacggcggtcttcggcctcttcccacgctgcgccttggccgtttccgttcggaagaccggtgcccctctcccgtgggttcgaaacctagtcgctaggcggtgcgtagagtggggggagggacgaatccgtgcgacgcggggctggatctcagtggatcgtggcagcaaggccactctgccacttacaatgccccgtcgcgttttaagtcgtctgcaaaggattcagcacgccgcccgttgggaagggagcttcgaggcggcccgccgcggcgcgtcggccgggcgggctgagccaatggcacgggcccttggggcgcgaacgccctaacgtgggtcggggcgggcggcgagcagaggcgccggttgctagcttggattctgacttagaggcgttcagtcataatccggcacacggtagcttcgcgccactggcttttcaaccaagcgcgatgaccaattgtgtgaatcaacggttcctctcgtactaggttgaattactatcgcggcgcggtcatcagtagggtaaaactaacctgtctcacgacggtctaaacccagctcacgttccctattggtgggtgaacaatccaacacttggtgaattctgcttcaca

SEQ ID NO: 10419 - DNA, 231 bp, Zea mays
ggtaactaaacattttaactgtttagacattgaactatccttgagcaaataacttttatgttttccagcattagtttaggtaactagtataacttaaatttgaacaaaattactcatatgttttwgtatgatttatggcaactaattcttagttatatgcagcatcacacatatcaacaactttttgtgtcctgaccaggaacaatagatatcataccaaggagaaaaagt

SEQ ID NO: 10420 - DNA, 421 bp, Zea mays
ataactctttctgtgctctcttattatcatggatttacttgtcttgttcaaggataatttaataatctgcacctttgcgttgaaacatgttaggatatcatggattcagtgcattttactggtatatgattctgataataacttgcatgtcctagtttgttatcatcataaaaaagggcaggcccatgccagaggctgccacatgagtggtgtctggggaagggataaaccagggcaagtcttccctgcaaatgcggagaggctgcttcgaatctgttgacctgatgactcagtgagacagcttccaccactgaaccaggcctgcccttcagtttgttatcctcataatattcttatttcttgggataaggtcagtaggccttttgatttgggaggccttggaattcccaatctcctcact

SEQ ID NO: 10421 - DNA, 323 bp, Zea mays
ggcctcgccgcctcggctcgcccgcccggtcccgtcgatcgccagcaagaaccaacaagcccttctgtctgtttaattccagtatcagttcgattctcatgttgaataatcatgatcatgtgggtttaggtgtcgtgctcacgagtatgtagtgtagctcctgctagcacagagcacagcacagagccactgggcgatcgacgggccgtgcatggcctgtagataccatctcatatgttcaccactgctactttgctcatgttgggggcctctcctgaactgggttcctggatgaactgattttctattagtttccggaatcg

SEQ ID NO: 10422 - DNA, 190 bp, Zea mays
tcggtacccctgctgccgccgtgtgggggcaataataatgggcttctgacggcgagtagcagagctcatcatgcaccggcagcagctctggcggcaacgcacaccgcgctggcctgctaccgtggcagcatgccggtgtgtactattactatgacagcggacgacggcagcggcaggaggccggcgtcgg

SEQ ID NO: 10423 - DNA, 824 bp, Zea mays
tcgtgttggtcgaatgagaatactgaggctcagtttgaatatagagactaaattttagtctttatccgatattaattaaaagcattagatatagtatagttataaaactaattatatatattaggactaaaccacaagacaaatctattaaattgaattagtttataattcacttatgtgatgttgagttcgatagattcttttcgtcgttcagtatccgtctctataattaattttataattaaattatatcaacatagatgaagaatcagatcatccatataatattttgaggaagaatactgaagcttttagtttggccctactcaaatatgacgacgggatcctgtacactttcttagcaggtaactgcagacggtcactgacgtgtgggcattatctaggcttggtccctaatgtcagtgacggagcaggttccaaatatgaagcttcagtagtgtatcgtgagaacacgtcggtgccaggctgccagcagcaacgaagccgcaccaggccccgcactgcccatggacgcacgcctcccggggctctcgtgtccctgtccgtctcccgtttgccgcctccaccgcaacgcggcgcgcggggtggcggtgctctcgcgatcctcgtgtcgattccagcggcgggggtgccattccctcccctggccgttgcccgcgcctcgcggtcgcgcaccggaaccggagccccgccgcgaatctagggttgcctccgcctcgccccctcctcccgagactcctagcggcaggaattaggacgagggtaacaggcgacagaggctgcgaaggacgccccctcgtcga

SEQ ID NO: 10424 - DNA, 458 bp, Zea mays
cagtacccagtccagacccggctccagctggcgggtataaataagtgaactccatcagcaggaaaaggaacgcaggaagctgcttcctcgttcgattttaaaatggctccccctccatcactggcagcctgtacggctgaccgaaaatgcgcaatcggttctgatatgaacagcaaatcgtattcaaatgttcaactattaattaaacaatgcgcaagacgctcacattgacatttagcacaggcgtggcatgccaccaccctataaaatgcgtgtcatctatcgcccaggcagacaccagacaggatcacaggaagcacacacatcactgatcgagaacttactacatagtacaccaagaaagcaagcgacgacgacgtctgggaacgacgaagccgaagccggagagctatactatacctgtcatccaaccagccagccagccaagccatcatatc

SEQ ID NO: 10425 - DNA, 1500 bp, Zea mays
ggtctatttataacatgcgtgtatatatatataattgctagtggctaaaactagttatagaggtttcaaacaatctagctaaagtctcgcctaattgctagctagatttccaactaacaattagtttactagttgaattggtacaactaaaacttgtcaaaaacaatattgtccttttatctttttattacagttcttggtcaccactctgcactcgacgctcgctcaaaatgacactatttagcaaaaacattgttgcctcaccgctgctgcggcacgaggtgtgaagctacgtagtaaatagagaaattcgcaaaactagtgatttaaaccagattttcactatatatgtaccacctacatgttatcaccatgcatccttgaaacatgtgcaccattttctgattcactctagcctcgccacggttcgacgcatgactcctgctgggttggtcagccgttgcaatcctttttaccgtgccccgattgatccgtcacccacatttccagcaccctagctgtcggtagttatgttcatgtagcacaactaccgtattttttttacggattcatgttagttgtgatgtatttgaagtgtggaaataatttctttttaaataaaaaggatgacagtaaaaaaggactccaagacaatacaaaaactagtatgttcagctaacctattagctaggggtttcaaatagcctcagttaatagttagctaacccattttagctaacaatttattagctgactaactattagatcaactccaaaagactctatatatttttttaattgatttgaataaaaattttagaaaaaatgtccttcaacggtttatttaaatggttattcaaatatagacattttcttttctgggtttctggagagctaaaaatagaaaaaatgactctttagaaaaactgtttgccctaaaggcatagaaattggtttttatacaaatgacagtaaattttgaaagactcttggtgatgttgtctgtcctggagattgatcgagagccaaaaagtcctatatgacagatggagttactatcgtggttatgctggtaaggttctgtgtggaaagcaactcagtttttaaataactactccctccgtttctttttattagtcgctagatagtacaaaattgtactatccagcgactaataaaaagaaacggagggagtactagtttttatttttagtcaggagagactagcttagtttgtgaattcactttgtatcgtctcatcagttatcctttctcgatctccctcagtgacacgcgggtcccgcttaccaggataactccaccaggccgtccaggaggagaactccgcctccgtgttctcgtcaatgggccatataaggcccagcccaccgatcctcctcttctgtcttctcccctgcgtcaaagacgacgcaagcccttgcctctccctactccaaaccctcgccgactcagatccagcttcctcgcaccgccgtcgcc

SEQ ID NO: 10426 - DNA, 951 bp, Zea mays
ggcacatatgcagagcaaaaactcgtggaagagcttcgctatgttcaagttcaattctacttgatcatagatattgtcatgctctattccgtgggtgactccgatgcaatattcggccggcgtaccctggtgctccggtacttgtacttgaagttgaagcagtggcagtggccctggcacccaagacaagagcgcaattgggagtacagaaagatttccccatacatgtcatcaaagaagaaagaattccgcatgaagcaggccgcgcacaggcacagcccaccggagaaacggtctagtgaagtcaaacaggctgtgcacaggcacacacagcccagaggccacatcagaaattggtcaagcgaagtgaatggaatagatcaatagaccgcctcggataggagagaaaagttatcccaggggccaggtccgagccaggcagcctccagagtcccaggagcagaaatcagggtctgggtgcacacctcaaccggcctcatccaaacatccaaatacggtatgccgacaagcagaagcactgaagcaggcaaaggatcgacgcggcacggtggggttgcatgccccccaccggcgtgcccatgccccgccaggccgccacctgacgggccacgagaccacgagatctcatcaagcgtgatcatcccattccaaagttccagtcgcttctccctgcccaagcccaaccgaagcacggcagtttctgcacccgccacgcgtccgcctgccctcccggccataaaccacgtgtgcgtcgaggtggccctcgcctccccggcccgctcctattatatcctcctcatcgtcgagcacccctcaacccacgcaccaactctcgccattgccagtcaagctcgctataagcagccagatattcaggaccaccgatcacgatcccaaaaacagcggctctgtgtcgcgacgtcgacggcg

SEQ ID NO: 10427 - DNA, 1500 bp, Zea mays
aaattaaaacagtaggccgtcgtcgtctttgcggctagggcaacacggattcgcgctagctagctagctaattttgcgtctagctacgtgccaatagacaggatcatatccaggtggatccatcgacccatgcatgcatcgatcagcgctcttcaatttgtaaaccaaatctatgtacgtaggggtgttttattaattatatattgatatcgatccccccgcgcgcaggaggaaacaacgttggtgtatactcaagtgcctgccaattaataatgtctggattaaatgtttgtctccattatatagttatatatatatttccgaattgaacgaagtggacgttatacttatttatttttgtccatcccagcaagtgcatgtatcttggaaacaaaagctgcatgcattggtttttagacaggcaagtatacttcactgtgaccaagttgctggatcaatacacacgttatatatgacaacagacaacttgagaaatatgtagtgccaatcatatgtgcacatatatatacatggaccatcactgtgggggattgtattcacgggacgaaggatcttctgcggtgcccccgccagcgccactgtggacggccggcgtctgggaattattgctgtcttcccgcaacttggtcctatagcgaagcaataatgtaatcttttgttcgtccagatacatagcatatgctacctgcaagtggtcaactaagctatgaacctatgatcgagcagttttcttgtgacatcgtacaactacttcctctatatatgttttttttggtgggggagggggtccattgcgaatgagctagctaatgcatatacacataagatttggatcggtgatcagacatcgcaattgcagctgtaacgacatttaccgtgctgcatgcggtcatctcgacatttacacgatctgttagccttacagcttgcaacgactgcgtgcgcgccatggttgacgagttgcgaatgaatgcacagtgcacataataagatcctttgtctaggaacaaaaaaaaacctttcgcctggatttgcacggatcttgcgtccagaaacgccctgcgacactgcgcggtttcccacaggcccaacgggtgcgcaactcacttctgcttcggcccacggacacgacgaatgggccagcccagatgcccggtcctcgcatcccgcgaatgtcggccttcttctttcccaagcacgacgcgccagacgcttccagagctttccacaccattcgctcacgactgaccacgaggcacgatcacacagcacaagcctcacccggcggaacagctcttccgagttccaactcccaaccgcagcctcagcctcagcctcagcctcacacggccgaagcagaacccgtgaacacctcaaacctcacggctcacgccaccgtcctccagccccgttctccggcgatcctgtcattccagacgcgtctccgcccctctcggtccaccaccccgacgccgccac

SEQ ID NO: 10428 - DNA, 1500 bp, Zea mays
catgagtaatctatttattaaaggatagatagattaatttggtgtcataaatcttgacgtaatttttataaatccatataaagtttaaaagtttgagttaatactacacttgaatctatctagtcttaacagaagagctgcaatttatcctagaactgtaatgtcctactaatggtttgtttggattcaacagctaaaatgaaagcttaacttctcctgagaagccaaacgtaaataaaacgtgttctttttactattttagtcacttatagccttttctatttacatctttagctcctaaagtgactaaatttaagtcacttttgttttagtttatggaatagaaaaggccataaataaatgaaggggtgcaggacataaaagcagcaaaagtatcgaacgaatgcaagctcttgcatctgatgattttatcatcatggagaatgaccttgactatatttaacgcccgttttgttgtccttgagttttacggttttagagctagtttggcaaccatatttttttaagggatttttattttcttaaaagaaaataaactaatttctaataaaaaaaataaaaattccttgaaaaaaatgaggtttcgaaactagcctttacttttttttccctctctttgtcaaatctggactctggcctctgggcacaattccctgctgagctggaccaaaaygcccctgcccgctcctggggttgtctgtggtccggttgcaccgaggaggcgcgacgcgcgagccatcatttctctcgtctgctcccgtgccctccgcggctccgccgcactcatcttctagtcttcttccctcccctccgtcaccactcaccacctcccctatggcatgggagcttctcccggcctcttcctccccttcctgccagaccatcttcctaccgcaacgcacctgacggtttccatccacctggcttccctgttgcgctagctgatcgacccacgcaacgcaagtgcaatgccgtgccgaggctagatcgagctgccgagcgctgatcacggtgaggccacccagatccacccgattgccacgcggacttcaccccttgccttttctcctcccgtccacccatcgggcgctttccctccatccctctctctcgtgcggcatctgggcgacccgccgacgcccctacgccaggtgcccaggccttcgtcgggtcctttaccggcgacgagcacacaccaggtttgcgcaccctttctcttccattcctgctgcgccaaaccgatcacaggaaccctaatttaatctatttgtatttggatctaccttcgatttttactgggtccgcccctgaccctaggcaacgttcatgtttttcctttaattggttcttcgggttcaattttggagcatttacatgccaccttaacatttttattccgtttcttccagggcactggagggctaccatctgcttcgctttctgaaaaaaaaacagtttcggcataattatcaccctaag

SEQ ID NO: 10429 - DNA, 426 bp, Zea mays
ctgcagaaaagcgtagaaaagaaaggtaaacaagattctcgtcgatcagttaaacgcatctgaatctcggcgactaaaacatttctatttctatccgcagtactagtagagctttcaacccgaagaacagcagctcggtagaactataaccgtagaagtaaaaaacctccacgtgtatcacaatataaagaattcagcaagtttccaacagagataccataagaacgcacgcgagtggccagtgggaaccaggaaacaagaaagtgagagggggaagctgcggccgacggccgagctcttgccgtccctatccacccctctcgccctcctctctgcctttcgctccgtccagccgccgcgtaaaatccgcggaaccagatgcccttatccgccctctgatcgaatccggcatcgccggcgaccttg

SEQ ID NO: 10430 - DNA, 649 bp, Zea mays
tgcagactgtagtgcaaccagtaatcaatgagctcaccggcagcgcaaatctgccacaaatgtgtaggatgctgtatgcagcctcatttatctccaaagattgcttggttcagtacagatttcatttccagcaaagatcaaatctgatatatctgtacaataaattttaataaaataagatcgaaacctaccgatgtgcaaaatatactgcacagcaaaaaaatatttatatatattggagtcgccgttacatggggccctctgcttttaattccgtgctggcgagttggtttgctccaagcctccaattcattgtgcagcctcctctttcactccctcctgccttcctcgtctgtcctctccccttcagcccttcctctttcactcctccgcctgtccggctgtccctttgctctctgctccgttccttgatccagattccgcggcggtgagggcacccagcccgatcgtccgtctctgtcgatctcccgaagccctaagtggaacccttctccgcgtcggattcgatcgcgggctgatttgatccagagaattcgcggggggcgccggcggcggggaataggatgctgtaggagggagagaggaaggaggaaacgtcccggatttctgggcgcgcgcgcgggcggcc

SEQ ID NO: 10431 - DNA, 103 bp, Zea mays
tggcgcctccacagccatcagtccatcacacttcacacatgcattgcatgctcccgaacaacaagcacgccagagcagtccgcggcggcgtgtcaaggccacc

SEQ ID NO: 10432 - DNA, 1500 bp, Zea mays
aaaacggccagaaacaatatttattcggtaatcaattttttgtcgtttatctttgattgcgaataaataggatataaaatctactgtacaaatttgtattattgttttttaacgttgagcttgtaaagattcataaaaggtaaacctcaaattttatcatatattttctcaaacgatagacataaaatttattatggattcagaaacaaattcggtaatttgttttcacatttttgttgttgtarggagcaaataacaatttatgcaatattttattcttatttataataatgtgattgataatataagaaaaggtcaatatcaaattttatacatatatgtattttaaaatattatttttttcccaaacagctcggattaccactctggtccctttttatctcggtgtgtattttaaacattttggcatggagggaaagctcctagcgtgaagcaacctatccatttcgaaacggtaaaaaggccaacaaggcggtggcaatgggggctacatccccccaccaaggaaacccggacacgcggctgttccatttgtcactgtcttgataagatcatctttggcggtggtttaaagcagtcccagctttccttgcgacagcactgtgtcctgtaaaactgtgtttcattgtcctccccagaatgaattactcaggctatccgcactggcggactggaaagcaaacgctatccgtttggagtccgcgatacagtaggccgtgtctgcagcggtgaactcgttcacctacgctaaaatacagtcgggcgtcaaaaactccaaatatagcgctgaactgagccatgcaaggtgggacggctgcaaggcttgcgagccaggtgggaagactrcaggtgtgaggtgggctcagtatggatatagagtaaacatgagtgcggaggattgtagtatagagtaaagaattttgctgatcaggacagaatattctttttagggtagaaatttagagtagtatgagtgcggatagccttagaacagctcaaactggacacatctcaaaattcgcattaaatgttcatgtgaaatcaactcatgccatcataccaatcgggcaatcggtagcccaataagcctcacagcccaagggatgtttgatcaattagcgcgcgactcgatcgatacaactaaaaaaaatatttggtttttaaagactatttttaatccattttttcattaaaaatttaatgatttagagattaaaataaaataatgaaactaaaaaaaattggtccctaaaaataatttttgaatgtaaaaatatttctcgtctaaagatttaatataaagcgaaaattaaacaaaatcgctccagtcccatcttctacgtggcttcgtcgtgcctacccggctagcggctatacccccagctctgcctcttatcatgtcttctcttctcctacgccgtacgaggcacgtagcatatgcggccgcatatccattgaagcctagacagtgatcgaacg

SEQ ID NO: 10433 - DNA, 410 bp, Zea mays
atcaaccaaacataatgaaatgcaatagaaacagcagggatataaattcatcacatataaccagggatacataagcaagttctcacaacacacataaccaaggatacaattcagtcacatacataaggactacacaacatactccaaatagactccacaaattttagtactactgattgctgttttgaatcctgccttggcaatcgatcactctaatattagggcgtgaagctatcagggtgcccccttggtactcacaaccccctggtaggatgtaggggatgagcatggatgcgggtgcccgatgaccaccgctgctatcagggtgtgaagctcctctcatctgtcctaggagcctagtgtgctgctcgatgagaacaatctgcccgattatgtacgttgggtgagcg

SEQ ID NO: 10434 - DNA, 426 bp, Zea mays
ctgcagtgccatcttatctcatttgctgtaatcccatggacccagccatctcttgatatccagagttctctggcatatccagagttctctttgcagagttcatgggatatccagagtcacgcctccacacccatgcactctctggcatatccagagttctctttgctgtaatcccatgaacccagccatctcttgatcttttcactgcctatttaagaataaccgagggggaagaagtgggagtaaaggagagatccttacctatgtcatcaaccacggtgtgtagcttcaacatagttttgttgcctccccttacccaaactataccctggacacgcccaaattctctggtcaagtgactcaacgtgtctggtgaccacgtcgccgacgcctcaacctcatactggaggaggagcagagagcaag

SEQ ID NO: 10435 - DNA, 340 bp, Zea mays
agggcctgctctggaaaatggcaaggcgtctaacctgtttctgctgctctattttctcctcctttgttcctacatagtttaaattgtcacaattctttgtgatggaatggaagaccagtaccacttctttcaacagtaatatcaaatrccggaactgtttttttaatacagactctcattagaccatgtttgaagtttgtttacttttgatgtaatttagaataagtgatgcgatggtatctgtgtgcttgacatctgagatggctgttgtctgcaatatatagttttagtacacttgttctatgatacataatttgtactgtcagtattcaagcaacta

SEQ ID NO: 10436 - DNA, 456 bp, Zea mays
ctgcagggtaagctccaaaagttagctaattataatactaaaatactgctctttttaaaagaaacatccactagtacttgtccttgtattaacattagcagataatttcatttggaactcccaaatatcgcttattcggcactcccaaatatcggttattaacttgtaagttgcatgttgacttgttgagtgttgtcacagtcacacaggagctttttttaattatattagaatattaggtagtagttaccttatgcataatgcaatttttgtcttggaatgtggcccttggattaataataaatgaatgcatgtaccatgtagtaagttaccattgcagttcagtgtcaatacctcaaaggttaaattttttatacagttttactccttatcacagtgctatctcattcatgttaccttgtctaaactttcttctcttggtctaggcttgtgcat

SEQ ID NO: 10437 - DNA, 462 bp, Zea mays
gttgagctagcgcttcataagttcatatagggaaacagatacttgcttttgtgttccaaaccatgcaaacgtttcttgttgtaaataactttgtatgtgagtatgtatctcgtttgatggatctataggagagttatatgaaatacctgttgtcatattttggtactctttctcctgtgctttcgtaaaaaacttcatttgaatgagataagaatccatgagtactgtagcccccttcaaaattgtgaaaataagctgtttgctctgtagtttttgtttcattcttgtaaaatttctgggttccaaaaggggccctgactctgtctggccagctggtttggctgggaactaggcactgggtagtgggcactgtcgtgtgcccacgcacagtcacacggacatgttaatcctcttcccctggtgaggtctcgcggcggcgggcaaatccattcgacgatccca

SEQ ID NO: 10438 - DNA, 1407 bp, Zea mays
tggctactaacagacggtttgtaatgtatgtcagtttctagtcctaatggcgaccattactgtccgtttccctccatctggccatgtacaaatatggaggagatgaaggaggtgaagttgcttccctctggatgtgtacaaatacggaggcgacagaggaggtgaagctgcttctagtcacgcacgcgaatatctctcatacgcattgcactcaacccatcatcgtccccaccttctgcgagcacagagagagtgggagagcaagcctccgcaatcgctgtccgcagagctacacttgcatgggtgtgcgggcaatcaggtttccagggagcgtactagcgaccgctcgcttcgtccgctcgaccaagttcctcatcgtcggcgtcgttcaagggactgcactacttacatctgtctacatcgactgcgtatgactacatcgaacatacatacgagatgtctcgtgtgaatggatccactaatgctttgagcatcggtccatccgtagggtacattctgttcttagtaattgtgcatgttttaatgttgtttactgcttatgcgagtattcatacacatatgcacatgcatgccgtcacatacatcacactaattttctggattaaattaaaacaaaaaatgcctaattctctaacacttttgagctctaaaactctaacatgggatggacaagagtttaaagataatttagataacttgtttggagctttaactttaaaatttagaggagagaatctagacatgctctaactagttacaccaaaaaaaacaacttaataatacattttgatattttagatgttagtatactccctctaattgattctctaagtttccttgagagtaatttatataaatttggtctaaattatttgacttataggccaaatctaaattgaagtactatatttattcccctttaactaccattttttatatcgaatagtcaaacatatttaattttaattaaatgtaaaaatattactaatacttatactgtataataaatttcattaaacatatatttgtataagacatttatttaaaagatataaatatttttttaaaaagctagttatacttgaaaaatctatctgacactaatattttttataaatctagtcacatttcagaaaatttaactgacataaagatatagacgtcattttaaagagatagaggcgtatataatttggaacagagaagaaattactaaagaaccagaattctattgacacataaacccttgtattgtatcctttatttgtttaccgcaccttcgtttcattgttttcatcagttgtcgtcgactcatccaagcaggacccgcggtactcaaaccctcggtccttctcggcggcggcgtacgggatagcagaggtggcc

SEQ ID NO: 10439 - DNA, 677 bp, Zea mays
gtgaagcacgagctcgatcctttcgggccacggactggcctggtccgttccaatatacacatgtagaattgagatccggaactattatacctagtcaatactaatgcaaataaccatatcattctagttggataacatgcccttaaaatataagatgaggttgtaattgaaagtttaggcgctaaaaatgatttttatttttacaaacggatggaagagtattttaacatagagacacggtttaagaagagcatataagctgagactgtttgtatgaggacattatgacgaacgcaaacaagtaaataactcagctctaaattgcaccgttttttttaaagaaaacaactccgttgcttttgttcgcgcggtgaagaggaatcgtcgaccaagcgttaacttggcgctttggatctggacggtgtgctgtgtgcaggcagtctggcagatcaacaagtcgcagcgcagtccaactgtccaagcaaggcacgtcggtccaagagcgacgctgccggcccggccgcgctgctcctccgagtccgagatctgaaggcgcgggaggaaggaaacgggcgaaaggatccagcagcaccccgcgcgcgcggcggttaacttgtcccaggtctcggcgtggcgcggcgcctccctcccggccctgccggtgagagcgcggtccg

SEQ ID NO: 10440 - DNA, 814 bp, Zea mays
attgccgtagaaactggggttaaaaatgaaacataaagcatctattttagttcaacttatgttggagtatttaattctcttatgattctaactaaatttactcagcgtgttcaattttatttaaaactgtctattcgcgtctcttctagctggcatccttcatcctacaacatccaaatgttttgtgcaatatcaatttcttgcctatacagtagatagtaaaagatccaaacgtaccccaaacgtctttagctggcaaggtgaggtaaagccctagcaagagattcgaactactttttctgggatggagggtgtactcccgaaggaagtttatagaaacttacgacattgtagtatatacatgttggcgcaactttataagccatgtaaaaaaaatgtacaattaccgacatctacagaaattatttcatgcattgaaaatactttaacagattgattttaagtaagatgtttaatccaccgaacggctcaagcccactggaggcctggtgggtgcacgctaaggggcctgtttaacgttttgctagcgaaccagattgcaatggcatataggaagcgcggcgtctagacagatatcagcattgtaagttaatgagttgaagttgtacagtgaaccatctcccacctttgacacttcgcgctccccatccaaacggtaccgatccgccggccgccgttctccatttcaaattgcaaacccgttctccttttccgcctcctcgacgcaactcgtcgccgtcttctccaactcgcacctcgttcctcgccccaccatttgccgctcccgcctacg

SEQ ID NO: 10441 - DNA, 1500 bp, Zea mays
cgctgcccaattctcataatgacattatattcaaccatttttttctttattaaaggactaaatgacattataatggacgtggagtgtttgatattggtatggagatgaaacctataaaaatgatggtaaagtggggaaacctaattctcgtagtggcaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcaggtatgcccaccctctctcttccgttcctgctttgcgaaaccgaacacccaaaccctaatatgagctatttgccttgttgtattcggatctgatcgaattgcagtatgaactttttgcatgtattatgcattctaacttcgattattattatttttttgcaaaaaagttattgggtaaacatgtgtaaactgtaaatccatattcttgctgggtccgtccctattggggaggacggtaggtcgtcattcccgctagtacctgtggcagatttgatctctctgtcgcggtacctgcgtctgcgaggctgttttgacgttctagctgttggtgagattcatcgtgtccttcgcttcttgtcatgctgctcttgattacatgtatcgtctgctgaatttgtgctcttgtgtgatccaaaaaatctgataacctatgggctttgatgcgtcatatctgttgcatggttttctcctgttagttttatccactgtctgggcatagtttgtcacctgctggtgtaaatttacgtgtaccttcggttgagagctcttatgcaaatggttcgatggtaaaagaatcattttcacacagcattttcaattagcttacatatttcttggagggtaacacctggtgttcctttcttatatggtaacgataaattgataattataggacatacatctgttcactttttttgtttggtttgtttgtcttttcttcccttattatctctagaatttacattcctactaactgaacttcagtgtttcatgccacaagtcttacaaaattgcagatcttctagaatcgagtcaactgaaatgccctagtattttaagtatggactgttgcaaacaaattaattcggtttataaattaactggaggctgttcagtgcttatactctcaacttcaacatactttaggtttactccttgccttttgttatgaacccacaataccctattcattattcaattcattcttttattctcactgcttactgtttgtcttattctgtatcccattttaagtattatttgcacttttatgcctgtgatgatattgtctacttcatacctctttagtattttttgaagcaagacaattagacaaaacgaatcaatggtactacttttccataatttggtggttttgttacag

SEQ ID NO: 10442 - DNA, 107 bp, Zea mays
tcttgcatgcctgcagccttttaaccattttttaatgtcacagtgtcttctctgagaactttgtgcgcctaagatcgacaattgccgatgcatcccctgtgaatgga

SEQ ID NO: 10443 - DNA, 128 bp, Zea mays
agtgcgtgatctactcttactgtcgccatgtgcttaatctaatgtgtcgtatctaccaccaccaccactactactacccgaatatacctttcgagtacttttgatcatgttggggaacggggtcgctg

SEQ ID NO: 10444 - DNA, 487 bp, Zea mays
gtcttttttttttgtcaccattgtgacttcacctacctgtggataagtcaggattcctgctaggatgtacagtacgcgtgattctttttgtaccaggtagcaaggcatcaaagattagatgctaggtgagcttataggcttctggtttctattgatttgtttgttggttgtatatttgtattcaggttttccttgccattttttctacttgtagccgttttttgggcttgtatactaggtggtaagggcagaagaccctgccctgtaagcatagttacacaaggtcttgctgtaggtatggaagctgtacatgtgttgtaacggattataaaagggggaaagtagtgcgtagtgatggctttgtggttggtgtgttgcttacctttgatcaatgatcatgtattggttcgtcatatattgtttattgtactgcacaccattccattgtagataacatacacgctcaagacttgttctgggatgtcaa

SEQ ID NO: 10445 - DNA, 757 bp, Zea mays
ggtgtttatatattgctgatatatacggttacagataatagagaaaataggaatatacatagatgagatcgtaattcacagttaacctaccgtgaatcacggtaaagagacacaattccctctaatttaggaatagaagtaacaaactgtgttttcatctgattagaagtactccagcacgtggatcgattgacttgaggttgccttaatccaattgcaacaacttgaacacagcacaaactaaaagaaaatggattagctcttgcactgcagtgtatgttgtccctgcacttgcagttggtttcaagtggagtttcagtcatgcttgagccatctcaacgattggctcctgcggtcctcctctcctgttcttttaggattgtagctgagcggcatcaagtagggatgatggatgtgagaagaggacgtcacgatcacgacacgttgagccgcgcagagtgcatgccgccgccccgatttagacaagaatcgaggctccaacaaataaagaatcaaaagtcaacctcgactacgaggataaagaacagctagctgatcacagcaaatgcaagagatagataaatagatagatcctggtcaactccataaacaactctaacttgattgctcgtggcaatgtcaacgccgccggcctagccctcacctccccttgccgtcttcttcctgtccctcgtcgcccattttttcgccccgaccggccggcgccgcattccccgatgccaacccagatccggcg

SEQ ID NO: 10446 - DNA, 1500 bp, Zea mays
tggcatattgtagaccacaggcacacagtacatgatatatgctgccactcatggtcaattgtaacactaacacatttagacaaaaaaatgcaggttaaattatacagcacgttccacacatgatattaccctgatggatcaacacattaaaactactgtttttacatgatatgaggtgcatgtcacagtttatatgattgaaaaatcatcaaatatcagttaaagacatgcaaaccttcaaaacaaagtagcatccctgagggtgactttgtcacattcatcacaagacaatttgcaaacatgctaacttgttaagttctgaattatgaggcagaaacaaaggacgtcaagcaaatcaatacacattcatgcctagcacaaactatctatgctcctatcagaaacaaatggaacaaaaattgggaagacaattaaaaaaagagtggtgacaagtccatactcttgaggtcattcatctcgaaggaaaccatcttgtcttgcaatgacaccgtggatactagcaggggcagatccagtaaaggaatatgggtgatttttgcaacaacaaaaaaaacttcgaagttaggagggttgtcaaatagctaaatagctttaggttagggtttcggtgctcagcttcgaacaggatgaagggaagggaaaagaacgggtgggagtacctggcgggtgtcgtcgccggcgaagagaccaaagaaagcctcagcagtcagcacctggcttagggcggcggcggcggcgcacccgtcgtctgagagcgacagaggggctagactagagaagtagagagacaaacaacgcacgaggaggttatgcatcgacggcgtcagaattcagaaagagccgcatcgggactcctcgaccgttttttctttggaaatttctgttttattacagctattttgggaattctatttaaaaaaagggaaatttggatccataccattaaaagatcaccaccttggatccataccattactatctcacttacatgtgggtccacatgagtcaatgacatgtggagtccatggtatatatctaaagtttggatcttttaatggtatagatccaattgttcctttttcataagctgcaggagccttgcctaatcctccgtgccatgccgatgggcagggcagggcaagaggaggtcacgaaaacgaagggtgccacccaccgcaaatcccggcgggattgaactgagctcctttcctccgtgcccttgaatgcaaccacctcccgaatcccatcttcttcatctcgctgcggcctccctcctcctccactggagccgacacttgatccattccccatccccatcccacgcggccaccaccaccttctcctcctccccctctccatatctctctctctccgggcaaggaggaagaggagcagtagatcagtcgtagcaataaatccgtcacgcccagctcgcctgctccgcctcgccattgccttgctccaaccaagcaggagtag

SEQ ID NO: 10447 - DNA, 234 bp, Zea mays
tgcagaccgatgcatgcaccgcgcacagacgactcggagcgccaaccaatcgtccaatgcaagttggtagactattgtctgatccgcaccgttggctgcgtcacattctctacgcctcgtgctccttcccttctaccgttcggctgcgtacccgcgtctccccagatccgctgccccgccctctcgacgcggcaattcctcgaacgccccgcgcgagccacgccctcgccgccc

SEQ ID NO: 10448 - DNA, 451 bp, Zea mays
cgcggctccactcaaagcttgagccttccttttcttttcttgtttttgttttattttcttggtaggggggagtcgtcttctccatctctccttagcctaggagaaggagagatccagaggcaaaagcttcaggtagacatggcgccctctctccctctcctcctgccctgcgttccatcccttcttacgaatagctgagcccgtgccttgctgcctcgtgcgtaaataacatgcgttcttgcacaatactgtcactaatcccttcatcgagctttgcctcgccatagtcgaccatagatcttttttttttcttcttcgtcgctagttgaactgatgtagctaaccgtttcttgccatgttcttttttttttctctcttctttttgcagggtttgtacaaattctagatctaaccggactaaccagaaaacaaaacaaaaaaagacgaaagc

SEQ ID NO: 10449 - DNA, 662 bp, Zea mays
tgcagatgccacacctccgccatcggaggcaccgaagcctgaagatgatcaggatgtgaaagatgagctatgatcgcaagatgtttccaggcttggtcttactgaatgaaagtttggtgactcgacagtcatcagttcagaacacaggcacacagctagtggagcgcagagggatagtttaacgcaggtgcaaatttgtcaaaacactacacctggaatcctggactacattgattcaggtatttcgtttacagtaatagtttcaagacctttaaccaaatcatatggcggggaagctgcgtccagtaataggttaacaaggcagccagctggggtgtagaactctgtctgctctcagctgcatacacatagactgtaatggtcaacaatttaagatctccttgagacgctgtaaaatttatcggctgccagtcgaaaggcaacagcgaagctggcagctgaaatgcccgagaattttgtagcactcagcaaacggattttttaaacactcagtaagtcaataatgcgacaatgcctgtcgcatgtaacagcaggctattgtgggcatggcagctaaccgttatactaaaaaaaatgccaagtgctttatcagttgggtttaacacacgccgttgtctgtccagtgaagttcgaatttcgcc

SEQ ID NO: 10450 - DNA, 556 bp, Zea mays
ctgccaaggaaccgtacatatagtcatataaaacattattttacatgtagactactttattgtttatatttttatagaatagattttaaactagaagattaatagtcaggtccccagtccccttttgaatttggtactttttctatgtttttcagtaaaaatatattgattcatataaacttcttatatgattcctctgtattatttaatgggcttcaggctgttgtgagttggaattggaacacaggctgatctattctttgttggctctggtacgaatcagagacaattaccacggcaggcgtccccacgccacggctgagtacggagaaagaatccctctagacttctctgcaacctgcgcgaggccgaaagagcagcaacggtgcggaggcagggaagcaaagcaatcccccacctatatacgcgccccgcccagtaggagagtaggagctgcaaggagtccggtctccgaaaaccgacaagacgatagcaaatcgaaggaggacacggctgctggtggccgcattcggtcgggggaggagcacgaggagcc

SEQ ID NO: 10451 - DNA, 701 bp, Zea mays
tatcgtgcctggcgggtcgggcccaaaacgggccggacttcaccgggcccggaccgggccgggccgggcggcccgtttggacatctctaagtcttaccgactttgaaggagcgatggaggagataggggaattggtgggtgtgaggtgtgttttggctacgtcatcctcattaagtggttcagtcatatctattttggctcattaggatttaatagaaacccgaacaatgattaagaccttaatgaacacaatttgatagtttatggaccaggttgatatagcaagacaagtttaagtagggggctgtattttaaagtttaccccggtaaacaaggaaatgctggtgcatataccatttcccaatcagaaaggaaaaggatgaaaccggggccgggcactcgcttctactagttcatattccactagctcaagactggccgcttagccgagttgttccaaagcaagccaccatttgggttgcgaaagccttggcgacgcgtaccacagtggaagcgaataaagttagttaactaacgggcaccaatatttatcggcggcctcctccgcctccacttccccgcttgcggcctttttaaccgctttttaaagctcccccgcctctcccacactccccacttcaccttcgccctcccccgcctgcgagcgcgaggcgcggaggggctagcgcgctagcggcgcc

SEQ ID NO: 10452 - DNA, 725 bp, Zea mays
gaaggacagtgcatacccaaatatgaaataaaatatattgtaactaaccaattttctctagattttaaattaccatatctggaagactgaattttggtatatccttttcagctccatatcccatagaaactataatggaagcacaataaacacaatgtaaaagaggtagttttttttatttagaatcaagactatataatccagattccttgaatcccctaaattgtgtttgtttattgttagaaatgaacttcatctaccaaacaggattcgaacaggcctttctttaccatgtttcgtgcaactatgcactgctaacatatcagtagcatggtttgtactgctagaatatcagtttattaccatttttgtgcaatcgtgactgaggtggatggggttattgaacaatgtatttgaatatttgatgttttagctgcatggaagtattcattccaatccttatgttgaattgcaaataattgcttaaatttgagatctgtatagttcaggtttagttgtgccttttcattggagcctgaattggacttcagttgtttgcatagttatagttataaatatagaatagcttgcttgtccatcaattttgaattgttacagtactgaatgagtcctcagagtgcatagtgctgttctctttttatgtgcctgatagttggtcctcttgtatttcagttgctcttgcggtagttcccccaactgccacc

SEQ ID NO: 10453 - DNA, 533 bp, Zea mays
gtgattgtatcagatcgacaccacatctaggaacaaggatgaccaaagaaaaatgaacacattgctactaatccaaccatctagtagacgttcacgatgtatatacactcacctatatagaattatgtacgtaaactctaattctatgaatactttcgaagttaggctgataatttttaagacatgactgataaagttaccacaaatatcttgctatcaatagaaatattatctatcactaaaaacacaaagtcgttaaattacctaatatcagcttctatacaaagtcagaccctacaagccctctctttcaagcgcctcttcaaatatcaatcccgggcagcctgtgctttcctcgtgaatattgtgttgggccaatccagcctctcatctcatttctgtgtctttgggctgcgatcggatgatggacttaggcacacgtgactggtggactagacaggaaaatcccaagttacgacgacttccccgagacgacggcgtaacaaggggggaaaaaaggaaaggggatcgcc

SEQ ID NO: 10454 - DNA, 558 bp, Zea mays
atctatctgccatgggatgcatgcatcatatatatccaccaagagaagagaggataattaattaatctactcaagagaagaatcagtgttgctgttatgcgaccctctatctatctatatatatgtgcttaatttgtcatgaacgactgccaatataaaataaactattcagagttgtttgcacgtaactccgactcgatggattttgcactaaattcctcagatcaaggatgcttaactcaacaaataagtaccaagtatatatggccaacatttctctcaaagtaataagccagcaggcgacgcattcacgcacatcaacagcttactagtaacaacacatctcagatatactaacataataacatttactcctttcatttcgttttagttgtcaccgctagtgcaaaacaaaatgagtcataatagttgtcgctctagttgaaggaaaaaataaactaccatttttgtcccttacggtaggtgtttaatgttggattaatgtgggcttggcccaaattaatattcaataatagtcaatgctaatggcccacttta

SEQ ID NO: 10455 - DNA, 1500 bp, Zea mays
cctgcgacatgcgccacttccttgctggtgcgtgcgccggggttgtctggaaagcaatggtagggccatccgttgtgtgtgtgtgtgtgtgttttcatctatacacacgcgcgcaagttgtccttaaacgtttgtcctcctaactctaactctgttcctgtttctagcagcgaacgaaaagcatcattcacgagtggatagctcttgtctctgttactctactcctatttaatttagctgttttaaacttttaatgcaccagagagctaatacttagctgctacagttagctagagacatctaaacaacttatctaatagtttacccgttagttatttttagctggagtcattaaaacacccatatttaatagtccagctaactgtattagctacacccttgatcactacacatttggtcataagctagtttaacctaactaaaatcagttaatagtttcaacggtcgcggtcctgcagcgtaccgtggaaacgaccacaccgatcgactgtaacgcggttagttattattaattgtcggttgaccttgcctacactacactacacgtaggccagctagcattgccacgctctaaagcctcaacgccgtgaccggggtacgcggacgtcccacgacacggtcgttttgtcgccgaaaaacacagaaacctcccgcacgagccattcaccatctgtccatctgcaccgactattccgacccaccgagccttccactccggcacggcacggcacggaacggcagacgccagcgaagcggtcggtttccacccaatccaatcccatcgcgccgggccccgtcgtccccgcacggcaggagtatacgatgtgaccgagagcgacagcgaccagcaccagcaccagcacccgtccgagccaaatacccccgcaccgatcgcgcgcacctgcttcccacccaaactcgccgtccgcctccgccaccacccccgcccgcgcccatagcaagctcgccttccacgcgcgcggccgcgccagcgcaccacgcctcgcttcgttttcccgttgcttgacgctgaatccattccaccaccacccaggcacggccaggccagcgccagcgcgtcgtccccggcccccgctccgcctctccggtcgcgcccgcctcggggcgaccaccaccaaaatagaaacttccgtgtgtaggtgacccccggctttacccccgcccgaccgcccccaccccaccccgcccacgcctccctccctcccgccgggacaaaaccgccgctcctcctcctccgcccctccccgctctttctgtgaggcgggaagcgaggcggatgccgaggcgacggggctcgcgcaccgcacgcgtgtgcccgccgcccgggggccaggcgaggtggtgaggtgaggccgagcgcggttttaaattgttcacccggccgcccttctcgccgtagttttcagtggtacaagcaagggaggaacgaacgtgagggctgcctgcctgcctgcggac

SEQ ID NO: 10456 - DNA, 338 bp, Zea mays
ggtatggatgccgctttagattgccttttcactattctcttaatattagatttttgcattactttcgtgacatctgaacttccatttgtatactgaactatcagctatggcattttattctttgaggttttattaatgaattaatactaaaattgcttgctgatgctagcttgtaagcacaattactttgcacttttcagactattctagtttctgcgcatgccctcacggatctttagactccagggttcaacttcactgtgaatacgctgacgctacgagaagtcatcacggaaggggtctcgaagcaaggtgcaaagactcacctgccgtctctg

SEQ ID NO: 10457 - DNA, 524 bp, Zea mays
ctagctcaggctacgggggacaagaaccggcgtcccatctggctcgcccgggtaaacaagcaatgatggcacctcacatgctcccatgatgacggcagttctcagccccctacggaagcaaggagacgtcagcaaggtcccgacagctgtgcttctacagggcccaagccctccttcgacggccacgacatcacatgcacagggcactaacacctctccgacaaccacgtcggcatgtacataggtctctggctcctctctgccggacacgttagcatattgctacaccccccattatacacttggaccctctccttacatctataaaaggaatgtccagggccctcgtacaaggaggtggccgcgcgggaggacgggatgacgagcaggctctctctctccctctccctcgcgaacgcttgtaaccccctactgcaagcgcatccaccctgggcgcaggacaacacgaagccgcggttctcccccttgtgttccgtctcgcgccgacccatctgggctggggc

SEQ ID NO: 10458 - DNA, 232 bp, Zea mays
ggtccgaaaaaacaccttccctttgctacaatagcaacagtcaatgacggacggcccccccccaatttggagcgtgctgagcgtataaataagaactcacaccagctatatttgatatgttgcttgtgccatttgcttaacttcatagctcttgctcactaacgcttgctagtttttcaagctttctgagcttcagttaaaaagacgcattttcgtcatttctgaagaaaaa

SEQ ID NO: 10459 - DNA, 52 bp, Zea mays
attttatgtgaagaacgacttgatagcgagggaggacattaaggaggttatc

SEQ ID NO: 10460 - DNA, 135 bp, Zea mays
aggcgacaaagataatcctgctggccgttcaagagcaaaatcaccaaggcaaaagcactaaagcagacactaagaagaaaacaaaggaaactagagcagaaaagcgaagggctcctagtccagcttctcagaagg

SEQ ID NO: 10461 - DNA, 1465 bp, Zea mays
tacatgttacacatctcgaacaagtgtttctgttacttagtcaaaacaagcttaaattgaagcaatccaattgtttgcttgcacgggacaaacttgagtttttgggacatatcgtgagtgcagctggcattgccaccgatctaggaaagatacatataatcaaggagtkccctacaccaacttgtgttaagaatgtccacaacttccttggaatgacaaggtgacgccccagctattgattcgttagacgggctcaccgacgttgcttgctacatgggaaaaggaataacttaycaagcaacaattttcggcctctttagcttggggacgagttgtatctcgagggagagatgtcaamaacccttcaatctagggaaggcaacagaagatgttgatcgcgggaggagccatcgcccacttggaccaagagcaatcgacgtgcgatccagcccaataacaaatacatgggtctctagtggatgacataggcgcacaactgtctgtaatcacatgatatatatatatggaaccaaaacgtgaacaaattggcaaagttgggatattcatacacttgctggtggtcgacgacgatatgtggacgtcgactagatcaatatactataccaattttgcgtgtgcgttaacatatcactttccattggggagggtcgcttatctcacaaaaaaatttatgggttcctaccggacaccgagtactgcatgatttcaatgaaaacactaaatctcacagatatgatagaaaaaaagaaaactagatcttttatactccatccgttcattaatatatgacactgttgatttttttaaaactttaatcacttgtcttatcaaaaaaaataatgagttatcatttatttttttgatttgttttacacttaaggtagtttgtgcttaacttaaaattttacattttgaataaatatttttaataaaatgagtgatcaaagtttttgaaaaaataaatgatatcatatatttatgaacggaggtagtagtatatatatagattgatagagaagagaagatatagataaataaatttataaatgaactcataagcttttattcctttcccgccatcgaaaaccggagcgcggcaccttcaaaacgggaaacgtttggttggtgggaagaactaactaggctggcaggtggggtcagaccaacatgagcgcacaccgggcccatgcccaaatcctggcccatctctattttctctcgatcccaccttcttttccctttctcggccaccacctctcgtctcttcttctgtctcctccgcctcccaaygcttcgttatataaaccctagactaaagcccccgagtccctccgcccccgctcgccacaaccactgcgcgtgatcccatttcgaaacaaaaaaggaggagcgcgctcgcactcaactccgcggagccccaatcccagcgtcgcctgcggtttag

SEQ ID NO: 10462 - DNA, 583 bp, Zea mays
ttcgaacctctgatcagtaggagggctcggagcccgagtgctctgaggcggctgttgaacccttccgaggggccagccttcgaacctctgatcagtaggagggctcggggcccgcttccttcgcggagaaggatccctttcagagtatcccctttctcggtccctgtagcaagagagagaaagaggaagaggaaaaggatacgaaatcgaacgacgtggcgcaccttttttgacgcggtcattatggcggaggtgaagcgtcgcctgcttcgcctgccaaaggtgccgcctgttctgccgcagagttaatgcaatgcgacgagtggttcgcggggcagccgttgtgcatgcgtgagccgttcgaggaacggacatttcacctttgagttttgaatctcgcggcgggttcgggcgaagtgttgaacgggtctcgcctaggcctttatatattcggaagagggaccggtcacggttctttactctgctgctcgcctcccacttaggtttccacaacctgagggaatagccagagaaagaaaaccgcgcaccttgtcagctccgccaccacctcttctggttggtg

SEQ ID NO: 10463 - DNA, 1500 bp, Zea mays
tatataagttattgagatattacctagtacttaaataacaattatgagtgttaaatataggtttaatacaattttattgtcttttagtctcgatttgttaaattagttttaattacaatatatttaactcttattattatcatttaaatatttgtaattattatttaaatattcgatataaaaacttcttggaatacatacagaagccgagccagagaaggaaacatgcaggaagtttcgtgcggcgagagtcaaagcctagagaagctactactctcctcccacaggccacacccacagcccacagggcacaggctcccggctctcccccgctcggccgcctcccgtcgcctctcctgcagtcggacagggtcacccacgtctctctctctcgtactcctctcacacactcttcacacggtttgccttgcccacgaaaagacaaccaacccggggccagggggcaagcggagagcagggaaggaagggagaggaaaaggaaaagcgggtcgcgagtgccccccaccccccgcttttgctccaatcggcgccgcctcgcgcgagatccgctccgcgtgccccgccgccgcgctgctgccgaggtgagctccgcccgcccccctcccccgctgatccgcgctggggctccgctcctgcacacgcccgatttgacactcggttgccggctcgggattcccccctgcctgctgttcgcgtctgcggtttgggtcggggccgtgctcggagctgcgggggtcgtgctgccgcggagggtctccgtggtgaattgcagctccgccctgcgtggctctggttctggtctcacttctcagggagtcgcctgagcgggttggttttcggtcagtcgatgggttttgctgctgcttttaggcagcattttttagggtgtcgcgccacgggccacggcaatgcgattcccggactgaacttcgcggctccgggcgtggaaatgaagttgttggactacttttttgtggggcgttcatgtttggagctgagatctttttcttctttcctcctggtttggaaccagtgcttttgctactccttttgatggataattcgaattcggggttcgtcggattctgaaaactggagtagctttacatgtgtgtcgaattattatagccagaactgttccgctgacattttcagttccatctagtcgtgccgtgcgtgtcacaacttggtctaacgactctgatcgcggattattttatttgtttcagatagagggtgtcgtccccggcatcgggttccacggagagttgttgatttgggtacctgatccaattgggggtggattgagtcgcttgaccttttcaacatctgtcccgttcctgctgctttggtcaccataagaggcttgcctggttccagagatgatgtcattgtgagtggagatggattctgcgagaagttgtttcagaaagttccagccgagggacaaatcgaagagtccagctgtgtctgccagcc

SEQ ID NO: 10464 - DNA, 1436 bp, Zea mays
cacatatgtgcatatataagttattgagatattacctagtacttaaataacaattatgagtgttaaatataggtttaatacaattttattgtcttttagtctcgatttgttaaattagttttaattacaatatatttaactcttattattatcatttaaatatttgtaattattatttaaatattcgatataaaaacttcttggaatacatacagaagccgagccagagaaggaaacatgcaggaagtttcgtgcggcgagagtcaaagcctagagaagctactactctcctcccacaggccacacccacagcccacagggcacaggctcccggctctcccccgctcggccgcctcccgtcgcctctcctgcagtcggacagggtcacccacgtctctctctctcgtactcctctcacacactcttcacacggtttgccttgcccacgaaaagacaaccaacccggggccagggggcaagcggagagcagggaaggaagggagaggaaaaggaaaagcgggtcgcgagtgccccccaccccccgcttttgctccaatcggcgccgcctcgcgcgagatccgctccgcgtgccccgccgccgcgctgctgccgaggtgagctccgcccgcccccctcccccgctgatccgcgctggggctccgctcctgcacacgcccgatttgacactcggttgccggctcgggattcccccctgcctgctgttcgcgtctgcggtttgggtcggggccgtgctcggagctgcgggggtcgtgctgccgcggagggtctccgtggtgaattgcagctccgccctgcgtggctctggttctggtctcacttctcagggagtcgcctgagcgggttggttttcggtcagtcgatgggttttgctgctgcttttaggcagcattttttagggtgtcgcgccacgggccacggcaatgcgattcccggactgaacttcgcggctccgggcgtggaaatgaagttgttggactacttttttgtggggcgttcatgtttggagctgagatctttttcttctttcctcctggtttggaaccagtgcttttgctactccttttgatggataattcgaattcggggttcgtcggattctgaaaactggagtagctttacatgtgtgtcgaattattatagccagaactgttccgctgacattttcagttccatctagtcgtgccgtgcgtgtcacaacttggtctaacgactctgatcgcggattattttatttgtttcagatagagggtgtcgtccccggcatcgggttccacggagagttgttgatttgggtacctgatccaattgggggtggattgagtcgcttgaccttttcaacatctgtcccgttcctgctgctttggtcaccataagaggcttgcctggttccagagatgatgtcattgtgagtggag

SEQ ID NO: 10465 - DNA, 1500 bp, Zea mays
atttaattcgaagcgaataacctcaatcaaactagtcgtctggtctcatgctaggtgcgagccattcgaaggtggtccatgctaggtgaaagctttggcttgtcttttcttcttgtttttttttcttgaagtactccgaaggaaacggtcccttttctttattttatttaaacaatgaatgcagcgaggcgaattattgataacaatgctgatgattaaccacggggcgcgcgcgtaggaagtcggcacgtcgcatcgcatcgcatccgaaggatggcggcaatgcccacgtattgtgtttttctctctctttctctctccttacgattatgccaattcgccgccggttaaatggacggtggtcgctgcccaccggcaccgggcacgggcaggcagccgcggcgacggttgaccgggcgactcgactagtaatctagtatccctcccgtacccagtagacccgccacttctcccgtcatatttttctttatttgatttgattttacccgggacgacgagatccgtggaacagcaagaagagacgagacgacgggtgcgtgacgtgaggcagtgacggtaaacagtcggacactgactgttttttttttcttcttcttctttattgggcttaaacaactacttaaacgagctaaacgggtaacgtttagtaaacgctaagtaaacatgctagatgatcgttcttaatataggatctgtcgataagtttttacatgattgactggaaaaaatataaaagacagaatttttatgaagaatccgtctatatatatgtcgtctcttattatagacttataattattttattatgcggtttcccatgtacgtgctcgattcttcagcgcacacaccacagtcacaccgccttggggcaccggaagcgcaagcagacaaatgccccacccgacccgggtcccattccatacccgactccgatcttccaccccgctgccgcctgccggcgtgcgtgacccgggtcccattccatatccggtgccattttttaatactactagtctcgttcgatcggaatcggcttcccgtcttggctgcatttttctatccccgcgtggccgcgtgtagtcctagtctctcgccagcaccatcatcatcaatcacggcggcgaccccgccccgcctcgatcgcccacgctgcccgactggaaccggtaatccacttcgctgtgccgcctcgctcagatcccacgttggctgttgttgttgctctgctctcctcggccgggaaaggtggggcgcaggggcacccgttgctccgttggctggcgccgctgccgtctttctgttcgtttcgccgttgcgcggggctcgatctgcgtgcgcgcggcctatttgcttgctgtccggctgtccctagtgtgtgtcctgtcctgtcgctcacgctcttccgcgggcgtgcgttgttccgcttccgcaggacgctgctgctgctgctgctaggctgacagcgacgacgagggggcc

SEQ ID NO: 10466 - DNA, 1500 bp, Zea mays
cgctggtcgaaccgtctttaccgccaacgcagcggcggcaagcggaggtccacagggccgacggatgcccgcggttatatcgtctgtgaaatcaacatctaccaatcataagcgtggcggcttcgagatcgactgggaccattgaatgattgaatttttaagcgtcactccatcgtcctcatccacatcacccacgacattgatgccaacgttagatcaactccaaaagaatgctaaaaagtttcttttaaaaatgattattgaaggcattctaattttttttagaagtgagttatagcgtgtactccaacagttccctaaagtatataaaaaacctgaaatctgtctatctgtgatttcaggctgatttctgtacaacagaaacaaacagatgaaccaacagtattattggccagacacaaggaaaatcaaaacaaaaaaagcattttatccttcgttgtagcctgtaggcgttctgctccaatttcccgtacgtggaacaaacaaatcaaagaatttcattctctctcctacttccaggcgttctgctcttgctactcgtggctggcagcctggcgccgtgtgcgcgcggcgaaatacgcgggagcctgtgcgtgcggagggcggacagattggggactggggagggatacatgacgcgaaaatatacgggagaagatgatgggacgagggacgccaaatttttagtgaaaggacgagggagctgaacaagaaagaccagttttccttcctaataaggccttgttcgtttctgttggattggtgggtcggaataattcctaaccggattgtttttctaatttatataaactttgattgagtggaacgaatccgggtgcaatccgacacaaacgaacaaggcctaatggttttgggttgatttacatcttttaaagtttctcttagtctccgtcatttcagcttggatctgaggttctctctaaccattgtccccatacattcgtttatctatactttctaatatatttcactctttctctaaaagatttttctcttttacttagtttatttttaacatttttctctatacaacttcccctatattaattaacatacatatttaccatttttgacttttttaaaaaatcataatattgccatagtgcacattattattatatcatagggcataattaaaattaaaaacgatataattaacctgtaaaagagacaaatacatttttagttatctactggaaattgtagccctattggtggggaaattgtagccccatacctagaggtggcaataaactcaatatcttagactacaaataatcaaattggattctatttctatttatttatgaactaaaagtaattaaaaactcaaacaaattataaaacgacatttggatcgtgatctaccacgcctacccgtacgtgcggtcagagagctatctggggtggcattggagttggagccggcctgacagcaccagagagagggttgccgac

SEQ ID NO: 10467 - DNA, 124 bp, Zea mays
ggcctccctgcctgttgtcctttcttcttgtcctttcttcagcactgcaaagatcacatacctggtctgttgtcctttcttcttgtcccctgtcctgtggttccacagagagtagcacaatgca

SEQ ID NO: 10468 - DNA, 1500 bp, Zea mays
ttaaaaatacacaaggagaaaatagagagacaaaagcaagcagctaaggatttgatcactctcaatgttgaaaacttcacgagcaacccagtcgatctgaacactcggaaagcttttggtcttgttgcatgaacagaacagtcagtatttcacttgagatttgagattgtatcctgcgcttgacacttgagagtattttgtttgccccaagaacaacaccttgcgttgcattgttgccctgccttcttaggagagtcacgggcatcggtgcagcagcttgtccttgcattctcgcgggtgtctccttcgccaatgccgccacagcaacctcgtggcgcagagttcacagtagtcacggtggttggagtagcacaagcttcgcgggcggagctgctgcaacatccggtggcggcggtcggcgccacaacaccaggacgctcagcggatggtgccggtatgtcgaccaccaccgccgtgtggtcctgctcagacggctcgcttgtctcccgacagcaatggcagcctgctttggtcccaccgcctggtcgtcgtccctgagcggttccggccgcgccgttggacgcttcggcgagctgagacctcatggccagcgaccgcgccgtcgcgcggcacgcctcggggtccccacccccacccctcctccgccagcccgcgccagctgggtcccagagcagcagcatgctgtgcagcacgacgagcaggcacgtgccgacgtcggcgagcacggccacccacagcgcggggcgccacgcggcggccagagcgaggacggcggccttggcgcccacggaggcgatcacgttggcggcgacggttgcgcgggcgcgccgcccgagccggacggccgcgggcacccggaggaggtcgctggacatgagcgtggcgtggctcgtctccatggcggccgccgagcccgacaggcccatggcgacgcccacgtccgccgtggccagcgccggcgcgtcgttcatgccgtccccgaccatcagcgtcggcccggccctcgccttgaggtccccgaccagcgcgaccttgtccgccgggaggagctcygagtggacctcctccagggcgccgccgagctgccgctgcgcccgcgacgccgccgctttgctgtcccctgtcagcatgaccgacctgatgcccatcgatctcagctcacggatcgcctctgccgcgccggtcctacagtcgtccgagagcgaaaacgccgccacgtggtcgccgtcgacgatcacatgcccgatcgacgcaccttgctggccttccatctccggacctgctcctgctgcgtagcaggaggaccttgccatgatccttgtgttcccaatgaagatttgccttccgtttatcgctccggatatgccctctccagggtagatacggaagtcagtgacgcttgtcggctcgggttggatggatttggactgagcgtactcgacgagtgcggttgccattgggtggcttgacttgctctca

SEQ ID NO: 10469 - DNA, 317 bp, Zea mays
aaatactgactgttctgttcatgcaacaagaccaaaagctttccgagtgttcagatcgactgggttgctcgtgaagttttcaacattgagagtgatcaaatccttagctgcttgcttttgtctctctattttctccttgtgtatttttaagcgtttatccatgaacaaagtatcggtactagggtactactaaaccaaggtatttaggctgtttggctcaggtttaaaaatgcttccactgtcaaaaggtagaacgtcaattaattgcgtgtttggtagaaataagctagtccatcatatttctactcctcactttc

SEQ ID NO: 10470 - DNA, 614 bp, Zea mays
acactagattaagatctttgttggatgtactcttagaggcaacctaatccgtccttcgagagataaagctgctagtttgcaacacttggagaggttggcgttgccagttgccaccatggaaaacacacgaggaaacttctgccactttcgctttcaggtagtctgacataaaattctcccagtttcttgctcgaacaaaagagctcacgagtcacgacaccaatatttcccaaccacacgagtagtagcatttccttgtggattcacgtgtcaggcagcgagtcaacttgtggagcttgagaagaaagaaaaccacagtccaacgctttggtcacccaacctcacccactcgaatgctcgaagcacgcacgaacatgggcttggtcatccaacatcacccacccgactacccgattcctcacgccccatgtcagatgggcccgcgtccgccgtcctctgtttcttccgcgtacccccagcgggtttccctttttagagtacacccgtgacccgcccttgctagcgtccagcaatcggagtcccccactcgctcgtgctcgtgagcgaacggagtccaaggcagacgctgcgattcacaagcgccgaggagcgag

SEQ ID NO: 10471 - DNA, 505 bp, Zea mays
cacataaattcattacttagtaaattaaatatattaaacaaagcgagtatcatttgatcatataaaatcaaaatattacaaccacacaaaatctatatattactaaattaaagaaattaaaaaataaaatctatatgttactaaattaaagaaattaaaaaataagtttcattgtgccgtaatccatacatgtggtttgtgttggggtccccaacgggccaaaatttgagacccacccatgctcgcattcaaatcatgcaagactgatctatattatttcgtatcagtccatgtgctgtttttagatcgtgtttatgctggtctaaaaaaacccgatccatattcatagcactaagccggtcctagcgacgaaccgtttcgctttcatgcacagaagggatcaggccggctcaagatatttcttttgacacaagaacatggcaggagctctgcgtttgtgaagatattcttattccatcctgctcatgacacccccccacaccca

SEQ ID NO: 10472 - DNA, 312 bp, Zea mays
acggcgtcgagtcgttcccgagtgggcgtacactgtcactaggtcgaggcgtagagctagcgtagccgcggattaataatggtgacatgatatggaaagattgaggaagaggatgctgattctggagccaaagtttggaccttttactgccaatatgtgaattgtagacgcgcggttcttggagcttgaattcctggtttgtctgtgcaaaacctgtttggttttgtacaggcaagcaattcatttcggtatggtctggttttgagaagaagctgagatcaagaagacatccattctgctatcgttcttcta

SEQ ID NO: 10473 - DNA, 1217 bp, Zea mays
aagggctgagaaagatatgagttaaaaagaagtacgcctytttttttatagctagattggtcgctcgtcctctcagctagcaagttggtagctatctgtgagcgctgcgctgcgtgcaaccatgtgtcgtgttagggttgagtgttttctcatgacatgtctaagagtatctcaaagaggtgctttaaatatgactttattttaaatataaggctcagaatcatcaaacactcttccaacaacgaccctattttataaaaaaaatcatcaaatgaatatacggctcattctatcggttcctaaatatacctcatatactaaagctctatcctcgtttactcataatctccaaccatttatttactaataatatgatttatttcctaaataacattatttaagacctagctgttagagtaaaaatttattttgaaaccctaaacaccccatatatggttctatttcaaattttaagactctattttagatatattgttagagatgctcgtgacgaatcctcctcagaacccttcagaaccgtggattaggttagaaataaatataagatttttttaaaagagtgacggtgaaaatagaaaaactaatgctttataggacaatattacagcaaaaattactaataattataaaataaattttgaatgagacgacccggttaaacatgaagtgaaaaagctaaactaattataagttgaaacttatggtgtgtttggtttgtgaagtcactctatgcttcatgaggtgatgcatcataagttcattctatcaatttttggtagaatcaacccacttcacatgtatatactaattattagcttatgaggaatagggtggtgatgaatcaacccattctattccacaaagcaaataaaaaagtgaggagtgagaagaagatgaatcatttcattcctcaaaccaaacacactattaggatacgtagttttgaaacacaaaagcacgattgcactaagatattttattgccattaaaatcaccgtctatgctctgattgctctccaatctattggcgggctggcggctcctgtctgtggtcgcagactcgcagagtcgcagactcgcagtagccagtagatgccggagccgtcgcagccactcaaaccccatcaataaaacggcgccaactcaacagacttccagctagcagtgaccacggcgaccatcgccggctcgccgcc

SEQ ID NO: 10474 - DNA, 289 bp, Zea mays
ttggagagctggagctgctgcggtgcagaaggttgccgcgctgactcagagcaagatggcagccagtgaggcagtgacgtgtttttctatcgacagtaatacgttatgtttgggctcacatgtgcagtgagtgacgttatgacatccagtccactacggcactacccgccggcacagagggcctcgcacagtcgcactctttattatagccacggccggccggtggacgacagcaccacaccacctccaactacccgagaccatcgacgagcatcttcctgcatctgca

SEQ ID NO: 10475 - DNA, 371 bp, Zea mays
cgtcggactgaaagagcgctcccccccacccccaccgccgcggtagggggaggggcgcggaggagcatgcgcgcaggctgtcaccgcggccagagaaagagaaggaggacctgcgccgcgcgcaccgcgacgagccgctctccgctggcacccacgccaaaaggcgaagattctcggccgagcccccgtcccttccaccatcccccgctgtaggtagccgccacccagatctgctcccctccgcacccgcccgccgctctccccttagattcgcaccacccgccgccatgcgtttgccgccgccgccgctgtgactgggctctcctcctttgtgaggcaggaataaaaggcggttcttgcgggcggttgcc

SEQ ID NO: 10476 - DNA, 565 bp, Zea mays
ggtattgcagcagcagcatctctgcgcgcgcgcgcatggagatcggcggatggctgccttgcccgtgactcggcacgcttgcgtgcgcctgatggagccaagcgcgcgagcacatgcacgtcgtcacgggtcgtgctatccggcccggcccagccatatataaggccggccgtcgccgtcgccgtcgtccgactctgatccgccgacgtgaccacgaccacacaacacaagcttgctataggtgctcgcgatcatatcgaagatcgtgtctgtccgtacgtgctcgagaattggaacgatccgggtggccgggaggaggaaggygagcaacgcggcggcgctggtagcggtgctgatygtggccgtggcggcggccgcggccggcgccatcaagctctgcggcgtggacgagtccgcagtggacgcgtgcacgccctactgcaaggcgggcagcacgcaggcggcgccgggccagctgtgctgcgccaaggtcaagtccgcccgctggagctgcctctgcgaytaycggagcgctctctccagcgacatcgacgccgcgcgcgtc

SEQ ID NO: 10477 - DNA, 106 bp, Zea mays
gccagagccacaccaccgtgtttcttgtttacgtgtcttgttgctgctttatcagtgctacattcttgtgcagtcgtgctcgttgggctatccgccagcagcatgc

SEQ ID NO: 10478 - DNA, 1500 bp, Zea mays
aacatgtgtgtttgacttagagatagagatttgagtttgatttgcaaaaacaaaccaagtggtggcaaaggatgatccatatatgccaaaattgaataaaactcgaatttattttatttgaagtgattttgcacttgttctagttgctttatgttgtgttggcataaatcaccaaaaagggggagattgaaagggaaatgtgcccttgggccatttctaagtattttggtgattgagtgcaaacacaagtgcttaaatgtgaatctatgcccatggatgaacaaagtgcaaatcatgagtaaaggtatgtttctaagccttagtacattgggttttgtgtactaatatacttgtctaagtgttagaaacagagagaagaagaaaaggagaatgttggctgtgtacagccaacaggctgtttcggtctggggcaccggactgtccggtggtgcaccggacagtgtccggtgcgccaggctgcctcggcgcgaactggccgctctcgggaattcgccgacggcgtacggctaaaattcaccggactgtccggtgtgcaccggactgtccggtgagccaacggtcggccgggccaacggtcggccgcggaatccgcgcgcgacacgtggccgagccaacggtcggaaagggggcaccggactggtcggtgtgcaccggacatgtccggtgcgccaacggctcccagatctgcaacgtcgactgcgctgtttaaggaaggaaatcgggcaccggacagtgtccggtgtgcaccggactgtcccggtgcgcccggacgacagaaggcaaggatggccttccagatttgttctcaacggctcctagctgccttggggctataaaagggacccctaggcgcatggaggagtacaccaagcattcctacaacattcctaagcaccaagacatcgatctcgcgcattcgtttcattgtgatagcatatagagctcttgtggagttgtgaactctttgagttgtgttgcgagctcttgttgctacttgtgtgcgtgttgttgctctgatcttttgaagtcttgtgtgcgttgctcattcccccccttgctctgtgtttctttgtgaacttcaattgtaagggcgagaggctccaagttgtggagattcctcgcaaacgggattgagaaaaagcaagcaaaacaccgtggtattcaagtgggtctttggaccgcttgagaggggttgattgcaaccctcgtccgttgggacgccacaacgtggagtaggcaagcgttggtcttggctgaaccacgggataatccactgtgtcatctctgtgattgatatcttgtggtattgtgttgttgagactcctttatagccacttggcaattattgtgctaacacttaacaagtttttgtggctataagtttaagttttacaggatcacctattcaccccccctctaggtgctctcaattggtatcggagccgttctcttcaagaaagggactaaccgcccgaagaa

SEQ ID NO: 10479 - DNA, 101 bp, Zea mays
ggtaactagttcatgccaaccagaataattcagaacactagagttctaacttctaatccatgtgaagcttgtctgatgatctgacctaacaccttttttgc

SEQ ID NO: 10480 - DNA, 1191 bp, Zea mays
tttaataaagcacaaaatatatgttttctattgattaggtgaatatagtgccaacaacaaggtttagaacactcaattatacataatttcaccttatttttttacataaactctcctattatagcagtatagaagagattataaaattgcgggttgattataaagaaatgtaggatttttttaaaaaatattgacacgggacgaccgttgaaactgatgatttaatatagtaaataaaagatatacacggtgctaatttaaaattataccatgaatttctaagcatgagaaaaatacattacccaaacacgattttcacgatggtaatttcatccagccctacagccaaaagaaggacaatgaccaccatttctccatttagccaatgggcatgctgcatgcagggaaaaaacttcagaaacgtgacctttaaatccaaggtggaccccaccagctaccgcgcgatcttttatgagctgtctggttgcttttgcttgcaacattttagacctcgccggcggtatataacattattagcatttttatgtggttggttacatgtacactatcattgacctgggaaaacagatgcaagcgaggctctctagcctggtgtgccataggcccatagaaagcgggtgactttaaactcgttcttttattatatatcttttagttaagatatttaattatcaaactgattttgcttttatgtttttaacatggtaggaacaaaacttgatcacacttgttatataaatttaaatattaattttatttatatcacttttatatactcataaatgcagccaaacataaattatatctgatttgtagaagctccaacaagtcaataacccaccaaagaaaggctcttgctgtcagtattgcacatgctggacctgcctaaaaggagcctgcctcctcaaatatacaagccacggtggccaggctccgagaaaaggaaatcaaacagcccctataaaaaaaagcctggctccctcccagctctcctctgccttatgctccccagtccccacctaacccaaaccgaaccggcccttcgcacttccgcagaacgagcactcgtggaccaaatatttggcacaagttagctttgcctgtttcttgcgtgtagatccctcaaggtttctccgccgcgcgcccgtgcccttcgccggagcttgccat

SEQ ID NO: 10481 - DNA, 993 bp, Zea mays
tgatacctcgaaggaataaaaaacaactggccaatattttgtctttacaccaaggtctataaggtcatttaatgaaagtagtaaatataattgaaaacatattggataaggaacgaaagataagtctagtattaaatgagaaaacaaaatttctttggtcaatgatagaagaaggtcatctttttgtagtctcaaaggatttttcaaataagtagggatataggataggaaaacacaaactataaattggtgtgactaccatttccataagcataaccttcacacttggcaacttattagccacttttggaatgaaaagaaaaactcaagcttagtaatttcctcaaatataaagggtgatccgaaatgtatgcatggaaactaattagcatgtcagagaggcattaatgacttgattcaactacaaaaatgaaaaaatattcttgatgtgaacccttaatatcttgttgcaaaataaaacattactttatctataacaataataaatcatttttcagcaacttaagcatgctaatctagagaacaaaatttcaaatgagattattgtgaagatagtttttagctaaacttagacaacataacggtaactacacctctaccacacaatttttgtttccttgcatgcataaaaacaccaccacacaaaactacttaccttctaattaaactttccatataatgggtgtacctacttctctttgaccattcctaaatataacttgcatgtgtacacattttttatgccttgctgttctcacttccattggagagcaaatggataacgatgatatcaagtatgatgaggtcaatttgttttgtttattcttgtaacttatatttggatttatgttgatagtttttatacttttcaagccaatatgaagggacatacattaaactcatacaatattttctctcactattatccttcggacttttgtgttttaggaatatgtattgaatgcacgagga

SEQ ID NO: 10482 - DNA, 801 bp, Zea mays
cgttctagattttggatcactatgtttatagagatcaatattttcatctcattgaccaagaattttatctaggataccaacaaaactcataccaacaaaccctgttcactaaccccttgtagcttcagttaagaaatgttatggtctccttttcgaatatttctcacagctagttgatactgaaacaagtagccaagtacaaaggggaattgatgttattcatatatgtagcctaccaatcttttacatctctaccacaatcactcatgatctgaataatttgggggtggcaaaatgacttttaattccttttaggtgatgccactaacctgaactttattgtgatagatgactaaggcggtccggaagatactttatgcagctgatgcaaaggattcaccgctacctgaggcgaatgatataatcacaaagtcaccaagcttgttctcaaatgaaaccgagtgagatgtgcggctacatgagctaattttggtgcttattttccatcattgatcgtcttagttttgagtctgtaaatgcgtaaaataacatttgacacaagtctttttgctgtcaaaaacagttttcctgtaagaacttgagtggggttaattagttattacgcattcatgcttgatgtgactgtccctgtatggttcctctggagaatatagggtctgttcacttgactaatctgtaccggcgtctactacttttacagtgtttttgtctcaatggattgcagttgcaacagtctaaatagtcggctttaatccgcagcgaacaggtaacgtggccttc

SEQ ID NO: 10483 - DNA, 721 bp, Zea mays
cacgtggtcggcgtgtagaggacacgccgagtgattggaggtcggcgtcggcattttagaggcaacgccgagcgattgaacacatggtcggcgttttagaggcaacgccgagtgatggaaggtcggtcgtcggcattttagaagtaatgccgagcgattgaacacgtggtcggcgtgttagaggacacgccgagtgattgggggtcggcgtcggcattttagaggcaacgccgagcgattgaacacgtggtcggcgttttagaggcaacgccgagtgatggaaggtcggcgtcggcattttagaagtaatgccgagcgattgaacacgctgtcggcgtgttagaggacacgccgagtgattggaggtcggcgtcggcattttagaggcaacgccgagcgattgaacacgtggtcggcatgttagaggacacgccgagtgatagccagcttcacgagttactttgaggataataaccgagtgatgaagtggcacgtcggctttcttggaaataactgtcggatatccacgtggcatgctgggatttcggaaataaccgccgggtgatgactgggcactttttgaaagggtatctggctcaagaatatcccttaagagtcgcgcttttagccgcctttgctttccgtgccctagttcttgcatttccgcatctgaatcttctccgccactcgcctcctactctgtttgccagcgagaagcaag

SEQ ID NO: 10484 - DNA, 1500 bp, Zea mays
aattttcctcaaatacacaggagagctatgtatctttgtattatagagaaaaaagcccgtaaacaataccaactcatgccaggacacgattacccgaaaaacaatattactgaccaaacagcaaggaaaaactcaactgaaagcttctaccctatatacaatgttacacatgatctcaaaacctcagaattcgggaagtgaagaataaaaaacatgcactgccattaattttctttatagtgctgtaccatttgttagtagtgtttaattaagaaaaaggaaatcagttgagcagtaagatggtactcaaacatttgtaggcgactgatttgargctttattcttgtacttttctctttaatgtgtgttcaagtagtatcactgatattttgacagtttttccttgaattttagtatcatcaaatatgtcctgacttaatgtgcctttatgtcaatacaatctttgttgattctttcatggtgatgtatmagcgggaggctatcttgggagcaattattgagaaatgcaagacttcggaagacatatgtatctttatatgcatccctcttaaaatctgacatgagtcgactggttgttgatgaccatgaggagattaagaggctggaccgtgaacttgatatggaggttattctacagtggaggtgatgtgcttctgttttttgtcctcagtaaatctccatggggattagcctgcaaatattaagtcaaaaggctcgtagcagcgtcccatgatgatccgtactagatattcttaaaacttaaaaagaatttgatgtagagtttggggaggttgccaacgttttgccttcacaagttcgtacagggtgactctaggtccacaaaagaagttcaacttattgcactttcccccccacttgctcagcttctgttttcccatgaaagacagtgaatgtgcgctagtgaaattggttcagcctttgaaattactataacttctctgcacccctcccccaccttcagccattaacatttactctgcacatcgatattggcycagcctttgacatccctgtcactgctctgcacccctcctttctttcctgacaaacaacagtgcatacttatttcttgtaaactgcatgttcaccatgtatccagtgagtctacactcttgtcccttctcacgtctacactcttctcctctcacaactatttccactttatgaaatcttattttgcatgcagctgttaaagaagatatctaattcttgaataggtcatccttggtttttttccttgaatatgcaggagatctgcatatcattgcattatctttgcttttgagcttttatttttggagttcaacatgtatatcagtattaacattgtatagttaatcccttgatcagtgcatgtttttgatccttcacttcccaaatgcacattgaacaaactgttatgtgtctcatcttcatcggtgattcatgtcagaataagtggcaaatggacaaacatcc

SEQ ID NO: 10485 - DNA, 220 bp, Zea mays
cctgttatcaccaaattgaacccatgtgtgcttgacagcaatccctgctctatcatctgacgacatagctcatatgccttatctgtcatcccctctgcatcacaaccttttatcagaaccgcatatgtcacattggttgctgtcacaccatccctgacagcctcgttaaataaatccaacgctttcccaacttcaccgagcaagcaatacccatgcatca

SEQ ID NO: 10486 - DNA, 206 bp, Zea mays
agtcttggagacttggtccctttactctaggagtaagtggtctgcaacttgggccatacatgaggagacaatgggatcctggtattacaaatgggcaattggtgatgagctgcgaggagctagctttgcagatcgcagtgttgcttggggacaagcaacatttcgtcggggcgataatgtaacacccgacactggctcaccacgtg

SEQ ID NO: 10487 - DNA, 1081 bp, Zea mays
aagagcagtgcatgcccagtggcagctattgtttgtgtactgtccgtgtatggtcggttttgatgtttgtgtgattcgatatggtgatttgtgcctcgccgtcgatgcacaattgtcaggtttgaatcgaccaaaattaggtaggtgtgtgttgccatttgcctgctttggcacatttcgagtttatgtatggaactatgtatagagtatgcattgcaatttgcagcaaacctgaaaagcagctaagaaggccctttcctccttgtttatgcaatgcatctgttcctgttgccttggacccttgatgagtccgggactggtactccgcgtgagctcgccgccgcgatacgaacgcctgctcttgccgatctgtgctcgtatggggcgcacacgtgcagaaccagacgacgtttggtgctgtgggaactgggaaggagctgtgtggcgtgaccggcccaacgggccgagctgtgttgatggcgtcgcgagcagttgctgccttgcccaccgatgtcattgatgagccgatcacgcgaggcggcgagggtttgccggccggccgtgtcattgttatccaccacgggcggaatgccgttgtgcgaacttgaaaaaaaccgcagcgcaagaaagcaacagaaagagcaggcgcagggcaattgggtaacttcgctgtaaagtgaaaacagacgccacgccgtggaagaatcatcggggtgctccggtgctgcctgccggcgcgtgctccgcagttcagcattggagactgcgaaaggcatagcaactttcagttcattttagaggaagaacgcctctgtagctctcgtatttaaattggatcggacgcacttcatggcgtggcgaaattcgcaatattcattcatcatcagtaaccaaaatttcgactttttttttaaacaagatacactataaccgagagcgtctgaagaatgggaacaaactagcaactgaagcgtactaacaaaaagcgcccgattcgcctcgcaaaatcgccgccgccatcacctacctactcacagaagttccgccttcctttcctccggcgcgcgccgcgcctgtcgcc

SEQ ID NO: 10488 - DNA, 290 bp, Zea mays
tttgcatgcctgcagattcagtttgttgccagttatgtaggtataatctgcaattttcggttctgagaataaaaaacccaccaagcaaaaattacacctgaaatatcagagaagtggctaaaataaggaccaaacatgtaaagtgttttcagttaatcgagttacatattgcaatttgcacctctcagtctcatgtgacagctccttcatgtggtaccactgttgtattgtttagtctggtgacagtgcgttaattctgcttaaacagactaggtagcgtgcctcgtttc

SEQ ID NO: 10489 - DNA, 62 bp, Zea mays
agtgagcgagtggtttgggctgtttggctgcggatgctttaggggcttgattgggctggaat

SEQ ID NO: 10490 - DNA, 1500 bp, Zea mays
cacaaccatttgtgtgcaacaaagaataaatattataaatattctgaatatagaaatcgtagtaacatatgggcaactgactaataaaaattatggtatattatctatttgctccatacaaataaagacagaattcttaacttgtcattttttgttaaagtagatttaatatgttaaatatataaatatatatcataatcagtctaataatatctatttatattgtgtgttgaaatatttattaaacttgagatacttgtaagggcctgtttgggaggggtttgggagggcttcacttcatgaatttactacttgtagcttttaaaaaaatgaaactagagggtagtttcaagatttttttgcagcttctcaaatggtgcattaaaaacattgttttcatacatcctcatgaagctacacaaaattacccaccaccccattggttacacgatctacttatccatgtctctctccccaactcatcatagtccactaatcatcaagggtaatctagaaagctcacacaaatcaactgtattacagaagctggagtccatgtgcaagctaaacactactcaaacccaccttaacaatttgttgaagttgttttatgttgaaactgaaaaatcgaagttgatgaaattctttaagtaaagctctcttaaacaagcccttagtcagttgctatgcccatagtatatcatactagccaattgcacgtggtttgttacagttgttatatatcatataaataggtattgagatatttatttaaatataattattgtttatttctaaacactaagttacgtgtggtctagtggttagcccaaatttctagagcagggggtgtgagttcgagtgctcgttctgcactattttttgtggttagtaaccgagagagcgctatgtgggcgctgggcgtggggcccacaaggcaatagctaagagagcgttgtgtgagcgctgggcatgggacacacaacgccgagacggggcagaatcatggtgggacagcacgtcgtcgagacggggcgcgtggagcgagagaatcaatcggggcggacccagattgtggtaacaccagatatatatacccatattaggctgttaatataatagagtagtatagattatgtgttgtcaatcaagttgcattgttagcgaggaacaatgcaaaactcacaaaccgacagatcggcaagcatattacagcagtatacgtcgcatttacatgcacatgatttttttttgtttcggaaaagggtttttaattcgccaccgacagtgccaactgccccttcctagcagagcaaggaaggggaaaccggggaaggccaggctccatggagcacggatcgggtcaggtcaactaccccatcctaatcttcaaaactcccctgcccaggaaggcccgaaggcaccatcgccgtccccgtccatgcgccgctgaccgcgcgcgccatcaaagccaattacccagccatctagctatcagcc

SEQ ID NO: 10491 - DNA, 1500 bp, Zea mays
gctcccccgccaaaatctccggctcccgcagcgagatcgcacggccgacaacgtacgcgtccccgccccgccagcccgtgcgggtgcgcgtgggcgtggcacgggtggccggcgagccctgactgccggcaagcgtgtcgagccaggcgatgtcgcgccccgggctggggcagcagcgccctcggctcccgggctaatgcggatttgggcggcggtttggcagcgtcggcgtgccagccagttcgtcgtgcgcggctaccaccacccatcagcaccttccacagccacgtacccaacgtttatgtcgtgtctacactcttggtcttggcgctgcgtagtagatcagcatcagcttggggtgggggtgagtgacttcttttccgtcgaaaattccctctccactcgtcgtacctggaacgtagtactagtgtatctttgggttaataattcgaggcaaaatcaccatgcttatcacaagaacatcgtgtcaatttacatatatatttgagtccagtactccagtgtatctaccagtaccagtatatacgcacccttcttctacagactacactcaaaatgcacgctagtattattccactgtactaccatcaggaatgttctccttgagaaccataacaggtgaaccactgtttattcctaatcactgtgaatgggctccttcgtggtaccttccggggtgagatcagagaggggcacaaaccatgcatgctaatatcctaacgagttcgaattattggattcgtaataatctataaggccttgccaatcgagaatacgtccaaaggaatctatggagaaccaaacaaacacgtatccagtcatgcagagcactaaaaataatcgaccatgcagggcccagggaatacggtgcacggtgcaggacacctttgtcctgcggcgcgaacgttatatgctccatcgataataatgctagaactactacacggatatcgatcgttacacgaaattcgtgtgggaagtaggattattaggctgtctttagcagctcttttatcctattttttattttttattttactatgtacaagactgtgggtaccttggcaaccattgctctttagttcttgccgaatcatttagactttattcgtttatttctacgccacatgaattcaatagaattgaaaaaaacatatattaacttgctatgaatttaaacctacaaattccctccaatccacatgaatttgagtggacccttaccattatccaatccccaagccagcgagatagctatgactttaaaagatgccagcacggcacaatcacaacccccctcccccagggtccactcccacttggcgcgctatatataccatgcgagcagctggcctccggcactcccacccatcaggactcatccccaccagttgcaatcaatcagctagcgcctagcaggagcagcaaaccaatcaagaagcccccacgtccaccaccgacgacgaagacgacagcgtc

SEQ ID NO: 10492 - DNA, 86 bp, Zea mays
tgggtatggcatgagtaggctagacgatgaatactatgaggctgaagggcagaatactggtggatctggctcagttcaagtgaacg

SEQ ID NO: 10493 - DNA, 215 bp, Zea mays
tgcagcgcggacacgcccggcacggcaagccagccactcttctcgcgtgaagctgccaggacgagagagagagaggaggaggattagcttagccattcttgcggctgggcaaggaaactgctgaagccactagccggctgcctgctctacttcctccgaaccgaacgaggtgcatcgtgaggaagcagcagcagggggggcagtggccgggcggg

SEQ ID NO: 10494 - DNA, 739 bp, Zea mays
gtttttttgcatattatgactatcttatgtctttcaaacttatgaatgactttttaggatatattgtattgaggttccttttatagtaccaaaactgtcttacatactaagttttcctttatgtggctcttgcaatctgtttgctatcgagtttctcctaactcctgggattttctgatggtacaggttgattactgaaatattttctttaatattctactccataccttccaaattataaattgttttagtttgttttagatacacagatcttgctatgcacctagatatatataatatatttacaattttgaatggaggtagtaaaacattgaatatttcctcatttcctaaacaagaccggagagctgtcatatgttagaagtaaaagctatgtcttatccacgtgtgcacaattgaaatggtatgctttacgtagttggtttacatgaaaaaattgtattaatgacaaggctagatttgtgatcaagttatatttcctttttaatgtcattgtttattgtaatccacatcatatttcgtattttacctttaacatctcccttgagttacagatgatgcaatatgtaaagataggcttcagcgtatgagacagcgtagagattagaatttctacatgtgtaaacttggcaaggactttgtaattgatgcagcttttacagaacatgcttctcgctttttttgaccacggttgtcaacctaactgtcggctggagaa

SEQ ID NO: 10495 - DNA, 858 bp, Zea mays
actccccgtgcgattaccccaacattatacacactgtgatcgaaatccttatcgatatatccaagcggctcaaagtgtcagcaacccctacgcgcaagaacgtttgaggtgccttcgtaggtaaccaacacaaaataccccatcaggcccctaaacaccatggtaagactgccttctccttaccaaacagagctacctcaccatcaaatgaagctatagttgatccaaattcatgatagacatcgcataggagtgtgtgtgctctgctcattttatcgcgcacttcagcctcaccctctatcgacttcgtcttcagttcgtctagttcagaagatagcctaaccaacacctcatgagcagcataaacatctgctcgtctatccaacgtagttgccttcgtcttgtcaacttcaccctcaagttgcaccacctttttagcgagtttacgactcttggctttagccttacatttctctcattcccacttagggcttgttcggttctaccccaatcaatatggattgagggggattgagggggtttcaatccctaataagtcaaaatccctctcaatctatatcaatcccctacaatccatatggattgaaaataaccgaacaagcccttaggggattctaaaatttaagtttatagtattattaatacggtaaaaacattctatccacactatgctgatgtagcatagtggagggctagctttcccctcctcccctggcctaatataaatacaaggtccatccttattagtcccttctctttctcatcagtccgctgttgtccgatccctcgtcagtcaccaaacaacagtgagtgccccaatactgcgcgagcctctta

SEQ ID NO: 10496 - DNA, 1061 bp, Zea mays
gtcagttgacttcggtgttcccgtccgtgaaaactgcaaggtggctgcaaactcatagtcaccatgatactcagttgtcaagaagataaactctctactgaggcagtagtttttttagtttttgagaagttgaacagctgaaactcttgtacatacatatggaataagatgtcaaacttttatcatactgtggtttccttccaaggactaagctgtatcctattaaaatagcagtaaattagttcttccatcgtgtgccttgatgttaggaggctcgattcatgtggagaaactgttttgattctgtacaagtgtggctttagtttcttagccatatactgtaaaacatctgaatagcaagtcattttgtagtttgtcatatagtgaggctacctctagtttttgtaccctttgggtattttgctgctatggttttgctcggcagcagaatctagttagacaagtattaccaattccagtgggattatttctgttacataaccaaaaaaatattctttcatactaataaagacattaaagtaaaaaaagtacttttgaaaaggttccacgacaacaatggaacattggcaatatttattgtccagtttactcactccaatcatgatgtattagtacatcaatgtctaagtagtttaacatgttataaagctgttttgttcgctgaatatattactataaagattaatggccaaatatgtgttttgaaagctctcattgctataatttgtattttatgacagggacttatagctccttgctgtaatgcttgtcctagtgctctgatttgttacaacgccaataaaagaaactattatctgcttggcttttaatgtttgatatcgtttgttttcactgaggagtttgtaacattcttgtcttgttggcgtgcaggtacactttcttctttggagcagaacatggtaacactttccattaacatggatccagaaggttaaacttttactcactgggttgctgctccaatttcttttggttccacatcagtgcaacacgagtgtatccctcaagccattcttgga

SEQ ID NO: 10497 - DNA, 1500 bp, Zea mays
atttctattggaacaactctcttatgtctaaacaagtgtgtttgatttagagataggaaattgaggttgatttgcaaaaacaaaccaagtggtggcaaagaatgatccaaatatgccaaagttgattcaaaacaaatttgtgttctcatttgaattgatgttgcacttcttttagttgctttttgttgtgttggcataaatcaccaaaaagggggagattgaaagggaaatgtgcccttgggccatttctaagtattttggtgatttagtgtccaacacaagtgcttaagtgataaactatgctaaattgtagataaggtgcaaatcaatataaaggtatgattctagacttagtacattggtttttgtgtactaacatgtttgtctaagtgttagaatcagaggaaattcaactggaaaagattggctcgaagcagccaaaagtctgctcagtctaggtgcgccaggctggctctagcgaactggctactctcgggacttcgacggcggcgtacggctataaatcactggactgtccggtggtgcaccggactgtccggtgagccaacagttagccgggccaacggtcggccgcggaatccgcgcgcgacgcgtggcaagtgccaacggtcggatggggcaccggactgtccggtgtgcaccggacagtgtccggtgcgccaacggctccaagattgcaacgatcggcttcgccaaataagraaagagatccgcaccggacagtgtccggtggtgcaccagactgtccggtgcgccaggcgacagaaggcaagaattgccttcctggaatgcactcaatggctcctagctgtcttggggctataaaagggacccctaggcgcatggaggaggacacccaagcattctctaagcattcctaagcaccaagacttcgattccgcgcatttgattctctgtgatagcaactagagctccattttgagttgtgaactcgtcgggttgtgttgtgagctcttgctgcgacttgtgtgcgcgtttggtactctgatttcgtgtcttgtgtgcgttgctcatcccttccttactccgtgattttttgtgatcatcaaagtgtaagggtgagaggctccaagttgtggagattcctcgcaaacgggatatagtaaagcaaagcaaaacatcgtggtattcaagtgggtctttagaccgcttgagaggggttgattgcaaccctcgtccattgggacgccacaacatggagtaggcaagtgttggacttggccgaaccacgggataaaccactgtgccatctctgtgttgatctctttgtggtcatcgtgttgtgcaagttctcctctctagccacttggcttaattgtgctaactcctaatcaagttttgtggattaagtttcaagtgttttacaggatcacctattcacccccccccccccctctaggtgctctcaattggtatcggagccgttctcttcaagaaagggactaatcgcccgaagag

SEQ ID NO: 10498 - DNA, 655 bp, Zea mays
cgattgaatagtttggctaccttatatagtcgaaaaaattattagataagattaatattatcacgatcattaatgactttgtctaagaaatgtttgaagaatcttttgaggtatattaaaatttatttagtatagtatttgaatgaagatcacattaattgttatggatataaaataatattatatatgtatatatataatgaaaaagattattatacttttaaggggcccaactttttatgtttgccttaggccaccaaaatctcagctcctccctgatctcgcaaagaggaaactgtttcttttgcaagttttgcacgctacacagagaaagagaaagggagggaaatactgtatatgtgtgtgtggcagggacaggacaaaagagagggtggcaagaggattggctggttgcagcaaccaaagcaccgcacagccattcgtttccgcaaggccagtctccacctcacaactcatatcgtcttgtccttgtgtgccatcaggtacacagccttttatacatgttcagctgccgcgccacttctcagctcaaagaccgtgtgtgtcaaagagagaaccagcacacagcagagtagcacctgatcgatcgatctcctactactagctcgttcgctttcacaaccagggagcagca

SEQ ID NO: 10499 - DNA, 538 bp, Zea mays
atctgcctgtgtttacgatcaccagtactacacctgggcattgaacttactgtacttttcgacatgatgatgtatgaccaagtcaaagtctcaaacaaatgaacaggctgcgtcgtgttgaaactgccaaacaaggctgttcctgcgtcgtataattcaccaaggcacgcacgcgacgcgaaaagccacgaccccctccagacgaccagatcggggttcagtgcgactgtgcgactgcgacggtcagttgggtccccaaaggagcaggtgcatcagtttctccgtcctctcaatctccgcctcccgaagccgaggcctctgcctccactcctgattgcgctcctccccggccgtccgcgcgcgcccctcccccttggcccgcaacgtcgccaccgtctcgccctcctccgtcttcgcgtcgtgccggcacgcaggcgcagctgccgccgccggctccggccctggcctcggcctcgcgtcgcgctcgtgcagggaggcgcggaacgcgcgctcgcgcccgcactcccgcccgttgcac

SEQ ID NO: 10500 - DNA, 1024 bp, Zea mays
cgccaggccgtctatttggcaatctatatgcggatgtgtggtttgtgacgcgggttaatttaaaatagattggaccgtccggtgatttttttcaccttattttaaatgctctttgtaatcgtgtttaaaagttttaggttttctacacggatagttatctagcatttgattatattctatccgttttaaattataagttgttttaacctttttaagaagtcaaaacatttaaagtttaactaaatttacacaataaaattataatatatatgatgttaaataaggattactatattctttactaattatatttttatagtatataaatttgataccatagatctgtgtaattctctacattattttggtcgaattcgaaatgttttgactctttaaaaattgtaataatttatagtttagaatgtctctaataaaatcgaaaaaacttataatttagaactgagggaatagatgattgttgttactaaggtttttttttcactgacgatcttcgtaactactgcactcctgtttaagtagtcaaaataacacataatatggcctgtagagaatgggaaaaattacacaagccgtgtaggcacttgattacaccggcacgaagatcacctccttgcccagcatgagaacgacgacggccggtgtgctggtgccgatggcgatgacaacgtaggccggccaccgtgacgcgggtgccacggtgatatagacggccgtcatgagcgagacgagcatggcgaggcaggcgatgacggtgagcctgtgaccccacaagagctggtcgaccttgaacctgacggggtcctgccaggcccagatgaaacagaagacgacgacgatggagctgcacatggcgacggtgttggagatgacgaagatctggaacgcgacgtggtggcccttaagggcgatgccgtcgctctggttatagccgccgggcatggtgaaggtggcggagaaggtgacggtggcgatgagggtggcgacgaggatgtaggtctcgacg

SEQ ID NO: 10501 - DNA, 1500 bp, Zea mays
tatatgtttttaatacatgcgcaacatgtcggacgtgtgcaaaataattaaataaaatcaaaattgaagttggttaagttagttatatggaaatggttttttaatgagtagagggatatataggggaaactatagggggaacggttgcgggacgagtgaatataggggatggaatcttgctgacgtggctgcatagtaacatttagggggaaaaatttagggggaacggttgcggacagtctaaattgtggtaagatataaaaaaaatttattctaatatatagtacctgttcttttttttatttctcacgtttagttaaaaatgaactcacgggtgatgtagtaatacacatgaattgatacgatatgaatgcataggcattcaaataagatctagaatctgccacatttttaggcattcagtctcactatcagcataaaartcgttcgcctcattcaggtactgctcgtgttctgttcttcgcgctgtacactcgtgagttctgaacttctcactgccacgtattttttcctctcagttttcttattgtttcgacaataaacaattttgtcattacttaactataaaaagcttctgtaatcttaccttagattttttttttgtcagccattggaggagtacgtcaaagaaaattttcatttgaactttgttgccgaagagtccagccagacgttagctccgccactggcaagtaggaaccagctcaaattaagaacacgaaagagaatcggcaggtaagaatcgtacgtcaggaacaaaataggtatcacattcatcgttgtcgtctctctaatccttgattcgtcatgattggatgcctggctttcgcttttgcgctcattaacgatacggccgatgacctgaagtaccatgttccttgcagataacgaacataaattgaccttgtgtgatgaaattgatgctttgcagtgcagtgccaaccttaacactaaagtcagtgcaggtaacaagcacacgagcaaaaaaacaaaatgatttcatcgtttaatcatttgaactaaaccaaaacgaactatgtttaaaagaaactatcgtaagcgagagaatggtcctccgttccttcttaccgccagtgaatttgccagagacagagagagggggttcttaccaacggctgatatgagcttgaaagggctctttttaattgtaatactagcagattaattgtacaggattcgtataaaattttatgcatgtgaaatataacaacttttttttcgagttagcatatataatacataataataatatctgtagcgaagagagtgagagagagaaaaagagcacgaaaaagcgcgagagcgaaggaaggaggcgacagggagaaagtatcatctatcccgacccgaggcagcaggatatgaggctgcagtgaacgccgcccggcgtctcgagacgaaagggctctgatcctcctcctctgccattcagtcagtcgtcactcccccgccctccca

SEQ ID NO: 10502 - DNA, 611 bp, Zea mays
ggtacccactacttattattcgaatacggtttgatatttgcaatttcattacaaatattctttattcaaaacttaggttccgcatgagtaggcctctcttcctgagaatcttgcaaggtcttcaacaacatgattcgtactttacacaacgggtagacgcaactggtatgcctggtctaggtccactacaaaaagtatgtgcggcattgcgggtactagcatatgggttaccttcagatgctgtagacgagtacattcaaataggggagtcgacagctagggaatgccttcatcatttctgtcgaggtatcattgcatacttcagtggctggtatctacgaactcctaacgaagctgacataacacgcatcatgcaccatagcgaatcaaggggtttcccagggatgttgggttctatagattgcatgcattgggagtggcggaactgtcctaccgcatggcgtggtcagttttgtggcagaaatggtcgagcgtctatgatcctagaagctgtggcaacgtatgacctttggatttggcatgctttctttggcatgcccgggacaaacaacgacgtgaacgtgctccaccgatcaccagttttcgacccc

SEQ ID NO: 10503 - DNA, 667 bp, Zea mays
aaacaccttcggcaagatagtacaaaggcaggtgcgatatgaagacataagccgaagatgatgtggacaaaagccgaagctacgactgagagagcatcggcttggtattttgataaaggcgaaggacgataccaacttaaagaggaaaagactatacagtccttgatagttcgcattatgattataattagttatcagggacatggatgtaattttgcccgggccgcgtcccgtgcctataaatagatgaagagtacccttgtactgttcacgctagatcgtaatcgctcttgcgtcactctcgctttttcaccttcgggcaagccgaaggtatcaatgtaatgtaaatattgtgaatatttattcatgcttataaaatgataatacaaataatttactgatatatcatcattatttgtattcttttatatttcatgtactttcgtttatatttgtttgttgagatgatgaaggtatgtccttcatgaccttcgtctgaagatcattatatcccaaaggagataatgcttcgaaggacgaaggtctttaaccattaacgattgtgttgctttgttcttgatgtatagcattcgagaacaaggaccaacattggcgcccacctccagtgaactcattcgaccaccttcggcaagcatcgactttcgca

SEQ ID NO: 10504 - DNA, 1388 bp, Zea mays
cggccacaacagttacgcgtagcgtaggacactaatcgccacgagatcttttcctcgcggggttcccgtgccgctgaccagctgtgcgcttcgtgattgattgcatcgcatcggcgctgaactttgtccctttaaatagacacgggtcatctcaaccctgtagccgcctctcctcctccttctccttcttccccctctcaaggctcccctcctccacagcctgcagcccagctcacgaggaccaggaggagaagaagttgcatagccgcccatctgcatccacactccaacagttgagtccctctctccctatcatcccccccccccccccccagttgccttatctcctcacgtcctagctacaaccatacctgcgtgcgccggcagcgagaaaggaccagctaccggccgtgacgttcttctcaccgtacgtcgccgagggattaggtggctcctcgtttctctctctccggattcattttttttcagctcggttccacgatctttgaattttgaaacagccccttttcaattcggtgtccttttgacgtcttaatatacggcgggccgcggggggtgatgcattgctcgcctactgctgctacaccagcagccagaaggcaggcactcgcgccccggtgttttctttagttttttttttcccgacggcacaacttgttgcggccgatccaccccaaaaaaaataacgcctttttcccctaggcgaaaagtattccggttggccgtacgttacggcaagttgcactgcggttccgatgttgattattggtccccagtccccactctcccctgcgaacgtttgaaggataaaaccacttgttttgcttgtttcgctcaccagtgttcgttcgcccgtgctttgtgctgagcggccgcgttcaggctgccgggacgggggaacaggggtagtggcagcggtcccgttctctgctgctggtggaggctttcggttccgggcgcgggcggtgtggttttctgtggtctcgagaatcccggaaagggagcgagcgcaaaggtgagagggcttctattgattttctttccgctctctctctctctggttgtgcttgcgtacaagttacaatctccagtgctacccctttttttgccggaacatttctctctcgaaatccgttgtatgatatgatgacgaggaaaccccaaaaaatagaagaaagaattccaaaaccctccctctcctgttcagtatcttctgcggctccgccgtggattcttcgtgcggtggattgctttcttccatcttcgtcgtcgcatttttttttgtgtttggcggtgggttcctgatgtcgaagtgaattcatcatgcatgcgtggtgcagataaactaagcagggcgctgcacgagg

SEQ ID NO: 10505 - DNA, 1500 bp, Zea mays
gattttttcgtttggatggaaactgtgtcggtggaacattggtgctctaaggaaatgaacctagtcaccctagggattgcaggaattattatcccctggcactcagatattattggattacaggaattattctcccttatatgttgctgttgcttttcatatggtggctgattcggagcgacagcggctatagcaccgcgactccatgcatggagaactctattcgcctttcctctcgaaaattctgacgtcctttcatcaaccgtttatcgtttaacgcctcttgtgttgttcttgctactgcttatgtgcgtcagaactcgaggataaatctgctcatgatctgtctaatcttttttgtttttgttttggtatctgttatgctcggcatgtttgagagatcgctctttttgaatgtggtcttagggttttagaaacgtgtggatttgaaccacttttttcttatccctttttctgttgatctctcgacactactgggcgtgcgatagggtcccttttcctgtttccttgcattgtgctctttggccgaacgttggacctccatcttgattttcttttgctgaacaatttcagatcgttgttgccgtgccagcatgcactgcaaactgcatgccgttttattttctccccccttgccttttatgtttatgtcagggagttggcatttctggcttactatcagtgtaagttaagcttgcaaaatcgagtgtgttttcttgtctattactataatttcttgtcaacaatgttatgtagtggcatatcgctatgtagttacttcctgtcagtaaagagtgtaatgctaaagcaccactaaatcatgactgttgcttgtttcacttcatccagataaagtgcctatacgattagtttgtcattcagtatgttgaagtaatgatcatcaaaattctacaagctgaaattggtattctgattttgacatgaagctgcgtgttatcgcaaaatctcaattcactttagcgttagtttttgaaataaatcttaggttcagaaccttattaatgcatccttgaaaaactgctacttctcatattatacaattgttctgtaatgcgcccaaattaaaggccctgtttccaaacctcggtaaaatcctgcatgccattcaaaattgtctctgttggttcctgaccatagaaatggtcaagagaaggtgagttctgcactgagcttgacaagcaatgatgtatgcctactatctatgttttctttctgcaatgaggtcctaatttgcataggacaatgccagtgctagtgaaactttctatttgtatttcatcaatgctggcacttatgtgatcgtagatctgatgttagtccatcttaatataaagataagcagctctcccgtgtgttcatttccaaaatcttatgttagtttgttcatttctaaaaaaatcttggttgtgaatttttaggatattttactcacactagtacgcaacaggatattacaca

SEQ ID NO: 10506 - DNA, 998 bp, Zea mays
gactgtgtccaacaaggtacgctaaatgcttctgtacgctatatttggaggatgaaacgttcaatattgtctccagcgagagcatgtaaaaggatcgctaaattatagagtgctttcggcaaacgctaaatctgaagttctcgtgccggtttcgggtttgtcggatcgacgttttttacgcacggcatttcgtggggtttttacggcgtttgacgaaatgccgtaccagaatgacgtaaaaaacgtaccagaatgacgtaaaaacccttgcagaagctgagaagcatcatttcctttgacgtgatggccacacccacacgccgaacgcgtccgcgccaagctgggcagctggcgccgatgcctggggcctgggcctggcagaagctcacaagtcacaagtcagaatctgccgacgtcatccgccatggtgatcgtgatccatcaaagcttcaaaatcctcgaaccggtctacactctacaccaccaacccccacccgtgccccgcccccttctcacctacctgccacaatgccacatctcccccgtacgtcgcccaactcgctttcgcacggccgcgtcactgttctctctgcctcgtggggcactgggcagcaggcgccaatctggccgagctgatcgagagcccgaggcgacgtgtactggcgcaccgcgcaccaacccaaccggcaaccgcgacagggccggcgggccggcagcaagccccgactccctcgggctctccggccgtcgcggccgacgcttcgcctcgctgcgattcggcggccaaacccacccgaattcgcgtcgatccgagctcgtttcggccaaaagaaaagccgtccgctcctttctctctccccgagttagttattatagctttgctgccgtcgcttaatccagccttccccgtctctcctcttctgccgaacgagacagaccgggttatgtagcctgcctcgttttcggcgagagaggaagaggcggaggagatcagggca

SEQ ID NO: 10507 - DNA, 593 bp, Zea mays
ctgtttacttaaacctccatcgatcagtttacacggccttgcgcagaaatctgttttctctcgagaagagattcttattcagagcttcagacgatcacctgcccataaataaaaatgtataaagagaaggggaaaaaaacgcaagccacttgccttgtatctaacactgacacccgatcgttggttgatctcaagacacaagaggctttgcaatatttaacggcagctggttttattcagacgatccgaaagtgaaatcaggaggaaaatatacgaaccgaaaaccgagaacgatcctgatcacgcgtatagtctgccacttgcgcgtgacggagccagcagatcgagttccgtcgttttcaactgcactggacacatggcccgcccagccccgcccgctagacctagacatgccagcccacgcacacctcctctccacgctcggccgacacgaactaacagtaccacaccaccgtgcgcctgccagctccgcctctttataagccaggaacgcgcgcgcgcacacacagggacagagaaagagagacgaacgcgcacgagctagctagctagctcgctcgatcggcagagtc

SEQ ID NO: 10508 - DNA, 1124 bp, Zea mays
ctattgcactagaacatcagacacatttcatgcaccctgccatgattttaaagttaattttttactaaaaaactcgcgcgtgccgatgatttctatatatatttagttgtgttgtaatgtatggatacgttaggctctccttggaagcaacctagtttttaagaatctaatttctatccccactttctagaaattgctttatgaaaaaaatggttaatggtgtttggaaccaccacagttttcataaacatcgtttagctagatgagcctagctttttggttttcaagaaactaaaaacccagtctccataaaccaggcataaactagtatgttttgaaccaccttagtttttataaactagtttttttcaaaaactgggtgcttccaaacatgccctaagttatgaaagtttaaattgtttgactgtttagaaagtaggtgagtgtaaaatttgtttaaagcaatttcaattgtgccttaaatcagaatatagggttcaactcataaaaataactccaacaatgttctattttaccattttttatcaaaaatatatatagggcaggctattgctcaaatatactacattgcatattagtgccttatccatgttttctacatcatcttcaaccttatcttttctaataatgtaatttatttataaaaatacatgatttagggattagttgttggagcttaatttgtttttagtgtcctaaacactttaaatgatgtagtattttaattttgggtactattttgaggcaatttgttggagatgcttattattattatattattacgcttaatgtggtttgatgagcctgaagtagtgggccgcactgcaataaataagttttgggctgagtgttgtcttgagggctggaaaattcaggcccatgagtcactggatggcctgacgcgctaaactcaatcgaaccaaccaaaatccagggccgtcccgtccatcgaagaaaaggggaaaaggggaaaatgatttcttaaaaaagaggagtgacccggtctaccggagcgtacggtgccgatcccgtcgccgccgctacccctcaatcgcgagcaacttcttccggattcgcaccaagctctccacaattctatcgct

SEQ ID NO: 10509 - DNA, 853 bp, Zea mays
accttattatcaggcagatctcataggggcagggccgctaaagttagattcaaaatcgaactacttcctaaatatgagcaactattggagactaagttattttttacttccaatagctatttagcaacttgctaaacatgattttagcaagctattttttagagaactactgaagttgctcttagcctcctctagttttatattcaaagcggaagtaaagtattattcgtactaaaagtagtaggactggaaattggcgtaaaaaacgtgggaaattaactaaagtgacaaatggagaagtcccatcctacctaccaaagactctctattaataacagaaagagattctaaataaagcacatcgaccatctgtacgacaaatataggggtctatgtatatatcgcgttagctgacaaatctatactagtcgtcgtcgccggagatcgcatgccagcgcgcgacacgacggcgcatggcaattgaccgcctgacttgactagctcgccgcgcccctttgccagattgccagttgccacagccaattctcttctcctaccaacgtcgtcttcgtcacccacgagcagcagcagtcgcacgtacgaccacgccgacgccctcgtccccacgccactcccttgctgccttgcctcctcctccacctgcatgcctatatatcccaaccctaacttctgccttcttccccaccaaaccccacggagctcgatctgcagccttcgatctgtcagtgtccactgaccagtcagctgcagctcgcaggctcgtagccgctagctcgacctctaggctctagctccaacttccccgctgtgttaatctagcgatcggcaagtc

SEQ ID NO: 10510 - DNA, 193 bp, Zea mays
tctgcactctttgagcaactcctagcaagagaaataatctttcggacttgaatttaattctaacgttaactccggcctttagtgtgtgtttaagtttataaatttcaggtttcgcctattcacccccctctaggcgactttcaattggtatcagagccagttgcttcattaagagtctaaaaaactcgaagtg

SEQ ID NO: 10511 - DNA, 780 bp, Zea mays
ggttagaatcctttttagataaaggtgttgtcaccatactttagagctgttagcttggataaaggtgttgtcaccattaatcttcaggtccttaatcttctgtaaatctgacggaggagatgcccacagacgcctacctatcatcaaatttctagttgatgcaggatttttttgctttctgtgtacttcagtaaccaccttcatcacattgtttacaaaccaggcaaataatgtcagttagaactactatacgcttcaggttcattttaacagccaagctacagtgcatcaggcgccacacaaactaccttatgctttcaggggataagtaagtttcaaaatcttcatccataaattccaattggttcgccatcacttactctccatacaatgtcatccttctgttttcaacgcaaagaataacatgaggctgacatgtttaaaatagctactaataatatgtaattgctttaaaaaagagcaaggaacgcctttggtacaagccaatggattaaaaaagctaagaaattcagaacacattgatacaccaaagtatattgaaaaactaatccagaaaatttataaatatataaaaaaaggcgcgctgagcgcgctttakacactagtatccatgaaagacagatacgagcatctagccatgctaaacatgattccatgaaacactaatatgagtagccgaagtgttgaataattattttttgcacaatttatgaacaagatacatctaacacatgtgtttttaaatttttgtgtttgtag

SEQ ID NO: 10512 - DNA, 136 bp, Zea mays
agcagctcctgcatgcatgtgcgttttgctaataattatacaagtgctgtacggtgctttttccgtcgcgtttttacgttgaactaccaggcatatagatatttaacttggagtccgtttttatgaatacaaacaa

SEQ ID NO: 10513 - DNA, 473 bp, Zea mays
tcttgcgttattttcttttctcttactggtacaactttttatatggtttacatcattacctacttgttctattggtccatgctgagttaaaagaaatctttcaccaacacttctatcataaaacaagattgtcacatcttacattgggttgtcatgggcgtgttgggtccgtctttgaagacattaagaaccaatgtttccttttagatgatctatgaaagagatttagcccaattagctttcaatggttcgtgctctgatatttaaaaaaaacttgaaaaatcattaattcgtaaaaatctatttacataactaccggcctacaaaaaaaccattttgttgaagacatttgacaacggcccaatagggccgaatttccattaagtccacttctcattctcaccatataacgcaggaaaaacytcaagaaccctaggaaataacaggagaggggacgcgcgctcactagcaaa

SEQ ID NO: 10514 - DNA, 1500 bp, Zea mays
aacataataaatgtgtccccacagagaagtttaattaggaatacatccatgcatatcgtctcatcgcattgagtttgtgagtcgtttaccttgttctacaagatcggaacggaacatatggttttgcgctagattcagttcacactaattattaaaaagaggccatatatttgtataggccatatttgtatcactcccctactactccaccatgcagcttgttagttgttacatgtggttaaaatagacaatttttattaaaccaggttaacaataactaatactacgagttagcagcgctttattataattaaaagagagaggggggaaaaggaagaaaagaggcacaccggaacaaatggagaagcgctggcgccgctggaacgaaactttcaacggtcaaacagacaagataataatctatcagtaaaaaaaactccatcttttttcccgctctaattaataaataatgaaccaatcaattaaaataatggatttattgctgtccggcgattttcttgtgcgttattaacgtgtcttccttctctctccggcgtcgcgtcgcgtccctccttcctccctctccatttccgccaccaccccccctctctctctctcttcttcttcttcaatcctccctccccgcgccggagttggaggagggagaggggacaagctttccggcgccgacgccgacgcggacccggcgccgacacgatccggtaatcctctccgtgctcgcgctgtgcgcctctccgtggatccggtcgggcgtttgattccgcagcggcgtcttccgtagccctggcgatccgtgagatcgaggggcgctggcgtggtgggccgggtaggcgcgcgctttttttcgccgtttcgggcgtctctggttcgctcgattcgggacgagcaggcgcgaaaggcgtcctcttctgggattgattttgtttgtgattttttcccgaacggcggtagttttggcttccaaggtccgttcttgctcgtgtcggttttccacccgcgtgagatggattggtggggaaaagtgtcagctttggcgcgaatttggcgagatgcatcgagaacggtcttcctccttttttttcgtgatttagttatgtgctagtacgtctgctagatgttaatcactctgctaggataatcttctccatttatgatcagagctgaattgctctcggaccaacagagtttccaatcgatcatgctaggggcaggagacttcccgatttggaaggggttggcctttccttgtcaagtctcccaagcctatctagcaatacaaacatgcctgcaactgcaagtgaatgtgccttttcaacaaacatttcattcaaccgctgatttctaacatcccgatcatgtgtttttttttttcacctcccgtaatcttgctctttacaggtggatcaagtgcatcacacctttagggaggccccttggacagcagtttgtgctgcaaattctatatagctctgtcgcagc

SEQ ID NO: 10515 - DNA, 976 bp, Zea mays
cccgagagatttccagagcgctcgctagcaatattccaaatctctcgtggagtcgtggctgcttgcccatcccatcgactacaactcaacgacccgagaactttccagagcactcgccactcgcacatcgactacaactcaacgatccaagccaagcgacgcgtgtgttctcttcttctccgaggccatcatccttcgcgcgaattagccgctcagcgaccgggattcaaggtacgtcattgctcaccttcgggatccctcttcctcgtttgcccccttctcttctcacatgtggaccaggaataagacgcaagcttgtcccccaccatggttcatcgttgcgtgagtatatcgtgtcgtctatttccgatctgtggacgaggcagaaaaggctttccacggatcatctagcttgcaaactgaagcagaaatgcaaggattgctcttggcgtttccatggacggcgacaagtctaagcagcttctctgtccatggcatgtgattatgtgaagtaaatcgccttctctgtttagctagtacaaaaccttggtttgtgtttcgttatttccgttgacgtggagcacgatacaatcagaaacgaactcgattcagtaatcctcttcatggcttgatgggctacattgccattatctaatttgtagaatcccaagatggtggaaccaaacacttatcatgctatgcaaatgcaatcgaacaatcggtagtatgagctaactgaacatgatcaaacgtgcgaaggaatatgaattaatcaaattgaaatagagtaaattgtgcaaaaatctcacactaggtctaactgtgttgcaaaccttatttaggatatgaacaccgggaatttatttgtacagtgaaaagaatttcacaggcaaagttacctgttggacaagttttggagaaactgaaccctttgcttctttcatctgaagcttactggctgcagggttgcgatcag

SEQ ID NO: 10516 - DNA, 208 bp, Zea mays
gccgccgccgagagcctgcccgagaggaccaacaattccaactcggtcctcggcttgattgaatgcattgggtgtagatactttttggtcaaagtataaagttttgttttttttttctctttgcacttttcaacgaggagagaagataggaacgttgtagtgctagagcctagaggtcgttgcaacgggaaacacgggatttgaataa

SEQ ID NO: 10517 - DNA, 593 bp, Zea mays
atagactcttttattttcctatgcacgtgatattcatgatacttacattctcttcatagctagattctgcgtataccaaaatcctcaaaaaatctcgttaggaaaaaaaagttgaagcaaatatatagtttgtttgtataattcctgcggtagtaggagcttgggtttgggccgttgtgatgttcacttgttccgttcatgacttttgagggtttttttatgcataccctgtcgagactcgagactccaattggaaggcatgttactaattgtgatcgcatattaaacctccactattaataaacctctaaccattttgcaaactaacgccgcccctgcaactccagtttgaactgtagggaggaaatctaaccgcgggccccaccatgtaactaactggccaaccgacttatcagcagctcaggatcctccctacaaatacccgtgccgcctcaccaatttggtcatccttccactttcaaacgatcgcaacacaatccaaagaacgacgcgggggagcgagcgataaagccagaacaagaggagcgatccagaggagaagacgaaagagtcaggggagctgctaaggaccg

SEQ ID NO: 10518 - DNA, 1500 bp, Zea mays
ccgattatatgtttattttgattttaaccgattatatgtttattttgattttgaatggtttttacccaaacgatttttatagaagctggctgaaaagttgagtgtttggcagtccgcagcagcttttggtggccagaagctgcgaaaagccgaaacaaaccggggcaacaccgggtgatgtaggtatggtttggcattattgttggatccatcacattttgcgggtcagtttcacactttcacttacacagacatgccagtggcagtgggaagctgcaaggcagttttcttgctcttgcatgttaccggaacaaagataggacttatttggatcaaaggattatttcttggatcctgtgttttctctgtgtttttgaacgaattcctgtgaatttcctatgttcaaaaagagccctaagagcaactccaaaagaatgttaaaaaatccccctcaaaaactaattattgggagcagactaaaaagttttagaagtggattataatgtgttctccaacagtttctctaaacaaaggctaaaacattgttaaatgcaacgatgttctcggtgtggcactttggtgaacacccagcaggcgtcacgcgggcattgtgaccttcaccaggccaactctctcctcactgtcatgctcaagcccgagcctatgtggtggcacagcatgtggtggcatagcatggtcgtgcatgtcgctgaactagagcactagctcgaacgctacagattgcgcaaagacccaccaagtctgcatctgcatggttccaacataagcgccaggcgtcaggcgcgctgccatcgagttgatttcgctcttrcggcggaacgagcagacaacgatgtcgcgacagcttgcacacagtcgtggtggtggagaagaaccgatggtgtgtattggggaggcatcgctcacacgtaaatatgcgggaggagagtaggtggatgcgggacgcgaaaattttggggaacagttagagagagctgtcggagcaagaaaaaccatatttattttctaatatctgttttgggatagatttacagtttcttttggagttgagactagatatatggttttgtaaacgtaaatttaactaatattaaaagaaaattgtatccaatagactctgtaaacgactcttcaaatttagtggttctctattttttcatcttcgctctccaattttggataacctgctttactctctgttcagtccgtaggtttatattttttctctaaaatctattttaaaaagtagctaaatcagtaaatttgaatagtctttttagctaatttgttagacacacccgaccggtttggacacgtatatctctatctcatcgtcatcattagaaaggccgaagccgtctccgttcctcctcgacgcgtctcttccacagccgcaacctctatccctcgtctggtatcgtctcccacacccctctgccccaactcagaaaaaccctcgaaaagcggcggcggcgcgac

SEQ ID NO: 10519 - DNA, 191 bp, Zea mays
agtgattgctaggaagttaggggcaagatgcaagggagataaaacttgcatttgggtccctaagacaattgtgactaaccttgtaggacccaacaagagttgagtacctaagacccaagcctaaatttgccttgcaggtttatgcatccgggggtacaagctggattatcgacagcggatgcacaaaccac

SEQ ID NO: 10520 - DNA, 995 bp, Zea mays
ttgtctccagactacatggtagtctaatccatgttatctaccaacccagaaaattacagcttaaaacttaacttgtacgtagataaataaaaaatacaaatatcatgaggtgtgggtcaagcccatattttgaataatgaatccgtaccgaaactccaagtcttcgatacaaatagagtgaacgcaaataaacattacttcatcaagacatgcatacaggaatttatcaataacagtatcattcagcaataaacagatagcaacaaattggactcgcgtgtattgtcaatcagcatatttttcatcaaccagcttgcaagaaacagttgaccctgtcctttcaaagcgttccattgtaaacctgctaagtcaagaaacacgaatatagagttgtagaccatacaattccattggttccttggtgcacactatggaatgattagaaacacaaatataaaattagcgagtggccaattcacaatgaagctatgcgtatttggtcactatttaattaagcaagataattgtcctttcgagaacatctcgagagcagtgcccgggttctgtgggtagtggactggagtcctttgatctctttcggctctaagcagcaattgaaccaaaagtacccatataatacagctgtaaccatctttccctactttatttgtgacatagtcagcttttataatatgcatttgagttttgtttttcaggttagctgtgcccattttacactgatatgaacgcaattatgcagtatattcgttgcttgttcaccatcagctccaatcttcacctcaatttgggagattgttaactattcccaagaatgtgtacctttgcttttcactgcatgtctatacctcagtctggagaaacatatatatagaatgtctcatcatgtggtggttctgaaactctcttgcactgatcttgtgcaaaatcgaaggctctgctgttcttcaaggtatttctgaattttgacaacatta

SEQ ID NO: 10521 - DNA, 564 bp, Zea mays
ctgcgcggggcgttgcggcaagcagtgcgtcggcgccgtggccgtgcgcccgtccgctgcaggcccgcggcgaggcgtagcaccgcacatgggcttctcgtaccttgccgccttccacaactaccccttgtcgccctgctcggattcaccatcgcatatacgcacaacacagtccatcaagttcttcgtcacacaaattgtccgtgcccgattccctactcctcttgttctgctttccatgtcgatgggtggcgccaaagaagagcgaggagggcacgacggagaggtggactatgcggcagaacaacgcgagatccctctgtctcgtcggcgttcgggatggcctagagcatgcgtggagggatgaggcgcggcgcgagaaagaagactgtttccaccgcctaattactacacatttttttgtccgattaattcgtcgactccacctactgagatcaaatctgggcatcagattctgtgctgccttcgacgtcaatcccgtctggtttcgccgcggaattcagtttcagttcgagcgcgtcagaggcatccccgattccggcg

SEQ ID NO: 10522 - DNA, 1052 bp, Zea mays
atacgcgcataaactaaaagtaaatcatgttcctgtttttgtacaggagaagggatctgattgggcagtggacctggctacctagattttcttgaaatttaagaagcctcagtatcgtgtatttacatgttctttttccagtacgatagatttacttttccgtaaagtggcgtaaaccgtaagtattttttcctcccaacartcctctcctaacgactaacaaagttcaattcatgcgaaattcggatgtttcattttaaaaaaaggatcttcagtgtgtgaacaaatgtatggatgaatatcactgccctgaagagaccagagaagctggtacctttcacattctgtccgtagaagtgatgcatcatcattttactgaaaccaggtgacgcatctgatgagaattttggctgtgtctgctgctctgctaagaagagagcagacaattgcatagaacagaaaagagacaccaaaaattgaggaggcatgcagccatatatgaagctttgacccataatagatgcatctaatcacaagctccaagacatggccacatgtgtaggccattgacacgaatgacttgcacactaccctctgctctcttccccataaatttgttgcacttgcacaactgagaaagaaagaaaagataaagaaatcactcacagctgcgtagcttcttccaaacaaaccactcagtcacagcatacttccacactcactctccctctaaaatatcagacaacaccactctctctctctctctctacacacacacacatacctagacgtgagatgagaggtatatataggaggacatggagagcaagaggatttcacctctgcaacaaacagtagctgcacaagaacaaaacagcagcagaagcctcgctctccatgccctggcacagagagtgtaagcagcatgcatggatctaacaatgtcaaccacgacgatgtccacgtccccagcgctcgaccatgaccatgaccatggtcaccacctcctctcctcagcctcacccacctccacagactcgccggcaacggca

SEQ ID NO: 10523 - DNA, 1155 bp, Zea mays
tcggtaccctcccttgaatggcgcctgcagggggcaccctacggccgcagcgctgccctctgcaggtcccctacgcgctggcccccttctctctccctctaaatatagcgtgtcactgttcatacctaacactgttcattcctgtagtagtgggtccactagtaattgttagtagatgaaatattgatagtagatgaaaagtaggtataggaaatgatattttatggttgtagtggagtataggggaaaatatagagaaaaccgatgtgggagatgaaaaaatagaggatgaaatgttgatgatgtaacgcaaaaaagtgatatagtcagaaaaatttagagagaactgctgcggatagcctcacagttagccaacaaacgacggagcgtcttttttgtttaccacaagaaacaagaaagaaagcttttgattttaaaccgttgcaccgtgaatcccagccacacccaagaaacagaagagcagagagcagacactactacactagacagtcgtttaaaaacactacagcgatgccagccagccaaacctcacatcccaatgtagacccacccaaccattgtcatctcgatcagaacgaagaacgtgtcgcgtatccgcgccgccgccgccgcggccgcgaatccaactggaacctcgccagatcaccagcacggttaaattaatcggccccagattacgtttttgttttgtcctgctgcatataccttcctccactacccgggcgatgcaaatcgagtggtttcctcctccccatcctccgcccgccctggcacacacacttgccaggcgaaagcaaaagcggagctgcccccgtgccaaggcgagagcaactgcaagctgctcgtctcgtccaataatagccgcaggagcgcaagcgcgaccgaattcggtgcgttgctcttgtcgccatcgcatccgcctccgcctccgcccccatccccacctccccctccaatccccgcagaaaccaccggcgccgtcgaccgcaaccagcagtggttccgttgccggcgcggggttgggccaccagccgcggttgtcgatcggccgaatgattgattgatcgatcgatcggtcggtccaccgcggcaaggccggggagggagccgtcgtcggtggttcctggcggttgc

SEQ ID NO: 10524 - DNA, 1207 bp, Zea mays
gcgaggtgcatgcatacggtacggggctagctcgtttttggaacggatgcgctgtgcaccagacatcattagcctggactggaccggaggaattgtaggggggaaatgggttcgaaagcggcacgtgaatcgcccgcgttggactccgtcgcctgggacggaacggaaacacggagtggactcgaaagcggaaaggaaaggagctcgctcggccggacggtcggggcgcaccggcgcgcgcgtcgggccaggcgttgcacggtctagccggcccagctccgtgtatagttggcgggctcgttagttccagtctagtgggctggaagcttgcgctcgttgggccactctggcgtccagcgtcgctgtgaatctgctcgcatgcgacgggcagcggcgagcgaccacaagaagccaagaaggcgatgagaacgtcgcgaaaaaaaaaatccacgtccacttccccatcgcacggccagctccgtggcgagtggtgacaccgctcagctgcgcttgcttgtgagttgtgactttacacagcatctgcctcgatcgacgaccaatcgtacgtgttcatggactggacgggtgacccctgtgacgctcttcgctagtcaagagtcacagtcatgctgtctatgtgtcgaaacatggcgagagcaagacacgagcgcccactgcctgtttacgtttacggccactcggcaagtgaaaaaagctcgagcgagaagggatgcatcaaaaggcagcggggatcacatcgcgcgctcgctatcattacccgaacagcacagacccaagaccgaaatctgcttcggccggtaaaccttgttgcgccaagatcgcggctacggacaaagtcgagatcacgccgtgcagcagcagtccgacacgcgcgcacacaacggcacaaagccgacgggcgctgccgcttggagtataccagcggagcggttgccttgcctacgtggtgtggtggtcgctgtaaccagccgcgccgtcaggacacccgcgtgctgcaggcacggagacgatgggcactgcttgacagacgagtagccaagtgatgaccgtctagccggtgtccttgatcccgagactgcctcaaaccacattattcataggcaaggccatccatatatctcatcagtattcgaagagaagtctgatcgtcttatctgcggtctggcggcgtccgacgagagtggaa

SEQ ID NO: 10525 - DNA, 117 bp, Zea mays
tcgacctgcagccgagtcgagtcgaactagcgcgcgagcgagcgaggaagaagaagagctagctatactgctgcttcctcgcgcgcagcagcagcagcaaacgaagaaaccagcccc

SEQ ID NO: 10526 - DNA, 686 bp, Zea mays
ggacggtccgtgtgttaaaaaaccttatgtccgacggctagtcacgcggccgtcggatataagcttaaggaaactggccggcagagaacgaatcacacggcgctatacggcgtctcgcttataggcttatagctgaagtgctgaacaccaaggattgctactgaagcctagctagcatagcatggtcacgtcgtctgaagaagacgccggaccagcaggcgttgagctagtaaagcgtgcatagggattttttaccaggaacaagctgaattccttgcgtgacaaaacgggctctcagaacaggcaaattcccccaacaaaaaaaataaggagaaattaacatatgggagacagacgggcgacggtcaccgttgatggcgatgcctccttgtgatgcatctacctaagatacctgcacgagtgacatcacgtgaccgagacgtgcacaaccccgcccccaccctgcgctgttctgcacatcagctgtaagccacaccgatcggccccaattctgagctctataaatcgccccaaccccctccctcgttctgccaccattgccatatcctcgatcacaagagcagctactagctgcctctagctcgatcggttagtttgtcgtgttgcttacgtacgtcagcagaggccatcgtcgagtgtatcccgtggtcgagaagagggaagaa

SEQ ID NO: 10527 - DNA, 1500 bp, Zea mays
catcgaattaccgcgtgattggttaaccagccctggcgaccattgctgcggtatgtgctgaccgtgtttgtgtctttgtttagttggctgcacagcattgcaagagcctgtccgcacggctacaggcaaagcttttttacacttgttagcctgcatgtgtggagaagccaaacattagcgtctcaatcgttgcagactcgtacaaatcaggcgcagaggctgcctgaaaccaatcagacctttaatacatccactcatgccaccaataaaacactatttttagactaatgtattcgttcatagaggatataaaattcatcattatctaatcaaccaaacaaatcctaatatcagtgtcatcttagccattaaatggtgaatagttgatcacctaccatttagatattattcaaacaaaacaaccacctaaggctttgtttgggtattctagtattaatcccaatccacatgtattgaggtgggttgggatgtaagttaaactaatttacacctcaatccatctcaatacacgtgttgggttaatactagagtacccaaacaaaatctaaggactagtttcggaactaaaccccctccgagatttccggtgtttgagtgagaaaatatctcattttttcactcaaacatagataattccgagggtttattcagttatttctaattcatatagattgagggattgatatgtattgaaagagattttgacatactagggattgaaacatcctcaatctctttcaattcatatgaattagggtagaaccgaagatgacctaagactttgtttgagtactttagtattagctccaatccacatgtattgagatgggttatggtgtaaattagtttaacttgcaccatataccctaactcacctcaatatatgtggattgaagtaaatattaggtgtcgtttggttcacgtattggtaacgtaatgagtaactcataacgttaaaatatatttgtttaagtctaatcgtaatcaataccacactagaaatgaatatcgacttattcaaacttgtcaccatcggtatttaaatgttaatcattaacattactatttacgttacattctgtgaactcaaaacaaagcgaaggggatttaagttttcaaatgcaccatcctgtaatgtttaaacggtgggaaaatgggccgggttcagctgggattgtttcgggtctggattcagctaggtttgtttcgggtccccgcagccgcaagtaccgtcggccgcttgcttcccacggcaacaactcacctcccgggcctaccacgcagaaagaaacatctcctttgtatcggcctcggcaatcctgaccggatcaacaaagacgtagctaccccctcccgcgtccgtcgaattcgcctccgccgcctgctcgatccggtgggaattcgccgctgccgggttgttttcgctggggtgattaaggctcgggattcgagatctacgcgagtcgcgggcaagcagcc

SEQ ID NO: 10528 - DNA, 354 bp, Zea mays
cagaggaagtacaaacaatccatagaagtgcataactatatatataatatgatttcaaactgtttctatagtttctatacttttgttagaaactatttaaccctcatgttctttacactttcttactttcttaatagagtaaaataaaaattatttaaccctcatgttttgtacactgaagcccgattacagcagaaccgtccgatcccggatccaatagccgaaaaccaccatcctcgaagccctagcgccgccaccctattaatgctcgtctctctcgcgctgagcgctccaatttcctccacttcccaaaccctaccggcggcgcagcagcatcacaaccaccgcccgaag

SEQ ID NO: 10529 - DNA, 1206 bp, Zea mays
gctgagggattggatgaaatgtgaaaccatacaaaaataaagacaatatactgcatatttctcagaggctattttagaacatacaatgttgagttgctgctctccactaatatctgttgtattaacactgaggagggtgcaacaactgctcatgaaagtaatatcaaactgtgaattggagttaccattatgaaagacatttgttaggcactaccacacgacaatgtatgcacatgtctctttaaaacagaaacaatagaagtgtaacaaataacgtatagacaatttatttggtaaaaaaatggccagcaagaagagtaggatggatcacgatgggcatccaagttgtttcatctctctatgaagaatcttagatgtattgcaccccttgcagcagttctaaaaagttatttaaccatatgataaaagtagaaatatctacggttggatgaacaacatccaagaatatataaagtaataaaaatttgcattttgaattttaaaattttgaatgtaatctttgagagcagagatgatttcaaataaaaaagttgtcaactaaaaagtttcataacttttcgagatccacaacttttatgttggtggttttatcatccaagatcgtttggaaaactcaaaaaattaaggatataaatgatttctagtggcggttttttaagaaaaccgccactagaaattatggcggttttcttaaggaaccaccactaaaaaatagcactgacggttgataacggaatccgtctttaaaaaaatacaccccactatgcaggctttggtgtaaagcaatcaccgtgcatcgtcgtcctcaacacactcggaaaaactatatatatagaatccataaataagagaggaaagaacccatgcagaaatctttttagtttactgaatctttctgggaaactttttctttattaaatcgttttgggggaacattttcctttactaaactactaggaggctgacatgaagggcccttcttccctgatccattattcttgccccgcgctggcttctcgtcgtgggcacatgcaggcttctagctcgatcgggcagggagggctgggcctatatatatgggatgctgccggtgttagccagcgaagacgcacacaaaggtaagtgtgtaaggttaggagccagtgtaccatcacatcagatcagatcgatcgcagcttatagggg

SEQ ID NO: 10530 - DNA, 373 bp, Zea mays
cccctaggtcccacatgcagcgagacgctcgcacagcgaagctaatcgaaggaagaggagctgtggaccgcgtgcatactcgtcaatcacctccggaccccacctgcagtgacaatacatgctccactaaacgccacgccaagccgcctccacttgagctgacagctgagcagcgttcaaacttcaaacaatcaaacgagaggggaaaaccctagacgagccccccttgcaacggtcagatccattcctatatagtattcctccgccgccaacctcctgagcatcccatatctgtgtgtgctcaattcgccatccacaaaatcactgcacccgatcatcgtatcaggaggagaaggtaagagacgtgagggag

SEQ ID NO: 10531 - DNA, 521 bp, Zea mays
ttatattacagggttcaccttttcgtttttactgttccgaaatatcgttttgatcaaaacaaagattgacttttgtattttaaaatttggaaccggaatagagcaaaaaccggagcggggacgagaaatttaccggtttctcgccctttccggtcgagaaattgaaccatgttatattatttagttacgtttttattttaaatgctatatttttcatagaaatttatagtctatgtgtcaccttgtagaacatgttgatgccctaaacatcatgtattttgaagtagagggagtaagctttttactcagaactctcaatttactgttaggtgggtggttaatccttgtattgcaagctggcaacccccattttcttctgttgcaatgaactgtttgcactgtggtttatgtgtcccttctccaagtgcaggtcccaaattttaccttgcttttcctgatgcgtggaagctctttcattttcaggcacagtggaccacggaggagaaagtactctgctttga

SEQ ID NO: 10532 - DNA, 1500 bp, Zea mays
cgtgcgagggttgcctttcagcttcatctcccggactcttgcgtttcttgagcagcggcaccagcaccagcttcgtccgtccgtcactgtacaatcactttcgctttgagtgcagaagctgctagctgcacaaaaccaactggtcggaaaaagaaaacgtttcctctttattttatttttttacttacaccccaaaaaataaagatgcccttctgagccgtggttaatgatttacttaataaaaagtaaaccaggtcggaattatatgagtttaggaccgtttggtggccgcgctgcgtcctttctgtttctgagccgtggttcgtcgtacgcggatcgtaggtgcacctaattgctggtggatcgaccgccaggcgccagccagccctcttcggatgaccaggaaacaaccgctcggcgacaagcaaaacacgaggcccctttaatggcgacaagtcgctcgcatggaccctgtcacctgtggcctgcatgaatcgctcgccattttagccagtagtgctcggtacagtcgcccactcgcccgtgaatctcaccgtagcgcgcggcgcgagagtccgggagatgaagctgaaaggcaaccctcgcacgcatccagttctgagccgacctttctgctgaagaatggtcggaaccaactgtcagtcagtgagttcggtatggggcctaatttcacccgacagcgagggagagtgacagtctcactcccgctccaccctccctcctgccccctgcttccctctcttcccttccgctatctcctgccagctctgcccgattccgtcgctgtctgcaagcagcaagcgtatatgctctcttctccggatccttagtctggcggggccagcaatatgagtgggatataatcgaagcaacgccttcgccgccgcaccagccaccctccagctctagcctggcggccaggccgccgcccttgtacccgacggcacctacaatgcttgcaacgtctcatccatataaaatagtgttcggtagggagtctagtagtagtagatggtaccgagacgagatgaatttcaggcagattttttctattcatttcagctccaatcgcttcgcttgcttcgtctccagtacctgccttgccacgccagtcgccagctcagacctcgctcctctgccctgctcctccgtaaactaaagaggccctcccgcggtcccgcccggtggcctctcgccgtgctcatccgttcggtaccgggtcagtgccgccgtcagtaggtggtcagtcaatcatccgctcgtccattccagctctctcctgctcttgaccggccaaccatccatccatccatcggcgggcgcgcagccagccaagcggtcccgccataaaggtggcgagcgcgagtatgctgttgcattgctgctgattgctccgtctcctccgcctctcgctcgctctctgaggtgaggaagaagaagcggagaggttacgggtttgcgggttgcgttgcgtgcgac

SEQ ID NO: 10533 - DNA, 297 bp, Zea mays
gaaaggttacccaagctgttcaacacgaatagtttcacactttcgtatctgcagcaggccggttctgcactaccctctgatcgatacatttcctctttctctgctggttgcatagcatacgtactatgcccctctctcgatctatatattatacgatggagcgaggagctcaacggcgatgacatgggcatcccggcctgtcactaataagcttgctagttgggtgatttggactgctaggtagctagccagccgtcgattcatcactagaagaagctgctagctagctagtacacg

SEQ ID NO: 10534 - DNA, 1500 bp, Zea mays
ttatgtctcaacaagtgtgtttgacttagagatagaaatgtgagtttgatttgcaaaaacaaaccaagtggtggcaaagagtgatccatatatgccaaatatgattcaaaacaaatttgagttttcatttgcattgatattgcacttgttctagttgctttatgttgtgttggcataaatcaccaaaaaggggggagattgaaagggaaatgtgcccttgggccatttctaagtatttcggtgattgagtgccaacgcaagtgcttttgtgttaatctatgcaaagtggtggacaaagtgcaaatcatataaaaaggtatgtttctcagacttaatacattgttttagagactaatgtattgtgtataagtgctagaaacaggaaaagaacaattggaaatgtcttggctcgagcagccaagactctgctcagtctgggagcaccggactatccggtggtgcaccggacagtgtccggtgcgccaggctggctcgagcgaactggccgctctcgggaattcatcggcgacgtacggctataattcaccggactgtctggtgtgcaccggactgtccggtgagccaacggtcggtcgggccaacgttcggccgcgcgagacacgtggtcgagccaacggtcgaaagggggcaccggactgtcccggtgtgcaccggacagtgtcccggtgcgccaacggctccaaagcgccaacggtcggcttcgccaaataaggaaggagatccacaccggacagtgtccggtggtgcaccggactgtccggtgtgccaggcgacagaaggcaagaattgcgttttaggaatgcactcaacggctcctagctgccttggggctataaaagggacccctaggcgcatggaggagtacatcaagcattctctaagcattcctaagcaccaagacttcgattccgcgcatttgattctttgcgatagcaattagagctccatttgagttgtgaactcgctgagttgtgttgtgagctcttgttgcgacttgtgtgcgtgttgtcgctctgatttcgtgtcttgtgtgtgttgctcatccctcccttactccgtgcttctttgtgaacatcaaagtgtaagggcgagaggctccaagttgtggagattcctcgcaaacgggatatagtaaagcaaagcaaaacaccgtggtattcaagtgggtctttggaccgcttgagaggggttgattgcaaccctcgtccgttgggacgccacaacgtggagtaggcaagtgttgaacttggccgaaccacgggataaaccactgtgtctatctgtgattgatcttcttgtggttatcgtgtcttgcaaagactcttctctagccacttggcattcttgtgctaactcctaatcaagttttgtggcattaagtttcaagttttacaggatcacctattcaccccccctctaggtgctctcaattggtatcagagccgttctcttcaagaaagggactaaccgcccgaagag

SEQ ID NO: 10535 - DNA, 1500 bp, Zea mays
cactagtcacaagttgctgttgcttaatcatacccgacctggtaatccctctcttctgcaacactgtgtagaatgcgtgtaaactgaacttagtgtagccttcacattgtaagcgaggagtgaaataaagctgttgtttatgcctatgaatctctttgattatgtgcagcgtacaatcactcatccatgaacagtctctagtctctgccggttaattctgtattttttttctcgaaaaagagaaaatcacgaggaagaccaagaccccaagtacagatcaaaacactaggaccagccagaaaaaaaaacaaaaaaaaagacaaaatagagcagcagaccagactccctagcacctaactggttaaattcgaggccatgtcaggagctgctgcaaatcagcaaccccagccatacaccacaaacaacacttgtcccatattttctgcaggagaagcttgaacatgtatttgatagtatctcaatgtatatccttcctaggtgctgataaggtccttccaagttaagtacttagtagcataccatattcatgatgtacttttcttcaaatactgaaaagtgtccttaaaaactaaattattgtggatcgatatattttcgacaacttgacagagttaaaaatatcatcatgcaaaatgagataacttatgtcatcctaatatataggaacggatacaagctccagaccacccaatccgtgacccgaggtatggctcatatgcttctagttatctttaaaccggaatgtattggaagtccaatagatgcaataggctgacccgaggtaatgattggaccatgtatctgcctcaagtcataaagatcaaggagaaccaaaaagtatctaagctcaaaatctatctcacaagtccatgtcaaaagcaatggctcttatttctggaggggttcggtaaaaataacagatcaagcttttaatgatagatcacaaacaagattttgagaagatccatggatggacaaccactcactcaaagacctttatctcatactgcataatattaaaaatagtctaccgaagctctcatgtcccacctcttatctttatctcatgtttccaactccattctgtaaattataacagtattatctatagtgcaaaatagtgttttatgtcgctatatacacgatctgatggccagccttatgcgagcacaactgcacaagtctacaccatcagtccatcacacagcttaccagcttttactagtgacatgcatactactacagtaggtcacagtggactacagtctacagaagcgtgattatgactcaactgcagatgtaatttaccaagtatgttcggaaatattcactacgctaatataagagaaagatgtccaagctttacaccgagacgtgccctttgcatatgtactcccatgtctgaaagctttggctccgatcctacgagtgagcgagcgcccgttttgaaaatggcatcgctacttacaatatctccaa

SEQ ID NO: 10536 - DNA, 203 bp, Zea mays
ggtacgttccagaaaaatcacatgaactcattttcttacttgcttggataacgcatatcctcctctcccttccattatgatctgtgagtttttctaatagaatagataccaactattttcttttgcagcctgcagtcaatttgtcagtttattgagacatccaacttgcatgagttgatcaacaagcccatccctggttcctt

SEQ ID NO: 10537 - DNA, 612 bp, Zea mays
gatcgttttgacagatgaatatatgttatacaaaatagtactgtagataacamcactgtgtgcagggtataatttaaaatataaagtgagatataaaatgtgatagaagagttgttggagatagcatgagagacaaatatggtttattacagtaaagagctaatgagctacactttagattaaatttaattgtttagattgctgcagctataatctataaaaacaaaaatattatataaatagtagaaacccggattaaaaccaagcgaacgtacttcttaacagtcggaactcggaatcggaagtggcgtgaagcaacgaaacagcgacacgccatcaacagtaccattcagatcggaatcccagttagctctctgtgccctacctgtcagtgacacagaaatccagtcggcggggctgccgcctgccgcatcctcccctcgcccaccgtcgacgacttgatcccctcccaccgttgaggccgcctcctcacggcagcgagccagcgactcctctcttcgtctcctacaagtagccagacaccactccgactttgccggcaacccgtcgacagcgacgaggcgcagcataaggcatacgggcacggcggcc

SEQ ID NO: 10538 - DNA, 1500 bp, Zea mays
atctcgccttccgggagggaccccgtcagggaggagagatcctaaggtgtcttggcgtcgacaggccacccaagacgtctctaattgacgtagagccgaagggatgtgaaaatttgaggtagaggaaggctaaactaatgttaaactaaagctactcctaatgcaaaaagaaaaaaaacgataagtagatttgatttgatcgattatggagagttcaatcggacgtagtcttttatctatataaaggggaggcttggacccgttataagtcgtttcccaagttaattctacagatttaactaacaaattctaaaaaaactcggaatcctaactgattctgtatacgcgcggactctccacgccaccatcgtgtaccgtctggaccgcggactgcccggacccagaatcgtccgcgagaacgcgacgagtacgttttgtgtgttcaaccggagttatcataccttgagaatggagttgatcccgcacgacgttgctgagttgagcatacatgagttggagagcgcaatgatgaccgtgagttggcttgggctaaacagatctcgatagatggatcgcaacagcctccgctcagttgacatacccattacaaatgcattaggtatccatatcatgtatttgatattttttcttgctacctccaacccaaaaaagacaattctcgtctttagagatttctttaagtttagctaaatctataaaaaatattaatatctttggtaaaaattatctagagggcgtttggataagtttattttggagaaattagaatctacttaataaaataggctatttgatttgaaatttgacactccatctttttccaataatttagatataatcgtatcttaaatttatatcttaaatttatagagcgaaaaatgaaatttcattttatgtatcattaggttatatttctaacttgcaatttataacacgccattcatctaactcttatatagaaaatgtagcacatacatatcatacaaatgtattctacataaaatcatatagtttaatgtcttgtgcctaaattatggttatcagaatgtaagtcaattcaaaggatcaaaacagtgcattggagatttatactcctgtatgcttaaaaagagcaattatcattttttggagccaaaagttttaagtttatcaaaatctgtaaaaaatactaacatctatggttgcaaaacatatttggagataaacgtgctgatatcatttttttaagtttatcaaaatgatatttttttaaattgaattatttcaaatttagaattgtcggacgagggagtaagttaaccgcaaactcatagcagcacggttagaattattcaaaaatccattgaaacgaactaaaactccgccgtycgcccgtccccgcccttttccttctcttctcccactctcactatacccatttctcgagatctcggcgaaaccctagtgaaacccccgccgtgggggcaccaagacgccgca

SEQ ID NO: 10539 - DNA, 698 bp, Zea mays
gtttgctaaatattgttctgccttgcgcttccatacctatagccaacatggagtacaataatcaaaatcccacttttatagtttgtgaatagtagtttcctaatggaagagtcaaatttcagcctagtatattaccattacccaagttgttcagcggatggttaggattaatttgttgctttcataaagcctgcaagcacaatatgcttcattgcagcaactttatatagctataaatataggcccaaattaacaatcatttatgctcttaagtatataacctatcaacaaatcagaaagtaaagcactgagcataatgaacacatacctgattcttttggccaatccaattcaccaaaaacatacaaaacgaatgttatcacaaattaaagtttcaataacaatctgaatactttcgatcaattggttcaatctgatggtccgccattgactcaactaaaacatcacagactgcataaatagctgccaatttttactggtcgcatattggtgaataatgaacatattattaaatcttccatgacaacacttgtactggcgtactcatgttgacatttcttactttcatttttttacttgcttcttagagaaaatatgtttttgcttttgtttttcactttgcaggtagaggcgaggcttcatcttaagagaatttagaacaatgtatatataagagc

SEQ ID NO: 10540 - DNA, 200 bp, Zea mays
acagagatgagcgaagtttttgcaaaaaaaaccacaagccccgtactattagaaaaaactataaaattcatgtaaaaataagttattgagtccatctaggcttctggccgtgacacgcccgacgtcaggtcgatttttagttagttttgaaaagttacgcatcttatttcactgccagccctctgaaaaaaaattaaaaa

SEQ ID NO: 10541 - DNA, 562 bp, Zea mays
tgcatgcctgcagctttcgctatattgcactactttcacagttttaaaaacttaactccaaaaattttcaatacttgggcctagctgatgctcttagggaggtaggatagagtctgttctttattgtgctgtaatctgtagtttttgttttagttgttagtgtgtgcagtgtgtgtgtgcgtgcaggtgtccctaacctatacctctcttgtaagaccctttcttctatcttatctataaagacgtgcaagtctcatgtttctttcaaaaaaaagttttaaaaactatggtaaaaaatattgtgagtatgtcttgacatttcaaaactgaagtatttcaaaactatagctttcaaatactttgtttccaaataggacctaattgtaaattagtccggtctattggagtcttcaactatccaccagttgcaaattcaatctataagttaattgtaattttccattccaatgtattatcaattggaatacctgaatgcttttgaactgccactgtgatttggcggcagctctctcaatatcaccacaggaacaaaggatcagaa

SEQ ID NO: 10542 - DNA, 518 bp, Zea mays
tatgtgtacctgatacgtctataggatatgtacattctctcccgcctgtgtgctttggggtgtgtgtgtgtgtttttttggggggggggggggcattgcaggtctccgccatttgcattcataagagtcatacatatccacaaagtaatagtctgagttaatgattatggcattctaccaaatttctaactttggatacgagtttatatttagagacaccgataatttcatatatttttttctggctgttgctttcgctatgcctgattgaactgaattaataaatttagttgttgggttggattttacactagttcattattgtttcttttgttggtggtatgaaagttcttcccaaaacttgttattactaattcctcttaccatgtgcagggcttgcaaatggtggagtggaagtcaagcaaacacctgcaagtcctgtacccaaatcagttgaatcctcacttccacttgtcaagatacccacaccagaatcaagcaaagagaacagcggtgtt

SEQ ID NO: 10543 - DNA, 1500 bp, Zea mays
acggcgccctctagtcctggcttctgctgatgctgctcatcctcagcaggctttgatggcttcatgacggcgccctctagtcctggcttctgctgatgctgctcatcctcagcaggctctgatggcttcatgacggcgccctctagtcctggctgctgctgctgctgcatgatgcttgctctgattctgttacgagacacgcatcggtgatggcgaggttgaacatgtgtgacgcctgccttgctttcaacggatgatggtccagagcagaggcattgtagttgccgtaggagcaagcagtgcccagcggtcaagctgtactgcaggccatcaataactggatcaccccttttccattgaaggagttcccaaggacaggcaggaggcagcaggcagcagggagtggtggtggcaatgggcacgcaaatgcagagagaagaagctgtaccttttggttgggttgggttgggttgggtcgtgttgacaaaccatcccaattgttagacagattgatcctccgggtggtggatgcgatgccggtacgttacattcttattcttatcctgccgcgatccccgctggaaattgcgtctccctggaaagcctgttagcatatacctctgtctctgtctctgtctggtagcatttaacttcgtctgctggttttgctggacctgcatactgtttttttttcttgagacgaaccaattgacctgctcggcccggcccggcccaggtcgcgaacccaataatgcatgtggtgaggctgaggcaggcccagctgtcagctctcagctggccgtgtctgactctgacctccggacgccagccgcacaagtggagtcatgtgcgcagcccgggcaacgtgatcccgtccagccaatcgtatcgctccacctccaaccccattacctcaagtacctctcactttccaaattgtaagttactctgttttctttcttcttttctagaaaaaaaaagactcgatgtcttaattttatcttaactcaaactatcataaagttataaatgaaagaaatctgtcttgaataacagaaaagcacaagaaagtaaatgtcatgttcactggtgttgccgtcttgcattttgccacgtgtggaaattcacctgtgctgtgcagaagaaccttttgtcgtactcgtacctctgcaatccgcggcatccatggattggtttgcttgaccccgtcgccgcgtcggtcgtcggccaccatcgaagccacgcggcttcttccttctgcgtttctgcccctcctcgcacccgcactgcccgcccgttcgtccgtcgtcgtcttcgccgctccctcccggcctcccgggctggacgaaacgaaccctcgctcgccctccttataaccgaacggccgaacccagccaacccagccgtttctcttcgtacggcctctgccagccagtgtcctgctactagggaagcataccaactccccattcttctcttcgccgcagccaggaaggaagg

SEQ ID NO: 10544 - DNA, 98 bp, Zea mays
ggtttgtggatcttagcacttaccaaagtgtatgtgtttgggcaagccatcatccattttgtcgtttttatgtatttatctgtactgttgcagttacg

SEQ ID NO: 10545 - DNA, 1500 bp, Zea mays
cccccactttcgtcactccactccactcgcttggccgctcgcgctttctgtaaacctaaagcggccggggcgctcgatcgttgttacagatacagtgcgtcggggcgggggggaggaggcatggaggacacggtgaaagcgagtactagtggtcgtctcttgtcgtccgcaccgttttttgctcgtcgttttgccggccgggggtgaaaaagctggcctcgacattttactggatcttgggaagaagcaacggcaaaaaaaaaaaaagctagctcaaggaggtttgaccactgttggggatttacgccaagcagtgctctttgcctctttgcacggacgggacccgttttcgtgcagcagtacttgcctacttggccttcgcggagcgcacgcaagccaggccagcaagaacagagctaacgtaggagtacgctcggtaggtcatttactcattggcaacgacggccgctggactcgtggtgacagagcgtttgattctaggactacagtaaagtttatcataggatgtttgaatgcttatttacaagtattaaatgtagtatttaattacagaaataattcttgatggcgtgagtaaacgtctattaatttcgaacaccacgctgtctacgacgcacaagagcgtttgcacgcccgtttatccgtaccggcgagcgagcctaactgccttgtgccgcactagctaatggacggacagacggcaaatcacagagatacatcgcacagaaaatggcgctgcttgcataaagaccggtcaatcgcacagaaaacagcacggtggcatgctccgagagccgacaatcgcatcagacggtcgtttaccacgatcaggaaaaaaaacaatggagcaactgtcgcggtgcagcgccgtgtcggccgacgtttttttcgctgcgctgcttccggcaaaccacgctatgcaaaggtccgtggcgagacgagagcagcgatcacggcgggaactcgggctgccacacacacacacacacacaccagggagctttacttgcctcggcgacagacagacgtgaagccgctgcagtcgccgctgccggccgatcgcctttcgtccagcgaggcgagaaaagtcgtgaaaccgacggcgaccgcatgcaacttttcctcctcccgacccgaccgcgccgcagaccgatgcgccaacgctgccgtgtgccggcgcctccgccgcggctcgcagtcgcagccaagccgtgtcggcagccgcggggggcctcccttatttaacagctcgatcgatcggcagtccggcacccggccggaaacgatcgagagctagccagacgtgtgagctagctagcttgttggctgttgccgtgttcgcagcttcgcacgtactcgcgacttcgcaagccatcggcttcccgcctctcttcctttcaaaaaaaaaagaaagaaacagctaaaggctcaagcaacacggtggtgcctgtcgggattgacgaagcagcggaggtggcg

SEQ ID NO: 10546 - DNA, 270 bp, Zea mays
cctgtggtaacgagaagagagtacaatatttgtatacaagcagagtaaattcagtacggatttcctattgcttgcaccattgtgtgtgtgtgtgtgtctatatatatagtttataaagaagtaaatgtcatttgggattcgctaatttgctcatgacatcccaaactagtcacacacaaataactagttcagttggcatgcgtgcaaacttgtgaactcaaatgtcataaaaagtgtcaaaaaatcctagtggtgtacacaacggaaagc

SEQ ID NO: 10547 - DNA, 712 bp, Zea mays
cgccggattggggctatccctcatgggtggtcgtgtcagcttgtcagggcgctgagcatattccttggcgaaaggggcggtgaaatagctaggctgttgcttttatccgcccttttactgacgccattgtgccaagagagccacgagagaagggatgcatggatggcggcgcccaagcaagtttggcaacggtagagagcgcttcgggattccacgggtggaactggccctggagttcgtgtcgagtgcagcgacatgtctctcaacatggccaaaaggacatgcggcccggtctcatcatgttcttttgcttggcaacttgatcatcgaaggcccggccacctgtctggaaaaaaaaacatttcccccgcattttactgataatattgtatttaggagtattgccttatcttcatactactagtagtacctacaagttgggggtatatcgatcgtctgatacgcacatggacatggtgccctgtatacatggatggatctaggggaacggccaacgacgtggagggcgccaagcgtcacagatacaatcatacaatccattctcgtggaccgtaccagcaccaccatgccccgagccatgttctctccggtcaaagctcctcctggctggattagaatagctaatcctccagtccaaatgcacgccactagtgaacaaaaatagcttggcattcagtgagctgcatcggcg

SEQ ID NO: 10548 - DNA, 501 bp, Zea mays
tggaaatacccctttagcaaagaaaaatagacacgatgtcgctttattttatcgcattggaaaagactatccatacttattctatgtacctaacccttctaggggattctatgtcagaaagcgtgaatatttatttcattccattaaaaataacaagccaattctgtttgtaagaagaaagagaagcagatctattctatactcgataagtgccaatatgcaatgggtagcttgggctatttggaaaaacgaagaatagatccttcatccctctttgtttatcattcaaatcacggattcttttttctttattcaatctgttttaccttccttatatgtagaatatttcaatctatgtattaatagaatctatagtattcttatagaataagaaaaaaaaaatgaagataataaactgcggattctttctttctcttccattcttacgtttccatattaaagtgtagtttttttacttaaatttaataatattaatctaat

SEQ ID NO: 10549 - DNA, 927 bp, Zea mays
gtgggtggatttcttgtaaatttatctcaaacctaaattcgggttttatgctatagaaaatagaaatacttcatgatgatgaatcatcaggttaagatcgatctaaaccaatccattttatatatacatacgacatgccaacggttaaacaacttattagaaatgcaagacagccaatacgaaatgctagaaaatcggccgcgcttaagggatgtcctcagcgtcgaggaacatgtgctagggtgtatgtgcgactcgttcagatcatgagttcaaacaaataataaaatttttgaagtatccatgatcggtaccaatgaataggatagagaagctctatcctagatttctatggtatatggaatttatggtttcctttggtgcaaatccaatcatctagattggaagaagcaattcccccattggtaacaaatggttatccattaagcggaggaaatagtaataaaaagaaaaaggcttatgctcctttatcttaaaagaacggactaaagggtcagctacttagccaactttcataattaaataccgtcactgtatgaataactcttattgtgaaaagagttatttactctataatggataggtagagccaaagaatgtgaactatacaagttcacaataccttttgatgaaagaaagggctccggtgtatagagagggcctcgccgtttaaaagggaaccataaaaacgatggaacccactgtttttttagtatcgttagaatttgttatttctatgcgaaataactaaatagaataaaaaatcgtggttgggaaggttatagtagcaaaagccattggaattaatattttatatatcggaataatccgtttagttattaatgggaaaaaagagggttaaaagaagagaaatcattagttattcattaaggttaatttgattca

SEQ ID NO: 10550 - DNA, 337 bp, Zea mays
ataggagcatcgtgtgttcgatttttccaaagaacagaaagagtaagaacttcttattaaatatatagaacatagatagaatactaaatacaaatcaactcatctgattttaggtagatattatttcatatgtatagagggtttttatttttatatatttggattttttatatttttatatagtatattttgatttaatcaatttatatagtatattttgatttaatcaaataatatatggaccaaagaaagactacttcttctggttctggatcaaaaattaataaaagaaagaaatccatttttttttttcaaattttaaaataaggaataaatc

SEQ ID NO: 10551 - DNA, 569 bp, Zea mays
ttcgcctaaacaaaagaaatacaaaggatcttgggcaagagtatctgatcatatatgtattccaatacgaagggaggattttcaatgcgggatataaaaacatatctctctgtagcacccgtgctaagtactctatggtttggggctttagcaggtttattgatagaaatcaatcgtttattcccagatgctttgtcattcccttttttttaattctagttattcctatgcgagagatagaattcttcgtgacatgacgaaaatttcccctttttgaattcttttttagtatatgaagcaaaaagaaagaaaagatggataaggattgtattctttaattatttctctatgttttattacttaatttacgaatttcaaaaattttgtattctattggattggatttgttcgataattcgaagaattacaacaaaatctttagaaatcacatttttagttaggaacttctatggattttattcttcttcttttctttggatccaaaatagaagaataaaagaataggtataagaattaagttaagtcgatccaaaaaggaaaggaggttc

SEQ ID NO: 10552 - DNA, 1361 bp, Zea mays
ggaggactgggacacctgcatggaggccccctgcgcctgctgtggcaacctcaaggacctctttaatcatgatatttttttatttgggaccaaaataaatgctcttggttagacagcagattcatgatcgtgattatgcaactatttctcagtttctaaaaaattgtcttacagttcctgttgtcaaatgaaaagctgatccttcttttcagtagaagatgtagttgttgccacttgttgctacaataattttttttccttcttgattgattaccatctatgcatatatgtgtgcgtttttgtttgtgcaatatgggtgcatggtgaacccttgcttgtgttttaaacaataacctttatttactagctagctactacacgacttatgttctagctaggtttgtcatttgtaggattaatatgagaaatcaaaataaagtttaaatcaaaatataggaatgaagaagacgtgttgagtaaatcatccttttacatgttaccaggagtctaaggaactacagtttgrgttgttccagatttgagtgtcatacctaaatttggctacttgtaactccagattaaatgcaatgtttcctttctcagtttttggacatcttacaatcataaattatccttttacatcaacttgcagcctttcaaaaacatatgttttgccaatattatttcttaaatgcttttagtattgtatcttcattttagagtgagaaatctgctactcaattcacatyaggatattagttgtcaaatattttagtactaatgttgtgrgggatggcggaaggcattgcgtggtggagttacactgccgtcaccttcaacatgcacgacgtaggccggtccacagggcgggtgtcgctcacgcgcttcatcgagaacatcgagtgaggtggtgtgctgctgctctaaagaagggaggagaggaagtagcgacaaggtcgccaagaccacctggcgcgatgtctcctaccagatcaccaagatcaacatgtacaaggtggtccagtctcgagccytctccctgcatgcttccattgatttttttatttcattccaatcgatttgtcgtgatatatgcaatgtaggatggtcggcatgtacaagatatgcttaaggtgaggttgcaattcaggatgtgcatatatttcttgggcttgaatttgtttaatctaaatagattattttttatccaatccaaatttccaatgacttgccatatcattagcatcagaggctccgtaaagcagctctgctgggattaacggattcactgtcaaggtcaaacatcactatgatattgctgagatggtccaatcagtgacaatgctggtggtattgttgtg

SEQ ID NO: 10553 - DNA, 460 bp, Zea mays
cctggtttattgtggaattataatcccaaacaactgtcatatattaatctagtgtaggtcgtactgcagtcttcatcrgtcgtcgtggcatccttgcttttcctcaatattcgtagcatcgttgatctcaacatatttaataaagaatcggcgaacgatttggattgctactggatggatgaatatttatagtgctaataacagaattttgatatatytgttccgtcaggaagcttggcgcctatatatctggccatgcaaacacagatgacgataaacacgtcttatgcgccttgtttcatgggatagagagagtacattcgaaaaaagaggatacggttggtactagataagcattatatatctatataaatagagatcctcccgtagctaaactctatcttattttctctcgcgttccactcctctctgttggctagctaccaccaccgtttccacg

SEQ ID NO: 10554 - DNA, 242 bp, Zea mays
tactcattttctctacatgttttgcaatccttgaaaaatcatgtttattggagcatcttattgcatatctgtttttgctcttctctgttcgcttcctattttttggaagcatttgctattctctatctttgagattatgaatactgccgaatccatatgctggaaaacaatttcttaattgtacccttttgtatattcaggcaattgatcacataattaattcagctgccaaatcgaactac

SEQ ID NO: 10555 - DNA, 1008 bp, Zea mays
taactcatatccggttagataccaactacacatattgaatagcataaatctaataaatatatggcgcaatgaaaatagtaaataattaaatatgagtaaataatatgatgacaataatgaataatattggaacatgtacattgaccctattttgctaatatatacttattatatttgcttaatttggtaggatgtatatgtgattgaggcgggtataaattatccataggtatgtgggtataaatagtctatacttatacccatactcatatacccgacgggtatatgattgtgtccattgccatatctgcgggtaaaaaactcattatatacttgtccttataagtaaaacctgttggacactagagtttaggtaccatataattattaattttgaacgaaggaagtaatttgcagcgtattaaggtgcttctggtctagaagaaatgtcacaatgtttggtgttagtttttggtgaaatttaaggttaattactttttgaaagatgtttccactaggtggaaccgaaagaaacggtgccaaacacaccttacaacaagaaaatatttgtaaaaaaattattttgaataagatgtctaaaaatagaaagcgtgtatactttaggacggaggaatacatatgtatgattgggaaaaccgaaaacgtacacctcctcgctgcaatacgctggtgacttggcagttcgatcgcacccagcggataaagatgagcacggagaactcacaaggcacagccgcacaggcaggcaccagcgcgaacgcatggacgggcggcccctgagacgtgccgcccagctggcccgctgcgcccacacgtggcgcggagctgcgcgcggctcggccacgttataagccacgcgcgctggccgtcgccgcacctcctgactactgcacactcgtctccgcagtttgaaacgaagcccgcggctactgcaagctactccgtctccgtagctaaaggagaggtaggtttttatttggcgacgac

SEQ ID NO: 10556 - DNA, 753 bp, Zea mays
gtagctaggtggcgggcggcatacccgctcagcaattccgcagctcattttccgtttttttaattatttttctctacgctttgcatatgtaatttcaaaatcgcatacatacaagtcgacagcgtagtttgtaaaccgaatgaacacggggcagcagtatgtacacaacacgggcagttcttgttatgtgagttggttttataactgatatctccatctgaggtatgcttgctttgcagagagcgggcccatcccatcccatggtctggagaacagccctgaaaaaagcgaggaaaatttgaagaaatcttgctacacagttctcactgatggctatctttgctacacagttctaatgacagtggaccaggctttctcctaactttcttgttatgcatgaggtctgtctaatggtatacgtgttacacccttttgatacctttcttggtcctctcctactcgactacagaacgagcgtaatggcttcctctccatctcacgccagtgcgttgcctacttgccctagaaccctcgccgccgcccctctttaggattcccatgtccctggtcgccccctggcacgcccgccccggatcctgcaccggaattccgtgtggaattccggacccgatcgaaatcgaaccgcctctctgcgtgcgcctccgaccaccaaactctctcacacgcgcgcgcgcgcacgtctgaggcggttggattctccggtgggggtcccttggtctcgatttgctgtgg

SEQ ID NO: 10557 - DNA, 1156 bp, Zea mays
tccacagcaaatcgagaccaagggacccccaccggagaatccaaccgcctcagacgtgcgcgcgcgcgcgtgtgagagagtttggtggtcggaggcgcacgcagagaggcggttcgatttcgatcgggtccggaattccacacggaattccggtgcaggatccggggcgggcgtgccagggggcgaccagggacatgggaatcctaaagaggggcggcggcgagggttctagggcaagtaggcaacgcactggcgtgagatggagaggaagccattacgctcgttctgtagtcgagtaggagaggaccaagaaaggtatcaaaagggtgtaacacgtataccattagacagacctcatgcataacaagaaagttaggagaaagcctggtccactgtcattagaactgtgtagcaaagatagccatcagtgagaactgtgtagcaagatttcttcaaattttcctcgcttttttcagggctgttctccagaccatgggatgggatgggcccgctctctgcaaagcaagcatacctcagatggagatatcagttataaaaccaactcacataacaagaactgcccgtgttgtgtacatactgctgccccgtgttcattcggtttacaaactacgctgtcgacttgtatgtatgcgattttgaaattacatatgcaaagcgtagagaaaaataattaaaaaaacggaaaatgagctgcggaattgctgagcgggtatgccgcccgccacctagctactacgacgacgacacgaggtgcgcatagagcatctggttccagacgtcgggaacgccggggaggcaccagtggatgcagtcggcgccgctgctggggtcgcgcgccctcgcttccagctccgccgccgtgggcgggctccactgccgccggtgcacggacgggtgcgcgtccttgcggtgctccgacagctgcgtcacgttgagcacccgcacggcgacgccgcgcgcgcccagccgcgccacctgcgcctccaccgcgcgcgcgaacgccgggtccgtgtcccgcccgcggtgcccctccgccgtgatcggctccatttcgccgtagcatcggtggttgccggcgccgctcccggacccggccgcctcctcccactcgtcggagtggaggtgcgtcggagaa

SEQ ID NO: 10558 - DNA, 1448 bp, Zea mays
ttgttctagatgttggatygaatacatataaaacttttagatgatataccatataatgaaattctagatctctaaaatatagctttaggcaatgttttttaaaatacaaataaacttttaatatattcatacttttgcaaaagtattttttataataaattaatatatatgactattagatttcaaaactaaataagaaaattgttatttgtagtcaaagttttatatatttaatttaaatcttgtccaaaacgaccttttgctttaggactggatggagtactatttggacttgaatttgactatggtaatacgaggttctatccagtattatgtttttgttagcaatattatttatgtatatcattaaaataattacaattaaaaattgtctattacttgttgcaaaataattctttgtattggattaaaagaaaaaaaagcgagaatgattggtagttatggtagttgaaataaaaaaaactctactatattaaaacatcagtttctatggcttctccatagttgtgctcctttgtgtttaaatagtaaaaatacaaaaaatatgcataatgaatatttgaattatgattgttggctctaaaacacattcacgctcacttaaccaatagaacacatgtctttgtgttttatattctatatataaacataaatagaaactatagtaacgcacgagtacctcgctagtattaatataaatctgatgtgacatatcttacgcctcgcttactttagcttattataggtagtgtatggttcctgagttaattggaataaaacggctctatgcaagggagcgactccttctcagagattttagagagctaaatagttcaacatttaagcataagggcatgtatagtggagttacacaaaaatggttttccaagcacaagagaaaactaagagactctaatatacaatggagtgtctataaatgtagtacactaataaatagagaagtaaatgtgcttgtatatcatcgaatcgatagaacagacgacgaattcgtacagtgtgaagtgagtgtaaagtgagacgtctattactacttggattacgagccagaaacgtcttttcacggagatacggctccacgattttttttaaactcacttgaggcacctcaaatgtctctagagtaaacaccactttccttctataaaaccaatccaaagtccaaacactgtcaaactgagagtcgaacagcttggtcccacactcccaccgtactcccaaacaaaacattctctcatagtctcatctcatgtgcacggaaaggcatctattgcctttctcccaacccgccaaaccctacttgccaccgccaaacttccgccttcgtccgcgccggcgccgctctatcgctctaaaataacctttccagttccaccgggactagctgaaaggagagggaacggaggggg

SEQ ID NO: 10559 - DNA, 75 bp, Zea mays
ctgcagcagcaaccggagcacggggaggagccggaggaagacgacgcggcgagcgaccgccgcaactcctcctcc

SEQ ID NO: 10560 - DNA, 588 bp, Zea mays
aatcaattcgggagttcacaggtaatcccagcagccccggacgaccggtcagcagctccaggccccagcaccagcaccagctccagcgctaagcacgggcggcacggccagcgcgtcgagcgctgagcccctggcttccatctcttcccagtcccagtcccacgcccgcggtccccgtccccgactccccgagagccgctgtgcctcttctttttccgtgaatgggaaaagctgtctgactcaccctcactgcctctgcgtgcgtgcgtcactgccgcgccgctcgcccgatcacgcgataaataactcgcctctctctctctcctcctcaggcagtcaggctcatccagggatcaggggacccgcccgccttgacttttcacgttgcgtttgagcggtgctgctgatctgcgattcctcctctctctctctctctccactccacacctgagagggaatcctgctccctcttgctccgcgcccgcggcggcggcggcggctttggtatccgtgcgggtgtttctgtccggcgtttacttgccgggccagcgcggcattggaggaggagggagatcggaggcgtgatcg

SEQ ID NO: 10561 - DNA, 705 bp, Zea mays
tctggagcttgacgggaagctgttcgtcaacacgcagcaggcccctacctggcgcgccaactgtcggcgtttcgaacccggggggtccctggaccgacgagtaaattatcgccgcgtgccccagcccagatgggtcggcgcgagacggagcgcgaaggggggaagaagccggagggaggcaggcgtgagaggtgaaatcccgcggccttcgtgtttgtcccgcgcccaggtcgggtgcgcttgcagtagggggttacaagcgtccacgcgggagggagcgagcggcctcacgcgagcgccgtcccgtccttccccgcgcggccaaccctcgtaagagggccctggatcttccttttataggcgtaaggaaaggatccaggtgtacaatgggggtgtagcagtgtgctaacgtgtctagcggaggagagctagcgccctaagtacatgccatcgtggcagccggagaggttttggcacccggttcgtgtgatgtcgtggccgtcggaggagcgccggagcctggcggaaggacagctgtcggggctgtcgagtccttgctgacgtcctcttgcttccgtaagggggctgagagccgccgtcgtcatagagcgtgcggggcgccatcattactcgtatagtggagcgagccagatgggacgccggtcttgttccccgtagcctgagtcagcttggggcagggtaatg

SEQ ID NO: 10562 - DNA, 486 bp, Zea mays
cctctagaaagttagtgccccctgctaacttcatacgaccacctctaggaagttaagtaacttcctagagtacttgtacaacctctagaaagttagtcgtccctgctaacttcctacggctttcctctagtaagttatatttcttaccttcatccctgagtctaccttcatccccgtcattctaccttcatccccaagtccaagccgctgcgccgtgcccccgcgccccaccccgtccgtcgtgcctccctctccgacctccttcgccccggcagccacgacgtcggtgcccaagctcgacaacgaacggctcggctccgacacaatgcatctccagctccaacgtcgtcgtaccctccgtctcccgtcccaagtgtcgctcccgaatcagattgtgttttgaaatgtttggtaggttctgtttatatggatttttgtatgtaagattgcattgttcttttgtatgaggctgcatatggcgaggcg

SEQ ID NO: 10563 - DNA, 1500 bp, Zea mays
tagattaggtgtagaagtccggaccttaggcatgaaacactaatactatatttcgaatatgctctaaagcttagcccaatgttgacgacgacacaaaaggatgacaatgcgttcaatcaagccacgtcgttgacgtacacgccgttatgcggggttgtatgcgtcgacaatcttggtaacaaaggtcctttgtggacgtgagtgttgtgcgttatattgggcatattgccgtatcgtcgtcgtcgtggctactcggtctagtgtagacggcacaagtctaaaaataccttgggtgtcaggctgtccgcagcgggcgactgcatgcccgcgctacccgacttagcgtaaaaaaaatgctgcagcgcaggactctacccgatactgcatgctctgcgttacgccatttctagcgctctctctcacctacgccaaacagaggcagtgcagctgcagcagcagaggtgggcccgcgactgcacgctctctcccacaatcgctatgaagtgcacgcaagcacagtagaaaaaataatataatatgtggtagttggtatagggttgggatataaagtaaacatgagtgcggatgattctggtatagagtaaagaattttgctgaccaggacagaatattctttttagggtagaaatttagagtagtatgagtgtggatagcytaaggaccactttaaatttgacacaatattgaaatttgaatggttttaacatttgaaggctgaaaaccaaaatactttgtagctaagtgttggaaacccgactcggccaataagtcgacagaccgtaaaataaggtcaatctaaactttatgataaatattcttgtttgatagcaatagcattgcaggaccaggacccaagggaagagaagatgccaaatcccatcgaggctaaagcaaaaacgatccaatttatgagcaaacccacactgaagtttcaaaattgttttctgaaaaaaaagtaaccagcaagttaaaaaatgagatggcgggaaagccaagtctcggttggtcgaggggttggttggggcgcagcctgacaagtgacaacggcagcaggatagtagcatcaggcgcaagccagcgcaggcggcagcgcgaggatttcgcttcacttagcggcaacggagacgctgcacccaaccaacacgagctccccctcacccgctgcgacgcgcgcgtcccacgagcggaagccccccgcgccgacgcgagcgcgggggctcgaccgaccgacccaacgcctccatctccaccgcgcgcaccaaatcgcactcccgtccgccccgccgatcgaacagccaccgctcacctctcccacccgccaaaaacctccggcctcctctcatattcatatagctagcccctgccacaaggtagagcgtcgctcacacctgcgtcgccctgcctcgcaatcgcgaatctgtcgagcacctgaggggtcggaggccgagagctagcctagcacgccggcctccgcgcgcg

SEQ ID NO: 10564 - DNA, 330 bp, Zea mays
gctatagctgttcgaagttttggcgctgaaatcggtaaaatttcatttctatacgcaattcagtcacctgcaatttgtagtcttgtggatgactcgggttcattgttttagtacatgctaatttggtgccctttgttgttttctcttatgtgcagaaagttcctgttgcttgtttcaaattgaaatttggatgttcgttcttcttaatttgaggcttacctatttatttggtgtctggttgtgtgcctttaggtatacattggttgttgcagcaagctggtttcttgagatccatattgatgtggtttgttctggaaatttttattcttc

SEQ ID NO: 10565 - DNA, 76 bp, Zea mays
tggcgtcgccgtcgccgtcgctgcttcttgggattcctgctttccggaggaggctgtggtctgtgctctgtttgac

SEQ ID NO: 10566 - DNA, 200 bp, Zea mays
cacccgtcacatttgatttgattctgtgcgtatgtcttggtttattaactaatgacttaatagacccaagacatgcacacagaattcaaaccaaaccaatcaaacccttttatttgttccatcatatctatgggaggaatctaattagtacgtaaccctcctatgatacaataataataataataataataataataata

SEQ ID NO: 10567 - DNA, 187 bp, Zea mays
aactgaattctggttagaagtgaaaaatgggtcaacctgttgggtgtgaaaaatgggtcaaccgttatcgattagtccctgttggatggagcgaatgcctgaaatttgttgcttgacttgcgagtacggtgtcaggaggtttcccagtgccttaatcttgcattttgtgttgtactagggattgctt

SEQ ID NO: 10568 - DNA, 953 bp, Zea mays
tgcagaggtatattattattaaagatgctgtgaacatggaagaaaggacaaacatagttattataaattgtcataggtatattattaaagatgcttttggattttgattctttcttttttctagagcaaacatttgatgattcgtctatgcatatatcttaagtcttattgacggttgatggttttgtcaggggttatgttgctatgcttcagaagaaggatccaaaactttgctctcatattttccataaccagccacaatatgatgagcaccatgattcgtccccagttttggtgtcgaagtatcatcgatgggattgctcaagatgtcttgatagtgtggaagtttcaggccataggccaacatcggaaaatgtttctatgcagcagaatggaatgaatgatggctgctctatttcaattgttcggattttgcctaatagtgttgattccagaagactgttttcttgcacacagcaatcatctcaagggaatgatcgattgaccctttcaaagactgcccaaaaatgcaattcaaaatgcagttctcctggcaacaaagcaattactgcgatgaatgttccagtagctgaagaaaatgttccagaggcactcgttgatacgagggttccatctatagaaggtatggctgagcatgttgaattcttaattattactttttgttgtatacaacaagctaatatgacagtattttctcagttttacaggcctctcccaatagtattgatttgtcagcaaatatcttgaatgctgtctcgaagaatgtcagcgatctacctgatgatgttgaagaaaatggcacacagaatccacacagtctaaaaccttgtgtggcgccaaatgaagattagaataacatagctaatgatgacctcaatgagcctaatgtatgtaaaccagtatctgggcacaaaagcaaacaagtctgcaac

SEQ ID NO: 10569 - DNA, 1500 bp, Zea mays
tctaaatggttacgttgatcatcaaacgctaaaagttgctttctatatctttataccatttgacaacttttctatatccgtgttctagagaggtattctcgctctctatctcttgctggtgaaaaattaaatctgaaattttgaataactatatttttttatgtttaattgaagagcccgttgaaggacacattttccatcaaagtctctaatactataaaatttaataataaatartctcttaaagttgctctgagtgcctatgtaatttaaataggccttaaacattggcgctaataccttcaagggactgaataattgtacatagcaattttgaataattagatcaccattcccaatggacttatggaacaatgcttttaaaaacgtgacatctctgtgagaatttattcagtcccaagtattttaagaattgtttaaattatccgtgctaacgctatgatcttgtgaaggaaataggtcgacgacaacagcgatgacaacgacggtgcgaggggaggagttgatggtggcgacagcgaggtgagtgagagagggggagggaagggatgaggatgatctaaataayattgtccactagatttgagtgaataagggaggtgggttatctagcgaagtttaaactgatggtctatatagtggtatagactggcatctcatggatgggagaggttgacggtggcggtggcgcgagtgaggggaggggtgggatcgctggggacagagagagatgatagatgatctaaataatattgtgtattgcatttgagtgcgtaaagaagatgaagttattcagcgatctaaatctttgttttttatcagggtacaaggacgtcacgaacgcacaccacatgcacatatatgcgtgcgcgttaataacacacacataaatagattgagaggcctagacctctagtgcatgagaacacgcaatactgctaaacgcacatgtgtgttaccctaaaacctgagaaaattctcgggtaggtgggaaaatcctaggacgagcagggatcaaacctaggaccatccgctacagggaggcagacaaccgagctacggctcgaactcctaaatcattggttttgatggtgtattaagtttgagtgtaatttctttggtggatttagcaagagttaggtgatttggttggatgggtttgacaaaatttaaattgatggattatatagtggtatacatataactaatataactaattagttataacaattcatatgaatattaaaatttcatttgaatctttttatgtcataaataaattgcaaaaaaatatataataagatgtgattgtccttcagtgcactcagccatcttcggaaggttaaatatacgccaaaagaaattttcgaggaattctcttttttccccctggtcttcccatactgtcccaaaacctaacaaaacccccacgccgcaatcaaataaataaataaaaacacgccgccaccatctccggcg

SEQ ID NO: 10570 - DNA, 1500 bp, Zea mays
tttataggtaaccgagggtctgccctgccttgttaaagacaattggaccctcagttacctaggttatccccagaatattccctcttgggggttatggcgggtcattacagagtaatcaattacagacatgggtcaaccctctatcagccttgccagcatggcggcctgcaggcgggaccctgtaatatggggccgaactatacatgggctgtaatatccacttttgtaatcagagtataaagaaaattatattcctgtatacatatgtgtgtcatccaagtttatcatttcatgagcacatcacatataacaaacaactaaatgacaaaaggcacttaaataaaatatacatcatgctgagatttattgtgtgtgtgcatttggtgacataaataaatcaacattcaaattgaggatttaatacctactttgaataaatagaatagaaggagagaaatactataaaatacaaaataaaacttataaaaaaaatcatattggcaagttcaaatttaaacctaacccaaggaaaaattttccacaaaaagaatttcttttagaattaaagtttttgaatttggaaaggaatgaaagaataacaaataaaaaaaagaaagcagtcttcggccgagtgggcctctattccatgctttcggcccatcttcggatccagctcacgtagcccaactccattttgccaccaaacatctccaccgcgcgacctgcttctcttttgggcatgcggacctcgcaactcagtctcctggcgcgcgcatagtaccattaccatttcactgacaggtaggcccatctgctcagcttcgtcaacaaactcgcggaggaagcgcggtctggtgcgatctcgccggaatccgttgactggcttcggaccgagctcggcccttggtggtataaaaaaaaagaagacgttctcgccagcctagctctatcctacacgcgcgcgcgccgcatccatttcccatgccgctgacgaatgggtctgcgctggcaggcttcgtccccaactgattttcgccatccgcgcgcgggtatggtcaagatccgctcgaccggtcttctccatgctcgcattggggtgaagctaatcccgcatccatcgcgggctcaactggtcagcgcaacagacgacgccgatcccgcgctggccgtcgtggcttccgctgcggaccaactacctgaaccgcgtatcgctgcagcgaagtccgccccagcaacagctcttcttctcagccggaagattaggccaggttgttgggtcgcccggcaatcgcgctaaccacagctacacctcgtcgcagcttcaaaagcggacaggcccctggttcttccccaagtcgcgcgcacctagcatcccttggccacaccaaatccgaccctgagccaaaccagtaaagtgctgtgtgtttgtcacggacagcagtgagagaaagcgaggagacatggactgggggaagccgcctccgtcattcatcgtccaca

SEQ ID NO: 10571 - DNA, 540 bp, Zea mays
tatccacccctagcgggggcggggcgcgtgatggaatgacgcttggctttcgaggcacgcggatgccagatttccccggatggggcgtgtgcggctgccggggccgcatcgtgtgcacgccaaattctcccgtcctcgacaccagctagcgaggctacgcagcagctgatgataccttatcccccgctggcactctggcagctagctattacccccctgctgcgccgcgcagccttctggtctacccccgttggctgcttcttctacctaccctcgccgtcgcctcaacttcccggccgccgtcccctccgatcaccagctgctgcttgtgctgctgagccaaggttagttccgtggcatcacgcttcactgttcgagtgcttgtgttcttcttcttgtgcttgcggttggttgtatccatgtggctagcgctagcacgtctgtgctggtgccagcttgctcaaatgtccggagaggcctagttcgaccgtcgcagcctaataacgatcaccggaatgtgtccgtgcagagcagctagcg

SEQ ID NO: 10572 - DNA, 169 bp, Zea mays
actgcgcatgcggcagaatcatggatggaatggacaatggaggttggatattagaattcacgagtagacgacgagatcgtcgtgagttttctccagtctcgtatttaagtatttgtataagcctgcaaatataatgggcaatggctgatgccgccgtccagacccagcc

SEQ ID NO: 10573 - DNA, 1500 bp, Zea mays
gtaccgagtgggacgacagtcttgcgagaccgtgataaacgaggctcgctatgtttcagccggaagctcgatagtggaggtggtggggagcatccgagaggagccggaagcggagcaccacttgcgcgaggagaagacccgtggctctctacgaagttattcgatcgtggtgcttggtcctcgcgtggactaccctttgcgtagggcaccaataaggattagtcgaaaccttacgtggttccggatacctcggtaaaaatatcgacgtcatccacgagaacttgctttctctacctttgctctttacctttcacatttatattaagcacttaaatttcagtctctcctattttagttagaatatttaggattgaaacttagatagcaaaaactctttttacggtagagattatatcacttagacaaaatctagtttaaatattctagattgcttatttgcatatattttattttagagatttatttgtggccttgtttaaaacaaagtttttagaagtcataatttattaccttttagacgtcacttttcctgcatgagcgagaggagatacgtgatctgagccagaggagatacgtgatctgtttggacttggatatgggaagggcacgatggtcaattctggtggtctaaacaaaaaatttgagaataaaaaaaatcatgaaatgaataaaaggagagaaaacatctaaattgaaaaattcgcagtgatggatgtcaattataagaagcacacgaatgtgatgttaatgtggtgtttagtttcttggattaattttagtctcttcgttttattttagtttataaattggcaaatacagaaattgaaatagagttttaattttcgtatttgaaatttagagaataaaataaaataaaatggctaaaaattagtttacggggtgtttgaatcccttaattttataggaattgagattcactcaataaagtaacttatttatttttgaatttgacattacaccactttctaaagttcagatataaaactatctcaaatttataggatggaggatggaaaataattttatatattagtaaaatttgtttatactatgtaatttatatgacactatttgtctcactcatctatagtaaaaataataatagtaatatacaaatacattctgtataaaatcgaattagcttaattgatatatactaaaattattattattaaaatgaaattcaattccaataattaaaatggggcgctatagaaatcaaacacgctctaaattatacgaggcatgcgaatttgacgtcaaatattgaaatttctccgtggggccagccgtgggaggccgagcacaatcgtgggcctggaataccacggagctgctgcatgtcaactgggaaagaagagaacaaaaataaagcaagaggcgagaggagagagcaacgacgccatcggagggaggaaagagaagaagacgatccgctagcgtgtgcgtggcgacgag

SEQ ID NO: 10574 - DNA, 305 bp, Zea mays
gggggagaatgatggaataagtcatgtggtcagcagcagttgcagcacaacagtcttttgattgcgcaggacaacatgcaatagctgtcttttgactgcgcaggacaacagtagcaacacaacagtcttttgactgcactttagtatctaaaggacagcacctgtgtgctgcagtgtgtagtgtaatgtgtagtgcagcccctagggctataaatatgtgtccccaacccttctaagggtatgtcatttgagtagtgtgtgagaaataaacgaaaattgccccaactcgtagtgtcatcctctgg

SEQ ID NO: 10575 - DNA, 1500 bp, Zea mays
ccatttttagtccaaattgagccattccagtttctaaaattttgtaatattattctttaacacttagagtcactgttttgacatgaactctgttagaaaattaatttatcagttaatcctattttaatcacattaaacattaggaaatccataaattaaaatctatacctccaaaattaataattccagttcctgtgatctcattttagtgtctagattattactgtgtattttatttacatgtttggtgtaatgttaattttttgctatactatgtatgtattgtgttgatgcgagtagacgagcaagctacagaggactccggggttcagctggtagagactgctgagcaggagctcattgaaggcaagttgtgcccttgatcacttcttttacccattcatgttcttattattcataatgatctgcataggttaattttgatgggacccaataggataccctagattttgactatctttataccttgtttcaccactggttttactactaaacttttgggtagtacatgctattgctttatatggttttgggtatagagatattcactactcatgattacacttgttattatctgtttattattattattcatgataagatcattatgttaatgggaacatggagaaccacccgggaaaacagtgctaccacaagggtttaatgggacgcccttggctgattaactaggaaagctagtggagggctaccttacccgaaaggggcaagggcagtaggggagtggtcagtgtagggaggtccttgggttgattttgctgcgatggcggtcaggcaagaaccctgcactggagcttcctataaactgtagcgggtagtctgaagctagtggaactttgtaaaggcctcgtagtggtaccctgcctcgcttccttggtagaggtgtatggggtctgatcaactccgtggcaaatgggtaacacgacttgtgggtaaagatgcgcaacctctgcagagtgtaaaactggtatactagccgtgctcacggtcatgagcggctcggacactcacatgattaaattatggaacttaaactcaatctgtcatttcattgcatctgggattatttcattattacttttatttattatttctaagggttggtatttacttgtacttagtaattgctaataaaattttgaccaacttataaaagcaatgctcagcttcagcctttatttcattgatcagccttacacttcatgaactcccacctttggtgagttcatgtcacattattccccacaacttgttgagcgatgaacgtatgtgagctcactcttgctgtctcacaccccccacaggagaagagcaggtggttcaggaggagccacaaggcgaggagtttgatctgatctaggtggcgtttctcagttgacatctgcgccgacgatccttagttcgttttatactcattattttattttgtaataagtcttccgctatgtaataaatactctg

SEQ ID NO: 10576 - DNA, 781 bp, Zea mays
tccctgctggctgtggctgaggttgtctataaatccttcgagtgtgttgattaggaggcaaatcaattccaccaccccgcctggtattgaccatctgagttagatacatatggtaagaaaatagtagccaaggcagtaattacaatcatgtttctttgggggatttattagctaagtagattagtgtgtcacctactaaagctaatacaataccttatagtggtacatgctaagatgtccatctatactatttcaatcaatcaaagaagcaaatcaggcattgatcatcagaacaatcaaccaacattttaaatagagaaaatagtttttttaattttttttgtcttaggcttcctatctcttaaaaatgtcataggggtagggattccaaggtgtgaaatccatcttgtatcagagtagaaaaggtaagaatgatcagagtagaacagtagaagatgagacaggatcaaggtaagtatagagagatttagagtaaggtaagtatagagtgaatcagagtaagataaataggtaatggtctgtccatttctatctaggtttcgtcctacagtcaacatttcctctgataccacttctgtcacacccggttttaaggaacaaagccgggtgcatctcatacatgcgccaagaagacaacatatataataacagagtgtatagagataaatgtcataaaacatcagagtatttattacatagcggaagacttattacaaaataaaataatgagtataaaacgaactaaggatcgtcggcgcag

SEQ ID NO: 10577 - DNA, 391 bp, Zea mays
ctgcagcagcgatgtaaacccacggccggttgcagacttgaccaccactccaccacctgccacagcaagtcccagttcccacgggacgatccatccgtctcgcccgcgcgctccgcagccacaagcgcaaaggcagagcacacagttctgtgtgcttggcagtgcccaccacccgacgacgtccccgtcgtccaccgggccaggacgcggacggctcgcggtctcgcccggccggcccggcccttccgatccctcgcgccacgcccatctataaatacatagctgcgcgctgcggagctgagagcaggcaaacaccgagcgcagctagcatcatcgtcctgagctgcttgcatctcccagcggccaatcgagctgatagcctatccatcat

SEQ ID NO: 10578 - DNA, 1500 bp, Zea mays
taagcaataatcgccatgcaaaagtttttcgattcctgcttgacgtcctaccagctaaggatgaaaactagaaaccatctccgttttcatccctgctaccagcccacactcaccctgcataggaatgttagtaggagatgaatctgttgcagcttcagttgccagcatcttctaaggactcttggaatggaagtgcatctaccatattaccatcagtggttaacttccagcatcagatatatatcatgcccgtacctacagtgatatgaatatgcaaaagaatatctatagcttgctgtccaaaaagagtaacaattttgaacatcactttttttttgcatttggcgtccataattctgataaattgtcgtagacgcactagtagtgcagtggcaaagctccctggtccttgcaccttattcaagtgggattagtctctatgtcttaatcgctagctagtgtcatgttctacaatctgaactggttgtcatatcataattttttttagaaatgtcgttttgtcacgttccgatcatcatcgaccgacgtacaattaatcctatagtatcgcttgctgatggactgatgaagagttggtgctacgctgatgcattttatagatgagaactgacaactgagaaggaactgatgagaaatagtagaagagcatgaggtccaactctgcaagtgcatctatcgaactctggcggtctagagacaaaggccacgagctctgaacatgcagtgcaaacaaggagaaaatagtgtgtggttttgattagattgctctggggccatccgtttgggtacttgttggatctacatccaccaggctaagatattacagtatgctgccatactgcagtgctttatgctgccatactgcaatgccttgtgctgccataccacatggaggattgggtccaaactgccagtaccaactgttatggactatgactctaagcgaccgcattaagcttgccaagcagcccacacaacttggtcgacagctttatcgccccttcaatctccggtctgcagctggactggatcactagcacgtcatgtgagtgagccctatttcgcagcatgccactgccatctgattgagacacatcttccctcatttttctgtgggcgtgtctaggtttcagtaggaaataaaaacccaagctgatccgctgaacatttctggccctcaccacaacggcacaaccggcaccggcatgtgccagacactcggctggcccccaatcagaatctcatccaaatcgttcccgcagacgcgtcttgcaacaccacacccgccgcgctcgtggccatgtcccttgcccaaccatttcattccagcaccggactgagctatatatattcagggtcaggtgggctctgaacatcatcacttgcagcttcacaagcaaactaaaacacagcagctaaaggcacagctctccagcattcatccagaaagaagagaaggaaccaagccaacagccaacc

SEQ ID NO: 10579 - DNA, 1266 bp, Zea mays
tggtcgttcccgtcgacctcctgcgcgctttcctggcaagaagttgagagaacttgagctagcttgtttctaacaggtggagtggagtggagtggagtgcttcgcttgccgatggacttactggtagagttttggtgctaagcccgatggatttataggtgaggaagtgaatcaaggagaaatcatgggtgccgttgaggtgcagctgtccactcgatccggctgtgaagggacaaggccacgagctcgcaacatgcaatgttgcattgcaagagaaaacgagtgtgtgattttccctggggcctgggccatctgtgttggcacttgttggagccactagtgctgcagcattgtcgggcgtgcttcttggatatagttcagtagagttggataccacaatgcgctgccatatggtgaccagtcgtgcccaataagaagcacgcctcgtgatgaccacatgaaaattgggaccgacgcgtgtcaggaccatctctatgtgattccttcgctgagatatctgggcatccgaattgggtgctcggactgagacatatttcctgacagttgcccagtcccaatccgtcccatatcatgcatgcatcttgtatatctgaacaaccggagtggaaggtccaaaacaacttgctggacagcttcagatcacttgttcaattggcttggcggtctgttggaccaccggcatctcatgtgagctccatttcgtcacttgttcaactgtcccatcgactgctagctgaagccaactgcagtggtgtttggtgctatgatatcacgatgtgctgctgccataccgacctgtttgatactccttgctaagcggccttccacagcatgggtcatgaggaccacatgtaaagtaggtccactttgtcagttccagaccttgcacaccacatttgtttctagggcacagatcagtcggtggtcccaacaaacaaacatggggtcctcgtgccacttcccagcaccgaaagcacacaccacgagaactcagcaccggcaccggcacgccaccagacactcggccccatcagagtctcatccaaatcgtactcgcactcgcagacgcgtcatgcaacatcgcactcgccgtcctcatggccttgtcgcttgcccaacaatacgatccccattggactgagctatatatccatgtcgaagtggtctcggatcggaacaccatcaccaatctcaactcagcgagctctccaccagttttacagccaagaaagaaaagaaccaacc

SEQ ID NO: 10580 - DNA, 1500 bp, Zea mays
tccaagccaagagaaagggagggaatagttagcttgccttaaatttccactgatagtagatattccaatgcctattgtatattgtatatatctttgatacatagtctcaccatcagaaagataatataaggtattacgtactctatggcccaaacctctatagagatatttatgttactatgctcatgatggcatgagttgttagacatactctacgacatcaagactcactctctactctcttgatcaaatcctcttcagtaccttgttaccttgatgttgtcaccatgataaacgctctggagcacaagaggtcctatggacttaggccgtgagcgccacgagacacgagtagctccatagacttagctaggacacctcgagtcacagaggatctcggtctttaatctatctttacaaactgatttcacaagtgcaaaagtgtccccgacatcaaattaactcggtcccctagtgatcttagcggaacatgatggcgtagatattattttagagtacacaaatattaatttgttgagaaggttaagctcatgctcttattggggcaaggtgcatgtcctttagaatcatggtgtgaatagctaagcactgtgatagctttttatattaagatttttaaatacatcttagtaataacatataaaaacatgatctttctagcgtactgataattatgtttttaaaatacgcttgtaaggctatctccagttgctatattattcttttcaaatgtcttatcttctattttaaaatttactctctaatctataacaaaaaccatctattttatacgatctgaacagtctaaccatatgtacatggaatccttgtacttgtacgcacctcccctctctctcctcgaacacagacacggatacaccattgtacatgctcgctcttcctcttggagtcttgggaccgccccctcccctcttccgaggtccgagcctgatccctccttccttccgtcagcgcacatctctagggttttagcgccccatttccgcaacgccattcccgatcggatcgcccccttcccacccgccgccgaccagatcccggcgcgagtgctacccaaccctccggcgccgccacccttagtctcagagggtcggtctccaccgaaagcttcgcacaaatcccctccgtttgtcggtgccatttgttgcaaagattgtgttttcctcctcatccgtgcctcgcgttccatttctgccgtccccgaaaatgccaccgctttgttgagatctctcgtttctcgatctgatctcgcctcggtatggcgtgagagttcctaggggagggcaaaatcgtcggagttgagattcttgcgtccatttgctagtctcaataccgagcatccgatctcgaacagtgagacaaagtagcgacctttgtgccgttccttgtaactgagcttgcccccgcctgcgtatcggtgggtgacggcgagctctacggcgctgcccattcctatga

SEQ ID NO: 10581 - DNA, 196 bp, Zea mays
gaagccccatatgaacccaccaacctcacgctgcattctgagttcccaaaagactagactgcttctttagaaaattgttgtgagttgtgactcttgtgtactctttgcttccgaagaacttctctatggtctctccgacgaacagttgcagttgcttgggtttggaccgactatttatcatgtgattgcgaacata

SEQ ID NO: 10582 - DNA, 1464 bp, Zea mays
actgtggcatcactatcagacaatctagtcactgacagataaccgttgttgctctctcaccatttttcatactgctatgttaccactgggagctggaacatgtgccctggagaaccacaaggagattcattttacaaaacaccaaacatatgatggagattttctcctaggcatgttggtacatgcacttttaattatccagctagaattggatgtagtatactgaactaagggctagtttaagaatcacattatcccaaaggatatttgggatatttccattttcctaaggccccgtttagatatttggaattgaatttcattctaataataataatttaggcatatatcaattaagctaatacaactttataaaaaatatatttgtatactattattagcaagatgtcggagataaaatatatttatatactattattagtaagatgtcagagatatttatgtactatatttttattaaaaaggagtgagccgaagagcaccctataagttacagaatagaatcatattctactaatatataaaatcatttcctatcctacatctataaatttgagatagacttatatctgaacttgggaaaatgatggaatatcaaatttcaagctaaataggttactttataagggaaattattcatttttttagaagatatgaatcagttggaaaaaatggagttactaaactagccctaaatgctcccatcaaccccgtgatatgttgggcgaggatatacctcctgaatcgtgcaaattctatgcatcaatctcacgtgccaaactaaagtttcataacaagtctacaacgtgtcacgcgacatgctagcaccccccatgtcagtgtgcaaccgaccgtggaacgcatgtacgtgtctcgcaaacgtcgtacgaactaactatccgctttcgaatgttccgatctataattgaatcatccgcactataactgaagctccttcaggagaattgagggaggttgggtttctgttccttacgcgagccatccggtgttgctgaaggtgtggaagaggagcgtgcggcgccgatcggcgtcgcaccacgcggcgacctgctcggagaggtcggcgaccctgcgctcgacgcggcggccgaggtcgaggccgacgagctcgcgcacgggcacgacgaaccgcaccgcgccgaccccgcgctcgcggtagaggtcggcgtagcggcgcaggtgcttctggcgcgcgccgagccagccgagcagcacgaccagcgtggcacccccggcagcaccgccgccagcgagcggcgagggggcggagtcgcccgggggcgggtcccactcgatgaaagggtcggagtcgggcggcaggaggttgaatggcacggagcccggaggcgcggcgccggaggggacggatagagaggcggcggcggggcaggcgaggctggccctgccgcgaaatgtcgcggg

SEQ ID NO: 10583 - DNA, 66 bp, Zea mays
agtgagtgacctggggtatactatgtgcaaatatttatcacaaactttttttgtcgtccagaaaat

SEQ ID NO: 10584 - DNA, 962 bp, Zea mays
atgaatcggatagggttttcttgtacagttctgaaccttttctaacacctgttgtatgttccttccctgaccaaaccagtagcacttgattcacccgttgtttcacgagtagtttggtgttgtaggcctgtagggttctttcagaacttctgcacttctgatacaaggttgtttcagaacctgcatcactgtatgctctgattctgttctctttaagggttgatttggtgacaaggagatcctgagaggattggaggggattgagggggaaataaactaatttcctcctcaattccctccgatcctcccagaatcccgggtcaccaaatcagccctaataatcctacgaaaggatggcttttggtttctgttcatgtacatggaaatatttgcaatttcgccactcccaactgttgacactttgctattttgctatctctgtctatgatttgtgggtccatgtctatgatttatggaccggtgtcaaattagcaaagaccactgccgatggtgtattgcttgtagatctgttccatgatctcaactgtcacagaacacagaacttctgcgatatatgattgattttcctaaaagaatgaatttgttctccatctattcatctaacatggaaatgttctgtttcaggttaaatcttaaatcctcccggggagcctggaggccagatatttttaccaacgaccacaagcgcagatgggctagcccaaaatcgtccagggcccaagaaaacgaacaaaagtgcacgggcttcctctttcctgccaggagaggcacccacgacggcgacgcattggattggcttgggacagaacgagcgacggcgaggagacggcgataagatttgctacacctcggactgtagctgggagactgcacgaacggcggcgtccacgagtcacgaggagcccagaggcttcttcacagcagcagcggcaggtccgctg

SEQ ID NO: 10585 - DNA, 125 bp, Zea mays
ggtaggcctcgattgtcttgcttggtaacgtagatgatgatacagcagcacaatttattactgtttgacccctgattgttgcctctgcaggcaaagccagcaaagttcagtattacaataacccg

SEQ ID NO: 10586 - DNA, 220 bp, Zea mays
gtgagggtccggctcgggcatagctttccccgttctgttggaatgtagcagcgttgtcgaggggttttgatgatcagatcagccaattcttctctgcttttcctcatgtacacgcaaaacatggtctcgttattttgtgacggacggacggacggacggaaggagggtacctactctactgaaacagctcataattgtgtcctatgccattacaatcaca

SEQ ID NO: 10587 - DNA, 1097 bp, Zea mays
ctcggtacccctggtagatccgttgacgtgatgccggcgcccatgtgctttattacggtgtaaagcgcttcgtacaaagaacaaacaaatctgcgtaaccatcatttagccaaaaccgcacgccggagcacatggaagacgaaagatctttttttcatcctctataaacggcgggaatctgctggccggggtcagcgtaggtcgacacctcgcactcgcgcctgccgtgccgtctgccgaacaaaaaaagcgtgctgtgcctgagacgccgcgccctgggggctcgatcgccttgccttgcccccacggcaggctctcttccgggaggcatccacgtcgcgagaggaactgggatgatggagcggcgcgccgtgagattgcccgtgaagaaggtatacacagtacgcacgcacgattgaagaaaagagagtgcgtaacgcgacggaccaccggttcatcagtccctcactccttccagatcagatccaggccttatccgctggagcagtgagggaagaggggcaacggaactagtagtagtactggtcagtggtcacatgcggctgcgagggaggaggggcagggcaactacccagcagccggctctgcacgtggttaccaatcagacccggcggccggcgcacaagtgttgagaggatgcacctgcccggctgcgagagaccgcgaccgacggtctgaacccgtcgtcgcagccgcaggtagtaaaaggcagcaggaagaaacgccggaaacagagcgaaaccccacgaccagagccgctcctacaagttcgttacaccttccttctcaggcacgggcgctgctggtatgcgggcgacgtggctttcgctcagaggctgccgcgccgcgcgcacagaagcaaacgcttacgcacgcggctatttccctccgccacccctcggtttccgcacgtgtcccacgcccccgcgctgcccgtagaaatagaccttcccctcccgggcctcccctcgccaccacagtgccagacgcacgcaagcacaccacacgccctcacaactcgcatccatcgggcctcttccactccacatcgggagccgcaagcagaagcagaacca

SEQ ID NO: 10588 - DNA, 550 bp, Zea mays
aaacggagggagtattaatttacgggtttgatgtcagcatcgctcagcagggcgatgcaggttttggctagcttgcgttttactgtttgttacacgcacgctggcatggaaatggtgttaccagatgcaatgcatgtacagtactccctacgtcttaaatgatagattcatacaatactttatgtatctgttttatatgtgtctaaatttatcttcgtccagacatcaaaaccaatagttaaaacgaccgacgatggagtattattttaccgtcatatatatacactaaggcatccagtatctctagctagttttcgtcttgtttgcactgttcgatatatagctgcagctagcagatacatactaacatacagatgtgcatatagctcgtctctatctccatttcacttctggaagataatttataaacaatgtatatatacgaaaaaactttaaccacgtcttgcgacaggggtgcaggttgtagcccgacgattagagatagatagacggtagagcaacagctagctagaggcggcggcaacagaag

SEQ ID NO: 10589 - DNA, 584 bp, Zea mays
agttttcaaccattgcattcaatacaagagctctagactttactccaagacacaaccaagagatcaattcctctcccacgtcgggaatcactctaaacatttagtgactagtgagagagagatatttgtgttcatttgagttcttgtcgcttggatcgcttttcttcttcctctttcttgttctcaagcaacttgtaatcaacgcaagagacaccaagttgtggtggtcctgtaaggggtctaagtgtcccgtttgattgaagagaaaagctcactcggtctaggtgaccgtttgggagagggaaagggttgaaagagacccggtctttgtgaccacctcaacggggagtaggtttgcaagaaccgaacctcggtaaaacaaatcaccgtgttatccactttatttgcttatgatttgttttggccctctcttttggactcgactttatttctaacgctaaccccggcttgtagctgtgcttaaactttataaatttcagatttgcctattcacccccccctctaggcgactttcaattggtattagagcccggtacttcattagagtctaaccactcgaagtg

SEQ ID NO: 10590 - DNA, 660 bp, Zea mays
tcctgttctttgattaggcgagtgtatcggccacctagctggagttactctctgacagagtccatatggtttaggatgtagaaaatgacaatttctactattgtaacgactcggccgattctatgttcacgttgattttgtatgattttgactaaagttatttttataaaaataggctcaaaagttagacatttaaccgtctataatatcttctagttggcagaagctgaaaaaagctgaaacaaacatcattgcctttcagttacagctacatgacagaatgtattactgataccagattaattagcgagatgaggcaaaacaaaaacacggttgaccacgtctagccgggatcctgttggtttggtcagactcagagagatggtttgatttgatttggtgtccgtccctcacctcttgcagtcttgcttgcttgtcgtctccatccgtgcatcgtcttcctcctctacctcctctcttctccttcggctgggtttgggttaacaaaggcagagggaccagcggcagcgaaggtcaattgcatcgcatcggatcagatctcgactcaattcccgcggttaatccacatatcgactcaattcccgcggttaatccaccgccaacacctaagttaaaaccacggcggcggaggcatcggcc

SEQ ID NO: 10591 - DNA, 577 bp, Zea mays
agtggacagtaactctgctcccttttttctacaaccactttgcagcagagtgcacctcaaaagctatttgctggaactgcaaagagcctgagcacatttgacatgaaagcttgactgaatgatattttgattattgctttcagctttgactgactatgatattttgagtatttagtcaggtataaaataaaagttgcatgcttagatttgacatgcttagatttgtacgaatatataatatcagtaatcagtatccattgtgttaaggtatgtcattagaacaacagaacagctacaagaattgacagccctgaagaacaaaaaccaaggaagccattgttgaagcagagcagctacaagaattgacagtcctgaagaacaaaacccaaggaagccattgttgagcgaaccagctagctgacaatggtacacacaacctaaagggaatgaagcaccctctgcttctcttctcttgctcgcgccggtgaagatccagccgttgagtgggaggagaagaggcagagctgagcaaccaaccggaggctgggacacaagaaacaaattcgctcagatggcc

SEQ ID NO: 10592 - DNA, 1468 bp, Zea mays
ctgaactcaagaactgacatctggtcatcagagatgttcacaaacgtcctgccaccactattacgcaaaaatatgcttatatccatttctctattttgtacccatagtcaactagcttcctcatgcatttaagacattagagtttaatactagcaattctaagggtctatttggttcaacygtagattatagaaaaatctgattctagctgttagaaaactgttgtgagctgataattatgaaaaaaaacttaaatttgtttggttgaaataactgccaactatagattttataagagtgtgacaacttgtaacatagatggcaggaatgtgaatttaggacagaaggtgattctgaatagaactagagaaatatataaattttcagaaatctattctgttgttatatctgtttggttgagattctaaatttttggcagcaaatctggttcaggaagctgaaccaaacacaccctaagttcgtaaattttctgggcatggttgtagtggctccatttcaagtgaatagatttaaagctcagatttagtaggatcatggttaggattgaagattgaacttcaactgtactttggtactttatttgtggagattaaggcttgcactttatatttctggcgcaacatcgagtgtggcaacatttagacctatggtcacttaaaattatttctgttcagttttcgttccttcattctctatatatgtttgtctgtagaaatattgtccaatacctttagtggattcaattaattatgtgttgttcgctgctgctaacaacaagttcagaagcccgttttactcttgtcttgaactcttgaagcgacatagctttagtttggctttaaatagctggcacgtcgaatgataactcaaaagttctatatgaataatcctgatccaaggggtcttccatataattatggaaaagctccctgaggactgcaatcttctatcacattatactgactagactcttttcttgaaaggtggttgattcttgatggttcagtcagtttttgatcatttaaaactctgtaaagcaaacaaatagcacctctgtgattatttcatgaattaagtttagttttgacccttttcttttgttttggtggaaataaaccaaacaaatatcacttctgtctgtttcccttgctctcttattttatggtactaggttcctgggcaatggtccatttttcaatggtttgtttagagttagtgagaaatccaattttcacaagggagcacaactgggattgtgcatttttgcttgttctcatcatctcaggatcgtataacgcttttttggtgtgctgctttttgaaattagtatgtactaatatttttatgtttcagtcacagaagcgatgtgccagatgaattttaggagatcccatggaactggggccatacccagagcgtttttggtgatccattctgtagctatttc

SEQ ID NO: 10593 - DNA, 434 bp, Zea mays
tcgccgtcgcccgtcgagagccgggagggaggagggtttgggtttggctgcgctcggattggcaacctgggaacgatggttgggggtttcggtgccctagtatagggtgcgggttgccgagacggctttggggtggtatgtgccgttggatcttgcatcgttttacggtgaggagtacgcgtggagcgggtcctgggccgaacgcccgaacccgtgcatcacaaaggagcaaagacgacaataatttgtttctgggtcgacaacaatttgccgggcacacccaagacccgcggaagccacgacgacaagcctccatcgcctcttgttgtttgcgggccccatacgtcagagaccacaagcccgaggcttaactctccctgccgctaatccctcgcgccgccggagggaagcaagagatagatctgtccgcggcc

SEQ ID NO: 10594 - DNA, 1500 bp, Zea mays
ttccacatggattgagaccacaacgaacatgtccttatatagttcaacattattgctcatagcatcgacacatgttaccttgaagctaaatcacggtgccaagatatgattaaaacatataaaatacaattttagaatgtctaaatatgttttttaaatgtaaaaaaaattaaaaaattgtgagacttttgctgagacatagggaacagggcacggatgccggtccgcgataactgacaagggagggcagggcgtgggcgtagcatgccgtagtgactactgactagtgactagtgaggcccaaacggaaagcgaagatgcccttgtcaacttgctctgctgcataataaagaaaacaaaaacgtcaacacgtatgcgaacactcatggcctcatccttatgaataagcaaacattcttgttctaggtctatctgcatccacttgagcctatctgcagttaatccagactatacggttcaggtctgctatgaaatttgattcgagttaccaaacaagcataccctcacatcgggctcataaaggtggaaaacaccaatgcaggagatacggtgattggacggaaattaggtacagtctgtttctagctctccagtgtacgtattctttcaggktaaaaacaaaatatccgtttcgagtgtaacaaaataggtactatggcctatttggtatggtttcaaagcaaaactccaagaaagagctagctaaagcatgcaaaacatcttaactctagagttataaactactatgaagtttttggggctgtaatacaattttttggagtaccttttttgctgctccaaaaactctaaaaaaacaacctagtcatatagtttggagttatttcgccactactaagaaacaatctaaactctggagcaaaactactctacccatagttttagagtagaactgttctagggtagagcagaatcatgccaaacacgtcctatatatagatcgaaaaggtggagttgcgtaacgtttttttcccaaccttttaaaagttcgttcagtttctgcttcgcgtagcctcgtgccagggaagcgaggaacggtggtcggaaaggcgaagcactcgatcgctcactaccgcccaccagtcggcgtacgtaccctaaaccctcataggcgcggaaagcagtgacggggcgagcgcgcggcgcaccggcaaccacccgaggcgcccgcccgatccccatccggcggtgcgcgatcgcccccgaccgtacgcggaagacacggagccgcacctgcgccccaggagcccggagctgagacgtaagccgtcctcacgacctcaccaccacgcctaaccggacccgaccccgaccccgtggttagctcgtggtcacccacccgagaagggaagaccccagcccttgtttgcgctgcgcagtgctttatatatacccggggctccactactccagtgctggctggcgttgtatgagcgtgggtggtggcgccgccggccgggg

SEQ ID NO: 10595 - DNA, 1500 bp, Zea mays
gatgtggctcagtgctaagcgtggttatgcgactagtcatttatggcgggtcagttcggggtcgtgcatgggattcactcgagtagttcccctccgacacgcccgtcctctcttgtcaggccctgccacgcctggccctaggcttggtgtcgtggggttcgaccgagagcgagtccttacagggttggtgcacctaccccttccgatcgactaatgggccaagcgatcagagaccctttccttagcgtgttcattgatcggggatcatttccccgacagtagccccgagcccctgagggtttgattgtggctgcttaagttgtaatcatccatcccttgccaattgattatgagttgtttttacctaaagtggaagtgaactgtgcaaaagcttgtaattctgtggattgagcttgttccaattttgatttgcatggataccagttccaaaagtcaatatgttaagtgctggtacgtttccctgaaagtatgttaccacaaaatagttgcaacggtgtggtcggtgaatggtactacattaccgcaaaaaatgctttgtattcgttcgatctgtttggttggtctatgtttgtgaaaaaaactgttgttggctgtgagatataaaaaaactgtcatgagctgtaaactgtgaaaaaactaaaattgtttggtggaaaaccactaaaaatcgttatttttttacagatatatatttttatagttccatctgaaagctattaaaaacaggtccatagatgatttcaattttgcactgcgagaagaaaatcgtcttttagaaggaaaaaaatgctttctaaattcaaccttttgatttatattttatttttagggacaaaaactaatgccaaagataaaccaaatacaccgaatttccgatctgaacttgtgccaagcggtggtcgaaatccatcgcagctagcttatgaagaggacaaggctttggactaatcaatcatgcgcgtgcaattgcacggtttgtggctgtaatttaatctctgcatagagcgtagagtgcaatccgcatcaaacgccggttgggagcgggagcagccaatggaaaccctccgaaatcgagagccgcgtcacacacacacactctcccacggtgccctgcaaataaaaaaaaatcaagaatctcggattttcggcttcctcaaaagcccccagagattcccaaaaggtttaagccacttggatggcgaccgcacacaacgttacaggaccagcttggcgcacacccggtccagtggaccctgacaccgtacataccaccggcatccggggcccgcaggaatccacgagcccacgggttgggtgatccggatccacgcgaccacctccaccaagccacgagtagactgagcgcgggatcccacgggcagaaagggacgcgactcgtcagggcgattccgattacgagtagacgggcaggacaggacaagggaggaacggcggcggcggcgcagggcagggtaaacc

SEQ ID NO: 10596 - DNA, 455 bp, Zea mays
gtttgtattctccctgtttttaaaacacataagattaattctgaacaagatctgatggttgctggtggctgatccaccaattaagcaggcttctttcaagagactgatgttgaagcagcaaggaatgcgaactacgtgggagtacccctttgcggtcgcaggtgtaaacataaagatattttccactctattgtggttagctttcactcttttgattttataactatgtgttgttacttggctgccttttttaattgatatgcgggatttaacaatgataccgatggcgtattgacattgaaatctgatctctttcagggagctgttgggctttctcaacaatagcagctgtggaaggcatcaaccagattgttacaggcgacttgatctccttgtctgagcaagagcttgtcgactgtgacacttcatagaatcaggggtgcaatggaggtctg

SEQ ID NO: 10597 - DNA, 491 bp, Zea mays
cctccattttaaattataacatgttttggcttttttttagatctatagttatgtctagacacatagttaaagctataaattcagaaatgctaaaacattttataatttaggacagaggatagtactagcttggagctgtgattgttgtgttccaaacagccattggttcacgagattgttcctctaacgaayaaaagtattgtatgaaatttgggcacgttgattgttgtgtgctgttttatggcctcaccctttaactgaacacaagtagtgcctgacttttacttcactgtaatatagtttaaaagcatatctcgtttttgttcatggttggaatttactacctttccaggattcctttgccacaatgggttcttgaggagatggataaggttccggacctgtcatataccaatagatactagaagagaaacagagaatacatatcactgggatgtgatattcttcctgttctgaaaggaagatcacct

SEQ ID NO: 10598 - DNA, 1500 bp, Zea mays
gcgctgagatgagggagtgttgcgcataagacacgtgctatcttcactagataaatcataaatgtagcaacttgaaaacatgcgaggtggagggttgcttctactcaatatcagaacaatttgaaagtaaggataataaagaagttctgaagcttagtgtttatatcttgttttagtcgttaagctctcttttgtggttgtttttgctcttctatttggaggctctgagtctaagaaggctcatgtaacttttggtagatacagagaatagatttcataccatttatctacaatatataaatataaaagtaaacatgtacgaaattaaacataacacatctggtggattctaatataatattgtgagatcatggctaataactcctacatacgtatatttgtaacctagctattaactcccacacacacagttgttggctggtatgacaacttgaccattatgacttgtgcttcagttgactataaacttacagattactctccatccctcctcatttcgacataaaatctatgcgcattcttttactatacttttgttgtgcattgggggcttgggcgcgacgaccaattgaccactgacttttctccgcgagggaggcgtcaggctggcgtgtacactgtgcgtacttgctccgacgcctcaatgtcagcgagctggtatggactcgctccatgagcagagaagaggatcgcgcatgtgagaacacgaacataacatggtcaaataagtcctttacagattaccgaacagagggaggctcgttaaacacaggaggatagctaaaccatgtgactcgttcgtcagatttggctgtggttacagccttacaggacatctgactgcctctgtcaaagacaggacagggcaggggcgttaagtccgtaacgaagtatcgaggcaaatcaggttagtctgttatgcgtcagatagtggagaggaatggaatacgcatctgatacatacattgtgcagtttcgcacaggagttgtagttttacacgacaagaactttttagaccagccagactagttataggaccaagcaaaggcaaaaggagtcaacacgaattaaaaagcaggcagggccgccggcgtcgaagctccgtccagacccgcaacgattcacacgtgcatcagctgctcctcctcctcgactcgcgtccgaccgatgggacccacccacattccagcattccaccacagtgctggtccaggtccgagtccaccgcaccgcgtccctcccggtcccgccccccatcgccactccggctcgcgcgccgcggtataaaatgtatattcttggattagcctgtcctggcaagcccggccaccaccgtacacccaaaccccatcccatccccccgaacgcagaagatcccgtgccaaccaacggcggcggcggcgacggtgtgtggactctagactaggagccaatccagggccatccacccgtagccccgccccgccccgctgccggca

SEQ ID NO: 10599 - DNA, 740 bp, Zea mays
tgtaaggcccattgggctggcgaagggttcattgggcctgatatactaacttacatggtcccatcttctagtttgtctaggcccaccgttcgtccgtgcgtgggtgtgggttgttgctccacctttcgcctgagtccaccttccacaggccaccgggaaggaaccggttcccgttggctcggctcggcttggcaaggcccgccaccgccctccctccccccgcgaccgcgactctgcgagcacgacgagacccacggacccacctcgatccagatccagccaactgcgcgcgtcggcgttaccccttcctcctcgacgccactgccgtggagcggggatcatccgcctgaaccgggtcgaccgcttcgttccttggttaggaagcctttgctttccgaccgatcgttccttctgttttctgcggattttttttttttttgtcgcgaacgctcgagtcgaagtttcctttctggtatgagagtggtctgatccatccgcccactttgttgccgatttgtctgcaagtattcggttgtggttggtgagggtgggcggttggcaattgagcaggcatgatccttggcattttgtaggcgacccgccgcatttcgtggccaatttctgaattgattatgcgatgcaagctgtggatcgtggttgagaaatatgtgtgacttgatgtcaatatttcaggtggtgggtagctggttgggggagctcagaaccttacacttacaact

SEQ ID NO: 10600 - DNA, 222 bp, Zea mays
ggtacgtcagctacttccttttctaatcttcctgctgtgcgaaatcgagcacccctaaccctcccaaaatcctaatgcaggctacttatattcggatctaacccaaagttgctgttttttccatatatgaaaagaagaacgcaagggatgctcgattgactctagttacttagcagaaccaaaagtggaaggccatcaaagatacgaggctattttctctcc

SEQ ID NO: 10601 - DNA, 787 bp, Zea mays
atcctgatggctggtaactgggcgacggaaagtgctgtcctgtcaggtggttgtgaattatgattttggcaaaatgccacgcccaaacggcagtttcctctcctgcttctattgtaaccactcgttgagttctgaatcttgtagagctcagcctgaactatccagaagtagtggaggagaaactggctggtattttttggatgtaaattgggtctgtgttctcccatagatcgataagatggaaagagaactttctgtagattacacactccagtgctataatttcttattttatttttttgctatgtgcgtactacaaatccaacccaaaagttacctcgaagacgactggatccaacttctgttatgatattttctaccactaggatcgccattgtctttgtgaatggaagtggttcttcaatattaggatggtgataatgagtagcaatgatataagcagcagtgtgcaagtcaaatcacatcgatgatcaaacacttgtaaaaaatatacatagcaatgatcgaacaggccacggctgaatgccaaaattgtggccataccatacggcatactctcctacacgagagtggcctcaaccaaacaggccgatagccctctatctcggcctttttggcccatatcatagtcgccttgaaggttcaagctgcttgacctcggagccaaccggcccaaccccgtctaggtttaggcacccgaccgccgcagcgtccccgccgccacgaccacgagcgaaaggaggtcgccggaagagggggcgcggag

SEQ ID NO: 10602 - DNA, 1001 bp, Zea mays
cgacctgcagtttcttgatacactactacaataccagtgcgttggacggtacacaagaagaaatagtacactttatcttagccaaaaggcctagaaagatataataagttgaaaaggagtacgaccctcttctatatagttcgctcggtcgctcgttcaactttatatagcgggttggtactatgagggagcgctgtgttgagtacgacttcctgtcgtgttgggcttaggtggttctcacaacatgtagggtaatgactgactatggtggtttttacgacctatctatggggtaacgaccaactggtagaggaatagatctacacgcttcacgcgtaacgcgggacgacctttaaaatcggcactttatagtagtagagaaaagagaggagtaaaatataaatttatgtaagactgtatataagcttgatcctataaatagatgaaaagtatggtcgctagaatgattggtccattagcataatttacacgtgacaccatcatatatcacctaagagcttaaccatatacttaaaaaggttaaaattgtttattatttagaatataagggtatattttatctcctgatagtgttgtaaaatatgttttcttacaaatggatcatggtccactcaagaaatgcatacaaccctagtgttttatttgaatacatatgtattgattttaatctatatgtgttatagctcagtgtgaattttagtctaaattttatatcaagccccttttagaatgcaaggtattttctgtgaaaataaactgatctatgatctttgtatgatttccctttctttaaaacttctacgttccaaagaagacctaaatctactccaaaccaacaaggccgcataacttgagcccaattaccaaaatgacaccaaccgattaaactcacagcccaactcctcttctcgccctcgtctgacttcgtttcggacctccccagtttttcccctccggccgccgccggagaagcagaagcc

SEQ ID NO: 10603 - DNA, 744 bp, Zea mays
gtttagtgtaagtattcagatcatgagattggagaacaaagatgtgcaactagaacagctgttgggtaggctggttgatatatgctagattgctagtggaaggaacagttgacttcagcgttcttgatacttcacgacagcttggtttgtttctcctgcctgctttgcgttaagcatttagaatctgaatcctgcaattccaagatgtccacatgccttccaaatttcatatgcattggcaccttaccatatgctgaacaactattaattgcaagtgcgaatcacatggcttgagttggcatgctatcagttaaaggagcaagatccactttgttaggatcttatgtctattgttaatattagcagcccaataatggaccaataaccacgagcaccttatgataatttattttcctgaagaaacttcaactgcagcactcccatttcattggtagttttttttatttagctgtcctccatgttgaacgagacgaaagaggggaaaatcgacatcaggaaaatagactcaaaactttgacttccagttgagtatatttctgtacactctcatatatgtacatcaaaattgtttcgatgatcagcagatcctctaaaacacggatgctaatcgcaggcattagagttgttgtatgatctatctacagagtgagagtgttcagaagagaaactctgctctggatcagtgtcctgaacaaagtggcaactccactctcaagatcaaca

SEQ ID NO: 10604 - DNA, 843 bp, Zea mays
tcacagatcaaccgtgtaatcacatgattatattgtataaggatgtagggatgattaaatgcaactacttgggaacctgggactggaggcaagcaaaggcatccagtgactagttgccagttaatcaatcatctcatgatctggaggatccgtgctcatcttaccgcccttcaaccgtgcaggcaagtttgctgcccatatagcagacatgacagcctcttaatcaagctaagtctgtgatgcttcttgggtttggtggcttctgttgcagttcaccacttggttacacatgagcatgattcttgttgtctgctggtcgaacatttacgctgctagtgcacaagcaatggagagcagagacatgagtacatgactaccaatatcttcaataatccaccgtgtggtgacgtgatwatgctggaatcaggtgatttgcagctagcctgggaactaggagctggaggcgagaagaggcatctagttgtagcttcctacagtggcaagttgcctgttgatcaatcatctcatcacgatactcatctcactgcccctcaaccgtgcatgcgagtttgccgcccatattgcggacatgacagcctgtaatcaaactaactttgtgaattgtgatgcttctcgggtttggtggcttctgttgaagttcaccactcggttacacatgagaacgattcttgctgtctgctggttcagccgtgctgttgcatccacttctttcgctatataaagaggaaagccatagcccagatgaccaccgttgcaggagctttccttctctccccgtttcaagaaaaaagaagctacacagattcaacctccattcaaacc

SEQ ID NO: 10605 - DNA, 825 bp, Zea mays
ttttgtatatccttatatagatgaatttctgtttgtaatgcatcaattatcaactgttttaggctccaatttttttagagaactagaacctgctgtacactcaagataaagatatttcatatggcgcattagagacatctccaactatctgcatttccctgctaatcgggactgcacaatgttgactaaaccttccatgaatgttaaccttatgttggtttgattacagctcttttgttttgttataggttagtgcatccatgagacaaggtgcacacggagttatggttggccgggctgcttataacaagtatgttctttttttttttttttgaacttgcaaactgttactggcaaggatcaaaagatacaagggaaggaaagaacaggagatggcatgatatggtatctggcaccatttctgtggatgaacaggacctatgaacggtgctggtgaatgcagcagcctgactgccccttgccacacagattggccgagcctgcttcttgtgtcacccatgggctggcctttcccatgttacagtccagccagctaatgccacatctgggctctaacacaaactaaagtgaacccttttagatagatctcgaaatgacacaaagctgtctggtgtgttagaaaacaactgcaagtgtatcttatgctttgcagttccagtggtcactttagttcttccctatatataagattatattggtcacattggtttttcttttctgtaagaatttgatttatgtactaactccaatgtcagataacgtctttataatttcatatttgctggactttccagtccatggaac

SEQ ID NO: 10606 - DNA, 502 bp, Zea mays
tcattactatttatgttatatttggtgaaccaaatgacgccctgcaatacattgcagccgaacagacacgctagcaagttttataagttaattttcactttctggcatttactactagtctcttacttatctaaatattttttaaaataccattctatttttattgttcaccggcgtaggcacatcgaagaggaagaggacactcatgacagcgtgtggggagacccgtcagagtcaaagcgttccgttccgttcttactgcccaccggccccgtgcccgtgccgttccctcactcgcccaagctttactactttactcgcccccaccaccaccacctccaaccccgccttccgcttcccacccgccccgcctgtctccacgcgccgccgccgcctccggatcgcggcctccctcctgccctgcagcgaagctttgcgcgctcggctcggcccggcccggcccatgccccgccgtgggtgaccagcgcctccacgtccggcc

SEQ ID NO: 10607 - DNA, 279 bp, Zea mays
ggaatgcattaaagttgaaaataccttgatcacacagccaaactccttgggatattttttaagttccacttcaattttccttgcagtagtctgttttctttgcaacaaaagtgaacatcattcctgacagtactctgttttccttgtatgttctgatataatgttacatcattcctaaatttcagaattagataagcaaactttagccactttttttagtttcctgttttattatgttttaaaactccatgtagtcagtacagtaacaattcctgactt

SEQ ID NO: 10608 - DNA, 184 bp, Zea mays
ctctagagtatacaggagatgaaccaattcacttcagtaaagattatggaaattccgtggatgctactagactcttcagaatgtagaaataagttggattgaacttgatagtacctatttgcagcatcatggttcacagtcgtcatcatttgcactggaaaaatggaggcaattttttgaagaa

SEQ ID NO: 10609 - DNA, 233 bp, Zea mays
agtttgttgatattaagaagctattgacctgctaatgcgtcaaactttggtcttaattaatatatccatttctcctaaatctgtgggccatgaggggaattgattgcagtcttgttagattttatgatattcttatacaaaacctctgattgtggtcttgttgctgtcataatctcaccttcatgactacatctacgttgttggcgtgcaggctaagcagttgaagaatgtga

SEQ ID NO: 10610 - DNA, 430 bp, Zea mays
tctggagcttgacgggaagctgtttgtcaacacgcagcaggcccctacctggtgcgccaacagtcggcgtttcgaccccggggggtccctggaccgacgagtaaattgtcgtcgcgtgtcccagcccagatgggtcggcgcgagacggagcacgaaggggggaagaaacaggcaaaggggaaacctgcagccttcgtgttgtcttgcgcccaggttgggtgcgctagcagtagggagggttacaagcgtccgcgagggagagtgagagagggagagactgtccggcagcccgtcctcccgcgtggccaaccttctcgtacgagagccctggaccttccttttataggcgtaaggagagggcccaggtgtacaatgggggtgtagcagtgtgctaacgtgtctagcagagaggagctagagccctaagtac

SEQ ID NO: 10611 - DNA, 130 bp, Zea mays
ggtaactgtggtgtcatccttccccctggggtagaatcgcgaagtgggcagtggaaatcatgggcgaaacaatctcgttcgcccctcggaaggccatcaagtcccaagtcttggcggactttgtggctga

SEQ ID NO: 10612 - DNA, 1305 bp, Zea mays
tgggacgatgtcttggctcgtcctgcatgggaaaaggttactgagacgagacgcatagcgcaccgaggctctcttggagccctttatttttttgtttgtttctttgagcagtttctgatggcaattagttgcattattgtccttgttttgtcatcaagtccttgcttgtaacgtttcatgttccatgttctcttatcggtcttaactattgatctatgtatggttgaatctgttcttctggtcctttagtttatccatgtacctacagttgttggtatggttcggcgtcgagataatggagtaacctgattccgttgcaaatgcactgattcaagggcttggtccagaatgcttatgaatgtaatctacctagctcatccctcaaacgtgcaactacttgatcaacatattcgacatctatggattacctcaaatatggagtgggttattgcagttacatgttacattgcactggtgaaaataaaaaccgcagaattaatgatgactggagcaagtttatgagcaaaggactgtatatttatgggttatgtttaaacacctgctttaaagatttttttaaataatttactgatgctgtatatcatgcgaaagaaagaaaacagctcaggatgctagtcctgatgaattgagtttgttctcgtaactccttttttggttaaaaaaactaacttatgaaatgcctgatttaaagcgtaagcacacgctggcgcgctctttattctatttccagcctaagtacatgtacccatgtcctttgttcttaacttgcatccatttaacatttggattctatctgactctataccagggacactgcttttgcccaaaaccttattcttgtaccctgacaggtggtggaagatcctctttactgatgttaattgatgccatattcttaattatctcaaatcatttctcatgacatatggccataaaccttctatgcattgtgcagtttcccaaacctctgtacttctgtgtattggatgtttcatcgcagtgcagaagtgaaaataaataggactgttttgtatgcatttgttttgctgtggtagagacaatatgattgttggcttgtcgcaagcaagaatccataccttgctctttgcctttgcacctctccttttttcatttacgctgtgtcaggtagcaaggcaagcatttcgtctctctagttcctttaaatacctggtggtagtagtgagacatgttagcatcaccattcttcatccctcgttgtcatctcacagcttgggctagagaccaaacaaaccaaagggaagc

SEQ ID NO: 10613 - DNA, 595 bp, Zea mays
cgcctttgctcgattcaactctttggaaaggtaggaatacggaattttcattgttcactcggactatgcgcggcggcggttggcaagcacaaccgtcagcgctgatgaaatatacgtggctgacttatggttactttggctcaactcaattggtttcagttttatcacgagctgaactagtatctcagctcgatttgttaatgagctagctcgagcccactagttagtttaaatgtgctagtatttataagtaaaataaagtcacaacttatgttggatagacttggatagactaatagcccaatcgtgccttgcaccgactgttgaaacttggataaaaaaacacacggcagccggccgacgacgaccgcggtgacgacggacgtgccgtgcgtaaacccgcgtacgcgccccacaacgtgggcccgccacccagggttttccgtccatttctgaccccagtcgcttcgcctataaatgcggcgtgcgggcgccccgagcgaggggccaccaaagaaatcttgcaatccacccctcgaaagaaaacctcaatcaacaccagaagctctcgatcccaccgaggaagaagagagga

SEQ ID NO: 10614 - DNA, 821 bp, Zea mays
tgccctctctggccccgtgtatcttgtttagttaactacttatttttgaaattaaatattttaacaatatgaaaatacgtaaaaaaaaggaaggtaaaatttggcggcttggcccaatcgttcacccttacggcccaaaggttaagaagaggaggccagacgccgagtcccgtcccgttctgcctccacacgccgccagaacgagaatccccctccccgtcccggcgtccccggctcccgagctccccctccagcctccccttccccggctcggccgcaccccgtccccggttcgttagagcgcgagcgcgcggcagccggccagccccaggcagccggcgccccgcggccaggttggctctcgctctcccctccggcacacctcgtccccggttgtccggctccggctccggatcagcagcgccccgagcacgagcgggaacgcgcgaacgccgggacgcggcagggtgcggcggggcggggcagctaggctctgaggcacggcagacggcttgcagtcaagatctctcaccagctgaattgccgattcacacatccagccatctcgacaacttgggtaagaaaatggaagtgctacttactacgtacattttgtgacatcaaagacggcatattggcgaacaatgaacagactattaaatcctccatgacaacacccatactggcgtactcatgttgacatttcttaccttcattgtttttacttgcttcttagtgaaatatgtttttgctttttgttttttactttgcaggtacacacgggacttcatcttaagagaatttagaacaaaaaagagagc

SEQ ID NO: 10615 - DNA, 1500 bp, Zea mays
aaatatacatctatttattttagtatcatatcaggagtggatgcaaaaacagatatcatctcctgaagcgcccgtctctcataatgttgttatgttctacttgtgcatcatcattgaagcttgtcttgtcagttctgaaattcgtattgtacagaaattttacaacagacaaaacacacagaagaggaaatttttctatgttccaaagcgggccttagccagttgaagaaatgttcgtaaccgtgtgatttttgtgcttgctgaacggcccatgatattttgggcttgctagacggcgagttggcccaacaaggactgtacctgtgctgcccgcgtccgctaggctaaaccaagcgcaatataaacatcgcgccttgcgctgggcgcataaaaccctactaaccgcgtctcctctccagcgcccgccgtcgccgccgccctcctcttggtcccgccgtccgtcgaggttagtctycacgcctctttccctccgtcccctcgaaagatgtcagatccgggttttggttcggtttcctcgatgaggcggtagagcgggtcaggtgctgcggatggggctggctgaggaggactacggtggcgttgcgcgcgcgcgcgcctcgttagcttcatagtttatccctacctcttgcgtgctcaagccaggaacggtggcgttggctttgatgcgccttctgcttttacaccattgtattgattgctgtgttcagcttgtctgcaattctgatcagcaagtctgtttaagtacaccagatagcaggtgtttggtgcagagagatcccatactttgcgagtctgtagttggcagcactttgggtacgttctggtcagctgtgcatgtggttctgtggtagcttgaaccctgcccaacgctgcttagaataatatcagttaagttctgctaattagatcatgcatcgttcagggttctagttcatgttgatcaaagcaggctaattgcaaactattagatgatgataaagggtatgcaatactagtcttattttgatgatatgttggtgacgaactatagctttatcctgcacgatctcattgatgaaacgaactaatacacatgtgatgagtagtttacaaccactagagccgatatcatggatatcctgttattagccttacgttgtctcatacattggtctggctttgtacgtactattttgttatggttcttctgagtttcaactttaaacagtatggatcacgtggttgagtttttttatcttctttagcaatgcgtttctttacatgatttttagtatagcaccagatgagtctttttcgttagatgaatgtttgtactaaacaagcaaacctttacattgtttttcattgatgtagcggcatggttacttgtacctttggttgtgttacataaatgcaaatggctgtttcctctgatattcttgtctgtgtccggcatgagacccttacaactgtatctctttgttcaggtaaaaggacagc

SEQ ID NO: 10616 - DNA, 688 bp, Zea mays
ccgcgggagaaggcgaatccaggctgtggcggttaaccggaggcgaggagaagggggagaaggaagacgaagaggaagcgagctgggcaagcaatcgacgcgagaagatcagaaggtgggggcaccagaaccgcactttatatgatttcttgtggtggtggagattttgacgactttcttgatgcgtttttttttggccttcgctcttttggtacggtaattagcaaatttattaggagatggttaaatgctattatatactagaagtagaaatgatttgtcttatgaatggtttgctgattgggagcttggaggctgtttagagttgtactggcagtgactaacaaccttcttctgcttgtgttgcttaattttgaagaaatggttccttgtggggttttttttccgaaaagatatgggcttagaggcggcaccgcagcgacgtgaagtgggcggccgtgacttacaaacggccacaagaaggttcctgaacgtgttgccgctcagacgctcagctgagcgtgacgccgtcattttccccctttttttccttcttcctattcttgttttttatgtgaaccataatttgttgcggtagaaataggcacagatataacatgactggattaatatgctttaataataaggaaatttgatttggagatggggccggaaatgatagagcagg

SEQ ID NO: 10617 - DNA, 742 bp, Zea mays
ccgcgggagaaggcgaatccaggctgtggcggttaaccggaggcgaggagaagggggagaaggaagacgaagaggaagcgagctgggcaagcaatcgacgcgagaagatcagaaggtgggggcaccagaaccgcactttatatgatttcttgtggtggtggagattttgacgactttcttgatgcgtttttttttggccttcgctcttttggtacggtaattagcaaatttattaggagatggttaaatgctattatatactagaagtagaaatgatttgtcttatgaatggtttgctgattgggagcttggaggctgtttagagttgtactggcagtgactaacaaccttcttctgcttgtgttgcttaattttgaagaaatggttccttgtggggttttttttccgaaaagatatgggcttagaggcggcaccgcagcgacgtgaagtgggcggccgtgacttacaaacggccacaagaaggttcctgaacgtgttgccgctcagacgctcagctgagcgtgacgccgtcattttccccctttttttccttcttcctattcttgttttttatgtgaaccataatttgttgcggtagaaataggcacagatataacatgactggattaatatgctttaataataaggaaatttgatttggagatggggccggaaatgatagagcaggatggatggtaggaaaaggaaggggaaattcagaaattctctcaggcgtatggct

SEQ ID NO: 10618 - DNA, 972 bp, Zea mays
ctgacgatgctcctggtttcattcttccattacctggtgaagaggtgattgatgccgatgagcatttgtgactgccacgagttctgcgatcgctctctaacagaatgttcctatatcatctgacggccctgtaagtgtacactaattgtatagtagctacgtattatttctatggcggcggcgatgcccagcctgcttgtacaaagaggaatgtagcacatacattgatagaaggggaaaaagttgattatcgcttctttgctgacgagagattggcgatgtgttgctctatgccttggcgtcataccataaagaaaccttccaaagtcagatgagttggccttcacatgggcagaatacagtggtctgtgcaactaacatcaagttgacctacatttccagaaataatgttaattatacaataagcagcacaaaaataagattcctcagtcgcacgaaagcacgcaatcactttcctgtgttggttggtagattgtcacggcaagaacaccgaattcacatattttcttaaggaattgggcgcgataagaaaaaaagtgaaaacaaatacaactctagcataaaaaatcacattaaagactaaaaaataatataaaaaacaatatttatgatgctcattaaattttatatgatgctttaaattttatatacttggactagatagagctggacgtgcaaacctgctacgcgaaaatagttacatcacacgacgtgtgagtgtgactgcccgctctcctatctcgtcctcaccaactcttcgactatttctctcttctattgcttttataataataactatagattgcagctgcagcagttcaaacagcttcaaacagctgtatttattaatctgaagccaagttttaaatttgttttaactcacgaacccaccacatcacagagggcaagccggcgaagtttgaagagcgacggccgacgactgaagcaata

SEQ ID NO: 10619 - DNA, 251 bp, Zea mays
agccatccaatcctctccgattctgtggcttctaaactaggcttatggctttatcctgcaaagttggggtgtatacggacacaggatatttggtcgctggagacagacacacgacacgacacagacatgcgtcgaggtcacgaggtccagagcagtaggaaagtagttttctcgaggccacgaggtcccctgtacctgtagctgtagcatgggcggtacagcagcaccaatgcaagctgcaaggcgatcga

SEQ ID NO: 10620 - DNA, 167 bp, Zea mays
ttaggctgcaggccgcggcgcgcgggttcatggcgaggaagtcggtgcgtgctgttcgtgaggtggagcgtgaggcggcggaggtcggggagaaggttgcgcgtgaggcagaggcgctgcgcggggacgcgagggcgcggatcgccgtcggggaggcgctgatgaag

SEQ ID NO: 10621 - DNA, 817 bp, Zea mays
tgataaggaggggcgattcaaaagacgtgcgtggattgggctttgtggtgtcttttctcttttttctaatcttttagtgcgatgatgataataataatatagataataaagcaacatcactagctaatcgacacgccagcacctacctactttggcgagtgctctactagtgtactcgtatacaattcgccaagctccgtgcacgctgggaaacgtgatagggcagcacagtagcgtgcgtgtgcttttcgtggtaccgtgcatttcgattggtcctctaacttgtatatactagtagtagctgtcatagtttcaaggtagaaaaaaagtgccaagttttttttttgtagaaaagaaaaaaaatactagccaattcgcaattattttggttttgcgacagagggagtagttgtaactcccagtctcccgttgcacgggaaggcaggcaatcaagcaggtggaacacgaagacccacgctgtcagtgcgcctgtgcagtgcatgcacgggagggaagggaactttacttgggcgcgattctcccgacaggtacgtgtcaaggtgtcagtgtcacccgcgcgcgccaatgcaaatggacgacgagcctcccatcacttcacttgacccggccagctcgggttgcccatcccatccgcctctccttgataaactccgtggtccgcagccaccgagccgagcccggcacagacgctactggcacgcacgcacgcaccagcaccacaccacaccacatgcatggtggagcctagcacgggcagctagctcccggccggcgacgtgacgaccaccaccaccac

SEQ ID NO: 10622 - DNA, 58 bp, Zea mays
ttcttagcaggcaggtgtgtaagacatcttcagcataccatctggtccgtccctggaa

SEQ ID NO: 10623 - DNA, 1500 bp, Zea mays
ttccacaataatctctcttcgactctacgccgattagaggagcaccaggcggcctgccgacccggagcaacgccttggaactcttctcctcaacgggatctctcctggggcgagttctagggttcttcgcggagaagaagaccctttgcactatcgcggaccgtctggcctcagctggcgcggaccgtacagaagcgtgaagaggatgatctgctcctgcgcccaggtcacggaccgtccgactctatgccgcgcgcggaccgtctatgcctccgcagagagcaccgccaagtggtttgttccagtgtttgacgcccagatcagcgccaacactcggaatattcgaacaacctaacccaaaattttaggtttaccagagcgcccattcctagtgcgcgccaccgcacccgacgcacgaagcaaagggtagatatgtccaaacgagtcaagccgcctaatgagaaataaccttgcacgattttagctcgacacgaacatgacacgacccaatcaccgggccaagcctagacctaaggctcggcccgacacagcctagttttgtttttattctattttttcatagaagtatctatattacccatgattataagtgtaaaacataaaaatatatgtgtcttattagttaagtgggtatatatattcttttaataatttaattaaagctaacaaccatggttcaaatctccatttttacacattttaacatttttgctacttaaacatgatgggctgtcataggcccattaagctcgttgagccatgagctggcccgacacgataaacaacctaacgagccatacatgagctttgtccttagcccgctggtcacggtaccatccataggccgaatcragtcaagtcaggtctatctcatttcatgtcaagcctcaacgggcttgggttgggccgaacgacccatttagactatatagccaagggaagaaatgcgacacgagcaaagagaaaaaataggaaaaaaattctgtacatttcgatgtaaacactttttttacagtttctcacatccattatctggagttccacaaaaatatatctaaatttacaacttaattattagtaatttatttcttttatatttgtatggaccgaggattgtaaaagaaattctttacattctagatgcaaataatttttttccaaagaacggccatacgagacaacgccacatcgatcccgatcccgatgacccaatcgtcgcgcactcgtcccaatcacgcgccgtagaagcccaccccacgtccacaccacaccgaacgagggccgaaacttgtgtcaaaaacactcttacaaagggcttggagacaaatagtacatggattccgggggtctttacgaaaaacgaccctttttatccgctgtttaaaccaaatctgaccatctgtttctctatcatcgcccacgtttccttccttccttcctccctccccattccttcccttccacgcgcccctccctccc

SEQ ID NO: 10624 - DNA, 1295 bp, Zea mays
attgttgctttggtggagcttccgatggacgggtttccagacgttgtgattttcttcttcttctttttgtataaatcttattctgatagctaacgcgtctgtctcataagtgttttgttttcggtgggttggaggaagttggggtggaatttcctgtgattatgtactgcggcgtcctcaatttgatttttagacatgtaggattgtttgtgtaaagtattctgatcactaggtgggatggatgtcttgtcctggcgccctgcagtgtacatggtttaatatatgaagcagttttatttaggtgttcatttttcgaatgttcaatgatcatttgatcctgacgctaaggtgtaacattgctctggtgtgtggtcggggttcccttgctcatgattgtttatttgttgaatcaaatcgcgttttcacatttaaaattacaaatttcggtatgtgatgaatgttgccatggttgaagattgtcatgatgaacctgtcattaaggctgcagaaatcgttttggcggaaaaaatggctgcaaaacgttttataggttacagaaaatgagaaaaacaaaataggctttcgtgcgtcgtcctccgcgaacatccgtcgtccgtagtctacaacaaactgctcgccgagatggaggcaagtaggtagaagagagaattggggatgaggtagtttggggaaggggtttcgtgggaagggaggcgcttagatgattgatgagtagcgttgatgcatgatccattaaaaaatgtccgtccgatgtgtttaagtaagagagaatagacaaataaaacgatctggaccgttggttttttatagtgggatttatctagggttaaattttttggtggctttagtagagacatgagtgcatgggatgatttgtggggtgtacctagtttagtttaaactggtgggtttaaggggtagagatcaaacacacttattaaagagacaacattattgcaattacatctcgagcaaaaatgaataaaattgttcgcatcatagtaacgcgtggctgcatgtcctgatgcccccaaataaaaaccttccgtcgtggtcgtggaggaactcgcgggcgagctcgcgcgggtctcgcagcagctctccacgccgagttcgtccgcatgaccgcatctccctctcctctctcatcaggagtatattgggcgggatccgagacggccgtgccgcttgcattgctcgatcgaggagggaaaaaaaacaaaagggaagcaggcaggtcgtcgagaggggaggatcggagaatgcagcagcag

SEQ ID NO: 10625 - DNA, 121 bp, Zea mays
cgtacacccgctagctagctagcttcttcatttggcctgcaggcggccagcctgcgccagagccagacagagatctctgttccggcagagcttgaccctcctgttacgtgctgcagcttat

SEQ ID NO: 10626 - DNA, 578 bp, Zea mays
tttctcctcacgttaacaagtcgtatgatagtatgataagggcagtgtagggacatagctggatacttaattggatgttaaaattttagtctcctttcttcaattacgaacaacgtaaatttatatttatgtttttagcattgagattattaaaatttataaaaagtacatctcaaatttgctctatatatttttaaacaattaatataaaattcatgttattcgggttcagatgtttttcgcttttttattatagggtgaaaataatgtaaaaaattattaaaaacatattcttatctttaataatatatttaacaacatgattaaagattagcacaaattttatataatctatattaaaatattagatttatcatataattcgttgcggttgtgtttcttccccgcaatttcctcaaacgaaacttgagcataggtaccgtaatttttttcataacataaaacaaagaaaaggagtggggcggtccctttttgcaaaccaacacaaacgccgaatcgagtcaatcggcattcggccgtccccagtccaccggaaataattgccttgatcagcaacg

SEQ ID NO: 10627 - DNA, 571 bp, Zea mays
taagttatgtggctttcatttagtttgttgttaaaatctatcattttttcatatttaccttgctaagaccttttttggtaccgcttctctagagaagcgcaaaacaagaaccatttcgtgcggtactgccacagtgccacggaatgacggaacccttctgcggttggcaacggaagcagtcgcgaggccccagccaaccggcggcgtgccgagagcagcagagcatgatacgtccccgttcctgacagacgcagacgctggacctgttgcgtactcggctactcgcgtgcactcccagcccagatgagaggcagagccgtccccatccagccgtctgacactgaccccgtccacaccgcgttgccccgcaaccggacgcgacgaaccagcagaaaaccccgtccccggccccccgcacggccgcggtccagaagcgggccctccactacaccccctgctggcctgctctctctcgcaacagccccacgtcttacaaccgatcccgagactacacggcacgctcgtctcctggcgcggctgtagcctgtagggaacggcgggtgcgggtgac

SEQ ID NO: 10628 - DNA, 460 bp, Zea mays
cactaagacttgaaaaggaagagatcaaccccaacagagtcggaccagatctctaaagaaattcgtttatttccagttttcgacacggtgcgaagttcggttaaaaaacgggaccgttaaccttgctgccagttcggtagcgtctcgcgactcgccaaaatcctcccagccaagaatggattcagatccaacctctggctgaccgttcgttcaatctaacatagcgctctccttccttccttcccgccctaagctgacatactcgtacattacaatctgccgcgcagaaatggatcaaaaaaataaccaaaaagctcaaaaagtcgatgggggaaaataaaataaaaataaaccacattctctcctccttcctcgaaaggccgccaactgcgcaactggccctcgctagctgtagctggggcgctctctaccgccgctagggtttccaccgccgccgtcg

SEQ ID NO: 10629 - DNA, 584 bp, Zea mays
ggtaaatgtaaatgtgatgtaccggccactacttcatcctcagatctcaagtcttcctgtgttcttgatccctttattcctgttgatttcatctccgctcactttctttctgttcgattttggcccctgcagattgcaagaacgggactgctaagcaagcctggatcaatctcaatcaacgggaacagagacgtcggtgactaaattttttgggtgaagccatgatgctggaagggaagtcctaccttgtgccgcgctccctgctaagctcctgcgagatagagacacagtgggcgtacttcgcccacgaggtccacggcggcaagcgcctggcgccggaagactgcgaggtcgaagacctggacaaagctgacgtcggcggcaagcgcagcaagccgccgtctccacagccgcacacgccggacatctccgagggtcgcggctccagccgccatgcctccggttgcggagagcagcagggcactgggagcaaccccatgaattcaatcgaccgtgacctgaccctcaatagcctcctccggactattgaatagggcaaggaagatgtgtgttctggggttttc

SEQ ID NO: 10630 - DNA, 224 bp, Zea mays
ggtaaatgtaaatgtgatgtaccggccactacttcatcctcagatctcaagtcttcctgtgttcttgatccctttattcctgttgatttcatctccgctcactttctttctgttcgattttggcccctgcagattgcaagaacgggactgctaagcaagcctggatcaatctcaatcaacgggaacagagacgtcggtgactaaattttttgggtgaagccatg

SEQ ID NO: 10631 - DNA, 584 bp, Zea mays; identical to SEQ ID NO: 10629

SEQ ID NO: 10632 - DNA, 428 bp, Zea mays
ggtaagaacccttacaacaccacacacaccttcaattcacttaggttcctagaacatgcgcaccacacaaacacatagattgaccacaaactctaacaccgacaaactatcgtccaggaggcgctaggcaaggaggcgagtaatacctattacctcgtgctccatccaaatcccaaaagtgtaactcctctacagctagcatcaacacatgattgttttgtgcaaatgtttaggtgtgttaaatgattatgagcaatagtctgatttgatggttgagttattttcagatattaaaatattttaccttttaacgttatcaacacattgatatgctatatgatctctgtccgtgcaatcttttgatatgttacagaatgtactattcctaattgcttagttgaagcatcctgcagatcaaggtagaggat

SEQ ID NO: 10633 - DNA, 224 bp, Zea mays; identical to SEQ ID NO: 10630

SEQ ID NO: 10634 - DNA, 576 bp, Zea mays
gcgcagaatacagagaacaatggagtggagcgagaagatgaagtttgaagtggaggttgccgtagggtgagcagggaatagtgtgcgccattccgagctgtattgggtgagtgcgtgagtagcgttatgggctgacccatgtaaagggtgatatatgtttttgtctcagacttgaggaagggttaagaaataacagagaagaaaaactctaccacaaattaaaatagaagatgaaatagaggatatactgaagcctgaagatagctttagcatgcagtcaggtctttgttattggtatatgcataaagaactcgtttaccagatatagccactgcgggataacctaatgaataagtgtggacagtacctcgcgaaatatacttgctatgttatgctccaataagtcattcctcgacttcttgtcccactgcttttgtccgcaagcggaagtacggaactattgagaaggatcaagaaagcaaggaagcacctctcttctacagcactgccaccttctccagctaaccacttccccaacccccaatccatatctagcattctactgtagtggcaacg

SEQ ID NO: 10635 - DNA, 981 bp, Zea mays
cgcgagcacgtgctgataacgtgttgtgataagtggaaacaagtttggaagaatgactacatcaactttattgcaggggaatcatgtttatatacatgaagggatgcaatgtcaaggagtgtatccattggcggcataactggcacacccttattgattattcaaaatgttacattttttctaacaaagttgtcgatagttttatggatttaattatgcctgaaattgcttagctatctatcactatgcatgtcacacagaatgatacgttggttgaccgtctattacaatgccgcggcgtattatattattacgttggttgaccgtctatacacgggttcaaaaaaatttaattaaagaaccttttggcgaaagcagaaaccacgcaaaaatgcccacgttgcacacgccggatccgaggctcttatgtttccttggcactttggcaggttggatcggagactttacaggctacagcggaatccgttgatggtatttctctctcggctgctgctgctgctggcgctgccgcactgccgctgccgccgccgccgctgcctgcggggtgcggccgtgcgggcctgcggggtgctggcgctgcgccgctgccaacctgcccccactgcccgtgactgctgactagtgactagtctctcagtagccgctccataaaatggggccgagcgcgctcccacacccagactagttccgctgaccgcttgaactctcctccctcgcccgcgcgtctccgccgccccaccggccaccgcccgcgcctccgccgcggcagctgtccaaaagctgaaaatagatagaatcacgagggggggattgcctagacaacccgatccttagctaattacgcacgggctgccagattcgggggggcgttcgcgttcctacccacccatccctctcccggtaaaccccggggaggtttaccgcgtagccgctgggcggcggcaaggcggtgggggagca

SEQ ID NO: 10636 - DNA, 1500 bp, Zea mays
tctcaatatctatacaggatagagttgcgactatgagggtgttagagtactcgttagggttttggttatctcctgtgtatttaccttctcacccctactttaatgggcctggcccaactaccggagtctattaatacaacacccaacccctactcatgtgttagggtttcccacaatattagctgtcatcactacaccaaaccaattaactttccagagcctaaactctaggaagttagctaaaccctcgaaattaaagcgataccgtcggaagtttggctctcgaaaatttttggtcagaagttaacttgacttcctataggttatagtggtagcgattgatgattcttcactcacatgttaaatatgctagataatgatggtgcgtagtatacgatttttcttacgctaccttgtagtatggttttagcacgcgctgaaacgagtgtacactttgtccacacattccggatccgaacaagagcagtgtcacttcctctgcacgcctgcgtctcactgaaaccggcccacgcatccggatgtttccgtgcgccacgcacggtatcagtgccggcgtcgcccacccatgcccatgccgatcaagttgcgaggtgccttgcgcttcactcccgggctcccgccgcccgagagcgagcagcgagcggagtaaacaaaatctgctcggagatcggggaacaaactcgattcgccactgcagatttcgcgtgcgcccctgcggagtgccgactccgtagacgacgaaaccgatcccggtggctccccgtctctcgtctgccgctgcacgtcagcacatggcagacaccgattcgctatgctagtctactactctaggcttctagctcgtgcatctcagcacctctgctatggcttgtacatgcatgtaaaccttctgcctgtctgtgtcgtgctagaaatgctagcagaggatgaagatttctctggcaaaccatcaggccactcttattgaagacactcattaattcttttgttcctgtcagcaatagatagcttctttccatggagatcgattgtgctatctgcagctcttcaagtggttcaaaccccaaatatatgactctgactaccactcctgggttactggacataaacaaaaaccacgatttctaactggtgaaatggggcactcaaacgcagatctccaagccacctacggtagctagcgttgatgttaagcaacgcagagcttgacgcgtcattacgacctcgattcctgcccatattcctcattgctccatggccaaatggcctaaactaacttccacagagcagaagcaagaactcacgttctcaggatcagtgtcgagagtaatggagtgatgcaacacatcacacatgcatggccacggtatttatacaaggatccaagaagccttcgtgctcacagcatacctttcatggtagctagctagtggcgtactgcgctcgctaccactcaacacgtctcgaccccgaccaaaa

SEQ ID NO: 10637 - DNA, 519 bp, Zea mays
tatttgactattaggactttttcggttattcttatctcatatcccatatagattagatgagattaggaaaaattatgaaagattttgacttattttgaatttaaatccacccaatctcatccaatctaggccttgttcagttattactatatcacatagattgtatgtaattaaaaaattagtagagattttgacttactatggattgaaatctatctaatcatctcggattcatatgaattggagagaaaacgaacaggtctctacaaagattgagagcaaaagtaaaaagcgttttacgggataaacaagatattcaccatctactttgcgctctcaatcattttaatgaaaaaataataaaacacacatagagagagagagagaggagcttcagcctcgaaagcaacccaaaactcgcagcaacgaattgggcatattcgccccacctgcacccccacttttggcactttcccttccggccccctctcctcggcgcgatctaaatccggtccggcg

SEQ ID NO: 10638 - DNA, 1341 bp, Zea mays
tgtcagtcgcctgagccacccccgatccgtccagcggtcctagaatttccttttttttagcgaggagcataccggagatcctcgttaaatgctcgccttttggtcgcattgaattttggtggaggtcggggttagttacttaaacggttgacttcgttcgcgacagctcgcctagcctaggagaacatcccctccctcgtcttggctgggaggtgaagttcgggaataccaatcgtagccatgccttttgaggagccaaccaccttttgggatgcttttcattgtgttcttgaaaaacttgagggcagaaatgacgagacaatctggagcagcagtgcatggtgctcctgcctgctgatgtcaaaagtgagtgggtcacttgaggaccaacctagtgcttgcctttttgctagatcatcccaatgggatgggaatatagtggcggatactcggttggtaggacactagggtcttgtgttagtaagtactggaaagacttctgtagactttttggtatgtttgctgattttggacctttaatgcgaaggaggaaggactaagtcacagcattcccaattttgttggatttggccagtctatgcatatggtcgaagaatcgtttttagcatgtcatagtgtatgtttttcatgtcggaatgtgaaaggcggttacaagaatggcctgccgttacaacttggaacctgttgcatgtttggaagtgagctgaaataagttggattacgattagtagatttgtaactgctaaatcattatcttgataaattaagtaagctgacatgagccatttgcacgaatgttgtgtcttcctgttcctttcagttgttcgatggttatgcgtaggagcaaatcttcggaattcagattaggcaaggtgcgcttagtagttaattaatgtacgtgattgagaccgtgtgcatccttggtcagctacttataccttgactttacttaacgtggtaaaacaacatagaaaagggaaaactgcatgcttttctctaccttgtctatattaacgagtaatgtacagcaaaattttaaaattaaggacaaaaggctgtgtcttatttttgcattatacaagcgttgcataaatgctcacttcgtttagctgtatgcctttgctatactacagggtggcttgaatgaagtgtgtgcttttcagcctgccctgagctgttgacttaagttcaacttgagctcgatgtgatgtacctttgagacataaattcatttttttggtgcagattgttgcaataagagatatcatacctcctccattgagggaggcattcaatgatgtgtatattgcctatgaattg

SEQ ID NO: 10639 - DNA, 519 bp, Zea mays; identical to SEQ ID NO: 10637

SEQ ID NO: 10640 - DNA, 914 bp, Zea mays
atgaaagtgtggatacaccctgccytataagccatgagagagcaagggctcaatggaagaggaatggagtcaacaataagtagcaacaagtttttatctaaacaaaaagaaatattaaagaaactctataaggccagtgagggattgtttaaactaaattatttgagcaatttaacaaattgatggatcgttcgaccacttgcaaaaaatattaaattattttaataaaaatgacgtgccgcatatattaattagaagtttgtaaaaaaaattgatgtgatgttaaggtaactgtagagtgaggctaaagaatatgtactagagtgttatataaataaaggtggacaagaattgataacaaaaccgatagtaagtaacgatacgacctcttgagtcttgaatccgcctaacatccgcaatgtaagataatgttttgaaaccgaaactctcgggtgagtttcattatctgtctggtggcaaaacatacgaaatagaggtcggctccaaacgtttttttgtgatgtataatggtggcagtggtacacgctacacggcaggagggggcacggccgcacacgggccggcgcgctcgccaaaaaaaaaatctcgggggcggcagagcatggagccgggcaaaaagcggaagcggctaggggacaggacatggcagaggaacaaaaccagcggctgctccacaccacccgcgccagaccagaccacagttttatactccccgccactatttatacaacacgcggtcgcctccggggacgctcatcatcactgccatctctctctgactctgtgtccgtctctaaactctagtctgtgcgaatctgctgccagcagcgaggaacagaacagtagccaatttgccatctcacagttgcgttcctccgattccccgtcccccg

SEQ ID NO: 10641 - DNA, 1500 bp, Zea mays
aatgactctctttatgcttcaacatgtgtgtttgacttagagatagagatttgagtctgatttgcaaaaacaaaccaagtggtggcaaaggatgatccatatatgccaaaattgaataaaactcaaagttagtttttatttgaagtagttttgcacttgttccacttgctttatgttgtgttggcataaatcaccaaaaagggggagattgaaagggaaatgagcctttgggccatttctaagtattttggtgattgagtgtcaacacaagtgcttaaatgtaaatcaatgcccatggatgaacaaagtgcaaatcttcaacaaaggtatgtttctaagtcttagtacattggttttgtgtactaatatatttgtctaagtgttagaaacagatagaagaagagaagagaagacttggctgtgtacagccaagaggctgtttcggtctggggcaccggactgtccggtggtgcaccggacagtgtccggtgcgccaggctgccccgcccgaagaggccgctctcaggaattcgccgacggcgtacggctaaaattcaccggactgtccggtgtgcaccggactgtccggtgagccaacggtcggccgcgcgatctgcgcgggacacgtggccgagccaacggtcgggaaggggcaccggactgtccggtgtgcaccggacagtgtccggtgctccaacggctcccaggcgccaacggtcgactacgccacagaaggatagaaattcgcatcggacagtgtccggtgtgcaccggactgtccggtgcgccaggcgacagaaggcaagatttgccttcctggaatgctctcaacggctcctagctgccttggggctataaaagggacccctagccgcatggaggagaacaccaagcatcctctaagcattcctaagcactaagacatcgattccgcgcctttgattctttgcgatagcaattagagctctagtcgagttgtgaactcattgagttgtgttgtgagctcttgttgcgacttgtgtgcgtggtgttgctgtgatttcttgtcttgagtgtgttgcttatccctcttttactccgtgcttctttgtgaacttcaagtgtaagggcgagaggctccaaagtgtggagattcctcgcaaacgggatatagtaaagcaagcaaaacatcatggtattcaagtgggtctttggaccgcttgagaggggttgattgcaaccctcgtccgttgggacgccacaacgtggagaagacaagcgttggtcttggccgaaccacgggataaactactgtgccatctctgtgattgatctcttgtggttattgtgttttgttgagactcctctctagccacttggcattattgtgctaacgcctaatcaagtttttgtggattaagtttcaagttttcacaggatcacctattcaccccccctctaggtgctctcaattggtatcagagccgttctcttcaagaaagggactaatcgcccgaagag

SEQ ID NO: 10642 - DNA, 349 bp, Zea mays
aatttcattatctcccatctttgacttagaggcaggtaagagtgcattcctgttgtggatggattctctctcgacccttacgttcagatctctttccatatcccttggattgtgcagattaggtgcggatcattgtattatgttaccttgctaaagtctcagtcactgatccccctcaggcaattcataccggtggtacatccaccagtcaccctttcacagggcctcgtcgcattgtatagttcagagcgcagaggctttcctcgcgttgggggatctgagccagattggcgctggtcttaatgccgactctgtaggtcctcccctagccccagggccggtagtatcc

SEQ ID NO: 10643 - DNA, 529 bp, Zea mays
catgttgttctaagtgtttgaaggtgtttaatatttttaatatccgtacgggtactgtctcgccacggaataatcagggattataatctgtccacaaattatgaactaaagaggtgtttgtttgggagtataatctaactagattatataattcaacaaattttaaactaagtgttagttcaaaacttgttggattatataatctagttagattataatccaaaccaacacaccctaagcgatagttcaaaatttgtagaattatataatctatacaaattataatcccaaacaaataccccatgaaatcttaacctttagcgcagtgggcagtgtcatggcacgataaggtatagccgtgtgtgatgttctatggaagtaagacgacgtcgctctgccaaattcgaagccagcaggcagcagctcccacgaccacatgttgtgccctcttatcacaaatcgtcgagctccaccaaccacaggcggcactcaccactagagttggtgccgcgactgcgaatccggcgca

SEQ ID NO: 10644 - DNA, 1500 bp, Zea mays
ttgatcgcctgcgcgcgcggcatgcgtcgccgcgctgccgcgcgcacccgcgcccgccaatggtagcgcggccactcgtcgcgcccccttcctgtccgctcgccacggcgcgcagcacatgccgtgcatgcagcacaaaacgattgatgaaatcgcgccagtagcatccaaaaggcaggctagacgctatctcgggcggggagacggacagacgacgacgacgacgacgcgccccggcacggttggtctcgtgcggctggctaccgaagctagctagtaggtccgtgggttgggttccagtcggacatgccgacatgggagccgggagggcttcgtcgtcttttgcgttgcattgcatgcatgtcccgcgtgtgttggctcgtgtacgaggagcgtgtacgtatcggccttacgcgtgtccgtcaatattgtactcgtaccacatataccagcaggccggaagcagcgtgtgtgtactacatcatcatccatccagagtccaggcagtcgacctagaaggggtgactagctaactgtgtgtgtccggtttttctacgccaataataatacgtatcatggtacagtagtactgggttatttctgtacattgggtaggttgtacgcccacagtaaatacttgtgtttgagctcgacaagaggacggaacggaagacgccatccattggattggatcacgtacgacgtacgtaacgtacgcaacgcaacgcaacgcaagcgtcccacccaccccttccaagtctggcaatgtcctgttgcacgccacgtgctcaacagctcaaagagtgtccgtcgccaacgtttataattcatcggagggatgacacgcatatattgcagcatttgccatttcagctagctagatctaacagacttcaagtttttgtatgcgtgtaatgttggtttcatggtctggtactttggccaagatgatccgccgcgcgctggggtaggccgcccgctggttggtgggcaatgccgccgcaataacttaccaatgaaacctagcaacgcccactcggtcgccacgtcccacgaatggcccgcacggcagcgtgagccagccgccggaacccgccacgggagacgaggcagcgcggcatggcgaacgcgaggagcaagcaagccgaagcagccaagcgaccccgcatgcagccactcgccctcctcgtcccattggaatccacccaacccgcccttcctctccaaagcacgcgcccggcgccgcgcgactcggctagtcctcctacgtgtcggcagcgtccccgcaggtcgcccacgtaccccgccgcgctctcccacgtgcccctccttctgcgcgcgtccgattggccgacccgcccttcttaagccgcgcctcctgccccgcgtccgggcccccaacgccgtcgtcgtcgtgtctccgctccagagtgatcgagcacactgacctggctctggcctgccccccgagcctcagctcgtgagccagagcgcctcgcc

SEQ ID NO: 10645 - DNA, 104 bp, Zea mays
ggtgtgtgtgaacgcaagcatgtgatgttatctattcttttggtggaattcctgaactgacgtttttttattactgctgtccagattcagggaatataagtaaa

SEQ ID NO: 10646 - DNA, 509 bp, Zea mays
tctatatatagggggagcagatacttcttcacaaattatctaacaataccgtattactacagtaaggatctagtcagctagaacaaaacaagtccgagtaaaatgcacataattttttcagtaaaaacagacctgagacatcgtctttcccccgtaactattgcaacaccttttttgcctctgccatccgacctttgctaacgagccatcttggagattcaggaagataaaatattgtcaaaccaaagaagaacaatgaaggtatcgcgagcacaccaagcataattctccaatcgggtgatggcgacagggacatcccaaacaccatgcagtatgacaagaacattcctcctgatccactgaattgtggtagtgtattcagcaaacctctaatctccgaaggggctatttctgaaatgtacaaaggcacaagcgtgacagccaagccaataccaaatccatctacgaagcgtgccaacagcaggacatagacattaggagaccatagc

SEQ ID NO: 10647 - DNA, 326 bp, Zea mays
tctatatatagggggagcagatacttcttcacaaattatctaacaataccgtattactacagtaaggatctagtcagctagaacaaaacaagtccgagtaaaatgcacataattttttcagtaaaaacagacctgagacatcgtctttcccccgtaactattgcaacaccttttttgcctctgccatccgacctttgctaacgagccatcttggagattcaggaagataaaatattgtcaaaccaaagaagaacaatgaaggtatcgcgagcacaccaagcataattctccaatcgggtgatggcgacagggacatcccaaacacc

SEQ ID NO: 10648 - DNA, 133 bp, Zea mays
ttatttactactgtattcatatcatttatattttttggtttccttccctggcagatctcccactctctcgtcagatcctctcggctagctagctagctagctaggacagaggagggaggggaaggcgctggct

SEQ ID NO: 10649 - DNA, 1500 bp, Zea mays
gatttgagtttgctcccaaggttatatgcattaattgagcaactcatatcaaggagaattatcttccgcacttcgaattgtttctaacactaaccctaggcatagtgcatattcaaagtttataattttcaggttttgcctattcacccccactctagccgactttcagagttgttgatgacaatagagtaattcgtcattagatcaccttgtttatgacgattttcagaagatggctcagtatagtgacaaaaaaatttaacctctgtcattaaaactgtcataatatactctagcaacatttttatgataattttctatgacaatataaaatcgtcgtacgagtaaattgccataaccttctcaacaaaataaattgccataacaaagcacatatgtcattaacatatgatgatttttttaaaaaagaatcatccatgttcagatatcctacataaatagttaatgttgtgggagtcttagtcttaggttagtcatcgactcctcttttcaagctgaacacgaactctacatcttcattagaratctgcctcttcatttagaaatkaatatctttcacgatttaagtctgttttagatttttttacgcatgatcatatcaaaagatactataattatatttttaattttctaaaatacaacataaatagtgtatgcatggccttcctctatgacaaatacaaaataggtttttatttatcttatacgtaataaaacaaaatcatatcagaatatgttgtatttatattttaattttcaaaaaatagcgcaaataatatacactcgtcttggctatattacaaataaaaaataaatatttatttattttaattagatattttgtttatcttatattcatatgtatgacatttttttggaaaaagtacttattacgtgaaaagtagcgccaaaacaaataaagaactagttaaatgatttattattaacaagaacaatagaagtagtgttaaaaagttaataccgtcgatttagatgttaatagttaaaattgtgtcaaaatccccacacgagtgaagcccctctaccgctaacaagatatcaacaaaaaaatattataatccctaaccctaataacatttcctactcctgccgcatcagactagcgagccaagccaccgacggccgacgtcgagcctccgcggccgagcctccgcctagcaccaactccgtcgtcgatcgtcctatgcgaccacgcccccgtccgccttccgtctcctgcctccactgagtcgcgggcgcgacatcggggaacgccaaggctgagcttcgcccagacgcctaccgccctgttatgccccaaaccgccgtgctgaggtccgcccaggccgggccaggagcttctcccggcagacccacccccgcccaacggagctccatgcctccgcccagggccattgtccgagctacgccccacgctcctgtccagtgccctggccacttagatggttctgctcagtc

SEQ ID NO: 10650 - DNA, 690 bp, Zea mays
cgtcccatttattacggtagcacaacaaaaaattaatgttggaacttatagtttatataagtaatttcttagtgaggtggcagctatagaaatcacttggtaatttttaggttgtgactgcccttaagaacgaatggagtactagaatttgagagtaaccaatgcaatcaaattaattgagtgcaacaaactacaatgaaacattgtctcacatttaaatttcattaaaaacatatctcaatgagttgttttccataaaattttaacaaataactttatgagtttgaaaattatttggatttaataaaatccttctacataaaggagtaaccaaagtccaaaggacgatgaaacgaaaaccccattcggccattggaagctagggctgtcggtctattccagcctccaccaattccgaagggcacaatggtaattgaaccaagggcttcctcaagtttagtgttggaacggagaaaaaaatctgtagagatcagtggcccagaggccgggactgggaacaggtggcgctcccgcaatcccgcagcgcctaccaaactactgggccacaaataatagggtccctacaaaccgcacgtcgaccggcccacggagcatcaccaccgcggcagctaatctcggccccaagattcagaatcaccgaggcgcggcgaggcgacggcggttggcgac

SEQ ID NO: 10651 - DNA, 241 bp, Zea mays
tgactgttcccagtttaatttcttagaacaagattaaaatagcctcaccctcacagcaggcttttatacggttcagatatgcagatatgtctgtctcccactaaatcttttttgctttttttgtatattttttttggaagcgcagcacctaatataatgctggccctctgtcwgaagtaacagctagataagagaagcacaagaaaaatctggtagcttgagttwtgactckaactcagag

SEQ ID NO: 10652 - DNA, 1500 bp, Zea mays
gattacattttaaatgtagcatctcacttcaatagactatctatctagtttgaccagtcaggtggctagctaagtttggttagtgagaaagtcaatttatagagtctgatagctttacgaattagattgctagtatgttggagagttttttttactgttgaataaacaaaatttggcttgatgaaccagtttgttggagatactcttaagccttaagccgtgaagactaagggcctatttggttcagtttttttctgaccagcttttccgagaatctagctgtggggagaatctgtctgtgtagagaatctaagtatyattaggattacgtgcggaggaagataaagttgtctatggggctcaggatctatagagtgacagattactactattacgacgacttaaccgattatatgtttatgttgattttgaatgatttttaatcaaacgaattttatagaagctggctgaaaaactgagtgtttggcggyccgcatcagcttttagtggccagaagctgcgaaaagccgaaacaaacaggcactaaggctaggcattgtttcataggaaaaataaaataaaataacamcgtaataaatacatgtacaacctaattaatatatgatgtatctkgacagatctctaagaggttaagtgaactttttgtaaaaatcggtctctacacgactctctaaacacactatattttaattatatttatagttatagacttagagttatataataaatctcttaactgtatcttatatttttaaaaaccgaaccggagtcttacaagtaaggtccctaacaaacaaagagtgtagtaaaatattcgagcagcaaatttggtgtccacaagaaaatgcgcacgggcaaatgttcatttacggatttacccgtctttggcttgcgggacaacagtggagtactcgagaaaaaacatgtcatttgactcgagatacccaaacaaaggttccttccccttctatgcacaaaccaacgccaccgagcacttgacttacccgcaggatgcctcttgggtcccaatatgctccggacccacctgccacgacaaaatccgcagacagtaacaggatttgcctacgcggcttattacggagcccgaaacggcgtgaacccatccccacccgccgacccgcttctcgaaacacgcggccccatgctccgcgcgtgggagcgccgtcttggaccgtccgacctccatccgacgctcccccgcgcgcgcgcgtgccctgctccgtgcctccgtcgtcctcggcccctctctccttctctggtccttggcccttcctctctctcctccccagctcaacgaaacgcaaggcctcgcggcggaaatacttatagactagtatactagacgctcacgagtcttagcacagtcgcatcactgccaatccattgctctcgcctagtacacgaccaatcgatgatggccttggaaccctaggagcggccgcgcggctcagcttcgcc

SEQ ID NO: 10653 - DNA, 268 bp, Zea mays
ggtaaaaaaatcatctagtttgcgtgttcatattcacttcagagacacttcaataatgmttccttcatcgaagagaaaagttcagagatatactctatccccctgcgttagtggtatgtgagaatataacagtttggttgtctatcaatttgatcttcctttttatgcgttgtgttcttattactcccagaaataattagagggttagggacatatgtgctttgtggcagttatcagcttgttttaggttttggatgcttcctggtac

SEQ ID NO: 10654 - DNA, 335 bp, Zea mays
tatttccttgtattcttcattgcatttattaactttttcataaactactttattaggcgtatcttactctaatcagttatcggatgcttctttccttttatctttatgtttaaggagtgatttaactcatgctaaatgtcttttgtgaatccttagcgatttgctctctattacatcatgattacaacctttagtttgcctgcaggcacttgtttttccccaagttttgttcataagattgatgaaataaatctccgcacttgacgaatgatttgaccaaagcttcacttgaacagattaaactgatgggtattacatgcagccatacatcaacc

SEQ ID NO: 10655 - DNA, 830 bp, Zea mays
ggttactgttgtatttctacctttggtgaagtatccataaattgcctgaaataatattttatcctatacatattgtgtagttatatatgccatccatatccgtagacatgaaagaaatgtgtaaacgcaactaatttatttgttaaaattcctcgaaaagtaagacaaataaacataccttagatacacactatctacattctctaagtatgtttttagtgttgtgccttctcttcctattaaattctcccagctcacataaacttgtatataagcgctacacaaggtgttgcagttgggtctgttagtgacaacaatgttattggcacaattctaaccccttacacttgttgcaattgaaaccaggagttagcatttttgtttgccattgctctgatagtttttgaattttgatgacgaaagttggcttcattctgaatttctgatctttatttacatatcaaaatgatggttcttttttctccatgtaaacaataaagagagggagttttgttttgtacttcaatttgaaatactgagcccccatgcgtgtgtgtgtgtacttggtaaatccactgcagaatagttaaactaagaagacttatttttgtctattaatatagcttgcccatcccacagttcaatgctgaatcaagttttatttcccactaatctgttgtaaactttaatttttgctggtactatgtgatgttgcttttgtgcaatagtatgccttatttgtcaaccttttcctggtgaccattgatcttatttgaccttgcaaacttgtttttcaggctgattgcttggatgatttggcttttgcaatt

SEQ ID NO: 10656 - DNA, 1500 bp, Zea mays
caggtattcatacctggtgagggagagccgagcaacgccacaagagctcaagcagactgcagacccattgtctcgtgcagttcttgttccgtaggctacgtctatgtgctcagtgcccatatattggtttcttgtattatcttcatttcaaattacaagctattccattttttaaaaaacaaaacaattttagtttaactaaaaaattatatgataagataataacatttaagatgtcaattaagtatttttagatccttaattaattatttttacagtatatatatttgatgttctaaatctttatagttttctctataattttgattaaatttaacatgtttttgagttctttaaaaaaattagaatatcttataaattaaaagagaaggaacactatggttatagtcgaattttctttcttgcaatgctctgctagattaccaggttggttactagtccatttcatgttaattaagcccccgggggcccggggaaacatgataataaactaataaaatcgatagccataggtgatgcgtcagtcaagtggtggctagacgattccgctaccagaatgttgttccttgcaactgaaacaaatgactgcaggctggactggacgatgattggcatgcgcggtgcgcttttgactccaacaaggaaaaagggcgcgagtgcgagtgatcatccgtgcctaatgctgcaaggtaatgattggcggggccggggcctcgtcctagcatgagttgcagccttgcaccactttgcgactgatgatcacgtggagcgtggaggaggaaactggtatgtgcggtgcagcaggataggccaacacaacaatttcgcctgatgcgcgccgtttagtagcacagatcacagaccaacccagcgtcatgaagatcttttgcgctacacgagttcaaagagatcgcggcagcggaagctgcagttgttctagctctatcgctgttcgtggtctcagagaatttgtacggaattcttcgctagaagagtgtcttgtgcgaccctactctaatcaaaacagcggcattttttcttgttcttttcttttgattgaatcggtacatgctaaggtacacgtacttatccgtagtatatacgaaatgacgaaataggaacaggaacagcgagctggccaagttggtccaaaagccgttggatcttaggaggcgtccttatccatcctccacgtgcagccgaccagccgtcgaattccgttccaaggcaaactaggcaaagggtcctcgtggcctcctcctctccagactccagagtccagaccgtgacaagttcatcatccagccccgcttgcgcttgaccccttcaagtccaagcattccattccatccagtaccttccttgtcaccttgaccttccccctctcccttcctagtcccctaccccctactcgccagtccacaggacctcgaccccgctaagcaagctccaagagcgatcgccgcagaagatcccgcg

SEQ ID NO: 10657 - DNA, 230 bp, Zea mays
cctctgattgtcagggagctcattcctctgtagctggagtagatccttctgtagctagggtagattcctctgtagctggggtagcaaatcttgctcttctgttttccttgagaagctcaatctccttatagagtccttccattctgctccacagtgaattgacagaaagtccccactcttcaaactttgagagccatttgtactggaatctttcaatcataccatttacc

SEQ ID NO: 10658 - DNA, 470 bp, Zea mays
cagaaataatgatgccacaataatgtgaatgatccaaaaattaatatgaatgattttaaataaagagagtagccatagttgatctaagtaatctcaggtaatgcacaacgagtgactagaaccgatatgaataatctagagatgatcttagtgatccataaataaactaattgatcgagtaactcagatatttcagaaataatctagcagatttataacatttaggactagtttatgaaccttaatttttcaaagaatttctattttctcatgagaaattgtgaaattgtggttccaaactaaagatttacgaacggtctcatcccgtcgaatctcgtcgctgcaccaaacacccacacgggggtaccgggtacgggacatcccggcccttcctttccttctcgcgcgcgaccaaataactcctcactaaaaccctagggctcccggccgccactgcctacgccgtcgcc

SEQ ID NO: 10659 - DNA, 362 bp, Zea mays
caatttattaaatacccgttcaaaggaaaatatccatactacccggatggctggccccacctcggagtccttcaaacgaagtctctcactgatttgttttccttttgtaactacccgcacagattcggctcaacaggcaacagcaccagcgctcgaacgccgcgtccaggcaacccatccttccgaccccgagcggtcggtacctcgcaagcaaaactacaagctcgcttttaaattctgttgctgcaattatctcctctgtttcccactcgtagatcccgccgcctcccgcgtctagccgtcgacgagcaccgcagcctgacacagccgcgggcgaaccatcgcgtgcggcctcgcccggg

SEQ ID NO: 10660 - DNA, 1500 bp, Zea mays
agttgcgtttgtccgtatgtgtctcgatcgtctaggcttccctggtagcggtctttatggcgggcgatgtgggcggcgaagagctccggcaccatcattgtcgtctatgtgccacttcgaccgctggccaccgtagcttgggtctcggtgtggctcgtcatgttgcggggcctgtaggtggccagtgcactcaggcctagactcgataggtcatgagtgggccataggctagggacccgtaggtcatgagtggaaggtggatcgactctctctgtgtgggctcgatgacatgtgcagttaatgcgacatatcatttagggcggatctgtcctgggtctagggtgggcactttttcaccataaacagaaaaccgaatcgaatcgaaccgtaccgaaatttcggttttttggtagttcggtttcggtttttgtatctaagaagtacggttttttgtatcgtaattggttttcaccgtataccgaaccgaaataccaaaaaatcgaataccaaactttataattctaaaatttgactatttaattatgtgaactaattgtgtgatgcaattaaattgttattcacttatttgtatgtgatgtatgatgtatctctaaatatttctatctatatattttttaccttttaaaattatatgtaatatatcatgtaaacttgttgtatgtgttgtcttgagtataaatttggtattcaatttttatcgaaaacctgaactaaaaaccgaaaccaaacttctcgtttttttattttctagaaaatcgatcggtttttaatgtctggaaaaccgaagtttttttaaaacaaaaaaatcgaaccaagtttaaaaatccaaatgcccaacgctatctgggtcaggcgtggaatccacacgattggcttcctctcgatctgcctaacccttcttttggctctgcctcatccgaccccacgctcggcgtctcaggacttatctgaggtgggtcctttcgggccgaacctttccctcacccttatactaactagtgggtttcgggggctcggagatcgtttcccccaacaataccatatgcaaagacactcttttttggtctctcacatctttcacctgaagggtcatcgaatatatcaaaatctacaacgtaatcacttggtaatatttttctttctatttatgtggccttcacatggtgaatacgagggtctgtagtgcgtttgcatcgttgtgtagatattttttttccggttttaagaggtcgggcaagcgaaaataggctcgcctctacctcggctcgggcgcagagcacgcggcaccggcgcgtcctctcctcctgctccgatctctctgcccagccccgcctgtgcgcttcgctactacgcttcctccatgcatcccctcagccatgtacgcctgtatttgagaagacattagcggagttgaatccagaagaagagccgaagagttatcttagccacagccaggtcgcccgttagttgttcgcggaa

SEQ ID NO: 10661 - DNA, 1059 bp, Zea mays
agctcacaaactttctcttattcggtctttgtatggtggaattatgttattttataatatttattcgtccagtcagtcgttgtgaactctcttctaatcgctcacttcattagccttgttgtaccaaaacatattgtatggagtaaacaataacatcagttagccaaataaaaaaatatcatataaagagtggagacaatcaataaaaatcttgaaattttttttgatgaataatttacgtgaatgttgttgtaagtcgtcgaaacgcacgagcaactgactggtttaactttataaacaaggtaacattgtatgtatgaaatagtgttttggtatcgatacggtaaacacggcgcccccgctcgcacgctccttcccactcagcagcagcacgcgctctgctccccacgccagcacgcccgagccccgaatcgagtcccctaccccatcgatccccgccgcccgcctttccccgccgcccgcctttcccctacccagctctcggggaccttctctcccagcccgagatccctccccaccgagatcccgcgccgccatggtgtcgtgacggcggcggaggcggcgtcatggagcgggagcccaagtcccccgacgaccgccctgagcccgctgcggcggcggcgcagccgcagccgcagccgctggagtggcggtttgcgcaggtcttcggcgagcgcgccgcgggagaagatgtgcaagatggtaataaattcaaccggccgctggcctcttcggatcggcccagtaccgtcgttccctcgcgagatttggtcggtccggtgtgttccggagaggtttagcggaaccatccctttcgtcgccacgggtgtccggggatcgccgggggttccttgggccgctaaacccaatgggtcgtggctggcttttacggtggtttgggtgttgaagcgtttgacttgttcgagtcggaggaagtgctatgcgcagtgtcttaatagggattcaggactgtttattactccttacacctcgacatgttgaggtttctctactgtgtctggttcgagcaactacttc

SEQ ID NO: 10662 - DNA, 183 bp, Zea mays
tctgcaagcttctttaatatttgttaggtagaatgtggcatgcttctagcaatttagttacacaatacgatacaattttagttactatccaccaaccgaatccaaattggactgttcttataggatattagcattatcttactgaatttctgctgcggattagcaggtccattataacttttt

SEQ ID NO: 10663 - DNA, 139 bp, Zea mays
aagctactctccatcgtatgcatggttgagctggtgctttctgctgcttttgcttcttcttcttcctcgcattaaattttagatttattgcgttgacgaccgccctactcctactggagtagcttttgactcgatcgat

SEQ ID NO: 10664 - DNA, 1500 bp, Zea mays
gtcctattttcggcagcttctggccgccaaaaatggctgtacctatcgtagtgatcccgttggtacacctcgtagtgattggtgaccagatcagcgccaacacatataccttttagttgcagaccgtcaagggtttgacccagattattgttgtactactggccgccgaaaataaaccattattttcggcggccagtaagtcgytcgcctaaaaataatgacttatttttggctattttttctggcagccagagaccgccgaaaatagatctaaaaccgccgaaaataagctagtttcggcggcgaaggtcctattttcggcagtttctggccgccgaaaatggctgtacctatcgtagtgatcccgttggtacacctcgtagtgattggtgaccagatcagcgccaacacatataccttttagttccagaccgtcaagggtttgacccagattattgttgtactactattgtacaacagtgcattgcaatctactaggtgcgtaagtgcgttattggtctttgatgatgggctactatattatatccggtggaaacttaatcataattagttgcaggattctttcagaattgcaggggcaggtacattttcctgtcacgcacgcgctagctgctcggctacaggaaacttagacattggatcgttgtggtgggaactgaatggtcgtacagacgtccctaaccgatgggcatccattgctggacgcatgcagcagatgataaggagatcgaccaatgcaatgcaatgcaatgcaatgcaatgcaagagaggtcgattgaaatggcgtcgcagtcctagcaagctcttgggaccacgccaagttgctgtggagatccatccatggccatatagccatacatcctaggccactacctcacgtactacataataaagcacaagccaacttctaaggctttgtatggaagcaacatagtttttaagaaaaaaagcttttgttttttttaggtaggagagaccaattttctgattttttaaaaaactgataatctaatttatataaaccgagtcataaattattatgtttggaaacacctcaatttatataaaccagtttcttaaaaactgggtggtttcaaacatggaagctggcatcacactttaatagactagcttctagtcttagttgaagcccccacctccctcacaaaaccctaccttagacaacacaaaagacatggctatatatgctatgtgtatacactcttcaatcagtgtaggtattagtatgtggtaaggattaaagatagccacaaggactgaaaaggaaggggacacacacacgctcccagcagcatctttaattatttacacagggaaaagaaaaaaggttgtcaatctagctagctactccagttagctacaaaagctaaccatagcagtgtgtgcagtggtctctctcttgctcgccggccagtataattgatccgtggtgcggccggccggcgtcgtacgtcgtcc

SEQ ID NO: 10665 - DNA, 509 bp, Zea mays
tttgaacctctgatcagtaggggggctcggggcccgtttcctccgcggagaaggatcccttttcggggtctccccctttcccagtccctgttgtaagagatagaaagaggaaaaaggaaagaatacaaaatcgagatgacgtggcgcaccttttttgacgcggtcattatggcgaaggtgaagcgtcactcgcttctcctgccaaaggtgccgcctgtcccgccgcagagttaatgcgatggggcgagtggttcgcggggcagtcgttgtgcgtgcgcgagccgttcgagaaacggtcgttttgctttgagtttttgaatcccgcggcgggttcgggcgacgcgttgaacgggtctcgcctgggtctttatatactcgggggagggtctggtgacggttctttgctctacttcttgcctccttcttaggttttcacaacctgagggattagctagagaaaaggaaaccgcccacccagtcctttccgccgccacctcttctgctcggtg

SEQ ID NO: 10666 - DNA, 884 bp, Zea mays
cacccttctctctatagtctatagcattgatcttaaatacaactagatcctaaatacacgtatagtacattaacatcttcatcaatatcctcatctctctgtagcattaattctaaatacctaaagatgtcttccctggacaccacttgaccttttaaactaacatcacaacaatttctctactatatttaagtggctacattgtcatgcgttccctcccctcgcacaggtgctcgcccagcgaagccacccacgcccgcccaaggaaataaccaccaaaaaaagcgtccaaaaagcttgattgatagggtttgaaaccaggactgcctgaaacacagctccgtcaaccaactgagctatcagctgcttgtgttatagaaaatctttcttatttataatatctttcatttcaatatagagaaaccgtagcaatgtacgtgtatctaactagtcactattgattgagttattcaaattgtgcattccaaagccttatttgcctggggctactgtgttgagtgtttttcaatatatatccatgcataaaaaatgaagacagtttcttttagtaatctagagtaggctgggtatgtactgtgctattaattatcaaagaatttggagtgtcttaaatttgctcatttgtcagggttttgccgagtcttgaaaatgaatttgcaagtttaaaggaggaaatggtaagttcagcattcagtaaacactttcctacgaccatctattttggaaagtaaccagtttgcggatcatggctatttgtagacagaaatggcattacaaccagctgaactcaaaccatctgatcggagaaatacaacacacgaaaaacggaggttagacgtagaataaagaagcacgagaagttg

SEQ ID NO: 10667 - DNA, 148 bp, Zea mays
ccgatcgatatatatatagatctatcgagtggcgacgccgcgtcccctgctcgtcaacacaacgcatctctcccctcgccgccgccgaatccagcgctggtggtgggtccaaccgtgcaagaggaacgccggcaagcgtggacgacaa

SEQ ID NO: 10668 - DNA, 180 bp, Zea mays
tgctgggagggcctacattttcaaaatgtttttcatctgggattggttctagtttttcgcaagataatagctttagtcctttataagggatggagaagatggttacaatagtctcagcaatgaactaaagatgacactcacggattgagtggattacataacttgggtaatacatgcttc

SEQ ID NO: 10669 - DNA, 564 bp, Zea mays
caaatctcaaggaagttaagattaggtcattttgttgaccttcggcaaaagacttttcccccaacaacatccaaataatcgtggtggtttttatggatgttaggttgtctccaacatattttctatcccacttcttatctcatccaatattttaaaattcactctgtaaacagtacaaatgacaacgaaaaaacggtgttttacacattcgtatacatggtctgccgaaaacagtcttattggagatactgtaagggtgttatgtttcagtacccgagtctgtgcagaagctaagaaacagtccctcggtgggcctggcgtacgttctacaatcagtctcgggaatgagaggccatacatggattttgaagatagggaggcagccaatcacaggcaagcatctggccacatgtgcactcacacgactcagggcgagaggacagcagggcacaataaccgttccactttggtccataggagcgcatagcacagcacaaggagaggccgagaagcgctttagccgtagccgtagcgataagagtgagctagctggtgcacaccggc

SEQ ID NO: 10670 - DNA, 706 bp, Zea mays
tttatactgcagcaactgctatctatagagacaaaacactgcagaagtagtaaaagtcgttacagattaaagtcgagtaaacaggcttaaattgcatgtattaactaattcaatcaaaaacttaaactaataatagtaaatagataattcacgtatattatattataacagaaagaacagttcttaccggaggagaggtactcgatatggatacctggaaggcattgtggtttgtggcgatgaagaaatgggatggtttgaaagtttgtatccatctyaaaaaccatacccactgttaccacaagtccgcaaccgtacacctaaaatttgctccgtttcacctctgaacccctgtgttttcaaatgggattagtcaaaccactctcgtctttaagaaaagatctctctctctctctctctctctctctctctctctctcggaaaacaaagggggcaggagccactgccaacgacttcgaggtcgcacctacccccgccccattctgcaagccttgctccatttgcgactcgcgagctcaccttccacaccctacctactcctccactctgagctcacaccaaacagcccgtgcaccaaggccaccattcacctccaccaacaacaaacgggaactcttcacagcttcgcacctcgcgtcacaacaccaagacgcacgtaggagggaacctcaagcttcagtcgtcc

SEQ ID NO: 10671 - DNA, 1500 bp, Zea mays
gcagcaacaatctacatttctatgtttttctgattttcttattttttattggtcgggattttaatccctgtctctcccaaatagatatcgggtaaaatcacctctagagggttctaatcacctagtggggcagggatgtctggtgtagggtggaaattcccttcggggtgtaaacacatgtgtattttatttccaaacatccaaaggaacccttaggggatggggaaggttctcccctatggggatgtaagcggggaaaaatcttcccctgacaggtaaacgggggcgaagatggggaaatattccccattcccgttccccgcggggaccagttaaacttatatatgatgatgtcttcatataatatataatgataaaaataaacaattacattgttaagagataacttgttgtataaatatgtctattttgatgtacacataatgatttttaacatctgacagtgtgtataagtgacaatgttttgtattaataacaaatgaattacgatctaattataatttaagtggtgatggggatccccgatggagatttattccggcggggaacggtgatgagaaagaaatgtcctttgcaagcgttcgtggggttctttatgggaaaattttttccgtcgcgggaacgggtatgagagctaaaactcgacgaggaattatccgttgccatcctaatctgaatgtgattggagaaattaaatcatttttattaaatttgattaaaaagtgatttaatcctctcttcaattacgtcaagcacttatccctccatccattattctcatcgtcgacattcttatccacatcttaccggtgcatcctccgttttgttctccactcctcctgccctagtctttggcctttgggtacggaggcgcgtgtgcccggagccaagtcgcgggagggaaagcggcgcgcgtcatccgttaccagtggccagtgggggcaacgtcaccacagcggccaactcgaacgaatacgcatccatcccatcccaagccagcaccagcagttcctccaccaccagcccagccctcgccccgtccgttcgtccgcccgcgcccgctgctgcttgcctgcttcccacgcacgcgagctctgttccgtgctgcagcaaccgcaaccgcatccgcatccgaatccgcacacgatccccgcgccacttgccccgtcaccccccacgcggcccgcgcctccgcccgctcgtcggccaatgcccggcgcaggccagctcggcgagatgagatgacgccgccgcgcggcggtgcccggcctcccgtcgctcacgcgcgccagcaccagcaccacccggccccatcgggattcttcatcccgtcctccacctagcgcggtagcgccgcatttattccctcccccgcacaacggtcacgtttccatcgcccccccgtcttctctccctcgtcgcatccggcactcctcctcgtctcctatttaaagcgcgccgggctgggagccagcgatc

SEQ ID NO: 10672 - DNA, 1500 bp, Zea mays
agccatagatcgcgttgcgtatgtcatttgagtagatacctaacatctaagtgaggatataaatagaaacctattaacttagctacattaaattaaataaagataaaattgtctattaaaaccagaaaattgaatgagaagcctatgctcccactcaacataacgtgggtctgcccctgattgtatgcactgcgcagcatagcactagcgcgtcagcgagtaaataatctcaaaaaatattcctagatctgtctggcccgctgcgccgtggccccctaccgtgccatggagggacaaggtggaggcgtgtgtcgtctgttggcctcgcttgtccgctaatagtctcggcctaagggtctctccaactattcctcctcccaaatctctcattcgtatttttattcatgtttaattacctatttctcaactattattctccatatttctcytcctctccaacagttatgcctattcagctcatctttatactttaagtgccctatttaatttttatatacattagttttagagttttaaaaatttctacaatatttatagtatcrtaatacacattattatatattaattatactaaaaaaataattttacagtaaatatgattaattagtgtttgtgagcttcgagctcccttttatgggtgacaatgaactctaaattttacactgtaaggtttaaggatcaagttaggatcgaaccatatttctatttatttttgaacaaaaaattaattaaaactttaatattttgtgaggaagtatttggattatgattcattaccacctcactccctctccatggaggtggatttttctgtcacgcggagaagaggggagtgaatcgttggactaaagagagagagagagtgggtacagaggggagtgaacgattcagggaatccttggagaacgcctcagccaagccaagcgcccgagccgccagtcggtcaaggttaaaattaaaaaagccgccgcattggcgcccgcagtgcgcccaatcgtcatccgccaactgggacgtcgcagtcgcgcccgtcccgagtcccgaccggtggagccgcacctcaccgcaccgccgtcggccccggagcgcggcaatggcatggagtggagccccacggtgggggtggtagaagtagtactagtacgtaaaccgtaatggtactccaaggattcccactcccagctccggcctccggcacgaacgtacgttggagtagcagcaaggagtgacccccaccacgcacacgtgctggccacctcccgcctacttatacccggcgccattcgtcctcccaatggaatcggccggtctcctccctccaccgcacctgcagtcagcagcagcctcctctccacccaccaagggcaccaacccaccaccaccactcactcaaccacctctcgtctctctccagcgcgagctagctgctagtgctagttcgctcgtcggccaagatccaagacagcagcagggcttgta

SEQ ID NO: 10673 - DNA, 690 bp, Zea mays
gtttgtaattaattttataattaaattatatttactacttcctctaattattattcaaacatcgtatgtgacctgaccagaatttaattaggtgatccaaactagtaggatcctaaaagttatactctacttcgcaaccatgcataggtcaagacaatctcctcgaacggcttctgccatgaccaaaaacagcttcgttgcgccgccgcccataggccgcagccgctcagctctttcctccatcggccgccgcgcatatggtctcagtcgtctccatcggccgccgcgcatatatcttcacaactcacaaaccaactaacgaatcaaactgccagaagttttgacttttgaagatgtatactttatgatacacatctgtcatctagatatatattttttattaatatgtcttataatttcgayacgaaggaagtatctaagctagctccataagtcaagttaacgatgctgcaagtcgcgcggagcatgtacatgtgtagacttatctcagtagctagctggctataaattcgctccaggttcctcatccttttctccattcaacccgcttccgagaaagcaattaatagcactcgatcgatcgggctcaccacgtccagctctcggtcctcgtctttgctgctagcagctagctagcttcgcgatcgtgctcaagatcaacgacgatcc

SEQ ID NO: 10674 - DNA, 1414 bp, Zea mays
tatactgatatatatattctcgttgtaacgcacaggcgctcagctagtttatataatagagctcggatcggagcacaactcgaccgtagtgctatctacattggcgaaaaagagatggattgtctgattcaatttgaaacggcacatgacaacaagcgtgctctttctttcgcgaagactccatcgccgcccaacgtgtggcaaaaattcgcccattgactcctaaagcgttgcatcaattttacgagtggacggagaggggccgctgtgtctcgataaggaggcgacgaccatgcagctccgcctagccgaggaggcggcaaacggggcagcgaagtcatcatctttgtcgcactttcgcctcagtctccactccacggtcacaactcgcgatgcaccacgccatcctctgtatttatgcaagtgcatttgtatgattttttattgtataggcatacaagctctttattattatttatacaaccatgcatgttctacaattctattataggatgacaaacctcaaattgaagcaacatgtggaaaagttgcctttaaagttcctctccgtatttactttaaaattataacattttctatgtaaatatctattgattcaacttttatataaatatctattgcctttaaagcaaatattttattatttatagatataattaaatttggtttaactaaattacaattagtgcgcgtcagttactaagtatatataagaataaacaatagaactttttaagcataattaactcatgtttaacaaaagtttactgtagcatcacgtgagctaatcataaaatatttaggtcaataagttttgtttcattgtttagctcttatatatataattagtcttgtaattagactatatttaatactctattcgtccaaaaatataagtcattataagatttttggagagtcaaattttaaagttgaacaaaagtatagcgagaataataaagatttatgacacataatagatataatatgaaactatatttaatagagaatataatgatatatatttgatattgtaaatgatatatatttgatattgtaaatgttattaattcattgtataaatttggttaaattgaaaaaaattgacacttcaaaatttatagaatgaattatattttagaacgaatctaaacaactttagtgcggaaacaacaagcgctagtttttggcgaacgtatgatcccctcagcctctgaaccgtctgatgttccacccaccattctagcgcacatcctagcgtcgcaaaaccctagtcccaatttctcccgactataaatgagtccacctcccgtttccgccccttaaccgcatcatcctttccctcgcgccgccgccaacgcaacccttgcagccccaatccctcacagcaacc

SEQ ID NO: 10675 - DNA, 582 bp, Zea mays
ccaatacaaccttaacctggcctgattgggtagaaacgaacgaggccttaagtgtaatcctatacaagatagaatgatatatgggaccaccaaaataatagataatatatatgagggatcccacatctaaattcctatagactagtctacatcattagcttactggataagtctacacaaacgagaagcatggtgttgccataacttaggaaatcgttcacagatcatttttaaggccaaactatcacgacggcaatcgaaacacacagatctcaaaaaacgaatagaaaaggcgttgcacaagtagctatggcgaccgacacaacttcactccccccttagttcgtttaatttttgtacatcactgcaccggtttgtttaacaactcactcatcgagctgtgcactgttcgaatctgaaatcccaaggcctctgatttgtttaacaccgggtcaacaagcgttgcgctgttcaagattggcacgcagagccggggcctgtgaagaatctgaactgcggtagctgctcatttctcgctaccgtgatcgatctctcaaccaagactccacagccaggcagccc

SEQ ID NO: 10676 - DNA, 1500 bp, Zea mays
acaccggcagtggctggttcagatctcagagatcttcagcattccatgcattcggttcagagagacagagtctagctatctttctttcttcagtacgtgacccggctttaccagccaacaaactgcgtggaccagacggcgggctctgcactggtggatgcatccatccatgcttccttttgggtaaagcttgaagaatggcgcctggcgcggctgtagaaaagctctctgcctcctttttttttttaacgtggaaggcactcggatgtgaggcttctttttttttttttaaccccacttctgatgccagaatctattgtggcctcgtcagctgcctgctcctaactaactaaccacacgtgtacgcacgagcactcgtaaacttgtctttgttacggactactactagctagcactcataccaagcatatatatggcgcagaggggaaaaaaaaagaatggcataatcatgcgtctgaagaaaggctttctcaatgatccatatgcagtacgtgtaagtattataatgtaatgtaacgtaggcgcgcggctaggagtctaatccgtccacgaagcaaacaaatgcatgttcgggtgcccgcggatttgggggtagctggcgtgatctatcgcgcgtttcccggccgcctgctgacgctcgtcgtggacgacgaaaactctcaagaacatgatgatgatgcctcataagcactgcactgacattgattaccttactttgtcaagcaaccggggccgacatctgtacgtattttattataaagttatgagcgttaatcatacgaaataaataaaacagatagaggcggacaaagttaatcataaatgtacgttaggattcatgataatgaatcctaaatttatgacccactgttgtacgcattcgtagcttgcatgcatgggaattgggaagaaagttccatgccggatagtaactctgaaaacagaaggatagctcgccaatgcaagtcgccaggcgacaagatggacgcttttccatcatgcgtcagtgcagcagatcaaaacccaaaaaggcatgaacgaccatttgtacagatcccatgcgtgcatcgttttaattcttccttgttgagcgtctgcttttcttttctttcatccctctcgcaaatctcaatcaatcatacaccacaagggcccgcacccgtctctccctctctctcctcggctccacactactaagcagtatcgatggccccctcccacatgggatgtgcatgcacccccactatgccagttgccctatatataaaaccgcctggaccgaccggagtcccactagctccactccaccacacacaccgcgcagctagctgtcaccggagcaagaaggaagaaaaaccagcggcaccgatcgatcgacgacacgcgcgcgatcgaggtgaggagcgaaagaaaaggtggccttttcgaagccgccggacggagtgtagcgctagctagctccccaggccggagaggagg

SEQ ID NO: 10677 - DNA, 1500 bp, Zea mays
tagcagctaagcaagtcttcagcaactcagaataagccagcctctcctgtagcaattcttgaacagattgatcagtgtctcctaatagatgaggagcagcagctaggactggttcataaccatataagtctttaaaaggggagcaacacaaagtagtgtagtgtgatatgcagagttgtaccaaaactcggctagagccagccatttcttccatttggtaggattgtcatgtatagaacaacgcaaatacatttcaagacattgattaaccctttcaaactgtccatcagtctgagggtgaaaggctttggataaagccagtttagtgttcaaagcctgaaacagtgacttctagaaaagactagtacaaattttgtccatatcagaaaccaaagacttgggagtaccatgcagtttcacaatgttgtccagaaaaatttattaccaaagctaagggcttgtttggatggtaaccttggaggcaaatgcctggcatgtaactcatcctagtccagccattggaaatccaagacctggtgttggtgcatgggccagacaactttttatggtcaccatcaaaatagaccccaaatcaaaggacttaaactaggaaggatatttttttttcaaaaacctgttttttctaagtattcttcgtggtcattagtgatcttacatcaacgattgatattgtttactgttgaatctcacttgatgtttacggaagtttgaagtttttatgctatttttcaagcatgactacatattttgagtatgatttataggtggtgaaatttactttctacatcccaaaaatatagcttttttctaacaatttttttccgtccgtgtttatttaaataataatgaatgtagatatacatttaaaytatttttatagtttaattaataaatgtttattgagtctataaagcgaattatatttttgtgacgaaaggagtactacctaagagagaggacgcgacgcatgttgtctgaaagtgtgacatgatggacacgctggaatggattcacccctaatttcccgcgacacgagatggcgaggatcacgcggttgcggcgacccaatcaatgaaacgcagcccatgttccctacgttcttttatttatttatttttgcatgtaaaagaaagggggtatgcccgcgagtgtgtgtgtgtgtgtgttgggtgcgcaggcagggcatcagcaaaaggggacttggcttgccagttgccaccgtgacggccgtcaccgtgcggatgcacttgtttgcgtcccgtgcgcgcgtgatctgatcagcgcgttcgcgtggctcggtcgccacccaactcgacaccgcccacctccacctcctccgcgtccgcttttttgtccgggcacaccccgcccgacgccgccggaaccagaccagagtccacaccacaccacaggagaggagaggagctcyggcccgccaaaaaaaaatagcaggggcaggggccgcaggcgccgcgaccc

SEQ ID NO: 10678 - DNA, 1500 bp, Zea mays
ccattaaaaagtcagactgcaccataagtctttcgtgatgaccgattaatgttgtaacagaatcaacaagatcgcactagggctggaaaaaaagctcgaggctcgtcagccggctcggacttgctcgggctcagaaaggctcacgagcctgaatgagcccgagtcaaacctacttttgtggctcgctcaaacagtgagcccaagccagctcacgagccggcctaatgatatggtgctatgttgttacacttacactattacattattatgttattgatttatttttcttattttttatagattcaatggtagatgtagtttaaaatatgttgtgagatttttttgtacattttttattttatatataaagaaaaaatatataatttatactctaaatgagacttagtgtggcggcttgcgagccttaacgtattcaagctcgtaatgtgaccagccctacctacaacatgatccctcttttaacctttcactaaattcctcttgctaaattttgccactaaacaagtaggtgtgtttggaatcaaagtattttttgagttttgaggtgaaaccatgatattggagaatactatagtattttttgccaaaaggtgtttggttaccttgtaaaaaactctattttaaatatcatagttttgtagataccatcatatttttggagtatttgaaactccaccccaacacaaagttttttctatgactagcttcttgcacatgtatactaaataccatggtttaagatactttgtcttcaaacaagtatgcttggaccttggagtgatgtaaaaaatattatggttgtgtcatgatatttaaaaatcctagtattctaaaaccatggctttgaaatactttccctccaaacacgccgaattgtgttaccctgttttggtgtcactaacaattattattttcaatatataatttttggaacctttgttaaacatcttttttaataaaatatcagaatattattaaaaatcacggtgttgcgttggaactagaaaaaaaaactttgttcccaaacatatccttaattttttcacttccgcaatctgctgcagatcctgccgcctactctcattttcgcgcatgcctgtgattttcatcgaggcgcccggccaaaccaaactggcgaggttgcgcggctttcaaaggagccgaaaaccatctgcaccgatcgactagcacaggcccttcgatcctccccaattcagttgtagccaataggagcccagagccacccatcacgcggatcctcactccgcctccacctcatcggcgccgtccattcccgcgcaatgccactccgtcacctagccggctagcccttctctcgaaaaagttcccggctccccgctccggttacaaaacacccaaccccatcccaatctccgaacgcctcgcatcaaaccaactctttcccaaatccaccgccggctcggctcgcccatcttcgcgccaagcaccgaatctccg

SEQ ID NO: 10679 - DNA, 524 bp, Zea mays
cgacctgcagcccctggataccgagtcccgctcccttgcgcatccgcccgtgccctgctcccaccgacgtcgcctcctcgctgggccacggatcccctccggattgacggttgcgccgcctggccacgccgtcggatcggcggtgcagcgcgcggtgcaggagatgctggaggacccgctcggttggtggcccgggtgggagttctttaggctggccggtgacccggcggttcggcctgaacggttgatgaacatgtcggggtcaccggccttcagggcgtacgaggtcgccgacttcgggtgggggaggccgaggcggacgaagcccatcaggatgaaccacgacgggcagctggcactggcactggttctgcctcccgacgctccccggatctcgcgtcgtgcgtccccaccacgtccgtcgcagacgccgcgatgagatcctggatcccccgcgacatcctcctccactgcggcatggccgccccgacgtcctcgcgcgccgctcccccgaggtggcgggc

SEQ ID NO: 10680 - DNA, 858 bp, Zea mays
gttcggtttagttagtgaaaccaaacaaagcactttagtgactaaacttttgtcattaaaatttagtcaggtgactaaggagatgtttggtttagagagtcaatccattctagatgaaatgatacattatgagtttattttacaaatttagtagaataaactcatttctcatctattattattaattattattttataaaaaatataatagtgataaattaatttaatttattctataaactaaacaagaaagtgagaagtcacgtttctcgaaccatcccacctgggtagcccccacgcgcacgcggacgcggcccttcctccagctggcagcagcagccggccagtcggccacacgtccgtcaacctctcaaccagtttccccgcctcaagccctcaacccatcacgccgatacatggggccaccggcttccgaccccacgctgccagtcatcagaagtaaaacatcgtctccagcccaacccactcgtagccttgtcgcgcgatctcctggctgcgagtcggagacgagccgggtataaaaggcatcgtccatctctccgggcggccgcgctgcttcgctggctttcggcaacgccctttaccacatctgaatctcacccacccacccccgcgtcccccacctcatggcgccggcgatggggctgaagcggcctgcggctgcggcggcggcggcgggagcgggggcggcagcagcgcagaccgtcacgctgtccgcgccggccgtgcgggacgcggtgcgcaccgccgtaagggaggccgaggccacggcgaaggctaccgccccggccgccagggtcccggcgacggcggcagtgccggcggagatcgctaggg

SEQ ID NO: 10681 - DNA, 440 bp, Zea mays
gagcctctttttaccctcgcacagggaaaaagaagtttgcatagcatgtggatttctccatacttatatttattcatcatgtaaaaaaataaaatagtggcaatattgcaaaacatttgtttcaccgtcatttcactttgaatcatatatcataaatttcatttgattcactgagctgaagtcaactaaaaccaaacatagagaattatatgattttttctcaaaaaggaattatacgacttcacacctttaagagccatgctcagtagatcgtgcacatgcactgtagacggtactgtttacagcgtgaagtttgaaatagaatgtgtgataggaagtctgttggagataggctaagaagttatatcatttgacttgacagctcaatctctatagtctatactaatatctggctttgtgctgcatttggcaggatggca

SEQ ID NO: 10682 - DNA, 147 bp, Zea mays
cttgagctacttttagtgagttaaattgtttgtttatagatacataccaactggagcaaacttatttgatgaatcatttgcaatatgcaggtttgtttatagatacataccaactggagcaaacttatttgatgaatcatttgcaat

SEQ ID NO: 10683 - DNA, 80 bp, Zea mays
gggcttgctgaaagctgttttataagcctgcaaatatttccctttttgttatcttttactattatattatcttatatgat

SEQ ID NO: 10684 - DNA, 147 bp, Zea mays; identical to SEQ ID NO: 10682

SEQ ID NO: 10685 - DNA, 80 bp, Zea mays; identical to SEQ ID NO: 10683

SEQ ID NO: 10686 - DNA, 356 bp, Zea mays
tcggtacccctgccactacatatcgtttccacgtggcgggtggccagtggggggaggaggggaggcgttgtccacgtgtcggataagggatagggttagctcatcactcctgaaacccaaggagcgccaggcgccacacatgcctgagccatatcacgcctgcaggccccatgcatccatgcgtgcacatgatttcctcctaaagatcgatcgcagactttacttaggccgtccacaaggagaccctcctcagccgctagtaccagtagtcgtcgcgtttgcagctaggcagatctgagttagccggcggatccgatccgtgcgcgtgcagtgtgtgtgtgtgtgtgtcggtggag

SEQ ID NO: 10687 - DNA, 191 bp, Zea mays
ggtagttgccaaatatgttgggggcaagcacaaggggtcaaagacttgtgtttgggtacccaaagttcttgtgtctaatgccaaaggacccaaaaccatttgggtacctaaagtcaagaactaaacttgttttgtaggtttatgcatccgggggctcaagttggatactcgacagcggatgcacaaaccac

SEQ ID NO: 10688 - DNA, 89 bp, Zea mays; identical to SEQ ID NO: 10155

SEQ ID NO: 10689 - DNA, 159 bp, Zea mays
cgactccacggagcgtgcgagacggtgccggcggctgtggagacccgcaacggggacattgaggggtaggtgaagccgcagttcgcagatttcaacgcctggtacacacacgtgatctccactaccgagcttgcggactataggtttgtgtgggggagc

SEQ ID NO: 10690 - DNA, 1227 bp, Zea mays
tcagtcaaccgtgtcaaattctcagaaacagatgatgccaaaaagcaatgttgtagcactgcacacgatcacacaaatcctactgcataccatcttgccacgaaggtgatgcatagaagatatgtccccctccccattattttctattaattatgcatcgatcctactgcagaccatcattgccgccttttaaatatgcatatttgctatccatgatatggataatagtaaattaaccttaaatgcatttaatacacacaacagaactattactttgattatgttatccttaagatcatcgatctaaaactttgaatgtgtctatattgctaatggtgttacatttgtagaccgaattgttctactactgtggctaattgtctatttagataattctatcacctttatatgtatctatatattttgctgctcctatgtattaaaaaacagtcttttaaataggtaaacacatcgtgcaaagcgcaaacaagttaagctattttcaatgataagtttgtagcactctttgcaacactgtcatatcatttgaaaaactaaaaataaaacaatgtctcttaatacaaaattacttcactattttacagactaacatatcaattaaatgatgcaactcaatgaccaatagaaagtaataaaatatgtgatgatgaaataaatcatttttaatggaggtttcacacgatttttaagaccttgaaaacaagttggcatagtttcatcctcataaaactaattttatctaatgaaatccaatcctcttaatacatgctatattataaaaaatggtactccctctgccgtaaattaaaattcgttttaaagaattaattgattcatataatatttaatgtatgtgttttgtatatatgtctatatttattatcatctgtttgaatatagatataaaaatcaagtgctaaaacaaatattattttgaaaccgaggaagtatgtcacagtgtgcataaaactataaaaccatgactgagaatagcctttgtaaagaaagggcgaaaaccaaagccaagcgcactgcaatttacacgaacgcccctggctcgtcgcctatttgtattttccgcgcctcacgcctcgcgcctcgttgcttcttatcctttatttttttccccaacccgtcgtcggctgccggctgcggcactctgggaggaaggccccaagcccttgccgccggagacgaaccgaaacg

SEQ ID NO: 10691 - DNA, 723 bp, Zea mays
attaccgttgaagaataggatcatctgccctttaaaacgatctattatattgtttcttcattcattttacaagattcgtcggtgtatgacaccaacaaatgcccctagctccgcccccgcttacagccttgacgcataaatctgcagcctgggatcaggctcaggcatgagatgtgatgagttgaactagcattgtaaatccggaagtccaaaaaagtttttacacctttcattatgaagctgtacatccagaattccagatatactgaagcaaccttgaaagtaaaaaaaaaaaaaatcaatacattttttttccttacagatacaatacatgctgatgtagtgatgtggtgacatgtagctgcatatctataggacaaacaagtaatagaatcagctgaggacattctttcccaaggcaaactaacccaatttcagaagcaaacacatcaatatttgtttgaatgccaaagagttcgggaaaaatctgacaaactcaatggtgcaagaccagtcaaaacgtttcagcaacgcatgtggaagtggaaatgtatagcatgcaagagcgcgcggcgcattgaacgaatcacaaaaaggtaaatgaccgtggcatcataagcttgatcgacaaggagagaggataacaatagtggattccctcgtatattaaagcaacaagagttgtgcaagagatgaattcacatccattatacaataacaaac

SEQ ID NO: 10692 - DNA, 989 bp, Zea mays
ggttctgatgcaacggaggtcaccgctacggcgctaccggttgcagcaacttggatggccatgagatggccaaatgggccgcccggcccggcccggcccaggccctgtgaagcctggctcgttttggatccggcccgtcagacacggttagaaaatcaggccagaccttctaatcacgcgggctcaattttctgttcgagcccggcccgcagcgggtctaaacgggccgggccgacccgtttagcacgaaaaagcgggccgaaaaacgggctatgcgggtcgataagtacattttagtgtaaaaaaagcgggcttaacgggcttagaggtaaacgggccgtgccgggctagcccaccgtgcctagtttcctgtccgagcccggcccgcttattcgtgccgggccggcccgggcccgcatataaccaggccgtgccgggctcggatcgggcccaaacagcgggcttcgtgccaggctcgcgggcctcgtgcttgcttattggacattggaactgtggatatgctgggggcagacaggcagagagctctgcctccccaggatacttcgcccctcgttccaccgcgagcccttccgcgttccgcctctgttccgccgctcgggacccgggagacgagaagtagtagccccatccccaactggtcctaacccacggtacccaatccttgactcggttctctccatgagcttactgccccatctccatttcttcaatcattactcgcctttccgttcaagggcgttgcttgcctggataaccacggcatcgttctacccgccgggcccgagctaaggtactttgtttctgaacccttcgttggtttcaggatttgtcccaacccaaggttggtaatcccttggtgctggtgttcctctgtgtttgtttcgtctgtagtcatacgtgcaaacaaagagcagcaaaagaagaacaagtggggcgacagggacagggaggaggggaaggcagaggaa

SEQ ID NO: 10693 - DNA, 954 bp, Zea mays
atatctgttcaggtctgctatgaaatttgattcgagttaccaaacaagcatggtaccctcacatcggggtcataaaggtggaaaacaccaatgcaggagatacggtgattggacggaaattaggtacagtctgtttctagctctcctgtgtacgtattctttcgggttaaaagcaaaatatccgtttcgagtgtaacaaaatacatactatgagcctcttagcatgactctagagcaaaactcagaagtgctcctagctagagcatgccaaacaccttaactctatagctgtaaactctatataatttttggagttgtaatataattttttggagtacctttttgctgctccgaaaactctaaaaaaacaacttagtcatatattttgaagttatttcagagttttagagtagaactgctctatggtagagcaggaccatgcaaacacgtcctatatatatggttcgtaaaagtggagttgcgtaacgttttttccccaactttttttaaagtccgttcagtttctggttcgcgtagcctcgtgccagggaagcgaggaacggtggtcggaaaggcgaagcactcgatcgcttcaccaccgcccaccagtcggcgcacgtaccctaaagacctaaaccctcaaaggagcggaaagcagcaacggggcgagcgcgcggcgcagctgcaccgacccgaggcgcccgcccgatccccatccggcggtgcgcgatcgccccgaccgaacgcggagacacggagccgcacctgcgccccaggagcccggagctgagacgtaagccgtcctcaccaccacgcctaaccggacccgaccctgaccccgtggttagctcgtggccacccacccgagaagggaagaccccagcccttatatacccggggctccagtgctggctggcgttgtatgagcgtgggtggtggcgtcgccggccgggg

SEQ ID NO: 10694 - DNA, 167 bp, Zea mays
tctgaaaaggtacataatcaacttgtaaacaaatcagaataatcaaatgtgaatgcccgtaagtgtgtttcaactgtaggtgtttaaccctggcagtgacccaagtttagcaccattcagtttgccccatacaaaaastgaaatagaggcattgcaggcaagaaaac

SEQ ID NO: 10695 - DNA, 1500 bp, Zea mays
tctcttttggaatgactctctttatgcttcaacatgtgtgtttgacttagagatagagatttgagtttgatttgcaaaaacaaaccaagtggtggcaaaggatgatccatatatgccaaattgaatcaaaataaatttgagtttttatttgaagtgatattgcacttgttctagttgctttatgttgtgttggcataaatcaccaaaaagggggagattgaaagggaaatgtgcccttgggccatttctaagtattttggtgattgagtgccaacacaagtgcttaattgtgaatctatgcccatggatgaacaatatgcaaatcaagagcaaaggtatgtttctaagtcttagtacattggttttgtgtactaatatacttgtctaagtatcagaaacagaaagaagaagaaaagagaagagtcggctgtgtacagccaagaggctgtttcggtctggggcaccggactgtccggtggtgcaccggacagtgtccggtgcgccaggctgcctcgagcgaagtggccgctctcgggaatttgccaacggcgttcggctaaaattcaccggactgtccggtgagccaacggtcggccgggccaacggtcggccgcgcgatctgcgcgggacacgtggccgagccaacggtcggaagggggcaccagactgtccggtgtgcaccggacatgtccggtgtgccaacggctcccgcatctgcaacggtcggcttcgccatttaaggaaggaaatcgggcaccagacagtgtccggtgtgcaccggactgtccggtgcgcacgacgacagaaggcaaggatggccttccagatttgttctcaacggctcctagctgccttggggctataaaagggacccctaggcgcatagaggataataccaagcaactttagagcattcttgatcatccacactcagtctttgcgcattcgtttgtcattctaagtgattcgagctccgttctagtgagaaccttgagatagtctttgagctcgatttctcggccgtgtgtgtgcgcattttgctggtggatttgtgtgtgttgcttcccttcccttactcgtgattctttgtgaacatcaaaagtgtaagggcgagaggctccaagttgtggagattcctcgcgaacgagataagaaaagaaaaacataacactgtggtattcaagttgatcattggatcacttgagaggagttgagtgcaactctcgtccgttgggacgccacaacgtggagtaggcaagttttgtacttggccgaaccacgggataaaccactgtgtcttctctgtgttgaactctttgtggttatcgtattgtgcaagatcttctctctagccacttggcattaactgtgctaacgtttaaccaagttttgtggcttaagtttttaagttttacaggatcaactattcaccccccctctaggtgctttcaattggtatcggagccgttctcttcacaaagggactaaccgcccaaagag

SEQ ID NO: 10696 - DNA, 76 bp, Zea mays
cctacatcaagaacctcacggggcggatggggccattcctggacggctggacctcgttgttgtcgaggccgcagcg

SEQ ID NO: 10697 - DNA, 626 bp, Zea mays
agattatagatgtgagtttctaaattagtcctaaaggactattcgtacttgcataacttatcattcgagagagcacatacttgttcaatattcaattcgatgttgagaaggattgtctagtttatataatttgctcgtcgaaatctaattatttacccagtgattaatttatccttattcctttagaactagtttgggagcaataataccatagtggattggcgggactaaatttcccttcctattcaattttgagtagaaagagaaattcagcacatctaatccacttcggtatacttgctcctaaactaggccttacaggaaaaaaaaacactataatcaacctgtgcaatggaaatgggagggaaaaaatacacgtcgtagaataaaaaaaatcatataattattagcacaaaaaataataaaagttcggtttaattttcctaatttgttgagataaacttcagtaataaaaaacaatcccttcattttttgggagttttctcacgccaatatgcgatggataatgcacgcggtaacggaaaaggacacagcgtgcgaggactcgctcctctggccttccctccagctcgttccgacgttcccctccgccttcggccgtggcc

SEQ ID NO: 10698 - DNA, 1500 bp, Zea mays
acattccatgcatatcttgtaagtagttatattggctaaattccaagcaacctttacacttacattatgcaaactagttcaattatgcacttctatatttgctttggtttgtgttggcatcaatcaccaaaaagggggagattgaaagggaattaggcttacacctagtccctaattaattttggtggttgaattgcccaacacaaatctttggactaactagtttgcccaagtgaatagattatacaggtgtaaaaggttcacactcagccaataaaaagaccaagttttggattcaacaaaggagcaaaggggcaaccgaaggcacccctggtctggcgcaccggactgtccggtgtgccaccggacatgtccggtgcaccagggggactcagactcaaactcgccaccttcgggaatttccagaggcgactcgcgctataattcaccggactgtccggtgtacaccggacagtgtccggtgcgccataggaggtcggcctcaggaactcgccagcttcgggaaacgccaacggctcgtccgctaaaattcaccggactgtccggtgtgcaccggactgtccggtgcgcctccggagcaacggtcttctccgcgccaacggctctctgccgcgcatttaatgcgcgctctgcgcgcgcaggggtcagaaacgcccatactggcacaccggacagcaaacagtacctgtccggtgtgcaccggacacccaggcgggcccacaagtcagaagctccaacggtcagaatccaacggcagtgatgacgtggcgggggcaccggacatgtccggtgtgcaccggactgtccggtgcgccatcgagcagacagcctcccaacggccacatttggtggttggggctataaataccccaaccaccccaccattcattgcatccaagttttccacttcccaactactacaagagctctagcattcaattctagacacaccaaagagatcaaatcctctccaaattccacacaacgccatagtgactagagagagtgatttgcttgtgttctttcgagctcttgcgcttggattgctttcttctttcttgatcctttctttgcaatcaaactcacttgtaattgaggcaagagacaccaaacttgtggtggtccttgtgggaactttgtgttccaagtgattgagaagagaaagctcactcgatccgtggatcgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgccctctctcacggactcgtttctttattactaacgctaacccggcttgtagttgtgtttatatttgtaaatttcagtttcgccctattcaccccccctctaggcgactttcaattggtatcagagcccggtgcttcattagagcctaaccgctcgaagtg

SEQ ID NO: 10699 - DNA, 296 bp, Zea mays
atataaaattcagtagaaagagagatttggttttacaaaactcagtgtgcctcataattgtgccattctacttttaagttttctccaagctgcaaacttttggtgcacttattgttaattttgttggttccctacaacctgcattaacggctccgccttttggggataccttttgcaatattggaaggatctgtagtcattgcagttaatggcatgttccatttgcgttgtctgtttcttacttgtggtacttaaattctaattcaacatttattgacatatttcactagttaagt

SEQ ID NO: 10700 - DNA, 914 bp, Zea mays
ggtataaaagaacctttcctcggatatcacacatctgttgtagtctgcccgagttcgagcaacggaaacttcttttatgttcttctcagtttcggyactctgacattctcttcttttttagagcacgtacagtatacctatgcagaactgatctgattttttttccaaacaacacactcatacccctcaaatattcctggaaaatttctgtataatttttctaaaatccttatattccaaacagggatgagtttctcgctcgagaaacaccggtttccggtaattcccgctactgtgtttccggtaattcccgctactaccgggaaacgaaaaccggtttggttttcggtttaaaattttaaaatataagagcaaaacggtatttgaaaaatacaaaacgaaattgtaatccctgattttgaagagggtggtacggttatgtactattatgtctgacatgttttcaaataataaaatatacctatatatttttatatttttgtagtttaattacgggaaaattgtatgaatctttttattatacaacagttttcatcattaaatgttgaatggaaaagacaatttgtcgggaaaggaaaacatctttcaaaaaaaaaagtgtgccaaccaacatcctcaaagggggacgttattctatccacgctcaatgcacgtgacgacaagatgcggcagtggttttcttctcattgttaccgctaatcacgtggacaggtaatcatggcttgctaacacattttagagtcccacttccaatcagcggagggctaaaacgaagtaatccgcccctagattaattggtggcttactggcttgctttctagtctccggcacaagattccctctccagcggcgcaccaccgctaccatcctccgacccccaacccgaacccgcc

SEQ ID NO: 10701 - DNA, 1500 bp, Zea mays
catgaccactcaagcccaacacgagaggaagtcgcacgcaacacatcgctctcatatagtatcaccttactagctaaaggaggacaagcgaccgaatgagcaataaaaaaggggtacatgctctttttcaactcatacatttctttgttttttactataagataaagtgtgatatttattcttgtgttccgttgcaatgcatgagcattgtactagtatgtataaagcaaaagtttcatcatgcgtcgtctccctccctattcgcgcgccatatgttatatataaaactgtagcgatacacgagatttgacacaaaacgaaagtcaccatgactttgcaaaacgaacatgacctcggagctagtttaagagcaaaagaattggaggggatagcgacttcaagagactctctagatttttcttagttagggagtgtttaggatgattaaggttcagctccartatggagctataatttattttataattttaataattttaaaatatttttaatctaaataataagtaaaataacttatctaaatgttttctttaatttaatatgaataggtatttatataaaaataccctccaacaacttatctaaatgattattcaaatatagctatcttatattcctaagttttcaccagccaaacataaaaacacatgaataactctctaaagtataaacaatatatagaaaatccgttggagattaaaaagatatagaaaatggttctaatacaaaccaatgtccaaatgataatttagagaataaaatttcgaaagactgtcgagggtatcagtccaacagctatagatatacgcaaacaagaagagagttttcctatttaataaatactctcctcgtcaatccgatctccagaacttgacccttttccctgggcgcctcttcttacttttcactaaagaatgaacaatcggctcaggaggtaggagatccaagtccagaaaacagacgtaattacaatactaaactaatcatgcaaaagtctgattctctaactgaacttatctttccgacgaagagaaacatggatcagttgctgtccctaagaatccgtattttaggatctgcagacgcaaaaggagcgtatacttataaagctatttctaatagattttctatcttatcttgtattttaaactacaaacataaaatatttttttattttacactatataagatccctcgatcttctccgtttctttccaaaactagcgcttactgttttgcacggccatagtctcgatccccaccgagtccagcaaacagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgtcgcagcactatcacccgccctccacctccgacggcgacg

SEQ ID NO: 10702 - DNA, 512 bp, Zea mays
gagcaggttatctaaaaatggagagctaaagtatagagataaagactactaaatttgaagagttatttatcttaatctgtkgtagacatttttttataataataactaaatttacctttacaaaaatattcaactagtttttttggagttgctctcatttcctatctatatatcatgcaaaacagttttacgatccgccgaactgatagcgaaattcgctgcggaaaggatccattgccatctaacccatccccgttcctaggtggcgtagggcgtagcatccatctatgttcgtcttcctcgatcctgaacgaaaaccagtaaccaccctccaccaccgcgtgctccgtgctcattccccatctgccatctcggctcctcccaacccaaacgacaaaaccctagcctcctcttccgtgtgatgggatgccgtctaaaccctacccccactccctgacctcctctacttcctccgccgccgtggcccccgcgacctggatgtccgcatctgc

SEQ ID NO: 10703 - DNA, 1500 bp, Zea mays
ttgcacttgtcaataaaccaggagaggtcaccggatgcgctgtcagcctgtctccgtcacgagctgcgctaactctgcatccttgcaggattcggtgggatttggccgtatcgtaagcctatccgtggtgtttccgtctagttttctctctcatatattccagggcggattcgtcctgcttcttgtcacgtagtactcggcagcaatgcctcctctgaacgtatgtagaaactgcatcaaaaaagattgaaactggaggtcacggagctttggcgtgagaaccgaggatcatcgccggtgctggcgcggtgacgccgacgggcgacggctgcaggttgacttgtagcarctaaccgtgtactgaactactgatatgtaaagccaaagactgactgcttgttattaaaccgatggcagtgacagtgaagaacattacgcaattgtattctcttgtggaaaattgatggtatcgtcgtcacaattaataactcggacccaaaaaaaaatacgccaattgcaggttgcggcaagcaaagtccatggaggcacgcatccactctctcgtgctcgtgcacccacctacccgtaccgctgtcctgcagcagcaatcggcacgggcatgaatacttcaggggtgtttggttacaccccgctaaaatttagcccatgtcccatcgaaggtttgaacctcagttccgagtaaatatagtcgaattataaaactaatttgtcagccgaagattgaaagacgagacgaatctagtccagttggttgtgtctatatttcatactcctatttaaaagtcaaacgcttgatgtgacccgagctaaactttagcaggagcaaccaaacacccccttcttggctgcggctttaatccattggcttgtatattttctatagtattttatctttataaatcataactataatagttcgaattatcgaatagctagcttaaaaaccacagccaacaagctgttggttgtcactgcactttgccggcatgcagctgcactcaaatatatatatgcgatctcggctcgtctctatccggataagattcgccaggactcaagagcccgtcggcgaaccgatcacagtcggcgagggccgaggggaggccttttttttttttttgacgcggacgccagaaatcccgtcatgtcaggtcccgccgtcccggcgcagaggagagcgcgagccccgagaagcgcggagcggaattgcaagagcagacgagcagtgtagacaacgggacagccattgacttccccgcctaccctgccccgtcccgtccgtctccgtcccaatcggatccacccgcccgtcgtcgcctataaactctccctcccatccgcctctcgaggggcccggcttcctcccaactgccaccgatttgtttgttcggcttcggccccatctccagtcacccgttcccacttcattggtcgctgctccctccctccacggccgatcccgtgccggcgagagggacc

SEQ ID NO: 10704 - DNA, 997 bp, Zea mays
gcacgtcaagatgaaaaaaatgcagtgggaactgggaagtacgtagtgtggcagcaatatgcggggggagggataaataggaaatcgatggaagggatcaggtgagtggtcaccagccaccacacccacatggcacaccgcaggacaggccggacccagatcatagaagcttctccccttggcgctttattctactttattatttacgacgtaggggaattgaagccacctttacgcgaccccgctcctacttcaatgatatgagcttcaactcaactcccgcgacgacgctggctaatacgctcgccgcactacttctgctcaggatcggacgccgtcacgcaggcaggcgcacatgcggcggccgcggcaacggcgtcggtgctcccgcgtggaacgcgcaccccctcgagttcgaccgcggtggctttggcttggacgggctcgcgatcccgcggcgcattatttgtgcgtgtggccttggccgcgccgcgcccgcaccgcaccgaactcgcccccatgatgccgtgcggacgccggccgggcagcgacagcgtagtcatgcatgtggccggccaatttgacccccgcgccatgggacccccgccgcgccgatttacgggccgccacatgccccgatcgcccatcgctgtcgagcatggagtgctgggctagcggaaggtatagcaacccccgccggcctcatgcctcggccacgcagtacaattcctcttccattccagtcccgctgccagcctataccttcttctctccgatccaacgaatcccaactaatattcttgcaaacaaagggagtagataggtcgcactcgcgtcataagagagagcgtcagagcgcctgcgaggcccagcctcccactcaccatacgcctcctctcgatcttaccttcgcacacacctttctcgatcgtacgcagtgtgtgtaagcctagttctcctacctaggcagccagctcagctcgccgcccggccggtg

SEQ ID NO: 10705 - DNA, 1500 bp, Zea mays
ctggggggcatagaaggcacaaggcggtggttaggtggagtgtcatggactcatgtgagagccttttgattaatgcaagtttggtggcagtggcatgaaagagcactcgtcgtccacctcaccactctctctgtctctcctctctctctccttcagttgctctggtttctgaccagccttgacgcggttgctactttttttttctttctttacgggacacggcacgtttttttgtttttgaaggggaggggtagatctggttcggtgggtttgcgggacggggtatttaaggactcgtggcctcgcctctcctctgcacacacacacacaagacacaacacaactcgtaggcagcgagcgtctctcctcttcctctcccacgcatcgcgccaaggaagagagagagatcgccgctcctcttctcggcgtcggtggtgcgggtgccctccctcctcgagcgagatctgtctggtgagactcgcaccctgatccctcgcggttactctggttttttcccccttcctaagtcccgagcccgatcattgtagttgaggatcgtgatttcattcagtggctagtttgttcccggactccgttctgcagacggttgtttcctcgggttcgttctctgaggaagacgctgtttcagatctggcggtttcgtggtttggatctggtaggagttacggttgttctgttgtagtggccgaggaggatttgcgcacctaaatttcgtttccgttgctcctctgatggctcagcgttgcagatcttcctggctgatcgctgttaaacgcctgttcatgtacaagtaatttcgtttcagtatgtcggcggttatggatctgtatcctgccattcattcattctctttaggtggttctgtgccatgaaaactatagtagtgtacataaccggaaatggatcacaggtgcctggtagtatattttgtggttacttaagttgtctggttcgtctaaggaaatgttttagaaagcattaatttctgatgtattcggtggagaagagtgatatggggccaacccaatcttgaccagcagaaagcctgcgatatgccgtgccttctttaataaatatgagatctgacttggtaggtagacgttgccaattactgtacctaataatttatccgatctcctatttgttcagatcagatcacttaagtaaccttcacagaacatgtctggctatgctctgttgtctcagtcgtgcactagtagtgttcaggatctggtgcatttgccagtgaattctgactgcttctgttaacatgtttggctatgttctgttgtttcagtcgtgcactagtagtgttcaagatctggtgcttttgcttgtgaattctgactgtttttgttagtttgggaaagttggtcgacttgtctcatctgtcagatgctcatcagggtatgtgttgtactttacgatccactgaggaagcaactctttcgattacaggtcacagatatatccgacaag

SEQ ID NO: 10706 - DNA, 58 bp, Zea mays
cattcctttccatctgcagccagcctctgatcgccgtcgaccgaccgatcggatgccg

SEQ ID NO: 10707 - DNA, 1359 bp, Zea mays
gaccagatctagctagccagatcgacattatctacttaggatgggttcagcccttctagtcaaacttcagtgtgcccttttattgtacaagtcgaccaggttaggktgatggcgaccaagcagacttttcttatggatttcaaagaattttctgtggatcaagctataaataaccattctttagagataaggatctatgtcatcgagtatatatacttctccactttgattaaaaaggtataaggcataagtatttttccaaattttgaatctagttgtattatttcaattgatacatctatcagcgacattttttcttgaaatattaagataccgattgaggaagttaatttacttatcaataatgaaataaacccaaattacattggccaacatattattgcctatagagagattgatgacaatattttatcgaagttaaatcttacaccaatgaatagtttggattatgtatctatttgggttgttttatttattttaaatctagtttatacttggtcccatatgaggtgcactttttataattgttttggatttaatgatttgggaccaagattgaaaaatattgcagatactgatgttgattttgtaatcaattctagaacaagtgcaatggtgtagtcgaatgagttgatgtcaaatctaatcctttgtttgcatagcttcaaaaccaacctcataagagtctgctaaagaaatcaatacctttgaatttacttttgttgatcacatctttgatatcttgctagataaccattttatcagaataatcgattacaatactttgccatctattcaaaacttagatgagcttacatattacaagtaacataatttatttggttataatacttctaactacaatatattttgtcaagtggatcttgtcgatcatggataaggacaatcataattctctaaaactcaataaatgactaattggattgaattaggtgttgtttagttcacgaattataatgtaaatgacaacggtgaagattcgcatcgagtgacagcgataataagtttgaatagacatgtatcaatttttagtgtagtatttggttacagtttagacttaaataaacatagtttaatattatttgtaacccatcacgttataattatgtggaccaaacattattaaaaatgacaaaccattactagatggagtgagtactgtttgtgacgaagtgtactcatcaataaataaaacaaaataagagcaagtctagcttcccggtcaacggctcctcgtataaggcacccctacttgtatcacaaattcacaaccagaagcagctctcaggattcgtagcgcctgcatgcagctccagg

SEQ ID NO: 10708 - DNA, 80 bp, Zea mays
ggtgagcggggcgccgtggatctgatgtccctttgagattctactctgcttctgttctccctacagcttggtgccttatc

SEQ ID NO: 10709 - DNA, 698 bp, Zea mays
ggtccgagtcagccgccgcctcagacgaatctcccgccgccaccttctcatcccccatccgcgtccgtgcttctgccgcctcagcaccaccaggggcgacgggttcccaccgtcctggaggggaaccttacagcggtgggttccctgttcgtttgtcgccaacggagccggctttggcgggggcgatgtctccggcggcacgacgctgttcgtcggcgacctccactggtggactaccgacgctgatctggaggctgagctcagcaagtatgggacggtgaaggaggtgaggttcttcgacgagaaggccagcggcaagtccaaggggtactgccaggtcgacttctacgaccctggtgccgctgcttcctgcaaggagggcatgaacggccactcttttaatggccgtccatgtgttgtggcattcgcatctcccaacactgtgcgtcgcatgggcgaggcgcaggcgaagtcccagcaggccttggctgtacagacatcatcactgcaaccaaagggtggtagagggggtggtggtttcggaatgcctcatgccggtggtaattacagtggcggacgtggaggtgctgtatcaggaggcggtggtgggaactggggtagaggtggtggtggtagaggccctattggtaatatgaggaacaacagaatgggtccggcagttggccgtggaatcggga

SEQ ID NO: 10710 - DNA, 956 bp, Zea mays
ccgtttctagggcagcttctccttatttttacgaagaagtcaatagaagagcctctcatttagagattttttttcaaaaaaattattgaaggagcatttgaaagagccctaccaaaaaagatctaaattttgataatataaatttttctatgtatacacacttgactattttaatatgcatccatctctatatccacatttaagtctgaggtcgactctagtagcctcgtatgcgatttcttatctcattcatattttaaacttcactttgtaaagtgtcatctagagttacacatcccctattttacaccgtcgactatagaaaaatccatttttcatcctcatccaagtattattattcgctccgaatccaaaaggaaagacgaattaacatacgacaaagatattctcatcgctacatatgcagctgctgcgctcttcctatttattattcagaaaaaaataaattaaataaactattaagttcctcgtctgacacatggccccaccgagccacaactaaactgtcagtgtccctgtgtactgtactccactgtactgatgccactcgttcatcagctcagctcgattcatcactcggcgacaagccgcacgcgggtggcctcaccggcggagcagcgcagctgacctggaccccaccaaccgaggcccccacggcctcgtctccccgccacgaggccccatcgccgggagatcggctcaccgcgcccacttctggggctagtagcctagcctagcctgctgctgcttcactcctagtctccaccgctattattactacccctactacctcttggttacaaatcgcgaacgcttgtggtggcagcatcggcagcgccacccgcacccggcagcagcagcgcttgtggtgtggctcactggctcctgtgtcggtcacggcctcgaccgatcgcctgctgctgcgagaggaggcg

SEQ ID NO: 10711 - DNA, 157 bp, Zea mays
actgttccagcatcagatattcagatcagatcgatcagaccagaaagtttgcgctcgtctgcttggtaaaggaaaggagaagtttccgaaataggggcggcgcgccgggcgcattttggttgctggattggaaccgagcgaacgcgccggagtccgg

SEQ ID NO: 10712 - DNA, 1500 bp, Zea mays
tggaaccaaacactacctaaaaacgatacatttgtacaacaagtgatctcttgacaagataattatttatttttatcattaactatacataaaaacatcgtcacgtgtaagtttaacggttaccgtgggaatgggatgagaatgtttccccatcccttccccgtttaccggtcggataacaatttctccatttactttcccacggagataagaaacttcaaagttctcatctcctaatagaagaatttctcgcggaaaaatgaagttagagccccattgccatctctagacagggtagtttccgatttttctccaacgactatttaatacttgggagctattaaaggagccgagtcctaccaataaagaagagaatctttatgtataagatagagaagctgaaagttttgatctgtatggtctcaaagttattaggagaaagtggctagtttttaggaagaagtggctagatgacgtgatgagtaaaagagtcatttggtctctagtttggcctccagctatgttaaaattcactggcagtagacggaagtggcacaccggtaagagaagtttcatgttctagtgccgatgaataatatactttaggctatctctaacattcttatcttttgttttactctctattttaaactacagtctataaataatttagtctaccgtgtgaaacgatattttttatggatatatatatccatgttttgttgatcatagcctaatttattaagtgtgtatatagttatataaaatactgttttatagtgtagcttatattatttatagtgatgtttaaaatagaacgtgaaatagagaattgatactaagtctgccggaaatagtcctgcatagaaacgtttatataggcctacaaagtattgtctcacactgtatatacactgttttattgaatgaagtttaaaataaaattttagctacaccctggaatgaaataggaagtcagatagcctaataatgcatataggcagaagcgagcccatatatatggtgcggagcatcggcgcagcccctttctccgccccccaccgcgcaccgcccgaccagcgacgggaacccacgccgccccctctccgccccgtgcagtcgctccccagctcccgcgccgccgttccctgctaaccccatccccttcgcctcgcctcgtgctaagagagcgcggaccactgcggtgccacgccgacgccttctgccggccccaggtggattctgtccgcagactcctggaggtgctgctatctagccccttgatctgagctgaaattaggtacgctcatgccgtctccatggtccaggagctcttccgttgcacgaatcttggttcaatctgtagacggggggaagacggggggtgcggtttgcttaagtggctgcgatgctatgctcatgtgaacagatgctcaaaatcgcccatttccccctctctttttgttctcgtgcaggatctgaacctcccggggcgagctg

SEQ ID NO: 10713 - DNA, 1500 bp, Zea mays
tcgctgttcccgtatctgctctgccgaggcctgtgtcgttaacctgtgcagcgcttctcgcccggcggcggcagcgacggagagagcgtgctcttgctccgctgctgtgccgtgccgctcacctgctccaggaaccacaccgtttctcctcgctgtagcctgtaggcgtgctcctgccgtgattcatcaacaagggccttcgcttcgctgcacatgtaagtttcttcagacaactgatggtgcctttcttggcttaattcctcccgcgcagctcccagcttcagtttcttctccccgtagcgtttcgatagcctggttgttggttagtctgcaagagacggtgcaagtgtgcacggtttccttattcgcgccgcgccctttcgcaaggcctcatcggttttctaaaaggcgggcaggactagtttcggtgcagccgtctactctttatgggatgacactgatgacattttactacacacaaactgacacaagagagttctgattctagtacagtaggaggcagatcaaattagctagcagagttgtttccctcacgttttaacactgttctgacctagctacacaagtttaaggatttattactcagttctccatcctccctttccaatgaggcaacgatggccgtttcttacttcgttggctttcttcctcatttcctaaattttaagccaagaaagatttttggaaggatactacaacaagattttttggaaggtggttgtttcttcatactcccttcctttgcggtggtctgagacatggagagataaatgaattgggaaagttggcatcgtctgtgtgtccgtgatcatggccacggagatacagctttgcaagaatgattagctttctttttggttgaggggcgggcgactacaccactattctttcctggaaagctaagaaatattgatacaatccttttccctttttcccaaaccatgcacttattcactaaaatacttttctcctgtaaacagatttttggttatttttttcactgggttaccttgtattgcgttgtcaactaatcatgcatggtgtgtgaaaggacattgtttggtgctgaacatcattcttattgagtgccttgttcttttcgtctgttcggttggtgcttctttatgttcaaatcatcttgacatctggccaaatttggattttttttggtgttacagacttacaggtccatagtacgttatactagtaattacatgcctatattgctcctttatgtgtttctgaagctttaaccaattcatctttgtccttttcttcttaaaaaccactagactcgtgttattaagtaatacattactttcatggagcttaaacatcaattatctaacaattacttctttatactggaccaccattacgaagacatattaatccacatgtggtggataatggacttacaattaactcccattactttctgtttctttcagaggaaaagaataagctggctcaaagata

SEQ ID NO: 10714 - DNA, 258 bp, Zea mays
ggtaataatgataatgtcataataggaaataagacctatttttggtattatcaaagaaattgttgaactaaactataaccacaaaggtactgtggtgctttttcaaatgtgattgggttgacaaccgtgtgcaaaacaaatgggtgaaaactgaccagataggtatcacatctatcaactttaagcacttgttcaatacaggtgacaaattatctgacgagcctttcattttagcatcacaagcagttcaagtgtact

SEQ ID NO: 10715 - DNA, 717 bp, Zea mays
atatacttcattcattttggaatgacatatttaaatttcttgacatatttattattttataacaattaaatgaattactagatatctatttatagaaattgtaaaataatatataaatatttactatattaaagcaccagtttcaacggtggtcccatgttaatatttttaaaaaaaccctacatttctttagaaccaacccgcattcctataatctcttctctactactataataagagagtttatataaaagtaagttaaaattatgtataagtgagtgtttgaaacttagttgttggctccacattcacaatttattctatgtcatatatataaaaattttagcaatgcacgaacatatgactagtgcggtcaaagcttgacatactatattgttattaatgaatatactcataatgtatccattgctatgcttataatttacatgtaacatgatattttgtcaactgtaaatccatcgataaaatagattcaagtcatgtgagtattcgaattcaaactatccgttttgtattttatccgataatattcatattcgtatgcgtatttgaattaaaatgtggtaaatagtgacatacaaattcgccgcaggcgtgcaagttaagggaccactttaaaaaaggacatccatgggctccatctcgtcaaaatctgggcggtgaaaccctcaaaccctaatcctttggcccctcacc

SEQ ID NO: 10716 - DNA, 1500 bp, Zea mays
tgccgtcctgcgtgggtgcrtgcgtggacgctggtctgctgtcctgctccgggcgaaatgccgccgccgctcgccgtgactgatgctcctcctcctggtcgtgtccgaacgcgccggacggtgccgccggtagcatgtaggaactatacgctccgctcggacctggtcatgatcgatcgatggtgtaggggaggtcatgccgaattttttcgcccggttctctgaacctgccgccactctgcaggcgggggaggtgctgcctctgcatgcagttgctttccttgcagctatagccaaaacaaacaaaacaaaagacgrgtttttttacggctgttgtaccagcctaccaggggatagctagcgactagcgtccgtgagatccagagaactattgtctgccacttgacgagatcctaggggagcggagggagcctgcttatccgcgcaggaacgacggtgttagcttctggatctggggtttactgagcaccaaggctcttgcaaactccgggtttaaggtttcatatatatatattttttgcatactcccgagttggtaccagaacgctagtagatccggcgcttctttgtttcctctttaattaaccaatatttttgcaagaaatatttctgtgacgattttcctcggataagttgttgccttgttggctttatccgtccggatgccccgccatgtgctccttgtctcgggactcggagacaggctgacagtcctgggttcttgtgctaatggccatggttaacttacgttaatcctgcgccttattatcatcatctaggtgtaattacttccgtttgtgctaatcacctcgtgattgcctgcaataaggaaccccagcccccccaccttgctgatgccgtgcttttctagagaagtaccctgccgcgtcacgcttcgtcctcgcctgctttggattcaacggctttttggaggccgaggccattggtgccatgcggccagcccttttcttctccatggttcccatcgatgtgttttgtttcggttctctcgtcagaatctgtataaaataggcgccctcccttcttccgccatttccctcggtcctctgaagcgtttcagttcatcgattcagttcttgtatgcctcttgttgtattggttgtttcttctttctggtctaggtactaggactatagtaccaggatctgagtcgtttttttttgggtcttgctcctgtctgccgtttctttccccccttccagagttaggttctgttggtttcttgcctgcaatatagtttcgtggcgcagcgtcaagggtgtgtcgagacttaaaagactggttgttggcagttgggtttatgtcttgctggaggggttttagttttaggatgtcatcgcagcttttatgtcaacggatctgaaccgtttttcggtttcagttttctctgctgactgaagcttccgcttccgtttcggtttcgctgtgcaggcctgaggatccaggaagaggacagca

SEQ ID NO: 10717 - DNA, 692 bp, Zea mays
atgactccatctgagattgctaatatttttttttgaaaatattgttttagttttgtatgttaataaattataataccataaaatagatatttgagacgctaacaattttaattaaaaaaacttatcaaatactctgatcattttagcacttaaattttatatctatattcaattaaatgataataaatctacacatatataaaacacatgcattaagttttgtatgaatccattaaaatgctaacacgacatgcatctatccacccgagccccggccatctgtcgtgcacgactgcacgtgcatctatcgggccatcttcatctgtccatgtccatccacccgagccccggccatctaccctgagtgaactacagtgcacgtgtacgtgcacgacaggggatgatcggacgaggacgagaggaggggagggacgacgcgcgagcagaagcaaccagtgacgcgcatttacggcatccatttttccttgggggacgccccgcgtgattgcagcacacacgtacgcacgacgtgatcttgaccatggctgtttagctggtggattcgcccaataagcatattccacggccagaacgaccggacagcagcagagatatatgcacggccggggagaagacacggacacgcgagacggacagggcagaggtgacacgtacgtactgagagtcagtca

SEQ ID NO: 10718 - DNA, 523 bp, Zea mays
tgtatttatatacgtggtatggtgcttgcaatgcgtgtaaaattaatcgcacatttatagcaaaatgatatttttttttccgttgcatcgacgtacgtagaagaggagagagatccaaaaacgcatttgtaccccaggaaaagaagaacagaagagtacgtacgtagtggagcaatggtgcgtgctcagcgggaggccagtgcagtatatagtaggtagggttcgtgggtggatggcgctgctgcatgcacatcagcgtatgcctgcttgcctttgtggatcggaactacccagatgcgcatgagccacatgacatacctaactccatggatgcatatgattatgcacgtcgtcgtccatatattcattgcgattaatcctcccatcatccatgtccattatatactatactccctagctagctcctagcaggcagagcagcgagctagctgtgtaagaagaagaggaggactggaggaggaagaagactatcgatcgatcgatccatccatccatcgaatta

SEQ ID NO: 10719 - DNA, 1500 bp, Zea mays
gaatgcctcccgacgtcgatcggggacgggtgagggaggcgtcgccaactcgatttagcgcctcctagcgccagtgacctggccggagggcggagacgcgagcagcgactgggcaccgaaccctagaacaggcgagtcctctccagactcgaggccgctggaacgagaagggaaagtccgggtgcagccgatgggctgcactgttctgggcagctgtttgggctgcagctgatgggttgtgcttgtgctgtgtagctggctagctgcagcccaactgcccaaatagcaagaagcagctgtttgggctgcagcctatgggctgtgctgtacagctgcagacccaaacagccgcaagaaacgagcagtccaccacatgcttgaaatatcatcttgaagagaagccctaaacagaatcctattttgaaatgtaggactaaaacatgctccaacaaaagtcttatcttacaaaatttcatcaataattataggcttggtctctcgagttctaaatatattgacttatatactggagccctattcccattttatatactatttctaacattttattttctaaataacataatatattttttaataatatgatatagggactcatatcatacttttggttggagatattctaagtatatcacactttcagcggtccaatgaaatcacatttgaattcaaaatactccaagtttttttggtacatagattttgccatatatcttaggcacaagtgttttgttttggtatatgatgacaaaatcgaggtaaaaagaagtcaaagcaatttatactgtggtttagagcaggagtcaaagcgatttatagtttagaatgaaagaaccaacagaaatacaacgacagacaaacaggtagtgcagttcagttatccacccaatttgagaagaacaagtgacaatacatttatcaaaatcaatgcggatccctttcaagtttgaggtttgagtttgagagacggtttggaaccccagtaattcacaggaactcggtaagattctactagtaaattcttttccgattcatggacatgtacaaccacaacggggaagcatggtacagctggaagtccaagacacgctggtaacgctatgcatttttcactgagcaaatgtccaagaaaaaaaaatgagcatcacatcgatagcgtctctcactcacagtcgttgttcattcagggcctatactgtgtgcatgtagatatctaaagactaacaggcagacaggctcgtcttgtgcttcctgtgcttcagctgcggcgcgccatcaccggcggcagcggcacctcccttgaccacagccaacttgtcatcgctcccggtcgccgccgccgccttcgactttgacgtctccgactttgacgtctccggagcagcctccttgtccttggtgccgcagacgtggggctttgcggcgagcgcgaacgggaacctgctcttgcccgcgctcctgctgcggccgagccgctcg

SEQ ID NO: 10720 - DNA, 1500 bp, Zea mays
ctggtaaaccggtcacacgatcagattttttgcattttacagagaaaaaatgaaaaaaagttgtcagggttcatttgtaatttgctaaattcacattgtacagtaaataataattgatccacacaacatgtcttcaacaaaatgacatacaacatacatatgcaaccacaaaactctagttctcatgcaacaaacaaccagcgaactccacaatactctaatactaattcttttatagttctccaacgacatataggttgacttgtttcacaatactcacgtattcagctcgagtcatagtgatagtactcaggcatgttggaaggatcgtgatatggtcccttatcccactccccctgcaccatatgatccagcatcacctccccccatcaccatggttgtcatcgtcttcataatgacctacactagggtcagttgtactatcatcaatgtctttatcctcttcttcttcgatttgatcggtgaatgtgacccttttttcctttcctttctgatggactgttggggcgaaggggaacacgctacccttcgctcgatgacttcgtcgcctcctcactccgacgaagacttcatccatagaacatgcccggacaagccgaaggcgtcgattggatgaagaccgatgcggtccccctttgtcttctctgttgcaagacgaaggctctgtcgaagtctatgagtctcacgtcgtcaccgccccgggaggcccatgcaggattcggcccacggtaacgggccttgcgaggataagcgtattacgggccacgtttgtaatagcctttactataatgattgtctgtaacctcccctcgtgggaatattctggggataaactgggtacttgagggcataaacgtctttgacaacggacgggtggccgctcgagtgcctataaatacccccgtacagtgccctcacaggggtagattaacaaagctcttgccatcccatgacaaactttgcaaatactctttccgctttcccgttagatctacttgcccggtagagcaagttccaacaatgacaccatggaaatcgtggcatatatcgaagtcggcatgatactgatggttgtaatgtagtggtgaaacaactagattaaaataacaaaatttatttatgatcaggatcacaaatggattatgaaatattttctcataacagtataacacacattttgtatataagttaccgtggtattatatgtccccgttgcaacgcacgagtactgacctagtaagaaataaaggcctaacccatcatccatctgccgtcgcttgggcccacggcgcgcgctcgtgcgggaccgggacgagcgcgagtgctccagaagtcgagactcgagaagccgcaagtgggctcttcggtctccggctccaatttctatttcttttactatatatactaaatattattttccatcttcttgctcagcttcttccccacccacccccaatctattccctaaccctagtcgcc

SEQ ID NO: 10721 - DNA, 1500 bp, Zea mays
ccagaacagtgcagcccatcggctgcacccggactttcccttctcgttccagcggcctcgagtctggagaggactcgcctgttctagggttcggtgcccagtcgctgctcgcgtctccgccctccggccaggtcactggcgctaggaggcgctaaatcgagttggcgacgcctccctcacccgtccccgatcgacgtcgggaggcattcctggcggcgtcagcgtcggcgtcggcgtccccgcacgcgcgcactactgactcatctgtgcagatcgagccgtcagtgagcatgacagatcttcctttataagaagagttgacaatgtgtgagcatgactgcatgagaccttttactgcgtcatatattttcattgtaatttatatacgcgtcacacttatttttcaacttgacatattaggacatgcctccatatcagttcatgttaacatagaaacgtcctccatattatgagtcaatgatccactctgttttttatgcaacttcaaaaagcaatggacattcctagggggcgtttggcttgaagataatcactctcaaccagccaaacgttcaaaattccaactgattcaggtgggggcaggagagaatcatttcttcatttacactaggagctaaaaaaacattcttcaccctgctgcctattatattgtggtggggatcagcagagaaattatcatcagcttaccaccttgttccctcctaggaatccaatggaatcctcaatcaaagaatcaaggagtagagctgaagaatcaggaagtggagctctcccaaagtgggtcctatgttgtcaacctaatccaagcaatagctgcaaacagctcccttgaacatatgtattcatgttgctgcatgtactaattctacttctatcttttggttggtccctgaaaaaacagcttctgttaatttcgataaccggcattcagctctagaagatagctgttgcaaggtaagttttggatccatgtattgcagcttcctttcaaactaaatggcactcctgcagaacattttgtttgcaacattttttttgctcctagagttcaattttaggccaactcaaatgtaagtgcagttccagcccgagtacaactatggaatagtgcaggcacctactgattggaaatttgtgtttgcgcatgacctgttctatcatgcacatagttttctaggcatgcacatgatacaattattagttagaaattcaggcgataaacaaatatcctgataattctgactggttagtgaattttcagatacgccactggagggtgacaactctggcttactcctcgacgtcatcatgctctgcacctgaagtttgtggctacgatctgcatacaactccagcgaggcacaaccccgtcgaggcaagtgttagctaactttccttgtatcctgttgttggtgatgcacgtgtggcgtatagatcttgtaatcagaaagacatgtaaaaaggaaaagtgacgcgcag

SEQ ID NO: 10722 - DNA, 395 bp, Zea mays
ctaccatatatatttctttttaggtccactactaaaacccactaatatcggaccactgatagcaaaccgcacaacccttcagcccaaagcccagtgggccgtgcgcgttcccatccgcgtcaacgacttaagggcccattcgtttctgctaaaacagaccagaattaatttcaaatctccaaaatttatagtaattattgaagaaatcaaagccagatatattacaccccctcattccagcgaaacgaacaacttgtccatcaaaatgaggcgaacttcccggttagttcccgcgagagacgtcgttattctcttcggattctggggagggcgcgcgcaaagcaaacctcaaacgccaaacgcaacacccgccagcaggccacctgtgagcagcg

SEQ ID NO: 10723 - DNA, 534 bp, Zea mays
cttttggtggccagaagctgccagaagccgaaacaaacatgccccataccaggtctatgggcgggctaccgggtccaggcagcccacggactgggccctccattcccattccccttccgcgtgcacgtgacgtggggacgatatcgcgggcggcgtttggttcagagtccgacaaggcaaagcgagagagaaggacacacagcgaagctaagcaaagcaaaccgaagccggtttcatatcgcaccccgcaccccgctcctccctcctcctgctccggctcccttcctccacagctcgaataaagtcccctcctcttccagtcttcctcctccgcgctccaatcttcccagcggcacggtttcggttcttgcagggtagcacggaggttccttcgttgggggttcttggtctgccttgagcgatttggtgcgccgcggattgttgtggggttgtgagttgtgactgcagagacaagggccgtgtggagagtcgagccatcgaggtcgaggaggagggaaaggaaaaggggggcgc

SEQ ID NO: 10724 - DNA, 67 bp, Zea mays
ggatggttagtttattggaagttacctatattggaagaatttgaaactgagacataatcttgatatc

SEQ ID NO: 10725 - DNA, 383 bp, Zea mays
acaatttctggggacaccaaatccttgggaagtcaggaaggcacgtaggaggaccgtgtacgaacgtgaaagaggtactacatgtacgggtcttatttaccaaaactgtatcatgggaacagtcggacggacagtgcccccaaaatcattagtagcatgcttcattaatcacggtacggcgcggcggcagcaggcggtgaaggtcagcacgccacggtgcgtctccaacgaggcatcgcgtcgcatctccactcgtcctccagctgctggggttgccgtcaccgtcaggcgaggtcgtcgcctcgtgaggaacaggaactcgatattgcttgtacttcccggtggcctccgcggtccggtgtcccatcccgttctccaacctg

SEQ ID NO: 10726 - DNA, 1377 bp, Zea mays
gatggcgtagaccgtcacggctctcgagcgcggacagagagaatgtgcgttcgcaagcgcgaatacacatgggtggaagcgattggttctagcagattgtgaaaaagagaggagagagagatagcccacatttaggggacgcaagaaggggatatcgtttttcgtagccactttcacgatctactggattgtgctataataacagtggttttctatttttcgtgtgcttgacaagacacgagacctgttaaaaaagcctaagactatttctagcaaactttctatcacacttcctatttcaaattctactctgcaaacggtataatatacaatacaaaatagtactttatacggctatttagacggtccatacaaattagctgtttacacggtgtggtatatgtgttagctttcgtcttcgcctcggtttgggagccacatggatcggggcacagagattccgtgtgatcggggcacagagattccgtcgtaaaaaaatcggtatggcgttggtattcgttctctcgccactagccgctagtgaaagaaggggatatatattcgtgtcctccgaattagtccttcctgcagtgtcctcgccgacagggaaagccgtgttgcaagaaggggaattccgctgcgagatccgtgaacggtcagttcgcaatcactcttgactgtgtgtatgatttcagatcatgacgcgagcttagcgcgtacatatgtcgtgagcttagtggagttctgaatccggccacgctggttcagtggttctgtgtttagtccgtggagctctgatccatggatttcgtggttacatccaaatattcagtgagagatcagaagttgtatgtttagtttgaatctggtgcatgttggggcaggccgtctgggtgattgagatttagacgtgtatcatgtgtgggcaacttgctggattctttcgttttgatgaggctgctcataaatggagactatttgagcttgaaaacctgttgacttttgggttgtaatgatctggttcctgcgtgaacgttaaatccggaaactaggaagatgtattgtgaccttttgggaggttaaaccgcgcttgctgttgctgacgcatgtttttttttctgattggtaaacttgaatcgggtattcaggtcaatacctgatttatctgttcatctgcagtagttcacccttttgtctaggtttagtgtctgcgatgtatctgttcatctgcagcgttttcttttgctgttctgaatgttacttctaagacttaactgtatttctgttatgcaaataatagaaatgggggtatccttcctctcagcgagcataatctatttgctgtgatgatgtatatactttcttgcaggttcagag

SEQ ID NO: 10727 - DNA, 1500 bp, Zea mays
cttcaacatgtgtgtttgacctagagatagagatttgagtttgatttgcaaaaacagaccaagtggtggcaaaggatgatccatatatgccaaaattgaataaaactcaaatttatttttatttgaagtgattttgcacttgttctagttgctttatgttgtgttggcataaatcaccaaaaagggggagattgaaagggaaatgtgcccttgggccatttctaagtattttggtgattgagtgccaactcaagtgcttaaatgtgaatttatgccatggatgaataaagtgcaaatcaagagcaaaggtatgtttctaagtcttagtacattggttttgtgtactaatatacttgtctaagtattggaaacaggaagaaaaagaaaagaaaagagttggctgtgtacagccagaaggctgcttcggtctggagcaccggactgtccggtggtgcaccggacagtgtccggtgcgccaggctgcctcggccgaagaggccgctctcgggaatttgctgacggcgtacggctaaaattcaccggactgtccggtgtgcaccggactgtccggtgagccaacggtcggccgggccaacggtcggccgcggattctgcgcgcgacacgtggccaagccaacggtcggaagggggcaccggactgtccggtgtgcaccggacatgtccggtgcgccaacggctcccagatctgcaacggtcggcttcgccatttaaggaaaggaatcgggcaccggacactgtccggtgtgcaccggactgtccggtgcgcccgatgacagaaggcaaggatggccttccagatttgttctcaacggctcctagctgccttggggctataaaagggacccctaggcgcatggaggagtacaccaagcattcctacaacattcctaagcaccaagacatcgatctcacgcattcgtttcattgtgatagcatctagagctcttgttgagttgcgaactctttgagttgtgttgcgagctcttgttgcgacttgtgtgcgtgttgttgctctgatcttttgaagtcttgtgtgcgttgctcattccccctttgctctgtgttctttgtgaacttcaattgtaagggcgagaggctccaagttgtggagattcctcgcaaacgggattgagaaaaagcaagcaaaacactgtggtattcaagtgggtctttggaccgcttgagaggggttgattgcaaccctcgtccgttgggacgccacaacgtggagtaggcaagcgttggtcttggccgaaccacgggataaaccactgtgtcatctctgtgattgatctcttgtggtattgtgttttgttgagactcctttctagccacttggcatttattgtgctaacacttaacaagtttttgtggcgataagtttaagtttcacaggatcacctattcaccccccttctaggtgctctcaattggtatcagaggagttctcttcaagaaagggactaaccgcccgaagag

SEQ ID NO: 10728 - DNA, 1500 bp, Zea mays
aaaaacttcaaaatttcataaattttgaaaaaagttcaaaatttatggatcagaaacctagatctggactaaggctctgtttcaatctcacgagataaattttagcttcctgctaaactttatccatatgaattgaaatgctaatctcactcctttgggtgtttggaccattctaataaagtttagcatattagaataaaaagacatatatgcccctaatggagagagaatgaggttagagggtatgggtggaaaataaagttcctgacccacgtttagctccttttagtatcccttgagcaacttataagataatatgctctaaattttatcacaccactattaattctcctatttagatcaccaaatagctaaaagtactaaaaaaactgctaaagtttctcttaagattgaaagagagccaagaaacagcaaacgaattacaaaaaactttgaaaattacatgaattggtaggggccgcgcgaacgcgtaccccctctaccacaaattatgacgtccactctcccacttggggagatggtaaaccaacgcacccaccaagtgcaatgtgggccattgacctaggccacgggccttcttgatagcccgtagaccccgtccaggtaagtatgttgcaaagtgggcaggggcgctggttatgtagcctcctcactcttcgcacccagcttcaggcggcgaggtgggactaaccgaaacgcgcctcacccagtcaccctgtcgcgcgagcgctggaagtgggcgagcgctcgttattttacagagcccataaacgaaagcccatgaaatcttccgactcgtgcgcgccaaccttttcgttgctcgctcaccgaccggcgccatcactcgctgaaatttcttttcccaatccagttcattctgccgccctccaatagtccaatccggccaccccaatgccgtcacggtcgggctcccggggcaggcggccgcggccggccccagaggtggctgctcccacggctgtacaagtgagctcgtccggctcgagtgaggaagggagcgatgaggaggaggaggaggaggggagcgagggatccggtgacggtgcgaggagcccgggcggctctgccagcaagtataaggcggcggagagtgaagccgaggcggaggacccatgccttcccagctgccccatttgtatggtcgcgtggagcgcgatgctgacgtgggtatcgtagcttgcatgtagccgggctcaaattctgggccgtccatgcttgcattgcgttgcatgtgggtgggtgacccgtggggattgccgtcgatttcgtgccttcccagacacggccactgcatggcctccactctccctcccgtaaatcttctccgaggcgagggcccagcttcacacacactgtaaatttgtagatcgtctccgaggcgaggagagagagagagagagagagagagagagagagagagagagagagagagagagagagaggagagagagggacagg

SEQ ID NO: 10729 - DNA, 831 bp, Zea mays
gttgctcgtgtacaactagctctaccaattcgagggcctctagaactacacctctggcatcatcgaccatgtccgcctccaagggatgacgatgatgaggaagatacataagtgggaggtattgatatacaaatctttttagttaatagatggctaacagctatagtgatataattgtttgttttaatatgtcgtgaattgcaatggttacaagtgcctttgtttttttgttttgcgagaaacataccacttgtctggtgtcaaggttcttcatggccttgataaggttttggaaggtggtgcagttgtcatgactcttagagatcatagtagtccttctaatggggatatcaatgaaagtaaagtttcctatatctttccccgttatcgtttctccatctgcccatctccaaccatatgtttttgatgattttgttcctgtatagataactttctattgtatcatgcatgtgaacctatttgctttcatctctcgtgacatattggcttgaagccatttgctgtcatctcttggtcatacatatgaaatcttttcatcttctcatgcttttcaaatcttttcatcttctcgagctcttaaatttcatttgatcttcatgaaactgaaagactgaaactgtctgttaattttatttcatggccttgrtgatttgaagtcatttgcttctacctcctctcacgcatatgaactatttatttgtttcttatcatggttgtgctttggtgtcctgaatcatgactgtcaatgttcgcaacatatgttcttgtaggttgaatagaagagaagagtagaagcaccaagctgtacca

SEQ ID NO: 10730 - DNA, 617 bp, Zea mays
gcattcatcctcttccaagttccaaaattaactcaatcacttagtgacttaagagagagagtttttatgtccatttgtgctcttattgcttggattgccttctccctttcccaccctttattctctaagtgctttgtaaagctagcaagagacacctaagtgtgtggtggtccttgtggggtcttagtgaccgattgattaaggagaaggctcatccggtctaagtgaccatttgagagagggaaatggttgaaatagatccggtgtttgtggcctcctcaacagggattaggttctttgaaaccaaaactcggtaaaacaaatcaccgcgttcacttgtgttgatttccatttgatttgttttccctctttcctctctcttaagtttccttgctaatattgatttgagtttgctcccaaacgtcatccgcattaattgagcaactcatagcaagagaaacaatcttccgcactcagatttaattctaacgctaacccataccttagtgtgtgtttaagtttataaatttcaggtttcgcctattcaccccctctatgcgactttcaattggtatcagagccattgcttcattaagagttttaacaaactcgaagtg

SEQ ID NO: 10731 - DNA, 497 bp, Zea mays
ggtgtcctcctgtcctgatccacgtcgccgccactgacagactcctctctcaccgtggcacgaattgatgagccacgaattgaggattgatcaaggtcttggcatcaacaaagctgccagcggtttttcagcttcattttagtttgtttatatagatctgtgccttgatcgaggtaggacgattcctagttaggctttgttcgtttacaccaatcccgctctggattaacatggattggaattaaatccatgcctcaatccatgccccaaaataatccatgactacttaattttttttattcggttaaacccattatggaatataacccaaaggtttgggaattttttaaactatgaaagacatggattctatccatagcctattaggtatggaacaaatccatgagatattgcacaagtttacattagaatccatggatcaaaagaataactagctttgaaagtcacatggatttgttgatggatttaatcccacc

SEQ ID NO: 10732 - DNA, 1436 bp, Zea mays
agcgttcgctaaaatgagaatcaactttcctgaatttcttctcctgacagttcttccattgttactaggttcataaccctgagcgagcctagtgtttctaggccaaaccattactaattatggtcattctttaccatggagcttttaaagctccataggtttggtatctgtaccgactttacaatactatgcgttcaaccatagttttcttttactgggagatgaaaaacattcaagatcataagcatgccaataacattagatatcaaaatcagctacaactaagtaactaacatacatgacagatgggtcatgaaaaacactcaagaccaagttggatatgtagtttccatcaacctgaaaaaataaatatgaaagattagagagataggtagatatctgtaatattatacagttaaagaaactaccagattattagagaacctggttagcattaccaggggttgctgtactagctgttaggagaatgaaaacccctaaccctaatgagtaggggatgtattgctatatagttcatggccaaggcacaatacactaacacccacaaagtcgcacctctattttgtacagatgttaagaccagtggtggacccaacattcgaaaagtatgaatctaaggtagtcraggacaaaaaaaatgaactttataggctaagggagatccctggtaggatccgcaatcctaccagcaatccattcatgttcaaactttatatatgaaaacaaagtgacataaacattttgttctgaagttagcctgctaatgtgttagttctggaagcccaattactatgtcttctttttttcatgccatattggatagggcacaagctccatttacattaattgtagttttattttagatagcatttcccatatcattttctggtgccttgactcttgataatgttgtaaaagtgcctctgcctccggcatgaaacaagaatgttttacatacactcaaatgcgacctatattagaatatgttttaaagtttgtctaccataaacattagagtagtacgatgtattataaactattttaacatattgttagttgtatataacttttaacatgatgtttgattctcatagcacctccaaatttttttcttaaacttactccattcttaaactcactctaaattaaataatcatttaagagttatttgaataaaaattgttctctatatcttttcatcttgtaatagcttctctacattgtgcagctctctaattgcattctcactatatctatgttgcttttggtaaaaaaacgatgttactgtttcagattggattgacatttgtgtgcaccaagtgcgacaaagtaaagaaaggtaaaggagggcggcctaatgagaacatcaaggagttccaagaaacaatcagcgagctttatccagatccaccagc

SEQ ID NO: 10733 - DNA, 1299 bp, Zea mays
agcgttcgctaaaatgagaatcaactttcctgaatttcttctcctgacagttcttccattgttactaggttcataaccctgagcgagcctagtgtttctaggccaaaccattactaattatggtcattctttaccatggagcttttaaagctccataggtttggtatctgtaccgactttacaatactatgcgttcaaccatagttttcttttactgggagatgaaaaacattcaagatcataagcatgccaataacattagatatcaaaatcagctacaactaagtaactaacatacatgacagatgggtcatgaaaaacactcaagaccaagttggatatgtagtttccatcaacctgaaaaaataaatatgaaagattagagagataggtagatatctgtaatattatacagttaaagaaactaccagattattagagaacctggttagcattaccaggggttgctgtactagctgttaggagaatgaaaacccctaaccctaatgagtaggggatgtattgctatatagttcatggccaaggcacaatacactaacacccacaaagtcgcacctctattttgtacagatgttaagaccagtggtggacccaacattcgaaaagtatgaatctaaggtagtcraggacaaaaaaaatgaactttataggctaagggagatccctggtaggatccgcaatcctaccagcaatccattcatgttcaaactttatatatgaaaacaaagtgacataaacattttgttctgaagttagcctgctaatgtgttagttctggaagcccaattactatgtcttctttttttcatgccatattggatagggcacaagctccatttacattaattgtagttttattttagatagcatttcccatatcattttctggtgccttgactcttgataatgttgtaaaagtgcctctgcctccggcatgaaacaagaatgttttacatacactcaaatgcgacctatattagaatatgttttaaagtttgtctaccataaacattagagtagtacgatgtattataaactattttaacatattgttagttgtatataacttttaacatgatgtttgattctcatagcacctccaaatttttttcttaaacttactccattcttaaactcactctaaattaaataatcatttaagagttatttgaataaaaattgttctctatatcttttcatcttgtaatagcttctctacattgtgcagctctctaattgcattctcactatatctatgttgcttttggtaaaaaaacg

SEQ ID NO: 10734 - DNA, 973 bp, Zea mays
cgaaagaaattgtaaatcagaatgaatggtggcttgtgcgatggttggtgtttctgcacagattgttcaattaacctcagatggactaatcaactgttggttgaaggaagaaaaagagatatgtttcctaaccattggtacaaaagtaccaaggcactgatattcgtttttatccaatgtaaggacaatgtgcaatcacatgtttattctctttaggctcatttgttgattacttataaaaaaactcaacctgcggggtaagacagtctctggtcattatattaagaaaaagatcttctcacaaaagccgagaaaaccctccgaacccctgcccacccatacatagaggcatcatagcccatgtgagaatgatcgtgactaggactaggccttagagctatgctttggtataggacagatgagcgatttttttaaaccatatcctgaaattcgctcccacggggagtcaaactcaggacccgagaagtgctactcagaccacctaactaactcagctagacgtcatttcacttgattacttattcaaaatgatgaactaattctactaaatttatagaagatgttatctacatttgaaattttcaattaggtttattatgaaaatatattatgtgattaacctagtgatacttggtagttggtacacgccataacaatgttttcaagtcaggtgacttgctggtcgttctggctaaccgacttggcgattaatcacgattagtcagacaacttggcgattaatcacgattggtctaaaccgacttggacgattaatcatgactaatcgcgattaatcggacgacttgaaattattgcgccataaacattaatgtttttatatttatttagttaaaaataactttatttgacttctcgaaaagcgagatttacattcttttggggatggagggagtaagagcagctccacattctagttcgccctaaattgata

SEQ ID NO: 10735 - DNA, 897 bp, Zea mays
tgatttaactcagttcgagctgcgtggttaacaaaccgagctaaaatactagtttagctcgtggctttgaaacaaggtgtattgtgttgaactgagctagccgtctctagcaatatcttctatatccaccatttatattcatcctttacggtctcctctaaaaaatttcatcatctatatcttcttcctctccaacaacgtcctctatacacatctatattagattcattttttacatacatatttgttatactctcaaatgtattgtacatattttaggtttgctaccccggttatttaaaatattcaaatggatagaggaccgtttagagaaactatatatagagagaattgaayagggtcctttaaatttagaggactgtttagagtacgctgctgaagaacgtagaaaactgtttgatccactgtatttaaggtacgtttggttgcgggacagtcaggataaagatgtctcctgacattctattttgtctttataatttttaattttgagagacaaccgcgacaacaccgatatgtcccaacatttaaccctgaaacaaacaaacttccgcgcggccggatccagtggccagaaccctcgctggtctgcgtttcccatctcgtgattctacacttctaccgttccactctcgtgcgctcttgttttcttctctccgttgccgccctacgtcaggtgcccaattctccattttcgggcccttctccagcgacgagcacccgccaggtacgcccacctctcctcctccgttccttcgccgagcgcccaaaccctagcttaagccatttgcattcggatctgatccaatttcaagtgtaytaggtccgatccatctcacccggatcttctgtatctcgggttcttggcagaggatt

SEQ ID NO: 10736 - DNA, 1500 bp, Zea mays
atatcctctatatgtaaatacctatattaaacatttttttaattttttaatttttgtacatacgtatttgtcatactctcaaatatattgtacatattttagttttattaaaccggttgtttacagtattcaaatagatagagaaccgtttagagaaactctacatatagaggatccagcagcgttctctaaatttagaggaccgtttagaggacgttgctggagggagtagaggacgtcctcgttctctaaatttagggtacaggaccctttagagagtcttgttggagccatcctaattgtttcgacttatcgatgcacacacaccaccaaaccatatctcacgttgatgtgacttttcttttcatacacggttggtgtggttgtttggtactgacactacgtggaatcagaaccaaacttgtccagaactgaccgatacgctcacacgcccccagaatcaaacggaacaagcaaaccgtgtccatgattacccagaccaaaagctgagcgaaaccccggaggcgggcggggggagggtaataatcaatgcaacaacctgccgacgaatgttcactgatgacgcatgccgagaggaaatctgcgcgagatccggccggggcggggcgctgcggcgctgcacagcggtgccggtgcgccacagaatcggggccggaacagcgaatccgggcggctacagcagtacgcggccacccccaatcaccaatcgaaggtcacccccaatctgcggccgcgcgcaggcgcagcagcagcatcttctttctcttccttcacacctccaccaccgccggctttctccttgatttcccacgtcgcgcaggagcgtgaggctgaaaccacggcaggccagccagctagtagcagagagagagcaccgtcaccgcgcagcgagcacacgcggccgcctgctacaggctgtactgtactgttctggaccggcaactcactcacccggccacccctcactccctttccttttcaggaacaccgcctgcttggcaccatccctacgcgggctacgccgccctcgtctactgcctgcgcctggctgggccccgccgcggccgttccgtgtgacgaggggagcataaacaatgactgggccggccggccccgtagccatttcacaatttttatgctttgtttattcgcggggatcatgtgggtaatcgcgtgggccgtgcgcccgtgcctggctgggtttatttacgccgacctgccaataggagcaaaaaatcccctggccctctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcgggg

SEQ ID NO: 10737 - DNA, 941 bp, Zea mays
gtggtttaggtggtaggtaagacggtagctaaaccattagttagagatatattgttgtaagataatagttaaactattagttagagatctatcgaaatagagttagagggtgtttgaattcactagagctaataattagttaactaaaaattattagtgaaattagctagctaataaatatctagctagctattagctaatagttgaactattgttttagactgtttagatgtatacaactaattttagcagctaactattagctctaatgcattcaaacaccccttttagccacaaactattagctagattcaagtgtggtagttgggtattattaaaagtaaactaaaagaaaaaaatttcaaaagcttttagaaaacctaaaccctacaaatcaaacatttttaaaaacaatggtaggagctctacctctcatctaagacaaaaaattaaaatttatacacaaataaattttaagatttgcgtttatattttttcaaacgataaacatgcatttttcgaactaatcaccctggtatgaatatgaaccctcctatctgccgccaaccttttccttccatatatttttaatcggagccaacccgatttttgttacctgtctcgtcgtagtctttgtttggaaccggtatttttggtgaactggttgaaggggcctcaacagctcagcccctgctcaacctcagccaactcagatgttcccgttgcacgattcgaacggcggcgaatcgcaaaaaattgggagggagaggtcgagtgcgaacgcctcctcctcgccgccaccgccaccgccgccgccaccaccacaaccggcgtctcgtcggctataaaaccctaccccttctagtcttcccgtcgccaccagccgcctcgctgaaaccctaaacctctctccccgttaggtctcccccagcgccccgacg

SEQ ID NO: 10738 - DNA, 1459 bp, Zea mays
tcagcctggtagagtttatcggaccagtccagtgcaccaccagacctgccataatcacaactacgaggtcatttattagaacctctcactcttaaagcttctccatggagagcatccacccacatataaagcttatgaaggtacggaagagacaaagcttgattccatattgttctcatgttgaatctataaccaaaaaaatgaatacatcatgcgtaagcagtgatttgagaaggaatgaaaatgattaccttcatcttttgccataatggcattcgcgttttgttgaaacgatgcaataatcataagaattggtgttacaaataaattttacatagcttttttcttttctcattgcagaggggggataaaggtacaagttttaaccatgtttaaaaaacttagtcggtaggagaaagaccatccccgtacaagtttaatcgagatagaccgaaaaaatcataaaaactggcctctatatagcatgtggatctgtcccctataagccatatatttactcgtgttttgaatcctcctagcttttatacaaggatcgagtcctatatatctgcttgtcgtgtttctttttagaaacacgacatgtcccaaacaatcaattgaaccccctaccaacatgtacaacttgtaattatatatttaacacttgaactcacaaccaacttgtgaagccctagaagactcgcttgcacttaatagcttgtacagtataaatattgtagccatttcttacactctctagtggagcctgaaaaacaggggatatgaaactgtagatgatactatttaacacggtttaaatagagaagtttaaaataaggtatacgttagagcttgagataaggacccctggggcttgttcggttatttccagcttgttcggttattttcaatccatatggattggagggaattgatacgaattgagagatattttgacttgctagggattgaaacctcctcaatcctcctcaatccatatagattgggatagaaccgaacaagccctgggatagaacgacccacgcaagattgtaaataataattgaaactgagtgaataagctaaataatttttactttttattttgaaatggctttcagtagacaatactcgtggctttctattaaaaatatttgtggattcacttaaaatcatttttggattttttaaacaaataattcaacgaaatctttcagtaccctatctacattatttaaagacgccatagaataaggtgtgccaacgatcaaaatgaaaattactgagatgtcccctcggacacacagtggtcaaccgacgccgccggttggtgcccggatccttgtccgccctcctgctcactccactcgcctgccagccgcacaccaatcacctctgcggccggcggcgtctgcaacgccagtctctgatccgaccccgatcggcacacacgttctcc

SEQ ID NO: 10739 - DNA, 99 bp, Zea mays
ggtacctgtgccggaaccctgccgggctgcgcgctggaagaaggcagtaaccagagctgctgcgcgtaccggccgcgcgccgccgagtcgctgcgcgcc

SEQ ID NO: 10740 - DNA, 126 bp, Zea mays
ggtgagtgagaggttctcgcgcgtgagtgatggtcaacagtcaacactgctgatggtgttgtgtcattgtgtgcccgtgcgtgtgtgtgcgcgtcaggcgacttcgagaagttcacgagggtgacg

SEQ ID NO: 10741 - DNA, 538 bp, Zea mays
gggttattattgtccttttggtttaacctaggcatgcatgttcattttctcatggaggagcagccatacgtacgtggatataattttttttcagatgaatacccatacggcggcatacgtcccgtgctgccgctgctgcagtgagatttgacgcgagaaaagaggtcgccaccagccagccatccacattccgattccacacagggccggcagtagtgcacagtgcagccgctgctgctctgccctctacggctacgagtgcgaggagccgaggacacctttccctttcccttctacctcccctcccctcccctcccctccatctctcgttcccattaatatctagccgcctctccccccgtctcttctcctcctccaaaactgtgagcgagaggcagggagtgcgctcgacggccgccgccattagtgatttagtgtggagagagggagagaatctaaagtgaccggacgctgtccttccttgctgatcggcgacacggtccatccctccctcgctcgctagggttccttttcgtcc

SEQ ID NO: 10742 - DNA, 512 bp, Zea mays
tggcacgacgcagggcgcacgggtcgaggcagtcgcgcggcctctggctgcagcaggggcgctcgcccgcgggcgcggaatggccggggctcgacgcacggacggctcacgcctgggcgtcgggtgcacggctggggcggctcggctccagtcctccatggcggctgtgagcaggaaggagagaagggaggagagagagaggccgggtgggggcggcggctgraagagagaggaggagccaggggcggcggctgggaagccaggggcgacggcaggtttagggttagggataatgggccgaggcggttagggttaggtttttttttctttttctttttttttctatttcgtttttctaattttgaaatacatatttaaataaccctaaaattcataataatcaaaccaaaattatttataaataaaatattaatttttagactaatatttattatattgtttaagtgaattttcatttaagagaaaatgttatttaatatctaaaatcaatt

SEQ ID NO: 10743 - DNA, 298 bp, Zea mays
tgcagcgacgccgcgagcagccgcgtggacggcagcgtgtcgccgggccgcacgtcgccgcggcgcaccgcgtcgcgcaacgcctgcgcgagctgacggctcagatcgccggccgcgcggtcgagcgcgccgagcgacgggatctcgacgatccgggcggttcttgccatgattctggtctgctgaaattgttcgaaaccggctctacagaataaaccagttagcggtcacaatcggtgcatcgcgtgcctgttgctggcccgtttctgcccgaaccctgtccgaccgtggagccgcc

SEQ ID NO: 10744 - DNA, 195 bp, Zea mays
caaaccagcgtgaaggcgcccgaaccaccgcgagccccgcccaccactccacgaaacccaaacgcacctccgcagcgagggatatcccccatcaccccctaccagtttcaattttcaaaagggcgtggaggcgccgcaccaccgccgccgccaccactgacgagggaggaaacgccacctccccgagccagtccg

SEQ ID NO: 10745 - DNA, 468 bp, Zea mays
gtaaattattatgttaattaagttgatagttattgtttattaaaataaagagaatgagatatagatgattgaatttagatgatgttgttagagataaagaagatacaaaagattgcatcttttagaagttgttttaaatgacatataatattaaatattttttgagggaataaaactagggaacgttgaagagtcccgtcccgtcgtgcaccaacatgccgccgcagctgctcgccagctccattattgcctctactccgccatctccttcctaatcgctcgcctcgtttcatcacctgagctctcctaatctcattcaccgttgcttgctctttgaattgcctttgcccccatttgctttcctgtttcttccatcccatccgtaccagctgacggtgcccgggttccatgcccagcggccagcgccttgtgacctgatccgcggctcgtccattcctccctccgtga

SEQ ID NO: 10746 - DNA, 117 bp, Zea mays
tgcggaaaaacgcgagggcgggctataatgcttggcttttcgcgtattcgcgcaaaaaaagttgggccttgcgtgcccggcattttgtaaatcagccccgaccaatcgcagtcggga

SEQ ID NO: 10747 - DNA, 729 bp, Zea mays
ctgattggtctctgttcaaacttgcgttttaatcctcatgcaccacagaaaatctgctccgaagttctgaccattcacctaaccatgttttttgtaaacgattgtattagcgaacctctaactacccccaaggatactgggttttatgttcgttggaagatcaatatgcccccgtttttttttcttgccagatgaaatcattgttgctgaccccaattaccctttaaaacgttgtgagctactggtacctttactcgcctgatatgcatccacaatacgacagttcagtgtgcatgcgcccatcctatccggaatcagtgcaaaaccaaaagatcagaacagagttcagaaacgactagcagcaaactgtagcgaagtgagccgaagcgagcaccgtggacggagccctgccaacccccgcgcaggcgccgggcgcaccaacccccggtccgcgcgacctgagccgccctctgcgaccttgcggccatcacgagcactcgtgctgttggtaggaaaagggccaaaggcgaccaacccccaagccgcgcgggcgcagcccgtcgctatttaagcgcggcctgctcctacatttcgctccaagaagagcagcaccatccagtgcatcacgagctcttctgcaccagattagcaggccatcgcctacttttggcttccaaatcatttatttacggcgtacgtgccttctgttcaaaccccagccccgctgca

SEQ ID NO: 10748 - DNA, 221 bp, Zea mays
ctgccatagaaaggccttggacctctcactagatgctcatacagtcatacttttaaggtgcttgtccatcagtgtttttgaatgatcttccatgcagatattctttgcctgctgattctgagcctttattatctgcactgatcttcccctgatttcaccagttttacaatcatgtctcattctcatgatgtgcatatgcagtgaaaaacttcaacccaaga

SEQ ID NO: 10749 - DNA, 130 bp, Zea mays
acctggagtcttggacgaaacaggacctgctctactgttctttttattattaatataatactagacgacatgaataatttttctggagtttttggcaaaacatagcgacttgggatgttaaaatgttaag

SEQ ID NO: 10750 - DNA, 676 bp, Zea mays
gttgtttgttatgcttggaaaatcgtttaggtgtaagcatcgtacatgccattatgtttcatgtacaacagttagtccttaaatgtaccagctttctgaatattcttatttcgttcccaatatatatttagcaacacactaaataagtgtttagagtgttttttttagaaactaatgcagatgctgtaaagacatttttactgccatatacagcacatccccgcacagccaatcaggcagccgcagagcaatgtgactggaaccgccgcgagcccacccaccccctctctccccatctcccgacgtttacgtttggcggcgccacatgctcccctggcctacgcgagcggtgacacaggagcagagacggccggatggcgtccctcgtggcccaccccgcttccttccgaggtccgagtagcagagtctggccgccttgtcgcgacgcgacgcgcgatcccatcccttcccatccagcgcggctccaatcctgtcgcggccattaaaagcttccctcccctgcctctctgctccgctcgtctcttctggaaccgtccctcgctcgtcatctttccgccttcgctacgcaattcctgtccacgctgcgggccagttgtgacgaccgcgaagctcgtcagagaaagaagagaggccggcaggcgggcggcgatcggag

SEQ ID NO: 10751 - DNA, 196 bp, Zea mays
ggaagcagtgctcgtcgacttcctccgcgcgaacgccgacgccttcgcgtggagtccctcggacatgcccggcataccgagggatgtcgccgagcactcgctggatattcgggtcggagcctgactcatcaagcatcctctgcgccgattcgacgaggagaagcacagagcgataggcgaggagatccacaagcta

SEQ ID NO: 10752 - DNA, 145 bp, Zea mays
cgtaagttagggatccaaatcagtagcaacttggtaggttaacttttttatgatatatatggtagctttttgatcgattgatgtcgccgcaatgttttttttcttgaatcttgcttgatcatctgtattttgtgtcagcagcaaa

SEQ ID NO: 10753 - DNA, 117 bp, Zea mays
ggtaagacatctgtgtttgttatcctacattttctgtgatacatttcggcggttttcctcttctgtataatcgtagatgggtgaagctataaccaatttttttctgttcagggtcag

SEQ ID NO: 10754 - DNA, 1500 bp, Zea mays
ttgtctagcctatttcatccaatgcaactctcctacataaatcttgtagcaagaggtgatatgttactagagcacgcaaacaagcaagttgggggacaagcactactatatatagttgagctagaactagtgaagcaactargctagatacttctaccatctaagagcatctccaaaagattctttatttttaactctctatttatctctctataaatattaaactctatatgtaacatctcattccaacagactctccaacgtgtaagttagcttggctagtgagagttgctagccaaatttggctagtgagagagttaatttagagagccagatagcttagcaagttaaatgactagtctgttggagagctattatattattaagtagctaaaatttagcttgactagctatttagctagtctcttggagatgctctaaactccaattctaactagagagctactactacaagcaactgccacacacacatgtatataaatgtaaaagcacatgttagtaaaagcacatctaatagtgagctggactattagatgagggtgtttggatatctctaactagaaacagttaattactatactattagtttggttgcttgaatgtctctaattaattttggtatataactatcaactccggtgcattgattgcatatggagagaactacttttcttggcttcattgtgtggcctcactattttctagggtgttcaagccgttccttctgaacttgatttgattggcagcggctagggtaattttctagctttgttaagtcagttggccgaatgttcaatttccgtgcaccgacgccgacggccaatggcgaccgcactcgcggcacccctgcggccaccggccaggccccgaccccgatcgattttgcccraggataaaccgctcgcgcaatcgcgccagccttctttatttggcctctcacccctggtcccctctctcttcttttttaccctcgctggcgggtcgcctcacccgttcactccgtccatgacgaaacggcaagcgtcgccctctccaccgccaccagtccacctcctcgtcctcctccggtcacgcacgcagctagcttacccgccccgccactataaaaatccacctccaccccaccgcgcgtctacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttggtgagcgccctcctccctcagatctgcctagttttgtctcgtcccgtggctctcgtttttttaattttgcaattcctcacctcccccacttttgctgctgctggttggttggtttgcgtttgttcgggcagctagcgtttcctggattggggacgcttccgtttcgggaagccgtgaagggatcggccacgacg

SEQ ID NO: 10755 - DNA, 1417 bp, Zea mays
ttggctagggctgtgtattggaaggctagacaccggtgaaggatgatccaaaaaatggatctttggatacgattgattaagagagaggaggtaaatgtagaaatgtggggcgttgattttaatagagtgatttgactgaagtaatttgttgtatgcacttagtgatattttaactggtgaattatgtatgggtatatataaattatataatcatttgttgtctttaatcgatattaacaatttaatttaacatggatagctggtactaggatagttttggcagttaaaatcggcaaccagtacaagagacggaagcctgtccttcagtagggcgtatgaaaccttcacaatactagattgaaccttctttaaccgataaaaaaaatcataatttggaccgagctgtcgtacccgtgctacgtgtgcgtctataggtgcggctgacgagatacggacacatgcgtcgcaagaagagcagccgacgggttagagggacgcacacgtgtacaacacaggtcccagaagaagcaccgcgatgctcgcgtcccagcatctgtgcagtgtgcacatgccccgctctgccttcggcggccacaagcgcgacgccgaccagctcaccccacgcccagcaggccagtccagacaaaaaccgacaggaggagcaacaaccgacttcttcggttgaaccagacaacggcaaggctcctgcgcgagtttaccgtctcccagccggacgagaagccagcggccgcaacaggctcctctgacattctggccttcgcgccctccgtcgatcgggtggactctcgtctcgagtagcctttagcttgccaagtcaatcagctagctcaatagctttgtttctttcccaatcttgtattcgcaccgtaataaaaaaaagtcaacacttccctcccctatttcgacgcttgatctctatcatcagtttgtttgtcatttctgtttagagagattgcaggttgtcattcattttcgcgatgtcgatattttaaagaaaaaaaattcaaattcccttcgctattgaagggaatgagtgaggaaaattagttcgtttctcgcccaatccctcaaatcccaaagagtgcattgaatcatattcagtagttcatagcgcactgtgtatcctgcgtgttcatcgaatattcgccccgatttcattaggggtccaaataaagctgctatgttatttggagtactcatacaaatggttttagcacatggggaattcgaggtaccttgctaaaatactccataagcgcatacgtacagagcgcttgacaacgcgccgccagacagagctctgtcgcgtccgcgtgcctgccttcctgttccggcgaccgttcaggcgacggagacgaggcgacgtgagcagagggagcagtagaagcggcgtcgg

SEQ ID NO: 10756 - DNA, 232 bp, Zea mays
agtgagcgagcagagcgaggcctgatgcggcagcggcagcaaggcgaggagcaccgggagatattcgtccagtggagaccctgcgacaagaagaggtcttaggccctccgccgccacgcgcaccggcagacaaaatccgcgcaggccttcttccgacccgcaaaggcgccgcctttttcgccgattccacaggccggagcccggggagaaagacagacagacagaccggaag

SEQ ID NO: 10757 - DNA, 1500 bp, Zea mays
tatcccgtatggaaattgactgaagactagctgagctcaagactgatgcatggtagctgtttcctgcatatgttgttatgttaagaaaggtggaagacgaatcatatgcccgggaagtcgaacattccggtgcgtgcaacaccatgtgtactaaactagtaagttttcaaaaaagatctgaatattttacgccataaggctgaattgaatattttggaaattcttaaaaacgctaaagtcacaaaatcataaaaaatacgtcggatataataaagtaaagatctttaaaaaaacgaatagacatgataattttttgacaggaatagcttagtctaaatttgattggcattaaggatggtaacaagtcagatttgcattgagtttggagtgcaaaaatccgcccgtgatcacacccataaagtatatctaaatccattcacgatcgcattcgtgggtacaattctaaacccgcacttgaatgttttcggtgggttttaggccatccgtgaatttttgctcagtgtacacttttaaataataatttagatataagcaattaagtataaacaataattgagttatatctgcgaattttaagtcttctcgcattaaatagcaacaaaatatttcataaataattaaccaagttacttacttaaaataattacttaactatttttgcgcaaagtaaagaataaacaaatctcgaatcgagtatatatgtgtcacctgtaggttggaatagaaacttgtatttacacccacgaatcttcggatgtgtgtgcacccacaaagttaaaacctttacttgtatctattagtactaatagggtcgggtatccatcgcatagtgtttgggcctttcagtttaaattaacatccataaggtctagtttgagaacaccattttttcaatggattttcatttttacaagaaaaattagttcatttttatttagaaaaataaaaaatccttaaaaattgtgttaccaaactagccctaattgttatgcatatagcgggtatattattatgtattattttaaccaagtggtactttcctgactaaagaatatctggatgcatggattcctacccaaatatagacgcaggacaagggaaacattcatgccaaccacagaaaactaccatgccaaagcgtaacaagcggcgcgattgtactaacggctggctccccggatccccagcagaggagcggcggtgagcgcacacctggcgcccggcggcccgctctcttgaaagctatggaccgttcctcttcctttcctgtctctccaccacccagatcaaccccgcacgcgacatcaatagtccctaccattcggcgaacgtacaaatcaaagtgcggcgtgcccgctcgcaaactttgagtacgtactgctactccggctcgtcctcctctcttctccatcgccgttggttctctcacgccacacggtcatccgatccctgtccaccgcgttgggagcggcgcagccc

SEQ ID NO: 10758 - DNA, 1500 bp, Zea mays
actgctggacagcaccctagctactggagccaaagcgataacccaggtcaaagaaggaaatgttgaatatattgtagttgatcttgacgaagatgagtcagatgaagaaaatggcaaagaacttgaagtttaagaggatgataccgacattcgctcgacgaagccgagccatgtgagcttcraaaagtcgatgatgaagaaggggcacgtagaagtgatgaagaaatatgggtactttggagttagtgaaagcatcaggcttggtgaagaggacactgttcctcagccacagaaaaaaaaatgaggttttaatcttctgaagtttcttcaaggtcggcctatggtttcctctgtataagatagttgtcaaagtgtcgaaataatatgagatataccttcatcaattaacgcgtaatgagataatgtgacttagggtatttatttgggtagtccaaagccaaggagctaaaccaagcgttgtgtgcttttgcccagtacacaaactgcattactaggcaaaggcaacatgaaaagaaatggacccatgataaatcagacatgtagacatccataattacataaatataaatttagacatagaataaatataattaaaagcacatacatataatactacggatatccacattttataccaataataaatcagacatgtagacatccctaccctcgtgtctcaatcctcctagttaaaatttagtttgtgtaacatgatatgtttaaatgttagttacaagcgtttaatatagtttaattataaaaaaactaattacataaataataattaaacgacgtgagatgtttaatgtaggactaattaagcttcatggtttcgttttgtcgtttagtttttttttgtgtaactagttttataataaagctatatttaatacttctaactagaatttaagtgacacgaactaaagttttctactagtcattaatatccaaacacctgcttttatagcccaccgggcagcgccatatccaatcaaccagcccatgatatggggatggcgccaatgccatggccgcacggtccgagttcgacacgcaaaaccagaaccgctgagcttgaggcctctgcactgcttccctcccagtccatcccttcccttcccttccgcttcccccacgccacccgtctactccgtcgtcttgtcgcaggcagcaggtggaaatctccgccattaatagcgcaccccggggatcctcctcggccgcaaacaaaaccctcctcgtcatccgcggccgcttttcccctgacccctgcctcgaccaatcctccctcccacacacatcacacccacaagacaaaaaaaagcgcctttgagcgccgcgcgacctctggtgcttggtgtcgtcgcgacgcgttagtttcagagcgcgcacgcgcgtttgtgctgtgggggttgggaagagccgaagagcgaggcggcagcgcgatcgagagcggttcggcgggcggcggccgagccg

SEQ ID NO: 10759 - DNA, 186 bp, Zea mays
tgtagaaatgtacatggctagttttgatattggtttaattcactaattgtttaatttttgctagatgaagcagcaaggagagagagagaggtcgaagtgaaggtgctagtcttgctgtggaatgatggagctttgaaagttgttggtttagttggtctcaaactttttagctttagtgttcttcat

SEQ ID NO: 10760 - DNA, 164 bp, Zea mays
tgttttttccagaataatccagatacaaaaagggttgtatggagtctcctttccttactatgatgaactctcaatggtatattccaaggacatggccacaagtgaaggtgcggaagacatgacagatgctgttaaaaacttggaagaagagttagtttgtgtaa

SEQ ID NO: 10761 - DNA, 1500 bp, Zea mays
agttctaggtgtgggttagcggcaacccccagtcggctgcctgtgaaggccgtgttatctacgtttctcttccgcactttgatttatttgtagaactatatggacgtctcagacgtatgatgtaatcgactatttcccttattaatactattttgagcactgtgtgatgatgtccatattatgtaactgctgtgtacgtgaataactgatcctggcacgtacatggttcgcattcggtttgccttctaaaaccgggtgtgacagttagggtttgggagcagtcaatcgttggcgttgttgtcttcttgtggcaccggacaatctggtgccacaccgggcaggtcctgtacactgtccggtgcacctctgacttctgctctgacttctgtcgcgcactgtagagcaccgtagcctttgcagagtcgaccgttgcgcgatttagtcgttgctccgctggtgcaccggacagtctggtggcacaccggacagtcctgtgaattatagcagagtgcgcctgttgaaacccaagagtggttggttcatcttcgtacggtcatggtgcaccgaacactgtccggtggcacaccggacagtccggtgcgccattcctcagcacactcaagtttcttttgctcctttaaattggatccataacttgaatatttattggtttgtgttgaacctttatgcacctgtagaacatatattctagagcaaactagttagtccatatatttgtgttgggcattcaaccaccaaaattaattgtaggaaaaggttaaccctatttccctttcagattataatttttttacaaatactcccttaaaacaccacaaaagctctcacattaaacatcactatacatatcctaagcctccactagacttaaccgtccacgatagagtgatgagtggctcaaacgacaatactaaatcgacgacgtgtgctgggtattatactctatttggatgttaatattggaggacatgaaattaaattggttttaatatcaaattagtcatgatattaaaataagatgtaattataattctattgtttggacattattggagtttggaattgggttgtctaatttcacataatacagagaggtgatactctgaattggagaaagagtttttagttagaatccaatactgtggaattagctctctgattccaaatcttaattatatatacaaccaaataacagaattcaataaaattaattttaattcataattctatacactaatatctacatccaaacagatgttagatacgaagccaacgaacccgcgtgacgagagtatcacaatcgaaaaaaggtcttccatctgttgtctcgttctctctttccgcacgaccgcaccgtgtgagttcaaaaaacttacccccaaaaactgtcctcccttggttccttcccgctctccagccaaagtcgccgctcccgctcggacacgcgtctagaagcttctggatccgtccctgacgccg

SEQ ID NO: 10762 - DNA, 1500 bp, Zea mays
tatttatatacctatcacgtcgaacttctcctgggtctcagacgtggaataggagcagacaacaattattttattttaataatgctaaccaagattcgaacttgtgacctctgactttggtaccatattaaactgcatgcatcaatcaatcaaacccaaaaaattaagctcataggaagacatggataatttacttatattatatttcaacacatgcattgttgccatcagatcgccacttgaggccaaggcccagtccccgctgccgccctgacttgcctgcattgtatacatgtcagtttcatgtaagcaggggccctcaatcaacatctgcagcaaatgccagcagtgaaaaaataatgaagatgtgtacaagyacaaaaaaatggatccctcatgacacaacatactctgcagtacacatggcaacatctgtccatgttagttcatacacatcctctatcaaaactaagtaacctggtagaaagcaagaagcaagtatgctaaactaaaactcataaacagataaatcagagagtagagatagcattgagagctcttcatccaccatccgtcaaagcagaaagcagagatagcattgacaattcttcatccaccgtgtgtcaaaggagaaagtagagaaagcagaaatcgtacaaaacagataaagcaatatgaaacacataagtttttggtaaacaaaaaattggattcccgaactttaaactagtataaagttgtgatgttggaggtctatacatggcggggcgggatggttgcgatgatgcgggaagacagcgacgacgcgggatggttgcgacgacgctagaagatagtggcaacgcgggatgcttgcgacgacgactatgagagggtgggacagcgggagggcacatgtaagtcacgatggtgctgacggcgcgggagcgggaaaaagcgtgggaaagggaaacttacaccacgcgtgggagggctacatggtgtgatggagggagatgccgagtcgtacgtccttgacaaatatgccttgcgagggagagagataccgatcaagatggagatgaaagatagatagtaaatatgttggatgtgtcttgaactggtttttttcccttaccaaatctaacaatttacctaaactgttggagttgctcttagggctatccaaacactcgctcattcttttttctaccgaagtgaagatcaatttttggtctagtttggaactcctttaggattgaagagaatttagggagaaataaactaatttcgcctttaatcacctctaatttagaagagtatttgagtttccaaatttgaggccgttgtatttatatatctgtcggtagccatagcgatgtgagtatgtgactgtcctactgtcgccaacttttctgccctacaatccgtcaatcccacacataaagagctcacggacgcatctccggaaatcctctctttccagccacctcactcttcactagcctctgctcctctgaa

SEQ ID NO: 10763 - DNA, 1465 bp, Zea mays
gaaaagtaggattagaagtcagggtttcgatctagatctagagacgtcacgagcagtagagcaccagagtaacaaacttgccgtcttaccgaagccagagcgccggagtaccggagcggcagagcccggaagtccggagtcaacctcgatgactagaggaagaagaaagccatagcattggagctcaccatcttatctatctgaaaccgatgtcaggccgtcagggtgctcaccgtcttatcgtggatgaagacgagccaaacaggcgacaagggaagcgcctaaccgtgcttttaacctaaccaggtgatgctcgtgccagcccgtttgtcatcccagattgtcgtcctaggcacgacactagaggtcgggctgtgccgacagaggggcgccatcgatcgggctatgtcgtgcttgggtactgtgggtcgtgctgtgtcccgtgttggaactggactgtcgacacatggtatgtatgtacttcgagctgcccgcacacagacgtgcccatccaggtcgtcgagccctgacacgtgcgcccgaacattttgtaagggaatttcaagcgctggcttatcagctagccagctgcctccgcctgatcgaggcttatcctgctgaaagggcgccaaaaagagaaggaaatcagtcaggaaagcagcaaaagcgagcgcctatggcggacggactcccttttctttttttgaatacataatttgcagttgccctggggcaagacaagcaatggccctggcaaagagaatactggggacggacgatgcggccataaagcagggttgcttcgtgcgcttgaactcgctcatgccaaagggcatctcccccctccctgactcatccctgagactgagagcccagaaaccaagaacactgcactgcgcggctatttttacttcgtgattaagcatcaagttggggctaaggcatccgcctccgctccccagcaattttcccaccatttttccgagccttttcttttctatctttctctcgagagcagaatcgatgccccatggaacggaaggaacagattcaaaacgaggggatgttttattcttattccacggaacaagcaagctgcatgcagcgagtggacatgaaaaataaaaagatatttgaattcgagtgcgtagagcaacaaagtgaagaatgcagagaaagcaaggcagcagaggcgcctaagatttccagaaaccaagaccgcattattgaagacggcccagcacaaagcaaagccaggattccagggcatatataaataataaaaccctcgaggaggcgcaggcgcgcagcgcatgcacagtcatcaggtccaaaaggcttccaccacccaccagaccgacgaccactctcacaagcggcagtgcagtgcacccaaataaatcagctgggaggaggagcaccagcaccccaagagcagagctgagcagagcagcgtgcgtccagg

SEQ ID NO: 10764 - DNA, 443 bp, Zea mays
tgcatgcctgcagtttagtgcacacaagggtgcaaaacgttagccaaatggtaggaagggaaaccctacaaagtaaccaaccaagagagctaagactacgagtctgcaacttaaagctgcttcttccttctctgagattttgtgctagcttttctccaaatttagttagtctttgataagagcagagccagtgcttagtgacccaccttgtttggccccaaagaaatatatggtagtcccacactgagtggaagaaagggttcgttttagctccagtaatcagcagaaaccagaatcttttagctacttcctaccgagtgaagtttgaccatacagattaaccgttaggttttgtagctggtaacttcttgtaactagaagcaggtgagcactgcttgagatatacagcatctaaccagtagtttgttgtactgtgtaaacat

SEQ ID NO: 10765 - DNA, 579 bp, Zea mays
tggccgaaattggatctaactagatctgagcatgggtcgtccgatttgaccaactcgatccaatccgtctgaaaaaactcgattcgatcaatgtaacaggcatacaagtcatagttttttatttaaaataatttatgtgtcatgtatgggtcatgaatttttgacacaatacctaatccaacaaaaaaactgactcaaaacccaaaaaaattccgacctaacaaaaaaaccgactgagcagagtcagacatgagccgtgtctaaagactaacgacccgaccttgatctgaaccaaagcaatccaatccaacgtttgaacaagcctagatccaacgctgagaattggtcttggttctactacgccctcatcacaggcccgaaacagataccgagaactagaagactcaattttctgcgcggcaggcacggcagcaacaaaggctccagagtccagacaactgctctgcttcacgaccacgagattgtggtttcggtaccagattaccagcaactccgtgaggcaatgccaatgcggcggccggcgtgaatacctcaaccttgaaggaggatacagtgtcg

SEQ ID NO: 10766 - DNA, 1067 bp, Zea mays
gattctctacttagctctttacattccgcatttatattaagcatttaagtttcaatcttgtagttatacttatttagtgtagattgaaacttagcttttgcggtagagatagcaacacttagacaaaacctagtttgcacattctagttttgattatttgcataggttttggtctagggatttaattgtggcctagtttagtaaaagttttagaagtcctaattcacccccctcttaggcgtcaccagtttcctacaccttctattttattccattttagtcctataaaccaaacacatccttaatagtttcagcatcacacttcacacctgccacgattgatttactaataaattgacgatgctccaggaggttgtttcacttagaaggtacccgcgtcggcaagaaaaaatgcgttttgtaacatttgaaaacatttatatctacaaataagtttattataaaaacatattccatgattattcaaaaaatacttattatatatcataaatatttttttgaatattttttgtcaaacttaaaagaaattttactttggaaagcaagacatgttttttaagtacacaatggtctcgttgtaatttccacatcaatttgaccattctagattttaaaaaggtactaaaagggtcaaattgatgcccacatgaaaacctgtcttgaataagtttccacatcaattttagtacacaaaggtctcgttgtaatttccacatcaatttgaccgtttgggaagacgaagtgcatttgaaaccattcaagcccattgggccaaatcgttgcttcgagcaggcctgctgctttctcaggtcacgtagcccgcacgcacgctgccgtcgaccgctagttgaccttcccttccctcagaaccctaacgagcggtgagccgcctctctcgagcgcctaccactctgccccctgcgccgcctgcggcctgcccccaactcccgcaccatcgcgaagtcctcgacgtctaggtcgccattccagtaccttctagaatatcaggatcgccagcgccgccgcatcgggcggccctgtggccc

SEQ ID NO: 10767 - DNA, 1500 bp, Zea mays
taattattaactaatttactgaaaatagctaatatttgaaccattaactagtgtgtttggatgtcttcggttaattttagagtatgtttggttactttagtccagtgactaaagtttagtcactaccatgtttggttctagcgactaaaagtattcacaatgcattaaatgaatcgtaagaggactaaaatatcctttagcaacctttcgtcattagtgcaactgaaataaagaagtggcacaatatgaaatttatatggtttattcttttttagtcacctcctgagaagctagagactaaaacaatttagtatctgtattagttctaccgtttgacaatttatgttaaataggactaaaatggaacggggtcttagtcgttaactattagctctattgtatcaaacattccttaaggtcatggtatgggtcattttttatgttttcttttcgttcaaagaaaccgtactgataggaaacagttgatattttacatggctctaaaagtttataataataaagaatttaccaaccccaggtggaattaataataacaggaggacctgtatctaaaattagaaatccttgaaggagaacacaggaagaccacccaccatgtcagagcctatttaaaccgcgctttgggcagccatctttcacacaacacaagagccttctcgctctgatctgagcaggaggaggaagaaagccaaaggccttccttgcgcttccagggcaaagaaggtaatggactccactgcagtactccactccgttcctctatgtgcttagctttcttgtagacactcctagagtgaggtaggtggggcgggggtagtcgggagccaggagacgagagtctctcttcctcctcctacctcccagtcccacctttctttctttcttttttctttctttttgggtttctctttctcctggtccggtccgggagacctgctggaccagacggtgccgactcactgcaggcgttcgcttgacagccttcctattacgagacgagctcttggttttccgcagacacggactctaacaagcgagggcctgtcatggcctggcctgctgttaagtctcgtctcctgcgtgactgcgtctctcttctctctctctcgctctttctcccggagtagattttattcctattcattcctcgtgtgagtgaggtccctccgctcctcctctctctctctctctctctccctctccgcggagtggagccggagtcgagaggcaggcagacgagacgaggaatgcttccttcttcccatgccgccgccgtccctgttcttctcctccctccctaattccagtgctctcacgtaccagatctgaggccgcggcggagcgtgacgacgacgaagtcggtcaggatgagccgcgaggataccctgaaagtgcaggtgagttcttctgtttgcctgtcattttagtcaatcaggcagggctggccgctgatcccggttcgcgctcaccctgcatgcc

SEQ ID NO: 10768 - DNA, 189 bp, Zea mays
ggtatctcgcatgtgacagacctttgcaccaaccatcgccacgcacatcaggacaggcattcatattcatcagggtactctacccggtcccggttggacacttggacagcccagcagccaatggcgttggtataaaacacaggtcgcatcgccgctacaagtcgcgcgcacacgataccattatattcc

SEQ ID NO: 10769 - DNA, 52 bp, Zea mays
gtcagtcaagacaatacagttagcgagttatacatgagaatattgtaattaa

SEQ ID NO: 10770 - DNA, 175 bp, Zea mays
atgctttctcatgagcctttgcagattttgattccatggtccctcgaggggtacgatacaacagcagctagctcaatcattttattttagattggtaggaaaaagagtggcctcctccgatttagtaggaaaagttgtgattttgattccagtcacactcactgtaaatagcggg

SEQ ID NO: 10771 - DNA, 1500 bp, Zea mays
atattttaaatacaatattttttgaaaacaatattatctacggaaacgatacgattacacggcctggttacattattttttgttacggtttccagcccattttatgccgtttgaaaaacctttgacgtagaatttatttggccatggtcatttttcatatacagggctagtttgggaacctcattttttcaatgaattttcattttaccaaagaaaattagtctattttctcttaggaaaatgaatttttttaggaaaatgagatttccaaactagccctaaatagtctttcttcctctatccattaatatatatatgatatactggcttcctccattctaaattacttaaatataattatttaaatatgtgcatactcattgtacaaaaacaaatcaacagatcagaacgcaatatttaagaggacatctattttgtagccataaataataaacttaaatgtatcaacagtatctgaacttgtcacatcttcaaaatttgataagatcgtacaccataattctatttttatggctagtttgagaaccccgtttttccacggaattttcatattcccaagaaaaattagtttattttttctttgaaaaatagaaatcctttaagaaaatgtagttcacaaactaacccttagatcatatcgagcacaccgtgatgcaccacgtaataagttaatgatctgaaattacgtttccaaagtttacagacccaaatagygtcttttaataagtttagcgactgttcattcatttaactttaaataatacgatggaaaaaatcaataataatggtctaaacaaattctcatgatttttacgttcgaaaacagcatgtcttaaattgttggatgggaagagggctccgtctccaaattgaagacacgttttgacctacaatttatcttgaactaaatcatttaagttacaaaatcatacaaaaataagttacctctttcaattatgaatccaatggtatcacttttgtgcaacaaaaaaattacatcttgcaaggctaattttcatttgacaatcacgttttttttttgaaatcttagaatgattacgcgcgttataaatgatgaagagagtatacgtcatatgtccgtcccgtgcctgtctgtgttgttgagcaaacagtcgacactccacaaagcaacaccaacacgagcaagagagcaggacagattatgtcactcactgatccttgcttcattggtgactctacatatgtagtttttattatacttctaaatatactctatgtttaaataaaataacaaaaacaatattatattttaaaagccgtaacgttttacactaatcccaagccaaagacacacatcatactggttccaaaaacaaacaatcatggaccatcactctcggctagctttctcgctccttatacagtgctcctttgaactcgatcacctctcatctcccatccatcttcgatcgcagctttgctgccatcgccatggac

SEQ ID NO: 10772 - DNA, 734 bp, Zea mays
agtgactatcatccaaaagttcatggaacaaaagttgtaaaggtccaaagttggctcagtgacactgattcgcagtatttccaaactgaaccaaattcagctaagttcacaacctgacagtccatctttggcaaactttacacatagttccaaatggttttagggctactacacttaataaaggttgttctcctatagttttttttatcgaatacgcaggagggctgcgtatcattaaattaaagtagagggaaaaagggcatgtggcccgggacaaacagaacacacacaacacaaacacacactctaaacacaaacacacacttacccttacaaagcacacaccacacagacacaaacgaccccaacactcccgtcttttagtaggctataaggctttcctttctctatccagggtcaaaaagagagcgcaagttcttggctccagcagaaacccacaatctcatctcatctttaaatccatcctctaaggtattaaggcagggtcgagctccttcaaaaacacacctgtttcgctgcttccaaatactccaagccccaaggattatcatactattaaaccccttttttttgctcttgggaatcttggttgaagcctttgtccgccattcagcaaaaactgaatctcttctcttaggacccacagaagagagaccaatgggggttaaaatattatgccaaaactgtcttgtgaagacgcaattagatagaat

SEQ ID NO: 10773 - DNA, 81 bp, Zea mays
gggcgagacagtaattacacggggcagaaccccaaaccctaatcgggtattctaacaacaggaaggctcatctatctcgcc

SEQ ID NO: 10774 - DNA, 1500 bp, Zea mays
gaccattttgttcagaaattgcgatttagggcagccgtaggcagtcatccatttgtatattcttccattgctgtgataagatggtaagaatgctcaaatttttttttggttaaatgaaaataagaaaaactcagtttgattctatctatttccaatggcatttcattgatcaaattaatgacttcatctcctatccaaggccatgcagctctatagaaagctatatatattgagtccaccaggacccggagctgcatccctttttcattttttagtgtattgaagatttcctaattatgtgaaagggaacagttaagtcgttagtgatgtgtacgtcatggttgttgttggagctcgaactaaggtcctggaaatcccgtgaaacttgagtggtggagtggtgagagcaaaatactcttggaaggttccagcaatttggtccggcgttgtggcacatgactacatgagacatgtaattctattattccaagttcttttaargatagcttgttggggaaaaaaatgtgtatttctatctccttgaatagcccaatctttcttagtttattattgactcttttcctacggaattctgcgtgtttggttggagtatcatggtgctgatgtgtaagatgagcttcagttttatgaccttgctggttgaggggtttggtttgtatggcagagttggctttctctattgctgacttgttgtgagctgtcatcttttgaggccaaaggccaagaatttggttttcgggccctagggttttaccagtagatttgctctaactctcttttgccaccttctagaaatattgctccgtaatccaccagtttccaaagtggaaagacattctagttcttggttctgtggaatcgagtacttcaagtatgggtatgggagcatgatcgcttcgcatcattggcaagtgatagataaattttagtagcgttgcgatggtggggatcaccatggccacacaagattgaacaagctagctataggatgtagtttgagcaagaatgagcatcatgaacatagaagcgattgaagtaggaagaatttatgattttagaatttgctaaattgaggggggcgcgtattcggtgtcaatcaaatattgattttttttttcgctacgaaaaccgtgtttggcattgctggccgtggccgctaagaactcgttgttcgtgttcgttgagcgagcggcagaaagtggataggttgcgtgtggtgtagctgccacctccctgacggggacccacgcgtcagctacttcagcggtcaagcaactgtagccgtagcctcccgcggtggaactgccgaaccgccgcctggttccctcctccgctgcctgcttgccgctggcctggttccctcctcagcagcggcgggagccattgctcccacgcgagccttgcactgcaaaacacgggaggaaaagaaatccagaacctaccaaacagcaaagtgggtagaggcaaggcaagaaaagg

SEQ ID NO: 10775 - DNA, 1500 bp, Zea mays
ttaaactccctcgtaatgcccctggtttaatttctccattcattgccgaagaacaaatcttgagcatcgtatatgctgtgtttggctgaacgacgtcgcctgccttcatccaacaaactggttggtgcataggcattccaggcaagaatactattttcctgcgcctgtatagtgggttgccagcttcgtcaacaaactgtttcagatttaaatgacctagacctttttgaacactaaccatctctcatgcaagggctatttttctgagcctgttttgctgaacgtgcatgtcggctattcgatcaccacccagtcactggtgtactaaaataaaatcaaagtctggttggtgcagaggcattaggccaattagaaggcttctcaggttgtttgtagttctggagcaacacaattattaggttgcttgcagctcataaacaggttgttggataatagtttccatctagtcacaattgtgatagtgcttggcatcatgttgcggcgctggagaaagaatcaggttgtggcactgctgctgaattgtgatagtgctttgcatcctcactaaaacgtgagccgaatactagagaaagtgtatgcagcggcgccgaacgatgagaaattaaatcagaggcattatggggagtttatatgatgacgaaaaatgaaaggaaaaagaaatattaaaaaaaaagttggaatactattttggagagtaatatcacttataaatactattatagatgaagattattttaaaaataccataaagaagaagcctattaaaacaggtactayagtagaaaaaaaactccgaccggacgacggagagaaaggcggaccaaacagaccaaatagacggagtcatttccacacttgtgtgcagacgtcactatggggctgtagccgagaagagagagacacggcccaacaggcataacagaccggaccatttccagccctcacatgggccaagctgcagccgacaacataccagatttaatatgggcctacaacagcagaagaccggccccagaaatagtgaaatactactgctagggcctaggaaaatcgggacatgatgattgtttgttttctaagctcgttcgccctctcttttctctccgtccaacgacggcgcgattcagatccaggcatacaggccatccttccgccgccgcggactgcgcctaatcttccttctccagcagccgggcgttcccgtcgtcctcgatcgtcccctggactggatcgcaacggagatccagccggacctgcggtggtcccttccttttctcggtaggccgccttgaatgaattcctcgttttctgtaatgcatattctttgcttgctatgaatcctcaaatccgaagcttttatgtggtggatatgatggattgtttcctttgcaagatagcataatgagctcgccagtggagaggtgattcgtcaggctggtatcaagttcctagtccatggtgcctggatgagcagtagag

SEQ ID NO: 10776 - DNA, 1500 bp, Zea mays
aacagtttatttatccttgtaccctctttaaatttcactctacaactagtgcggtcgtgttttgaattttcatacggctgacacggtctaacaatccggaagcgagcgatcagtatacgcagccagaaaacccataggaaaaatagcgtagcgtagcgcgcgcgcgcgcaaaagacgacggcacaccctgcctggccgccgtactgctgcaggtctgcagcactgcgactgaccacgacctgcacaggcaacgcagtcgtctgtcgtcccgtcccagcgctcgatcgggtacccacccacccacattcccgagaaaacgtcccccgaaatggacaatgattggtggcggcgcgccgcaccgtccatgccggacacgtcgcgtcccatgtcgtcatgcctcgggcaacgggcacgccggggcaggccccactctgtcccctatccttccgcgagcaccgccgccccgtcccgccaattccatgggtctgtttggttcaattttttttaccagcttttctgagaatctgactgtgtagagaatttaagtattattaggattacgtgcgaagaaagataaacttgtccataggactcaggatctagaaagtgacggattactactattacaataactcaaccaattatgtgtttatgttgattttgaatgatttttatctaaacgaattttataaaagctggctaaaaagttaagtgtttggttcagcttctarcttctgatggccagaagcccccaagaagctgaaccaaaccggggccatgtctccccgtcgcgtcgcgtcgccttgtctgggagctccagcactcagcagttcatcgcggcccttgctagctgccagcctcaaaagaactgcgagctcggccacctctcgctctgcttttattacttttccatctccagcctcggctagatcctgcttgctcgcttccactgtaaatataaatattctcyggtcaccatcaccggcgcaaggcaacaagaatataccgtctcgtctcctgttgctctgggctccggttcccctccctgcttgctttaaagctgcaaagcccttggcggctccggctcctggtcatatagaagagcggaggccgatccgtgaccgtgagcactctgctctctgctgctcgcttctctcatccgatccatgccaccatagcggtcaaatagactaggtcgaccagcctttttctttcagagccttgtgtctccctttgcctctttttcttttctgctgtgttcccagctcgcagcccttccatgctcttgtcacatacactcgcacgcaggccggcctttgagctgagaccgccgagaggcatagcacaggcaccaccacacaccaccgcaccagcccttgccgcgtataaaacgtctcgtgcgtaggcggcggcgactagctaggctgtccccgtcacgcatacgctacgcgcacactatattgggggggttgcatgatcaggcatcatccgaccgacggc

SEQ ID NO: 10777 - DNA, 1454 bp, Zea mays
tgcaggtctgatatgagtgttgttgcgacacgcgcagggccgggatccaaggcagctgcttgatggctactaacacagtgcagacagcaggcaggcaagctggttgatgcttgctgaagacggagcttgcagttgcagagaagagagaggcggatgcgagagggatggctggatgctgaagcttttatagtctcgagctagcgaagggcacgcgccacgcgcgcggactgtttccgatccatggagtgtcggaggattacctttggagcgcgtctgacattttccaactgcatgcaggagcatgtcaatttgagtacttgttagtaccggcggcgatgtcgctatgcacgcggttgcatctaaatatattattgttacatgaattttctatcctacagctgtttgaaactttaaaataaagatggactagcaataagggagaagcgccaataaagagaaggtgctgggtcctaagtttgagaataaattctgatcattagatttagatcacatggatgtctatcgccttaaaacaaagaaaaaatcagacgtatgtgatttagcaactcctatatatatatattattacagttttgaccgatgaggggcgatgtacgattgcgacgctaagagaagctgtcgtgctgacttatttatacaccattttatatgtaaaagaatagtcagtaaaattcatgttgcggcgggtgatatagggagtgtttgaacgcaccatattactatatatataactaatagttagtggttaaaatttgctagagacatccaaacaccatagctaatagtttagctattagttatttttagctaattagctattagttaactagttaatttcactagtaattttttagccaactaactattagctctattgcattcaaacacccctctaaatatctaattatctaaatacgccccttgacgaagatacatgacatatttgattggtacattgagtttattgaatattttgattggttcgataaatatagtaatgatccatttggatcctccttctcctcaagagctaaaagtggttaggtctagtttgggaaccctatttttctaaaggatttttatttttttaagggaaattagtttattttctcttgggaaaataaaaattacttatgaaaatatagttcccaaactagctcttatatagaatttcggttgtcatttttaaaaactgaacttaataactgaactgaaaaatttcagttaaccgagtgcctagacctaatccaagcgagccaaagccaaccacctttccttgcggcagtcaaccccccaactccgttcattgcggcagccaaatcgagatctccgtctcccccgtgacgaatcccacgcccacctctccccgacccggctggccgcagcaacagcgcatcgcaccgggaggcgggagccgaagaaccgaagaggag

SEQ ID NO: 10778 - DNA, 647 bp, Zea mays
tctgttattcaaaaatcagattgtagtataaccacatttgttaataattctagcagttctttgatggctagtgcttctcttacatttacgattccttgcatttgctttatttgttgcctgaattttcccctctgaaagatgacattaatggtttcagtttctgcgttttcattgctcattacatgaacaaatttcttttatcagtgcaagcatagagtgttttagtggcagttgcattctagaacattttttgctaggcattcccattgtgatgacatggatttttcaagcttgatactttctttggtaagcagcatgttagaactgtacaaatcttctgttacctcactgttgagtgagatgttttgaagcttccacttaggcacctatgtggtctcactggcacatcttacacctttcagccaatacaagaatgataatcacctcacagtgtaggcacaacaaccacaatgcacgttttgctattgaacagygttgcagagcacccacagaaatgaaatgtccaccaattagctctagaagaattcatcatgccatcatcaatgcatgcatgaccgcccgttgttttcgccactgatctcttatggatgaagttaattgttgtattgataatcttacccttgcag

SEQ ID NO: 10779 - DNA, 1500 bp, Zea mays
tctatttagttgctagtaatctatctaatcaaatttaactaatttaaagtattttagctgaattagtaactagctctctctcatcaaacatgctcttgagctcttctataaccaacatgttcttctataaccgcaagatatactyttatgtagctatgccacgagttaytttcgtagaccccaaaagttagcacaatcaagtacttatcatcctaatataatatgttctcttaaaaattgttaggtcactttgtgccccacaaccccttaatctcatacaaccaaataagctcatataacggtgcaaaacactgttttgaactatagattgcgctgtttacagaatgaagttaaaaacgagagacgaggattgctagagatagccttaccaataggagccagtgtaagcatgtaacacgtgcagaagaaatttggaattatgacattatgaaaagtggaattcgctactttgtcatcagtttatgaggcttcatctgaatatcattataaaaatgttgcacgctgtaatgtcatttgatcgtttaataaaataaaaaagaaatgtatatatttgtatggatattgaggtctagttttattgggacacatagagacaacaggggcttacgacgaacatcagtcaccgaagtgataatggatgaacaataataagggtaaaattgtccctcaatgtctctataaatattgtcccttagaattagtttggaaattcaaatctccttcgggattgaaggagattgaagagaaaattagttcatttccacctcaattccctcaaatcctaaagtgaatttgaggttcctaaaatagccctcaatgtctctataaatattttttttgtttttataaaacatcaaaatgatattacaacaggtgcaacatattttatttaattcacatatttgtaatgtaatagataactaataacgttaaattatatttgtttaagtacaactacaataaggtaccaataacattaaactatatttgtttaagtacaactgtaataaggtaccactttaaaaattgatactgatctatttaaatttaataccactgtaacgttaaattatatttgtttaagtacaaccgtaatcaatactatattgaaaatgagtaccggcttattcaaaatggttaccgtcggtaatcgagtgttaatcattatcattaatatttacgttatatttcatgaaccaaacgacacctgaaaatgtaaatcattaccgttacatttggtgaaacaactgacaaggttgtgaaacccacctcgaaggcagaattctgaatttctcaccgtctaactgtaggtgcagctgtgatctcccaacgccatttcacggttcttcgtcaaccgtcatcgctttctccccctcccccgtctcttctccctcgagggaataagcccgccgcgtgaagcttcttcttgcatccgagtgcggaatcacctccaatctgcccctcgggccgccggcgccg

SEQ ID NO: 10780 - DNA, 768 bp, Zea mays
atcggcgaggcggggagccgatggcaccaaattaaatctcccgtgcaaactaaatatactttattaaatttggtagggtggctgagtttgactattttttagcaactacacttggattggtaggatgtcctctaatattggcaattggatattgtaataaacagtaaggaaaattgatagtctcaataaaccattgtatttgtagcatatggaaaattgtatatcaaggccatttgtgggtgattgctgttttccagtctaaagtatcagttatttatgcgtggagacatttgaccctgtttggaacttgggcaatcgtttaacctgttcgtttgttttttataaaaaataaactgaagtttgataaaaaaaatattatgtatttttataaaatttatacgctccaacaacacaaactaataaaataattggtagattttatgagtggagacgcggaacatgatattggcctattgggctccggacctccgagttgaaccttctagtggtacaagtacagtggtgtactcgtgtggacaacattgcttctctctctccctccagaagacgggggagaatgttgccgagccacgtggcaatctatctcacagcctgaatcagaatcagcccgcgcctcccctcccacctccactcgtttcgctcctctgaatcccccccgggccccggcacggaattccccccggcacaccccccaaggccaccggacgccagcagccccgcccccgcccacacctacgtacgagcgca

SEQ ID NO: 10781 - DNA, 81 bp, Zea mays
tgtaaggcgttggccgccgtaaaatgccaccccacttttgtaccgccccattttggggtttcaccttcttattttaatgaa

SEQ ID NO: 10782 - DNA, 1420 bp, Zea mays
tcgttggataaattcaacaaatatatatctaatattttagccgcttaaaaaaactttctacaatctcacttctacaaaaaatattattaagagtatgtttttttaattattattaagagtatggttcaaaatgaaaattcactttttttagagtatggttcaaaacgatcctttttaggttaagtttgaataagacgtgcyggacttaaaatatattatatactaaacagtattatagtaaaattaataataattatattttttttgagatgagtcgatcaaacttaagattaaaaaattaaaggaaattaaaaattgaaacatagggagtattaatttataaactgttggaaagactccaatgagtaatgtcccatcagataagaggacaccccctgtcatctttttggcctaccttcgtcgtatctccaagagtctaaattttatttttaaaattattatctaaagaatgatttatataaaaacattttatatattttttctaatctccaacaaatttttatatcttatttgagccattaatgtttcctatctttgactaacaagaaacacataatagatgatgactatatttagataatcgtttaaataagttgttggagtattttttttataaaaaatctctactcatatgaattagaaaaactttggagttgcttatgacttttcatgccttgtctgtagccgcatgatgcagatacaatacagtatggacacagtgcttaactaccccgtatgaccatatcactgcagaagatagcgttcagatcaagacagaaaacaagcaagacgatcttaaccaaacagccgtccactgccttttctttctcccgttcaccccgccgtgcacgctctttttgtccctcgtgccgacgaccgaccgaccgccgccgccgccgccgcctcaaggtcttcgtaaagccactcgccggcaacgagcagccaccaggtatgccagcaccttctcttccattcctgctgtacgaaaccgagcacgcaaaccctaacttaagctaattgggtatttgtattcggatctcatctaattacaggtgtttacatgtattatgcctactaactaacgctgattttcgttaaaaagttatcgggtgtacatgtgtacatccatttcctttactagttcgggccttggccaagggccgtttggaattgcaaatgggagttggagcggcgaatgacatgtggcatgtcttgtgggatttgcatgctctgccagtacgcgtgctgcgttcatgagcttatgctattcaaatgccatttgctacgcatttatggctatttgggatcgggaactggcgtggcaaaaacattttatcgatatgtttcttcttctgcaggaagatgttgtgaggactgatgcaataactaagcttgctgg

SEQ ID NO: 10783 - DNA, 1500 bp, Zea mays
  unsure (1)..(1500): unsure at all n locations
ccagctgttcataaaagtgtcttgaaacaaaaagaatcccaattaaagtgttggtaggttatttttcataagaataggactgcatatcaacaaataaactgattttctaaaagcagaacctgtccagtcggttgtgaattcttgaattgacgtgaattatcgtattgttttagatttatttaataagactttaaaggcatatttttagctgtggttttgatgaaaacaaggtagggctactttggaaatttaaattggatttccgtggacctaaattttctctttctagtttggtaactctatttttttcaaaaaaataagctaattttctttacgcccggtttagatcattagaattggattccattataataatagtgatttacgcatatgtcaactaagctaaatcggttttatgcaaaatatatttatatcagatatatttatgtgctgcatttttactatagaagagtaagtcgaagagcctcctgtaaattacagagtagaaacaaattatactcatacataaaatcatttcacatctccctcctcatanatntgagataaacttatatctgaattttggaaagtggaggaatgtcaaatcccaagctaaatatgttactttattaagtactttactaagtgaattccggttcctttaaaatgatggcatccaaacgtcctgttaaggaaatgtaaattctttggaaaaatagggttgttaaactagcactgatctctgggaatcctgaacaagatttaagggggtgtttgatttgaggaatcactccatccaaaatgagatgatgcatcatgaatccattcctaaaatttggtgggatgattccattcatcatattagtactaactaactatgaggaatgagatggtgatggatcaactcattccattccaaaaactaaacaaagaaagtgaggagtgagaagatgatggattagcttatttctccaaccaaacaatctaaatatttttcttttaatcagatgaaggagaagcaccagcctagtctaaacttttaactttctaattccacggttaaattttatcctacctcttctcatgagttattttcttcatcttaaaaacagcataggattcctatctcatcaatgaagttgagtgaaaagagtgaaagaactaggtagagggcagctttgtgagcatacctcgtcagtaaagttcagaatctgataatcgcttccattcattcgattgttcctaatccgcaagccaaaaaaagagttcttatcaagctagcattttcagttacctcgccgagaaaggttcgtttcttcatcacccagcacaaaccaagaatctacttaaccttctctcgatggcccaataccttatccacatgcatccgatacgaaaaggaaaccaccattgctgctcccagttcctcctctggtacctcctggctccgatccggctcaggaagaggaggaggaggaggagaaggagcaggcagcagca

SEQ ID NO: 10784 - DNA, 1500 bp, Zea mays
ttcggctatttcaggcgtacaataatggtcgagcgaagctatctattagccaaagctacaagaagagaagctacgtctatgcgtatagataacaagaatgtagatcgaagcaatgagctttagcagatgagacgtctcggacgaagagcgacgaaggtgcaataagtgtgaagaaagggaaaaggcaataatatccctactacatttgtaaacaatgagtataatgtcacaagggcgtgattgtaattttgtacaaaggcggttcatcttcactataaatagatgaacaatrttctgcataaagtaccttttctaagggtcatagcttcattcctcttagccttcgaagaatcttggtacctccctctgtcaaggagccgaaggtacgcttgtaaattcctctagtgtaatgggagacatattgaaaatgttaaaggcaaagaagataagttctcatatatcattgtattgtcttattccaatacatgccatttctattaatattcatgtctaaagacctttgtccttcgtgttaacactttaaagaagtgttaaaaccaagacgatggtctccattcctaacttgtgttgtcttgattctctaacaccttcagaggattaaaatcaagtatccaacacacgagatgaatctcatactatactctaggacgttgtttcattttatgttgtattatttgcctttcttcctaaagaccttcgtccttcgcgctgttaaaccaaaggacgaagattttaatatttaccttatattgccttgatttttggtaccttaaagggattgaaatcaagtaccaacagtacgccacgctctaatcgatcaacagctaccagagattagagcagagaagatcttatatgcatggagaggggaacgaaccgacaaaaaccaacaggagcaggggacagaggaattactaatagggtgtcgtgtggtgggacggggtggagatgtggggcaacggtgaaaggcggcgcggggaaggggaggatgctgggacacgacttgagcttgcggctgttgtggaggtcgttgtacgcgcggaggttcggagactggtggggtataactggtgtggagacgacgacgactacgactacgaagacgattattgcaaatctggtgggtgcgcgacagaagatggacagcgggttggttagacagaagtgttataaaaacggcgatcgtggaaactagaaaaacgggttataattataatagtagagaaaagacttgtattaggttgacaatgttcaaaggctaacaagtccagctcgatatttgccaaaagtttacggttttgtatttcatcgtgtcgcccaagaaaatcgaaggaacgcgccgccaccggccgcaacaaagcaacgcaggcctccggcctccctgaactgacttcagaagtcaccaacgcacccagcacagacagaagaccctcgccggacgctcgctctcgccggggacaactcaatcacgaggccagg

SEQ ID NO: 10785 - DNA, 74 bp, Zea mays
ggtgatagtggaagcctcattatcctaactagccaggacagcgagaagccgcgtcggcgcgtcccatcgggata

SEQ ID NO: 10786 - DNA, 1450 bp, Zea mays
acgagaatatccaaacaaaccttaagggaggttttgactagatgatttatagaatgtttggattgaggaatcaaaccatccaaattgaagtggtgcatcatgggtttatttctcaaatttggtggaatggtctcattcctcatattagtactaactaactataaggaatgaggtgatgatgatcaactcatatattccacaaactaaacaaaaatagtgaggagtgagaagatgatagactagctcattcttcaaaccaaacacctcctcattaatctgtcaacccctccgacctccttggttttgggatcaatcgaacagtctttcaatgaaatcgcgcaattgttagtgtgatggggcagttcccggttccatattgtaacttctgcaaattatctacagtgccttgaatgcatggaatgtcgtagtttttaccttccttgtggctaagcatgatttgcaacaatgggaaacgcaaatttcacagttaactgaatcatgtgacacgactttttgtaaaccgagtaacgggccaaattattgaacacagatttaggccctatttggtttgagactaaagattagttcttctattttagtcttatttagttccttaagtaacaaacggtaggactaaaacaaggactaaactgatttagtccttagtcccttaagatgtggttaaaatggactaaatcatattaatttcatatttgcccctcatttagttcaattatactaatagcatgagaatattaaagaccattttagtctttttatgagtcatttagtatattcttattaattttagtccctagaaccaaacatgtcagggactaaactttagtcttctaactaaactttagtccctaaactaaagaaaccaatcatggccttatactgaagtaccagcaaagtatgaacggcaagactcatctaaacttgcatatacatcgatcgagctgtgtctactgcaacgatttgatgatgatgcttctgtttctatccaatcacaagtcacaaaacagaaccacactgctgttaacgagtatcaacatttgatgaaacgaacaccaagtacaccagttacaagcaggcagcatgttacaattgtcaaaaagaatacaagctatgaactaatagtctctaatatcatgcaagcctgtatttagatacaacagcaggcccataaaacgtcagcgctgcaacggttctgcactccgtgacaattctcactgaaggcagcaagcctaacgggagtgggaccactttttcacaagcaaaagcaagagtgcaagactggacagatgatgccaaaatgtcactttcagcccagaccaaaaacagaaacaataataaaaataaaaacaaacagatacgtattgatcatagtgggatttgaacccacgacctttagattcggaatctaacgcgatatccacttcgctat

SEQ ID NO: 10787 - DNA, 1500 bp, Zea mays
gagggagagaacaacatgaaattagtccaggagttacaattctatcttgtatagtttcacatttaattgctcttgatttcatggctaaactctcgatacyttttctttctttcttctctatctttttcatttctttttctatctatgtttccctctgtatttttttaagataaaataaaagcgcgctgtaggggtttaccctacagcctttctccctcaaaaaaacatttaattgctctttttgctggaacagttttttcttcttccctayaagcatcttctttgttttgaaacatctgatctaactccttactaaacatggtctgatggtcggtggttcacagtcaatatcagtcgataggtctaatctggtaaaggctgtatgttttggttcagattgggatggtttcagtttctgattgggataggtgtgccatactgatgtttttccttttcttattgatatattatacgaagttgcattttagggtaacttgttctaaccttctgatagatactttggcgatatcctgtgccgttgcatataatattctttagtgaccatacatgattaaaatatgtagatttgaattgttggtattcataggcagtatgaccattccactttttcttgcacttttaacttgtaagtagtcatcagttagatctgctttctgacatgctatggtttttatttaaatattaccagttaacaatcttaaatagaggtaaagagattaatcttggattttgtgtcttattttttattttctgttgcacaggagtacatgacttttgagctaagtgtttttcgtgaggtaacatgatttttttcatagcaattcaattgaacctttccattcagaaagataatataattcgacctaaaaaactcggtcgatagaggaaagatcgtcccacggtattatattaataagaagctcattcggagcyccgatcgagaaaggtcacgaaagttgggcctccgtgcagcataagggtccgcccccctatagaccaaatctttactcgtgctgagccctccaaacatacatacaaggatcccctataggccagttcatctcgtgtgtacacaaccagaggaaccaacgagtgacctttttaactccagcctgaaattcgctcccactgggattcgaaattggcctgaggagtgctactcagaccacctaatcaactcaagctagaggcctttcgcaatataatccaacctttctctaatttaaacttaaaacaatgaatttggccattggctattaatttcagaaagttttattgaaaaacatctatgcagtttaaaccttgactacttgataactagatatgacccgtaggggcttttctttcatcagttcatttgccagttttgttacatatcctgaatgtggtcggtcatataatataattgttaccttggtgaagtcctaatgtcttgattacctaaacagttctcataaatcattgtcctcataacttgta

SEQ ID NO: 10788 - DNA, 387 bp, Zea mays
ggtacggttgccaccatgctagaggagctgctcatcttcaccaagggcggcctcatcttgtggtcgtcctgccgggagctcagcgccgcagccctcaagggctcccccatcaatgccctcatccgctcatgtctcctcgaggagcgatccgccgacgccagcttctcctaggacaattatgccctcaagtggaccttccacaacgacctcggccttgtcttcgtcgccgtataccagaagatactccacctcctctacgtcgacgatctcctcgccgccgtccgcaaggagttctcccagatctacgaccccaagcgcacctcctacgatgactttggggacatcttccgccagctccaccgcgaggccgaggcgcgcaccgaggaa

SEQ ID NO: 10789 - DNA, 491 bp, Zea mays
cgtaaatagtagtatagtgcagttgtagtagtagttgttgtagtagctgtagttgtagttgttgtagtagcgtaggagaaggacgaggatatcagggtcggctcatagtgagtcagccctgcttcctttgtaatgctcttccccacgatgaatgaagactgactgttgtgtttctgctttcgtgttactcatgttttgtccgatgaatcgactcctttgaaccccatcgactcctgtgattttggttctttaaaaactcaggaaggcctagctggaaacataagccgatccattttcttttgttatgccaacaaccggtccgggccatttccctgctactttgcgcccgacttagcgtgtgcacatatatatttgtcaacagtttcttggtgcgtgaaccctaactctgtttctcttccgccgcattctagtctctcaagcttctgcttgctctagtgctgttcccgaaccttcttgcttgcgagatcgag

SEQ ID NO: 10790 - DNA, 1500 bp, Zea mays
tggattaaattaaaactaaaaatacctaactttctaacatgaaatgcttgggttttacctttactttttatttcttccccctctgcatactataggctttgtttcaaatcttctccttttgttgtggtatttaccttttaattttatggagaggcctattcattttcatttcaccacgtccgtctcacccggaagtgaaaaagaaccaggcaattctgcgcagatagacgtgtttgttttaacttttttcattttctagccaccaaaagctgctgcggactgccaaacactcagcttttcagccagcttctataaaattcgttgggggcaaaaaccaaccaaaatcaacataaacacataatcagttgagtcattgtaatagtaggaatccgtcactttctagatcatgagccctatgaacaactttatattcctccacacgtaatcgtaatgatactcagattctcaccacagccagattctccccacagccagattttcaaaaaagctagtcagaaaaaaaactgaaccaaacagggccattgatgtcccaaacattgcactattcgtctattccaaacaaaaaaaaaagatgctaccgctcaacatcggagtgtacgacaaaagaaagctcggaatctgagaaaggcgtacagtactaccagccggccagaggcaccttttagctgtagcgccgcgccaagaggatggcgctttacaacttttattatacggcccaaaagaaaccttcactttagtaaatcttaagaagtcaaaatacttaccttaatcaaatatataaaaatatttatttttgctcagtataagtattagatgatgattattttattaatcatatcactagctagtacatattttcatagtgtgactttgaaatactaatactgatttttatttaaaaaaactactctattatttaaatttgaaactggctgtctctatatcgtaagacactccggcttacttttctatcctaaattaaaaaaatgtacgtatcactgtgattgaaacagaagagtttaaacgcttgctgacaagggccctaaaaggcgtataggattattgtcatatgctaaaccgtcgtaccttgtagattagtatataaataatagacgactcaggtttaaacagcaaaaggcttacctctccgccactgctagcgcgagcgttaaaaatgctctccgtatgcgtcctttctctccacgctttgcagccagcttacgagcctgactttgttttgttactttttgagacgcgagatagtgaggtactacctgccactgttgtcttacatgccaccaccacccgagcacgtgtcagactcaggcatcaccctttgcccgcctctctttggtgggattcttatcacaaccgcacacaccaaaaagcagagacaaacttataagaactttacggcgtgctatacctatcaggctatcactggctctccccgtcaactaaactctagccagtgagtgg

SEQ ID NO: 10791 - DNA, 1500 bp, Zea mays
actgttttttgtcatcaaccctttagtactggttttttttactccggcgtgcaacatcaccttccagggtggtcaatttgtgcattaacagacgatgacacatgcgtcaccttccactccctagagcatgcctaagaagccggacagaaatagtttgcaatgaactctgaagctgctggcaaaaaactgatccattccatcctgccatggcccagaccctgaaatttctcttcagcatcaacagtgccggaagtacctgctgcgacacagcaaaatggtgctcacttgtgcaagaaggaaggcatgtatgcgactcattttaaaatgtgacaggcaagatctgccaagaattgacctgttcttggtaccagcttcgcagcagctaggaaggaagcatccatgatgactgatgagcgtgattgccttcaacctagccctcaggaagataaaatacccatggtagttgctgccaagggcaattgcatactttccctgatgacataccacttacatatgctgtccaattgtgcagaagatagttagttatttttctatatatacagcttgatattgatgtgactgagcgagtacatgcgcatgattcgtgccagctgcaagggcgtaatttaacgaatttttcaatgcagtgtgaataattgatatgcacatccgttcggaagttttctttcgcaggattagcccttaacacgtgcaaaggaaaggcaaaatcaaaccacaaaaggcagtgacaaatgaactacagatatcccccaatctatttatcaatgcacggaagttttctttatagtaaaattatgccgcttataccattatatgtgtatgcagcaacgacagaaggctagcagctcatcataggaaagaattttaattgcagcaagaacctctgaacgagctacaatagccagtctcttgtatcatctctttctgacagtagctgtctgccctgaaccttaacagaaggattagatctacaccttcttgacggtgttaccatcgcggctagcattaatcaatattgccacccagtctttcctgcaatttgtgttaaccgataggaagctgcggttaaaaaaaatcactgccgatgtactaaattttttgcaggctcatcagaggtctaaatgaacactctactccaaattcctattggtaaatgggcagttttaattaaccaccaggtaccattccttgcagaccaaactaggcccaagtatggaccagggaaaaaaatggggtcagatacagcccaaactaggctcaagtaaaagtcggattgcggagctggaggcctggagcaaagtgaactaactcatcagcgccgtcgcgtctcgcatcgcctccttgtccggttctaccgtcccatctggattcctcttctgctccccttctcctcccttcccttcccttcctcgacttcacctcaccaccatctccagctccatccgcacgcagccgtttaccaaccgacgcagcgaggag

SEQ ID NO: 10792 - DNA, 365 bp, Zea mays
tgttgttctccatgtttccaatctatttataagatggttcatggtattatttcaaatactctaaggcctaatctgcattgcttaacagctgatgatatgcatgacattttgtcatcatggtgcttgaatctattagggtctgttagaaagttgtacagctcacatgatgaggccagctgcacagaagtttttgttagaatgtccaataaagaaacccacttagagcattgtgcttgtcagagtgatatctatctttcaagagaatgtgtatgccacttggaaagcaatggggatgttgaaactgcaaatactgattgtcatcctctatcaggacaaagcttaagttttttctttaaagatggtgt

SEQ ID NO: 10793 - DNA, 1057 bp, Zea mays
tggtccggtcctgcatccctcactgactgtgatgagacacggctgttattattattattatgtctatatatatattttttgaaacagagcaaagtcaaagctccaaagccgccccggccatatggctattagcatgcccgagactttgacttgcgtattttagtgccaaattaaagactaaaaccggttagagcatctacaacacctcccaaatagcacttttaaaatcttattttaggagaatagtagaaactgttgaagttgggtatgttttttgggtctttatattttttttggaaagcgtctaatatagtaatattgggagaacaaatattaggaagatgctcttaaaggcttaaagcgctgacgcgtactatgcactacatatatatgccaggtcaacggaatgagattcttcaacagaaaacgttcttttttttgtttggggttatttctttcctcttcaattactgcagtcaacatgcatgcacgcattttagtaactgcacaaaatataaatatagtcgtccgtttacatatgtttagtatagtagtttggattatctcctagaacctgacacgtgcacctgggtttgctggacggctgccgccggaacacgtacgcgggccgcagtcaaacctctctagtagtagactagtagctagccgtaagaacaagttggtacgggagtggctgcttgaattgccaccggccgtttcactgcacccacgccacgcatgcaattatgtttgcacaaactctcctccccttccactgcagccggcctccccactgctgctattatataacatcccttgcacagttgcacggctgcaccctgcccaagccattccgtccatagcttggcgagcttgaccgaacccgcacacttcactgcatgctgctgctaccggcctcctgcagctagcacacacactactagcgtcttcgtctgttcgtcgatcagtcgtcactcgacagtttggagtacgtgtagtcctagatggcacgtacgtgttgacacgtacaacccggagcagccgcggccggcagctg

SEQ ID NO: 10794 - DNA, 1098 bp, Zea mays
ggtacgtaaccccaaaaccccacccccacctgccctttgaattcaattataagaaaaacttagataacaaggatagtctaagttgtggatttaacttaagaagggcttccttctgaagttgcaaagagaatgacattcgaagagcagttaataagagaaacttgagtataaagaaagagtagcaccaacacaccttcaagcacccctccaagggactctacctaaaatctcgggacgagattcctttaagggggagggctttaacaccccaggtgttactcagggtgtccacccagggctacccccttttaacctattatcacatgtaaattggtttgggcaaagtacatcaaacttggaattcaaggtcctaaacaagtgccaaccatcttggatatcatgccctagcttgtcatgcacatctaagaggggaatttcccaaaaccctaaagcaaacccctcttgagccataggaaccctctttgaagctaggatcaaaaggtcatgtaaaccttatgatcatggcttgggccaaatataaaagttgtagtatactttataacctacaaatggtagtaagaaagtaaccccaaaaagaattcagaaaagccccaaaaagttcacccaaggttgagcacaagagaaaattcagaatttgcctaagtctaaaagctaacccttgaacaaagatcccacatgttcaccttaatccaaaattcaaaacacttcgacccaattgacaaagtggcgccaaattaaccctagaatgccctggaaagaggtgacacctaccctagggcgtttgacatgacttggcaccatttttgtctcggtttggacatgtctgacacagccgacttctcaccctcatatctctctaacccgaccacatctactcttggaactcacatgaactaggtagctctaggtgcagggaagagatctcccacaggcgatagggtaagattcgtacgttttggccgctcagcagagggaagaacacgggcagaagcaacgagccacgtgttcgacgcgctctgagctcgccagagcacgcccgctcgtgccccgcgtcgcgccaaacggccagccgacgcc

SEQ ID NO: 10795 - DNA, 83 bp, Zea mays
tattagtggagaggagagacgggaggggtcgatgtggctgctagccatggtcctgatcagtccttgcttggtattgatcgatc

SEQ ID NO: 10796 - DNA, 162 bp, Zea mays
cgaaaaatacatgcagtacagaaaaaaaaaaagagagcctgtcagacaacctgtaggccatcccaaccaggcaagcctgatcaaggaacgatcctctacagcaaccagagcaagcagtacagctgaactcctggccgttaatcacgctctggcccacaggtc

SEQ ID NO: 10797 - DNA, 1032 bp, Zea mays
tcttcgggaatactaaaaaactgttttcaatgccgaagcttcaaaacttaaaagctcagcaaatcttggtgcgcaaaagctaaaaattgagtgagcgggagcagatggcaagaaagcgtgccaaatgagtttgcggtatgatcttatttatacgcccagtgcgttgaaagtggaaagaccccgcttgtcagtgaatgttgctattctagcaaagggaaggtgttttttcggaccttcggcgtaaagccttcgtccatgtcgcaatctaaatttattattttaaacaaattaatattgcgaggggctactgttgggggccttcggcttacgaaggtcctcaaaaacaggatttaacagtatttctggagtataatgtgtgagcaggtatcttcggactcaagtcggtatcgcgacagaagaagaccagaataatacgaaggtcgatacagcgccgaagatgtgagcaggaaagcttcggcgtggtagcagaaaatgaaaccgacttagagatgaaaaggctattcagacctcgatagactactatagaattattatcaaatgtaaagggcatgaatgtaattttgtatgggctgtgtcccgtgcctataaataggtgaacagtacccccgtactgttcacgctgatttggcattcgctttttgcgtcacgcttgtactttcatctccttcaagttgaaggtacatttgtaattcaacattattcctgtttatacatgataataatatataattgtttatgttgtcctttacgttccctataattcatccttcgtcattgtatagcgaatttatgaaggtacgcccttcataaccttcgtccgaaaaccattatatcctaaggggaataatgtttcgaaggacgaaggactttaccgattaacattttctatgttgccttgttcttgacccatagcatttgagaacaagtccccaacattggcgcccacctccggtgaactcacttccacactctgagttttctgaacaccttcggcgatcataaaccttcgtt

SEQ ID NO: 10798 - DNA, 88 bp, Zea mays
ggtacctaagacccaagcgtaaattgccttgcaggtttatgcatccgggggctcaagctggattatcgacagcggatgcacaaaccac

SEQ ID NO: 10799 - DNA, 1399 bp, Zea mays
ggcaaagaagtattctttgccgagtgctgcctggaaggcactcggcaaagctaacttctttgccgagtgtcataagagacactcggcaaagccgccgtctccgtcacccggcgccgtgacggccactttttttgccgagtgctctctggcactcgacaaagaaggttttgycgatgcactgtttgtcgagccttctttgtcgagtgtaacactcggcaaagcctttgccgagtgtttttaaggcttcaccgagtgcttcaggcactcggcaaagctattgattccggtagtgctggcgggtcagaagccattagaagttagctaagtttcatcggtgggctagtgggctagtagagacgcaggcaggatttttctctaagagctagtttgggaaccatgttttctaaaagaatttcgttttctcaaaagaaattattcattttctcttggaaaaataaaaatcacagagaaaaatggagttcctaaactaaccctaaagaggtcaatacatataactacagttataatattaataaataaaataaatgtaaatttacaatatataatagtaactagttataacaattaacacagatatgcgctaagtgcatacaatattttattttattataaactaactattttattttagtcataaaaaacaactgcaaaacaaatttacttttttgttagggggcatggctcctactagccctcttgtcggctagatcataagtckatagaagttaacttgcatcgacgggatcaaactggatcaaaagccaaaggttggattgcgactgacaaaaaaatgtttaatagcgttggttttacataagccgacgaaaattatgttaaccgacagacgcttacgtgttttgtggttgcagcgagcactcaggtcgcaaaatctaactatatataaataaccatcatcaaggaaactaccactcctagtttatatgcaccgcccatgcaatcaatacaagcaagtatattgcaaccgaccagccggttcgcgccacatttaatactcgcacgtataggcgcagggacacgtggaccgtcctggcctgcaccgcccggctccccggccccccgcagcatcagctcctcttccggcgacctcacacaccctcctgggggcccctcgcatctgacgatctgatctcctctgctctccctccaacctccatccgcatcccctctcgttcgtccagtatttagaagggtcctttgtcctcgttccggccggcggcttgagcttttgccgctcgatctcgatcctgcatgcgctggctgccaccgcgcgagcgaacgaatccttcctccattccagtccacacgagctagctagctaggacacccgcgcccccgtccgcgcgccgcgccgatatcg

SEQ ID NO: 10800 - DNA, 1500 bp, Zea mays
aggcaaagaagatgagttttcatactctattgtcttttgttattccattataaatttaaaaattattctctagaagcattaaaaataaaactgattaattctattttttagaaaaacttagcttttaaaatatatcaagaagcatgaatacaacactccttacaaatttaaatcgaaaaaaactgtaactcgatttttatttaacatggttgctaacatgttgctcagggcggccgggacaggatggcgggcttagcttagaaactgcggctgctctcgttactgaaatctggctttctgtggagtgctttcgctatcgaaattcgtctgatctcaaccatgaacgaccatgcccaccggtcgggagagaacagatgttatcctatcctgcggcctctacagccggcggaccggccgctcaagcctccatggaagcctctggaactctaccgcgtagccagcacgccgcagcaggtagacaaaattaatactcctaattaagatgcatggtagagacgcaaatagccagctgagcatggtgcaaactgccagggtacaaaagctagcttgctcgtcgcgcagcgctgcacgagtgacacgctcgaatttggccgcattcggtcgtgcaccggccgtaccctgagagttaggaatttcgctcgacttgtgctaattgattctaggtttgtaccgatgatgatgttcggtaaataaatacacgatactcgtaataatgttagttctcaatattttatttagtttttaaacattaagctaaaatttggaagaagaaaaaaagagttttgaaattttcgattgaagttcagagctgacttttgtgacattaatttggttttagcggtcctcaactatatgtatgtccgaatccatatataggcttaggctgggtagtaaaatccgtagtacttatgttttggcgccgacgacggccgaccaagaatttattcatttaatttcgtttgcaaccctgaagagtggccaggggaacaagtcgtagtagtacactgcatgccaaatgcatgtgtaagctagtagtgaacggcatcgtagtcagttgatggctatagctagctagctagcttcatgtcatgtgcactacagaatggaatgatcccgatgaggatgacgtggatccacgtgtcttacgtgggggagtcccagtatcgtctataaagtccgtcccatgcccaacaaacaccacctccatcacgcactcctgccagagaccaaactattcgtatcgtgcgtaggtgttgcttgctgttgcagcgtacgaacggaccatcaactagctaggtgcttgcattgctgtcgcactcgctcagctatctccaccgctattggttgttgtttggttacccacgccctgctctctggcctctgataccagttgatagcagcagcagcagctagctataggttgtcagcaggatcgaccagatagatagcgcggatcggaattaacagcgctgcaggagg

SEQ ID NO: 10801 - DNA, 59 bp, Zea mays
ctcccttgtctcttcatcgttccttccgtcagcccgcacatctcacctgcgcgcgcgcc

SEQ ID NO: 10802 - DNA, 47 bp, Zea mays
tgcaggaccattgtgtttactgaagcagcttagttcatgtccctgtc

SEQ ID NO: 10803 - DNA, 1500 bp, Zea mays
gtcttttcttttcttgttttctcttttccagttcaactatgtcgacaaccatgttcagtcattgtgttttgatttgtcattaggaaagccaagctcgctcagttattagcttgcaattagctaacatataaaccatgtgtattttgattctcttcaatggttacatgtttttttgtgtgtaagtaatggttacatgtttgggatgaaaataaggaattggatattttattgttggccagtctgttttgtggcaagaatgaaccaaataggcaaaagggatttggccaaagcttgccaaacaatcagtgtggcaaccgattcaattgaggtgttggtggtgtgttagtttggcttgatccttaacatgcttaattgaagtgtggttcatgaaaggaagccttgaatatggtctatattttagcttccagtttgaaaatatgttggaaacttgtgtcagtcggtatgaaaatctggaatactgttgttgcactattaaatgatccttgaagaggtagtgattctgcaactaccaactatgcaacaattcaagagttccattatacagcataatttcataatcactgagtcattgttaatttgctttgcaagatattaaaatatcaggaacgaaaccttaaaagcattgtgcattggttgtcataaatttcagaaataagaaaagaaaagaaggtttctaatgcatagtttgatgttgaactaagtgctttagattttatttattgtatgcagacatgcagttytcatctgtctatttttcagtggcatcccagagccattttagtttctgttatacttagtttactttgaaagtttttttggtagcttgtactaggtgataattttgtttgaattcaattgtttttttgggtgtccctttttcctcagaaagctgtatttctgttatcttctatagaaatatccaaattcttggactttactgttgcttccagaactgcagctgaggcaaccctgatggatccacttccggtaagagatcaccgagcactgccaggagagcttgctgcacggtctgaacgcgtggatgagctgtaccgttcttacaaactctctacacgcgggatggacttcaatccgggagcatcctaccagacaacttatcacccgtctagtagtgtttatggtgaaggcattcagaggccagttttggcaaggggtaatggcccaagtgtgcctgtgtccagccgttattcctttaatggcccaccagcatattgatggattgcctagatgcaagcactcaaatcggccccagcctattgtactgcgtaccagttaatgtaggcaatgccttcttgtataccgttggaagccaggatagaacttgatggtagttaggggccctaatggtagtagcttcgcagtttgttcatcgccgtgggattcattttgcmagataaatgtatgaaatgaaatgttaaccttgtttgatccaagttgtttaaacaaaaatgcaaagcg

SEQ ID NO: 10804 - DNA, 230 bp, Zea mays
cactggctcccttgggtcctgcaaatccaagaagaaaggagcatagaacataagaggagagaccgcactacacacctcacgcctgaagttcagatctaagccttctcgtcctcgcccaaggacaacgataaacatctaagaaccaaacaaaaacagagcacgaccatcggtctctaagcaaaacgcgcagcacgccgggcgctccacgcacgtaggctagcagagcgcgc

SEQ ID NO: 10805 - DNA, 1500 bp, Zea mays
attcaatagtgaatttatgaggtaggtcacataattgaaaggtgaaggtaaatgcatgagaagcatagagatttatacatgtctaggctctcaagatgagataatacctaatatcatgtttgctgatggtgtttgtactatgatttaccttcttggggtaccccatcgtccatccttttatagtccaaagaaatacaatggtttacatgatatgtatccatgtcggttacaaaatagggaatgtaactgagtctgtcctgaacttacatggagtataactctatctttagatgtgttttttcttatctatctagatctaactatatatgttaggacctaggtcatatctcataatctaatatgatatttaccatgtttatcctttcagaatccttatggtagtaggccctccttatgattttgccgtctaagtctttggactctcggtcgagcctatagaccaatctcccgttgtctttatctcatagaagcttgatctcagtacccatggtacatattatggacacaccctttcccttgggtattttgatcctttcaaagatgttgtaagagtgaaccatctcttgatactatgaaagcttgagattatgtgaagtaaaaatgtaatgtactactcaataacaatattgtcggtaccccataactgaggtactcatttctactgtgtcaagacagagaccccacaaatcaaattttgtgtgtgaacccgaatctaaygggttgaatatctgacctgtgggtaaaattgcccagatggccaagacgagtttcccaaggaccagcgtgtggttcccacatggccacacacatgcccagtcaagtaagagctgatttggtgactagagaattaaagaggatccaagtgagagtaaataggaagggattactcctccataagggcttgttcggttattttcaatccatatggattggaggggatcgatacggattggatgagattttgacttactagggattaaaatcccctcaatcctcctcaatccatmtggatyggggtagaaccgaacaagccctaaatcccttccaatttgatggtagctctaagttcttgttcggttacatctagatctcgaagagaattgagagtgattaaaatcatcttttatttaattttgactagtttagttctctacagtcaattaggccattttactgtagtattcactcgccaagcccaagcccaaacccaagcccaatccggcggcctgaccaggagagacggtcggacggacacggagttcgattccgttttcttcgcgatgacgccctctttttcgcctataaaaacaaacaaacaaataaagattttaaactcgatcagcgttaaatagggagagagagagagagaaaaaggaaaaaaaaaacgcggcgcagaagccagaagaaccagcgagccaactcccaacctctcgcccgatctcgatctcgatctcacgggcgccgccgccgccagcgacg

SEQ ID NO: 10806 - DNA, 914 bp, Zea mays
actgaacaatactgatatcagtatacatccaaatttaattgtatcccaaatcatagatgaagcttctatatgaaatctgtagaatcccaaaactgatcgtatatggtactgcataacttttaaaatgggcttttggctgtgatgaaatattgtttacaattacagttaaggcgtacactggaaacaatgtcaaaaaaaatccacttaatttacaaaaaaaacccaattaaatcaattcaaaatcattttattttgtaaaatctaataacattccgataccacgatatatccaatagaggtcgtgagggggagaaatgcaatcctatctaggatctcgattgtagcgacattggctttccaacctcctcaccgactacttgtgcgctactcttactagctttttatgatctgtatatgacacaacagaatttgtattgaagttttctaaaaatcagtttaatttcatagaaaatatacatggacacgaaaaagaaacctgtattccaaataggctctcatggtttccacctaatctaacgtcgcttctacaagtcacaagttatcggtagaacattcctttaaagatatatgatatgagtactctagaaatgttcttcaggcattcttaagctatctcgagcaactctcttattacaaaattctatttaaactccactatatgaagtactatctacactgcacaatattgttttacataattatatgtatgatctgctgcacacgtccaaacactgggccatcttctctcaggtacgaccgtacgagaaggccggcagcaccaacaaaagccaccaactgcagctctaccatccacatgcaactctgaacgcattgccccccacgagccatctacacaagctaactagctaagcaaaagaatcaccggcgccacc

SEQ ID NO: 10807 - DNA, 1500 bp, Zea mays
aaaaccctcttatcacaaaaaactactctcttgtgcgggagaaaattgattatggaaaaagggagagttttcgtcctttgatcaaatataatcttgaaaaatgttttgatttgccaaaacaaagtattttttacatagaagtaagaaaatgaatttgtattgcgaaaataaaccaagtggtggaaaaatgatcaaaatatgacaaatcctgtgatatttcaatcggtattaagtttgacttcaatttacacatattggctcacatttggttattgaaagggaaatagggtcaaaccttttcctaaatgattttggtggttgaattgtccaacacaaataattggactaactagttttctctagattataagttctacaggtgccaaaggttcaacacaaaccaataaaaagtccaagaaagggttcaaaagaaaggagcaaaagaaaacctaaggctgccctggtctggcgcaccggactgtccggtgtgccaccggacagtgtccggtgcaccagggagatcaactccgaacttgccaccttcgggtttctggaaatgtcactccgctataattcaccggactgtccggtgtagcaccggactgtccagtgtgccagcggagcaacgactacagcaccaacagttgactgcaaaaagtgtatagtaatagtgaacagtgtggactgcacgcgcagaagtcagagcaggcgccagaaggcgcaccggacagtgaacagtgactgtccggtggccccacttgtcagagctccaacggtcgaaccctaacggttgggtgacgtggctggcgcacaggattgtctggtgcgcccatcgacagtagcccctcccaacggccactttggtggttggggctataaataccccccccaaccaccacacttcaaggcatccaagttttcagccaacacattcaatacaagagctctagacttcactccaagacacaaaagcaaagatcaaatcctctccaagtcccaaacacattccaaagatttagtggcttgtgagagagagacatttgtgttcatttgagttcttgtcgcttggatcgcttttcttcttccccatttcttgttcccaagacatttgtaatcaaagcaagagacaccaattgtgtggtggtccttgtggggactaagtgtcccaattgattgaggagaaaagctcactcggtctaggtgaccgtttgagagagggaaagggttgaaagagacccggtctttgtgaccacctcaacggggagtaggtttgcaagaaccgaacctcggtaaaacaaatcaccgtgtcacactcttcatttgcttgtgatttgttttcgccctctctttcggactcgattttatttctaacgctaaccccagcttgtagttgtgcttaaagtttataattttcagatttcgcctattcaccccccctctaggcgactttcaattggtatcagagcccggtacttcattagagcctaaccgctcgaagtg

SEQ ID NO: 10808 - DNA, 691 bp, Zea mays
gatatgctcttattcaaaaatgcctctaaaatggtatcgacgattattattccaattaatgaccggcgatatatatgtcgcgcgcaggacgaattaagggccagcagattgcattttatattcctgactgattccttgatgatctttacttctgcaagaggacaacacaaaactgtagacatatatatatatatatagagattagagagagagagagagaatgtgtgtatgtgtaggtacacagatccctatgagctgaggcatgtgtgaagagaatgttatctatccatccaagtccaaccatttctcactctctcttttggtagggtgatgcagcatgttgtgtgtgtaaatgttggaaggagagggagcaagtctcattccttttgctgcgctggactccccctttaaagccacgcgcgcccacacaagcgcaaacacacttgcccacctcctctcctctactctgcttcacgcctcgccggccgatctagctagctatcgcagaccccgccggcccggccctcatcgatctctcgtcgcggcaatggccatcacaccgcgcgctccccgatgattgatccactccggtcgccattcccgccgccatcatcagctcctactatatattagcccgacgaccccgttcatcttcctcttgtagttttgtccagcgcgctccgctgacgca

SEQ ID NO: 10809 - DNA, 283 bp, Zea mays
cgcgcagaagacggggagtccggcaggggtagattagtccgaagaagaatacaacctgcagaaaaagcaatataaccggcgttaacagagcgcggggcattaactgtgccaatatggcgaggctgtgagctccagaataccaaaatgacgaggtccagctgcggagtaataaagtagcgaagccgcgcgacgagattattacaatctcaaataactccgcatcgatcaccctcctcgctcccggtcaacagcagcggcgcagagcacgacaccgacacgcgcc

SEQ ID NO: 10810 - DNA, 208 bp, Zea mays
gcatgcctgcatatactgtagtactccgtttcgcccgtgccgcccatccgttcggctgcctcgcacgccccaaaatcccctgctgcgcctccaaagccagcagccggcaggtcccgctacaaaagcaagcgacatgcgcgtgcgcgacaggtagcagctgcctgagccagtgcgcctcggtgagcagacaggacgacataggatagag

SEQ ID NO: 10811 - DNA, 779 bp, Zea mays
ggtgggcagcgtcagaaacggggcatcgagacagattggttcatgtggcgttggaaagaatgggatcgaacagatggatgcaaggactgtactgagaaggaggactgaattgatccaactaggggacctagaacataactgatttggtttacctaaaacttctatttatttttctatacttaaagtaaatgaacattatctataagaggtaccaaaaattgggggggggggcacgaccccctttgcccccyatgtggatccgcccctgctcctaggggaatcgaacccaggacttggaggtgctactcggaagcccttaaccactaggctagatgccctttcacaactatattaatttatagaaattgatggccaaagatcgggcaaaactaaaacaaacacctttcaaaaacggtgggagtattagagttttacttgatttttgaaatataaaaggcaatgaaaatkgtattcagatttgctatctgaggttgtgtcagcggccaatatcgtggcacacttccatggctggatgcaactgaaaaaagaacagctctttcattgcacatttgttactggttttatttgtttgatctgtctgtaaactatgcttcattgtctattggaacatgtcggtgcctgttcaattgcggttcatccacttgattttttcttatcacttcaccaggatctgatcatttttcacaactgcaggatctttttctgaatggaggggcaagcttactagggactttggttttgctattgatttgataagc

SEQ ID NO: 10812 - DNA, 231 bp, Zea mays
gtaaaaccagtggatggtgttggatactatgtgtagcaatagatctcattgtaaaaccagtggatggtgttggatactacgagctcgagatgatgaggaaacaaatgagttcctggttggactcgactctctttacacgccatggggccttattgttcatagtaaatttatgttcagtttgtagtgtactttcattgttctttgtgaacactgttgtgtgttgtacttggg

SEQ ID NO: 10813 - DNA, 173 bp, Zea mays
cgtgaccgcttcttcttactccaacgccaccgccgggcaaggagctctcctttctcgacgagaacggccgccccgatgacccctcctccgcctcagcatccagctccacctccggcgccaccccggccgctggtgtcgtcagatgtgacccccgcgacgccgtcagggtattc

SEQ ID NO: 10814 - DNA, 557 bp, Zea mays
ggtaatctggcactggagattttagtcatgacactgaaacttgaaagtaccaaaattgaccattaagaaaataaacaagccatccttttgccctttccgcctttgttgatgaagataagatttactctccgcatggaacaatgcagatgtgtgaaaaatgggcatattataatgtagagatatttttttcccacaccggtaaaaaactaattttcgttacggtagtaacgaatttacagagttcaaaacataacattcagaccaaatgaagcaaagctgatcaccctgatactgaacacccagggaacagtcatcaggggataaattatactgtagatatttaaatcacctatattgtttctccaacctaacacattcatgttactgaagagataagccatgacacgcttaaactgttggtaagcatgtttgtttttaaatttaggctgctgctatttttttatgattttggaagccagtcacagtgcttttgagttttacaagtggcaagtttatttttctgttctttctgcgacactcactttgtccagtgtttg

SEQ ID NO: 10815 - DNA, 510 bp, Zea mays
catttgcaatggtgacaagtgacaacgtcaggagggccacacaaagacaaacaagagacgccctttgaccatagggaaaacccacccgccgctttctctcctgcttttatgcccccttgtctcttcttctctcgtgtcccagtcccactcgccaccagtatattctctctccgctctgcactgcccactgctcgtctccttgcttgcgcttcctccgtccccctagccgctgcaggtcctagttgccccacccctcacgccaatgcagcttccccctgttttgttgctttgaccgccttaaacacctcagggcctgcagatgtcgcaccgaatcacatccccttcacgcctcctgctcgaattcctaacgcccgagaaaccaataacctggtggtgatgccgctgagcaacgccgtcaccgtcacttaatcccaactcccccactagttgtctctcttcttctcttcggttacaagagcagaccggagttagcgggcagtggaggccgcg

SEQ ID NO: 10816 - DNA, 338 bp, Zea mays
tgcagagctttacccagggcgttaactatccgttcggaaagcgtgctgacccgtccctgttcgattttggtataccattccgtacttattcccaacatcgccgcaacttcctcacgccttagtccgggcgttcgccgtctttcaggcccggcagaggggggacgctcaggcttcacccttgcacgtcgtgaacgtaaaaactggctgagctcagtattcttaaccattttttgaacctggtagtaaattatacctgtataaaactagtgtattttacgccgtttttggtcgccctatgatggtttcatattgttctatgccctcaggagaatatgacc

SEQ ID NO: 10817 - DNA, 1166 bp, Zea mays
tattcatatttaattatggttgttagtcatacaattaccatctattaaaaatacatcactattttgttcatgattccaccagaaatggagattatactcttaccgctatagttgttattagttgaatccaggatgaaacattgaaactaaatggaaaatttgtagaattaatcaacaaagagtagatgccttagatgacatgtaatataagctgtaaaggtgcttttggcttcgttttgcactacctgtgtacaaccatgaacacatcgaagtccaccactttgagtttcatttaacatttcaggggaccgtgatttaatcttatcctttggatgtttagttttgatatttgttgcatcaagaacattcatatctgatgatatcatgtgaaataaatgtgtcgattattatatcactggttggaacatgtcgctctttttggtttgatggactaaagtagcttccatgtattttagaagaaaaaaacatgataagtttagtaatccaactgatcataactgttttcatgcctgattttcttgcagacagtggagaacacagatctttttctccgcacgagtaacaacatcaaaacaattttaagcaggtaccgcattgagttttgaaaccttctgcaattgattacaacattgagttgagacctggcactactgatgttaacgtctattcttatgtactctgtttcagaatgagcgaaacgcctggtatcatgagtcagatgcccccattgcctttatccataaacgaagaccatataaattctcttattcaactgaacagactggtaagaacacacaatctgttagcaaacaggagagatggttgatatttctgtgcgacgttaacagcaggctctcaattatgtctaagtaacattatcttatcctgaaaggttgcatcatatggcacaacaagcatttcccatcatacgaagcaagagccatgagttgaaaccctaattaaaaaccaaaatgccattttttaagcacggacctccaagcaacaagaccatacgatacaaatgactccacaagacctacaaatctcgagcatcatcagaacagtttgcagacaggcaggcaggcagctaccaccgccacctccaccatgtgccccaccgtgtcgcttccctctcgttggccatc

SEQ ID NO: 10818 - DNA, 166 bp, Zea mays
ggccgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatca

SEQ ID NO: 10819 - DNA, 754 bp, Zea mays
ctggcacgtgccattaactagttctaaattatgttcaaacaatacatgcatcagtactaaagaggggcatatatgtaagggtagattggtcttcttctttaagatgtaacaccattaagtagtgttaacgaaataggggcaaatggtacctttattttcaaaaaacaacggcactagcacaaaccataaaaaagaggggtaaatctacggtgctgtcacaaagtagggtagtcaacacaattaccgctatatatacacatcattttaaaaataaaaaaatattactatatgacagcagcctaagcacaacataactctcctaccgggtcagtacaaacccaatataaatcgtgttgcgccggaccacgattttttgcaacactattaaataagctatgtattagacgggtccacaagatacaggcacacagctcatttgtccatcaatatttcgaatatctggttgtttgaaataagaaaaacgcaagcctaaaaggattaggatctcctcggttccccgcgtggccgcgtatcaagtacccaaaccctttcgatctgctcaactaccaaactctgctcctccctgcttccgtcacgcgagagcactccactcccacgcgaaccctagcagtggttctccctcggggccccgctaagcagcttggttccaagctgtagaagcatctccgatcccatccgcggcgggttgaggccatcagctccggtttctgcagccggatttgggatccgcgag

SEQ ID NO: 10820 - DNA, 1500 bp, Zea mays
aagacatttatgtgctatatttttactatagaggagtgagacaaaaagtatcatataagttaaagagtataaacaaattctactaatgtataaaatcatttctcactcttcatccataaatttgagataaacttatatctgaactttcaaaaatgatggaatgtcaaattacaaactaaataagttattttattgagcttgcagtcgggtgtgtcgggtgtgtccccactctccatttctcagcgtgcgcgctctcttctctctcttttgtggtaactggcggcggccgacgccgacgccctagctcacgtcttcgtcggtcccttcccagccttcgtcgcgtccttcgccgtcgacgagaacacacgaggtatgagcaccttttctcttgcgttcctgtggggaaccggacacccgaaccctaacttaagctctttggctatttgtaatcggatctaatctcatttcaagtgtatgcatgcctgctaatttcgattttgtttgcaaaaaatattgggtatacatgtgtaagtccatgtcctttaccgtgaccgtcgctgctgccgttccaattgatccatcaatcggtcgattaggttcgtcatctactcatcttcgtcttttagcgcgctaggtgtagaatactatttaggccttgtttgatgagattaaaaaaattagtagagattttgacttgctatggatttatatccacccaacccctcgaatccatatggattgagataaaaacgacaaacctttagttggcaccattgggcttcttgtaatcttggttctcaagtaggccttattcggttgcatctggatcgaaggggatcaaaccaaacaagcccggtacggttgcagtttaatttgaaaagacatcrggattcaaccgaacatccaatccgtgctctggaagcgcaatggattggcgaccgaggagcatttctaatgtttccttcaggacatgagcatgatgattgtcattattcaagatcgttctttcttgaaaacattgcctatgcatatccaagtgaccataatatatatgatgataatattagattactgctacattagatccgactgtatgcattttagctctactacaatgatgctaacagtttagtgaacagtgactggaccaatgtttcactacctaagggctgactatatgcaaattggttatattgcaatgatgctagcagcttcgtaaacatcgaccgggggtccggggccagtgtttcactacctacagcagtacagctgcccattttcagttctttatttacacaatagtacaataccatgtttcatgctcaggattagagctcttgatgttagggtttctggtggctctttggatgcactcttgtagtgtaggagtatatatacctttcaaccaaaggggaaaaaaaatccagagtaggtctgattccaaattttctgctggaaggaattcaaggaaacacttgcaggactgaagaatagagaaac

SEQ ID NO: 10821 - DNA, 1255 bp, Zea mays
ataatagtatttttatgaagtaatcaagtatatgttagtaattatgtgttactaggatatagtccgtgctagcgctatgatcttgggaaggggagagggaggatcgacgatggcgatgacgcgagagaggtgccggtagcagagtcacaagtgagggggagagggaagagatgttgggtcgtggagagaggggccagcgacgttagggagggatcgacgatggtagcggtacgagtgaggtggaggggcggtggagtcacgtgggatgggaatcagacgataagaggggagggggtgtgggtcgctgtagaggaagggagatgagagatgatctaaaataatagtgatcattttatttaatgaagagaaatgaatcaaacgatctgaatcgttgattttgatgatgcgttaagtctgtttgtattttattggatgagttttgcaaaagtttaaacggatgaattataaaatggtctagacataaatatataattatattatacctgtttaaaatatttaagaacgatttcacacggtctaaaccgatgcagtgaaacagatggcttgaccggttccatatgcggcggcggcacacgccatacagcagggaaagcattcgccgcagacccgtggtagaagaagagggtgagaccagtccatctatttctagctatccatcttctatatatatacgcagttatattatatggccaattagatagagattagagagggagctgggaatgaaattttgtacagggaagagagagagagagggtagttgatgggaagggtttgatgtgactgccctttcttttcgctttgcttcctggatccaactgccgccgccgcatctgtcttcgttgattcggtgttcttcgatcggatgcctttatctgcctaggtacgtgcgccgattcttgcgtcgggggattcaattctcggatgggtggagggggattcgtcattcgtgttactgagctatgagtgggtggatgggttcgtgaggtgcttaccagatctcagcttctcgatctgtccttcgcgatttgtcgcccaattcgtttacctcctcctatttctgctcgcagatcggagcaagagcaaagcgcggggtgtaaatcctgagaggaggaagagaaggaggagaggagatcgagaccggctccccccgtcttgcttgtgcttgtcgcgtacggttcttgtaagaacccgcagctgccgcgtccggttctttcaagaacccgcggcgggg

SEQ ID NO: 10822 - DNA, 385 bp, Zea mays
tcgccgatcgatcgcccggccggcacagcccggagccccggacgaacgcacgcacgcacgcacttgtgcctctcctagtagcagattaattttacgttcctttttttttttccaattcgattcgattgattgggggtcttctttcttcggttctgttacacgggttcaggaacaggtggggggagagagaaaagagatgcagattgccacgctcggacgcaacaactcgcgggcggattcaagaggtcacgagagaacccgaggaggaagaaaccggcgaaggagaaggcggcggcgagggcgaagaaaagggtttcctcctcctccggtcccttctatgttctctctcctgggctcctcccgggtgggtgcgtgactaattctg

SEQ ID NO: 10823 - DNA, 253 bp, Zea mays
tgtgccattattaattgtagcggcagcggcctcttccactctcgcctcgccgtcgccgtcgtcatctcagctttaattcgcagcaggcgggcagtggcaggccagggccacggcgtccagcaccagctacgcctgtgcgcgcgcttgtgcagtacctacgttggtgggtgggtaggtagctagtgcggcggagcatcgatcgcgcggtactctcagttccatccgtcgagagatcgaccggtcgtcgatcgac

SEQ ID NO: 10824 - DNA, 1176 bp, Zea mays
ggtgagtgcgctcgatctctttggttcctcgccccaggatgtggagtgatagccgaggaggcttccgtggtttttctgcttgggcttcgttgcttcggtgggggattggatcattggaagctaaatttggagaaatttcccttttctctgtctcctctaccctcactcgacatgctttggattcgattattggtagccttgcagctttcgttaatgctctgcttgtgcttgattgtagctgttcgaatttggtgagagattgaaccccatgatgacagttttatgttggttggaactgtggaaccagtggctgacatataatttttttttgctgttaggttgttacttgttagcgctatggggttgccatcaatcttgtattgatagcttgcttgcagaaaatcgctagatatttttggctgatcagtgccgtggaatttcgactgtgtactgggtgcttggtttctatatgattgcttttagctagggcaatggtggttgtgcaagcagtccttaggtgcaaacgagttctctcgtccattagattatgatctaactgaggcgtcacactttaactagtatgtctattgtcttgtctgttgttttttaggggcggtctccagcagctctcctagtatcatatcatattacctatctcacatcctatttcaaactccactctgtaaacaatgttatctgcaatacaaaacattgttttatatgacaatatgtacgatccgcgacacaacattatgctactacatagttgttggtacagtcaatttattggagtcagtgacataatgtggataggtatactgattcagcaaatcttttttctttagtgcattgatggcactgttcgactggctgaatgcatggttgttttagctgctcgctctattaatgtaattattattattgtggagtttggttgcttctcattattgtatggcgtggtctgcagtgttttctgcttcagcctcgcactcttgtttgcagcagtgcccagttggtgtaacttgttatggctaattccattggttttgaacagaaaaggagaacttgtgcctttatggctatcccgatgagacgtgggaggtgaccttgccagctgaggaagttccccctgagatccctgaaccagcattaggaatcaactttgctagggatggc

SEQ ID NO: 10825 - DNA, 236 bp, Zea mays
agtagagtcataaaactgtagcaatttcttatacatcaaacagtcatctgctatgttttgtatgttatctttatacttgataacataccgtaataatgtttgttgttctgtatctatgttttacactaattttcaactctcgtggcaacgcacgggcatattgaagaaaaggaagaaatagaggtttaaagagatatgcaagttctgaagaatttcaagtgtacctctaaacactg

SEQ ID NO: 10826 - DNA, 95 bp, Zea mays
gggccgaaagaactaagaagcccaagcccagctgaccaagagaggtagctgagcgaagcatccggtgtgttccctcgccatccgccgccgccgcc

SEQ ID NO: 10827 - DNA, 818 bp, Zea mays
ggtcagtttccatgggaagcaatttttttagaaaaaaatgggaaagaggtgaaaatctcataaaccggagaaattcacaatcttggtgtcaaatgttatacgtcatatgaattaggcgtcaaacccagtgagacctgtaaaacgaatgtgaaatatagaaatttctatagttgatttagtgtttatttataaactgtaatttatttcgtctatagtctttatctatagcagttgtataataattataaggatatatacagtggtgtttaatgtagagactctcgaggtgtttaaagggaccatttgcaaaagagacgactcaagtagcaatagtctactcactttccattgtataaatttaccgtctgttatattgatccgatgttgtatatacacatttacttctgtatttattaatatactatatttatagacactccatcgtaaaataaagtctcttatttatctattgtgtttttagaatcatttctctttactatacatgcctaaatacacaatcaattagatacgtatagatattcgcttgtacagaaagtcgaatttaaacctgctgccgaggctctcctacgccctttcgctggcggtctctctttcagattgaacgaagtcctgggctttgtgccggaaattgagaattcagcccaacatcaaacaggaccaacgcgtgcacactgacctttccctgtgtctcgtcttcctagttcaggtctcaccgcaagcacctcgatacggcggagtcgtggggaaccgtggaggtgaggtcgtgaggagaggaaaatttccaccgccgtgcagcc

SEQ ID NO: 10828 - DNA, 247 bp, Zea mays
ctctccccccttcgcggccaagccaaagccatgcctccttcgacttctacttcccccaccacgtcacaacagggcctccacaccgcctccctccgcccccttccgcttgcgcccacgaaccctaaccctaaccccgtcgccgccgcgggacctacccggctagcactcgcaccgcgccttcggcgtcatattcggcgcctgcgctctccgtcctcgcgcggcgagccggggtgctagggttttctag

SEQ ID NO: 10829 - DNA, 1500 bp, Zea mays
atctctatcaagatttactttaatacataaagaatattttgtatagtcctcaaagaggataatctattctaataaaccaaaactctttctattacctatttggctatttcttgaaactcactaactgaattttctgtttctattttatttttttaacattattatttattttagaaaggttgaattctaaagtataattattcattagaaatactttactttgatttcttttattaatctcaaatttaggatttttaggtgttacaaaaggttggccatgttgcagtaaagtgggtctggcttggtaacatgttgtgggcctagccacaacatcgaggcccgtgaaagcttgccagggcgggtttgcctaaattccaaaccgatttattttaaaatcaatttttgacatgggaaattggaaaacatatttttggagtagtttactaytggaataagataaccatctctctatattgcaaggatcatgaccaattaaggtatctaatgtccccaattgaacaaaaaaatctactgcctctcttttgcccttctaacgagctgagctctacattgttgttcagtgttcgatgaacatactataaacgatgacgctttaggcatgttgactgacctaggacaacccaatgatatccttgccctgataggttcttccatgtttactagtttgctcgaaaacatagttcttggtcacataagcgtgattgattatggtttgatgatttcctcataaatatatttgttctacgttttgtaaggtctgttcgtttttatctcaatccatgtggattagaggaaaatggatgagtttaaatccatagcaagttaaaatattttttttctcaaatcacatccaatccatgtggcgtagtaacaaccgaacaaggactaaatgtgtatttagccgtgttctcccatccgtaataacttgacgatctaactctagctcatgtatgatctaatctaatccataatgacttgacgaactaactttagctcatgtatgatctaattagtcgtcaacataatttttagagtgtatttgatttctagagactaatttttagttctaatttattctattttagtttctaaattattaaacatagaactaacactctatttcagtttttatatttaacaatttagagaataaatagaataaaataaaaagactaaaaattagtcccttaataccgagaagtatttatctgtgtttaggtttcaacaggcaacaacctagtaaaaggaacgctgcgctgtttcatcgtcatgtattcttttttatgattatgttgtcatcatatgctgactaatgactaatcatcttgtccctactccaatggcatccacctttcaaccaaaaggcattacatcacctcaaaagaattgtacgctactccagtaatattttcatgtggagtaggaacctaacaaggaagtgctactgcaaagtgaaagctcttgggttggtcggaagca

SEQ ID NO: 10830 - DNA, 270 bp, Zea mays
atttgacttaagacaattttatttgacgtcgcttgtttgtacaaggtacctagctgggacagcgcgtgctacgttctctgcactgcgccttcacgtacgtcaatgcagaaagagtgtaacacgtgtacggcgcatgcccacgttgcaacgtccttgcattggcggcgctgcttgctcggccggcgacggcaacaaagcatataacgaaacgtctccgccgccttcactttccaaacgttagccttttccaatcagggagagagctcaaac

SEQ ID NO: 10831 - DNA, 365 bp, Zea mays
ggataatttatataagtattgttgtgagccgtcacaacgcacgaacaatctaatattgtaactatacagtcgagagtaaatgtgaggtgctgtgattggtattggcatggcatgcccccttccacgttgattccgtctacctttccacgtaccactccggcgtccaggcgtccagcccgccttccatttcgaccgtccaatccaaatctgacgttctcgatgtcccccatcagctgcaaaccccttgcgcgcctacaaattcgcagcgcgaccagacctctcctccgcctttcccgtgtcgtgtcccccgcagcaatcaccgcgagggtttcttccaatcccgttcgttccgttccagttccagc

SEQ ID NO: 10832 - DNA, 1500 bp, Zea mays
aaactcttcacaagttgacttgttagtagacccaaatatattatcatcaacataaatttggcatacaaacaagtcttttgcaatagttttagtaaagagagtaggatcggctttactgactttgaagccattagtgataagaaaatattgtaggcattcataccatgctcttggggcttgcttgagcccaataaagcgcctttgagagcttatacacatgattagggtactgaaagggaaatgtgcccttgggccatttctaagtattttggtgattaagtgcccaacacaaatggtttaagtactaaattgtgccaaatggtggatgaagtgtaaatcaacacaaaggtatgattctaaacttagtacattggtttttgtgtactaacatatttgtctaagtgttagaatcagagaaaacgcaaaaggaaaaagacttggctggaacagccaagactctgcgcactctgggtgcaccggacagtgtccagtgcgccaggctggagtctggtcaactggccgctctcgggaattcgtcggcggcgtatggctaaaaatcaccggactgtccggtggtgcaccggactgtccggtgagccaacggtcggccgcgccaacggtcggtcgcgcaatccgcgtgtgacgcgtggccgggccaacggtctgatggggacaccagacagtgtccgatgcgccaacggctccaaatcttcaacggtcggttgcgccaatttaggaaagcaatctgcaccggacactgaacagtgcttgtccggtggcacaccggactgtccggtgcgccacccgacagaaggcaagaattgccttcctggattgctgtcaacggctcctagctgccttggggctataaaagggactcctaggcgcatggaggagtacaccaagcatactctgaacattctaagactctcgtactccatcctcgcacactcgattgacattcttagtgatttgagctccgttctagtggtgaacttgttgtgtttcatttgagctcaagttttggcttgtgtgtgtattgctgggatttgtgtgtgttgctttcctcccttacatccgtgtttctttgtgatcatcatttgtaagggcgagaggctccaagttgtggagattcctcgcaactgggatatagtgaaagaaaaaaaacaccgtggtattcaagtggatctttggatcacttgaaaggggttgagtgcaaccctcgtccattgggacgccacaatgtggagtaggcaagtgttgtactttggccgaaccacaggataaaccatcgtgtctgttgtgcttgttctcattgtgactattgtgtttcacaagagctcggtccttagccacttgatttcattgtgctaacacttaatcaagttttgtggctttaagttttaagtttttacaggatcacctattcacccccctctaggtgctctcaattggtatcagagccgttctcttcacgaaagggactaatcgaccgaaggg

SEQ ID NO: 10833 - DNA, 632 bp, Zea mays
ttttggcagaagacaaacgaggtgttgccgtatgagtctgacgtccccaccggctcaggactcaggacacaggacgacactgcacgtagatccatgaggtcgtgtggctggccacacaggcagagcggccacatgtatgttggcccgccgcgacccaaatcatctaggggtgtttggtttaaagaattactttatctaaattgaggtggtgtatcataagtttatttctcaaatttgatgggataacctcatttcttatattagtactaactaactatgagaaatgagatggtgatgaattaactgattctattctataaattaaacaaaaatagcaaaaagtgagaagataatagactaactcattacttaaaccaaacaccctactaagtctccagtcggcgtcatgtgccggcccgccgtgcccctctgttcgccgtcgaccggccggccactcgctatcactctacctcgctagaaagttccaaacgactacggcatcctctgactcccccgctctcggtccgcatttccattgtgctttctccgttgcatgcagcctcgtctcttctcgcatctagcctccgccctcagctcaccaccacgacccgagggaaagggagaggggacga

SEQ ID NO: 10834 - DNA, 738 bp, Zea mays
ctgcaggcctgtggccactggccaggctgcaagtcgtacctgttgatgtgcctgagtctctgggcatacgggatgggtgaagacgcatgaaagtccacgcctatccaaacccatctacatctatagttatcaaccgttttaatctacaatacaaaataaactcacttaacctaattcgtttacaaattaaacacatcacaacacaccaaaataaattcattccttaaacctatctaaaatacacgtttacactcactctatttgcaggcctacccgtgagtctctctgtaagagagattatgagacagttgagtgattcagctccaaccacctagcgagtagagattccaacataaacgacagggccagggcagtttacgtgtgcacaaccgtacgtgtcgactagcatagtactcctttacaacagtagtatcagaggctcgagagaatgagtgaatgaccgatgaagctctcttgtgtttgtaataactgataagtatagtaacccaagtcctttccgtccgagagcagtaatggcaccgtcagtcctggtacctctccgactccgatctatactagatgtaggcaggcaggttgctgggacgacggacgacgctcagttgcattgcattgcattgcagtgtagcaggcatctccgtgggcaattgctggctggcctagctagctagaagtatctcatatccgggtataggagtatctctctcgctttctctagcc

SEQ ID NO: 10835 - DNA, 1500 bp, Zea mays
tggatggcgtggtgccggggcggcttgtgtcgcggctccgcgggcggtcctcctggttgctcggcgcgggcgggtgagagccgaaggaaggggagagaagggaggagagagaaggggagggagaacagagaggcggcggctgagcaggggaaaggggatttccccctggcggcggctaggtgaggggggcacggctgaggatgttgggccaagtgggccaatttggccgttaggttagggtttagttcaggttttttttctttttttatatcttttctaatttcaaaatataattttaaatgatcctaaaattcataataattaaaccaaaattatttataaataaaatatttatttgtgtactaataattattatattatttatttagtttttcatttaagaagaaatgatattcaatatccaaaatcacttatgagcaatccaaaatcatttcaaatgtaaataaataacaaacacttaaaaaatttattaccataaataccattaataattaaatgtattatttttatttgatgatttttatagtgttacaattatgtaggtgtaattcataaaagtgagcttaacattttggatgtacgagtcgctatgtatagagcttcaagggtgtattgggtgggattgattgacgcattcaatcgcgccaggctgctgctcgcctggccgggtagcgaatgtcccaccccacttccccgctcatgcaggtaagccggttgaaaagtgcctcgcgtaggcaaccaattagccgctcgggctcagtcaacgcatgcatcctgtttgggcgcgatggaccgacaaccaatcttgcacactggaagtctggaacccgatttgtatgtatggtggacaaaaacatctgcatgtaaaagtgagattaacattttagcttgcttaccgccgcgacccacgggcaagcagacaaccattggctcaccagtcgccatataaccctcgcgcatttgagccattcgcaattttaccattattatttgtaagtttcactagtttgttatcggacttaggctattttcaataggacatcatcacacttgtgacatggcattgtaattaatagaagagaggtagatatagtttcatggaagattatagagtttcatgggatttaaatctgatgtggtagcattggaaacggtacattaaagcattgcatgagaatgaccttataaatcatagacccagtcatagatacggaagtagtagagataaaaaaggcaaaataacgacttttttccgcgcgtttgggccatgcataactttacgtgggccctgcataactttactttgggccatacggctcgttacaagggcccagtctttggtggaatccgcctgtctctatcttctccatccgtgacacgtccggcagctccatcgagttcgaggactagccgccgccgccgcacctgcacgcacgccaagggacgggagagcaagagggagatccgaggaggtcaaag

SEQ ID NO: 10836 - DNA, 285 bp, Zea mays
ggtaattttctctctccatttttcgcattttgttttctccgttttttggttttcagtttgattgctcatcttttcaccaaaatatcaagtagcgtcatacttgaaatttgattgatcatcttctcgatttgatcttttattttcttataggagattggtcgtctatctggagcactccgcggccatcaacccccacgcttaaggtcagggtttctgttggagcgtcagggcgatggtgtttggggcgttcctttatcaacaaggggtagagaaggaagaaggtta

SEQ ID NO: 10837 - DNA, 1500 bp, Zea mays
agcaaacataaaatgtgttttaaaatagcaaaaaaatattttaattaggaggctcgctcgtctccgtcaaagtggcgacatttttccactcaaaattcacgtgtagtctctgtgggaatcgaacaaccaacctcatcctcgcgcgtagcccctctaccaatccacctagcacttacttcatatttatattgtagttttgttggcaacatattagaacaatccgaatataaattgactatttgaggctgtaaacgaattcaaacgaaaaagttgtcaactacaagttttgtaacttttgaagtctaccacttttattttggtacttttcctatctgaggtcgtctgcaaaatttacaatttaaatttgataaatttagatgcaattttctagagccgaaataatttcaattaaaaaagttttaaaacacaaaattttataatttttagagatctacaacttttatgttggtgattttttcgtacgaggtcatttgaaaaactcaaaaaaatctagctaaaaatgtttttttgtcagttttttaagaaaaccgcattatcgtataaatcgatttctacatatggttatttaagaaaaccactactaaaaatactactatcgctccataactaaaatcgcctataaaatttaaactctaccgcagacttagagttttttttactgggcaggccggcggaaagcttagccttaggctggccgcagtcaacaaccgcacacgatacgctaaggagatcgagttgtgtgtgcagtaaaaaaatgctgcagccatatactttatctattactctaaatatagagcgggtaagagaaaccttatttatagattatactgtctcgtactccactgtgctctcatgttggatgaggaggtagatggtgccgtcttaatatatattgataaaaaatatcatagtttttaaagagttaagatatwgagtaattatggatacgagagtatatttcaaaatgttgatgagtagaatggaatatttttttaagtaggaatttagagtactacgataagtatgaatagccttagagggtgtttgaatacagtagaactaatagttagtgtctaaaattaagtaaagatattcaaacattctagctaatagtttagctattagttatttttagtaaattagttaatagttagctagctatttattagctagctaattccactagcaattttttaaccaactaactattaattttagtgcattcaaacacctcttaaatttttttagagcgagaatcgcgctcgcagaacacattttccccaccctacttgtctgggtaggtcctctatctgtccttttcttctacggccagagaaagaagagacccaaaccatctgtcctaaaaatagcaacaaccgtccaaaactgcatgtcgggagaaacccaaaaaattaaactcctcccgcgtgccacctccccgcggccgcggatgcgcatgtcccgtcccccgccaccgcc

SEQ ID NO: 10838 - DNA, 1500 bp, Zea mays
tgctaggatcgagtggcgtggtgaaaagggctagaaaattgctttgaaaatgttgtgaaaatgctaacacacacgtacatggtcttgttagcacatttgcaaaggtaaagagtttcggatcgaaacagagaagtttggaggtcactggggtgaccggacgctgggtcagtgcgtccggtcgctcaccccagagaggcagtgtcttggctaggtgttcgaggcgattggacgctcggccggacgcgggacagtgttttcggtgtgtccgatcgctcggtggtttgacagtgcaattgttggatcggacgctggtgcgtctggtcggtggtgaccggacgcgtctgatggatagctgtcttctaatagactgtgcttagtttggtgcataagtttatttcttcgttttgtctgctctttaagagcttgcttttcttcagccgggggccggacttgtaataagggatggttaagtggctaagtgcatcttatgcagaggccggaataaaaattcttttttctaaaaagcacgattacagttgcattcgtgatgttgttctgctccttaagtttgcatccctgccagatctctgataattaatgtcatgaggtttaaccattgtatatcacgtccaataaccatttattcaaggtaggttacagcactcacagttcagctgacagaaatgaaggtttgtattctcaattatactgctgtctgttaacgaacaaaattacattgaggtataaaaaaatgcacaaataggagtgtcacacaggatacttatcagctacatacaagcaagtaaattaaagaacattcagattaccagggataataataagcaaataagatccatggattggttccatccaacgttgggtttaggatacgatattgggctgccacttgggccttctgctagtctctttactggcttgctcttgctctgcgcgcttgcctgttggctgcttgctttctttacaaattaattatgatgaaccaatgggcctgttcgcttctgactatttcagttgtggttgcagcagtaaactagcgcagcgctgttgctagagctaggtgaaggtacagctgctgcacggagctggtgtattattggggaagggcgtaatggcattgaaatcaattagaccagccatttgtaaatcaggtctaaaactgtgctgtaacctgcctcatccagtgtaaaagccaacactcgctcacatttcagctggcagaaatgaaaggagagttcagaaaacttccatgttatttgtattctaaacgatacactgctgtgtttatttgaaccaataaaatcacattgtgaaaaaaatgcaacaaacgggagcatgcatcggacatcattctcagatagacagatacatacaagtaaactaaaagaaaaacagaatgccaaggataattaagtagataaagatctatggatctactaggtgacaacctgcggcttgcttcccgagtgcccaacaaatagg

SEQ ID NO: 10839 - DNA, 64 bp, Zea mays
ggtaacgtggttgatcttgattcgctgtcgttgttcgcatgcgatccttggtgtttgccgctgg

SEQ ID NO: 10840 - DNA, 677 bp, Zea mays
caaaaaccgatccaaacacggtctatatctctcgcttcatgtttttttctagagcacctaataacccactctatcaacttcactaaattttataaagccggagttaccccaaacaaaacctacatgtcttaccattcatttttttatttttatttttacttccttttactctataaatgatatagttaacggaagtttgatggttactcgaagtttgctttctgggtagaaaaaaccattttttttcttcgatcaactcagccctctgaataaagcaataggaaggtggaaaaaagagcagctgtttcctcgattccaatggcttaacccaaagaaacctaattcggcgacaggacaaacacgagaaaccggccccaccactgccctcacctcctctccaccactttccctctgcgcctcggcccccacgaaatctggaaagcctggacgccattgctcacctttttccgtccagcgcaaagacaccgcgcgccagagagggtgagggattgccgtgaccgattcgaaaggtatctcctcgcagcgccgtccctacggcgggtcgcgccttgttttcaggggtccggccatttcatccaggtcgtgtgaccactctgatctggattcctcttgcagccacttcgggcgcgggtgggatcggcccgtggccggcggag

SEQ ID NO: 10841 - DNA, 1500 bp, Zea mays
aaaaagaattttagcactagaaaatagaaaaatttcctagaaaaatctacacaaatcctaaaacattctaaacaatatataaacatgtttttaaaacttttgtatttaaaaaatatgagatgcaatagcatttatgtatcatacactaatactaaatgcattcatgttatgcatgtgccgatgaaaggttttcaaaacatgttcacttatcaattagaatgtttttgaaaagtgttggcgttgatctggacgccaaacactggaatgaaccacctctctgcggaggcgcagacggtccgcgtcacagagtcggacggttcgcgacctggacgcaggagcgactcctcctttgcgtacgtccagacggtccgcgcgtagggcttggacggaccgcgatggcacagagtgttgtcttcttcacatcagacctaggtctcacctcccaggtgagatcccatcggagaagagagatactagggtctttcttggcgtcggcagaccactcaaaacacatctagtcgacgtagcgccgaagagaggtggagatttgaggtagagaaagactaaattagggctaaactagagctactcttaaggtaaaaacgataagtagatttgattgaatcgattgtggaggttcaatcgatcgtagctcttcgtctatagaaaggggaggtctggacccgttataagtcggttcctgagttaatcccacaggtttagctaacaaaccccgcaagaaatccagaaccctaatagattctgcgcgcgtggacggttcacgccactacggcggacagtccggatcggggaccggccaccagacctttttctgtgctcaacaaaaatcttctagagtttctaggtaattatactttttagctaaatcgtttttttatgcgcattagatattttcaaaacctttgaatcttttacttggattttttatccaatctatatctggatttttaaagcttagagacattttattggattaaatcaagtatttgctaataatttaaattaccacttcaaactagaccatggaggtaatttgaaaaaaatagtttataaaaagtatgtatgattttggagtttcataaggaaattcatagtacaaaaagtagtttagagagctagagtaattttttataaaaaacgcattattacatcagttttaaatttggaactccaaaagccagcccaatagaaacctacgtaaaaggcatatagattagacagatatataaacggaaaagataaaaaaaaggcaatgtcctgtttcatggccggtaggtcccaccagcacggacacgttggagcctcttcaatccacttaagtcgcattcccacgtctcgcgtccgctccgcctgccttctctctcctcacttaaaccctcctccgctcgacgacaccacacgaaaatatacgtcagaataaaccgcagcaaatcttctccggcaccggcagcgcccaaatccggcaatccgctgctccga

SEQ ID NO: 10842 - DNA, 428 bp, Zea mays
gtaaacgtatatactatcaacaagttgggggtgcaaatgtaaaatacacgacgactcactcgcctcaacctgtctttttattttttgcaacgtttacccacgtaaacagcattactgcctgccagcaataaataattcatgttaaagcccagcagttaccataatagacctagtaatcctcttcccgttgcgcttctgcccctcctcctcctctctctctcttggcctcttccgttgaagaagagcaccgctatttaacagccttcgcgctaccgccccaaccttactctctctctctctctctacccacttcgtgcaattgcacccccctccctcccctccaccaacaacgaggaggagaattcgatcccgatttacagcgcccgtacgttgcgcaggtccgtcggtgactcgagcggggagcggca

SEQ ID NO: 10843 - DNA, 1243 bp, Zea mays
cagtaccgagcaaatttgatcctctagttgatcttttttaagataggcagacaccttttttttttcatgaaacggtaaaatactaatttatttaatgtacctatttattttaaataaaatgatgatattttttcttctaagacctatgaaacgtagaaatttcgaagataggacttgagacgagcgagctcggctcggtcgttttgcgagctcaaagatcaggctcgactcggatttgttcagttgcatacactaagtccaatttagagcataactagtacgatgaccgtgcgttgcgacaggataaactatttgattaaaaaatattgatctgtctggttcgggctcgatcaggctcgacttgctgtttgaacgagtcataaaaagtaggctcgatttgggctcgcgagcctcttcaaattgagcttagtctgaatataagtacgagccgactcatgagcttcgagtttttttagccctagatatcagttattttaaaaaaataaccggtttttttaatcaaagagggcctaaatatggaacgtgcatgctcccaattcccaaaccctaccacgcggatctgggagggagatgcctactgtcacggacagaaaggcccgttgaggcccgcctactcaacggcccatcgtttccgcgacagaaatggtgaaatagtgagatatcggccgtccaaactagggttcgcggatcccccacgacacctataagcaccaaccctagcccaaaaccccgcttccacttcacagcctctccgcctccgctcctcgcgccgccgccgcgtctcctcctgtacaggtacgcctttgccctttgctcgccaccttcctacctcctggggtccccgtgccgtgcttgccgccggtggattggtttgctcgtatgatctgggttctcgatcgactgcttagccgttggctgcgatgcgcccgcggatcttgctgcgcgacggctctggattcctgatcggttgcttagcactgatcgtagtctgtgagatgctttcgatgcttttgtgtgcgtctagtgtccatgcgcgccttgatgtcgcaacgtgcttcagacagtccactgcgctgcgctgcgctgctaacgagggcgggagatggagctgttggcagctcgttgattcttgttcccgtggtgtttgttgttcgtctcggctgacgccgttgctgttgatgtggcgttgttgatgtgcaggtaaggagaggaagagggcgaa

SEQ ID NO: 10844 - DNA, 972 bp, Zea mays
ttttctactctgtcatcctttaatattcagctcctctcataatctatatttacattaatattgaaatctatggtgctgttaatgtacatattacggttagacatttgcaaatttgttaactcctgttgtgaataatgcctctatatcttttcatatttttattagtactccctccgtctcaagatataaggcgtaaccactttttattcttgtcccacaatataaggcgtgctctctctatgcatacgtatatcgatgcagtgctatagagacaattaagtgcacttcttggtctttgaaccagaggtggttacgccttatatactggaacagagggagtatcttatttagatccaataataaatacactcatataataaatctagctataaggttgacttttagattaatctcttgtctctttctttttcatccttttatcttagagtccacctgacttttgtatgagaaacaattttctctattttctcatgtccctttcctctgtataataaaaatgttatataaataagtttagagtccattattatacttctctagttcacacgagtcgtggtcgagaacgcgacatgaacagagcaaggagctcaacccaagcaaagccgaccgaccgaccggcccgccacccaacctaacccgagtacccgacgacgcagtcacgcaggcgtgccgagcccggagccggactcccacgacgcgctgctcgacccacccggcaaccaaaccctatccaccccgcgtcctctctcccctcatttaaaccgccaccacgacggcacgccgcctcgtcggaaaaaccatcatctaaagttcaacgcccgcaccgcaagcgcaacacgccaacacccgagacccgacgcggccttcgccttccctccgcgcgagggagattcgaggggagagaggttctcaccttcgcgcctgcggttgcttggcgcagagtcgtcgcag

SEQ ID NO: 10845 - DNA, 311 bp, Zea mays
tctgtatctaaccctgcctgttttatatgttgtggcttataagaaataaaagatctgttcaaaaaggtgtcactaacacgtataaggacaccgctactctcccctcagctggctcccagcccactatacagtatatacacacatcatcccactccttatcgctatatatagcagtgttgtgtgtccatctctctgctacattgcaccgcatcgtctaagctcgcctgccctttacagcagcttactactacaaagacgacaacacagcgcgcgcgcgccaagctgagctcagctcgtcacgacacgccagc

SEQ ID NO: 10846 - DNA, 137 bp, Zea mays
ctgcccgatcttgtggcacaggcaatcttagcatcacgaagcttgattgagcttgacaagagcgcacgaaaggctgccaaggcagcagctgctgcggcttctgggcaaattgttgcagttggcacttgctggaagca

SEQ ID NO: 10847 - DNA, 786 bp, Zea mays
cttgcatgcctgcaggtgcaacagatgactgtagttgtgtgtagtactcggcatgtattgtacagtacgtaccagatgcaacagcttgtggctgcccggcccgggtggcacaaaccgtacaacacaaactgggtgttttattattattattattattattattttatctgagaaacaaaatgataatttattgagaagcaggatgccagcgacacaagaatgtctctctccgtttgtgtgtatatataaacaaataaaggtgacgcaggataatctgccatttggccacgccctggatcctgaaggtgttaaaaactctgacgaaacacatgttttagtacatttacagcccataaaacaaagacccggcaccaaacatgcatgtgagcaggaaaggaatcaccgcatgggccgttcccgtacgaggaagaccggggtctcatggtcatggcaagaaaacaaaacaaagattatcgcgtacagtacagtagtaagcaagactagcatccccagttccccacacaccaacaccacactactccaaaatctatccgttaacaaaacaagccggcagccaagtacagtacagtacagcagacatgcgtccccatccgtgatatcccgtcccgtcccgtcccactactactgggacccttccttcccaccgccaccgctcactactccggccgcctctcttccagcaaatccctcccacctcctccccgccgtctcacgaggagctagaggaaggggaggctctgtaccagcctgttggaagggggcgag

SEQ ID NO: 10848 - DNA, 495 bp, Zea mays
ctgcaggctgcacaggtatgtatagtatgtatattagcgtacgcgtgactaatgcagattagagctagctagtttcggtgtcttctcgaggagctagcggaagagcgctgtagattcttggatggatctcgatcttcatctgcaacaatatatatatagatgcattagaaggcgctggtcaagcctaggacaagacaagttatctggataaaccgctactagcgctagggctaatccaatcattgtcacaaacaaatattatcgccgcgcgtcttaaaatagctgaattatttggagggtcggagtcggacaggcagatcgaaatgcggcaccgttgcattgcttttatcttcatgcagcgtccatcgtccatcgcgcccgatagaactagatagatagatagctactggtactatataaacaccccaccgttcaggtcacggcgagggcagctagcttttgcttccaaccagcggcagctaggccgcaggcggc

SEQ ID NO: 10849 - DNA, 1017 bp, Zea mays
agtcgattttgcgttcagtaaatttatacattgtcaaggttcagatattgttcctttttcgtgttatctgccaagtacgttatatgtatctttatttagaatctaaaatgtaacttggttgaaatttagtccacgagaatatattctttgtaaacttgctacaacgttctgggcttttagctctgtaaatgatgatcttaattactcggattctccttcaagagatctagatgggtgatgcacatacgagtttctaatgcgctcatgcccaatgaaatgtaaattagttaattatttttcctttccatttttatgataaggaattgctctgaataattgtaatgacataggttttaaactcatccattgggattttggttatagaactgatttatttctactgtttgattatttggccattgtagaatgatgattgaacaaaggttgaatacagggtgtggaaccccttccgttcgaagctggctactgttgtgcttggtggtgttgacaacattctggattgtaagtaaactttgttaactcaatctgcttgagttctatatgtttttttgcaagtagaaactatggtgctgttatagctgataatttgttaatatatatgtaggctcctggtactcgtgtgttgtatcttggtgttgcttctggcataattgtgtctcatatgtctgatattcagaatcccttccctttcgtagtgcgcatgtgtaatggtagaatgaaaaggtgaactagagattgttgtctttcactttttatattctttcattttttacacttatccagtgtgtttgtttgccaaaccattgcaaatttttaattgttctataagttgcaaatttggttatgtgtgtagcactcgaaccccttaaaaaagttggctgaaattacttcaaaattctggtagggtctttgactctttgttgtcacttgatgttttttatttgtgtactaaggccgtgtcgaatctaagttgttgcattttggcgctctgcgcaa

SEQ ID NO: 10850 - DNA, 387 bp, Zea mays
ggtcatgagtgttaagtatgtcaaggcctatgtattctaggcatatatgatccataacaatgaggttccagaccaccgctgtccactggatgcgcacggcagccaccaaaactaggaggtaaacaagggagaaaggaggaaacggcctcaccactgtcgtccttgcagcagcatggacttctggggtgacaggggagtttgggcagcggcaggttcatgcgggtgagacgagatgtttgtaaatgcaccccattgtaatttgactgtaaataattgtgccaaactcattttataaattcctttatatttattgttttctaatgtgatgactgttcaatattgaattttttacagtactgtgaccaattacggcaagatttaattcca

SEQ ID NO: 10851 - DNA, 906 bp, Zea mays
ataaatcgtatgactttaacgtcacgtgtcacgccacttaccttaagatcttaaagccgtaataataccaaatacggagtatatatggtgtaggcatgaaattaaaaaaactgcaatattatttaaaaagtgtcggtctaatkgttcattcttaaagtaccataaatatttactaataacaacgaagggtctcatggcacaatggcgaaggccacttgttgatagtgctcccgcggggacggcagggttcagtacacacgtatgtttagtggtattgcatgttcacaggcattagagttctagacctcttaatttattcttagcttgtaaaggatgcgtatgtgcagcagtgtgagctagtatcgttcttccttgtaccctctaaaaaattcttactaataatagatttgttagttttaataatttggtatcgtcgtttattagctttataagcagtttatttaatattcgtaattgaatttgacgtgacatgagtattgatagtactagccgaggagaggagtacgtagacagagggcagcagtgagtggcgtaggctgacccatccccatcacacagcgggcgacatctgccatcaatgcggccctccacagcctaccccgctcgcattcattgcacatcttgtcctcatacctctcctttccaacacctaattaatggcgcgcccatacgtgcctgatgctggctccaaaccccgacccttttcatccctccctccctccctcgtcgtctcctgactttgctcgccggccgccccgcccacaccctcctcctgcgctaccactgtcagcaagtgcacacccttcgaggacagctgctgtcgccgccaaggccgcaaccggccgtcgctccatgctgcggtagaatttagaaacgagaagggag

SEQ ID NO: 10852 - DNA, 118 bp, Zea mays
ggtgattatattaagttaccaaaggaacagatgaatgcattcaacagtcagatacttcagagtttaagtggaacttatcaggtttcacaaaaacaaaatactattcagatacctggag

SEQ ID NO: 10853 - DNA, 587 bp, Zea mays
tacactaaccaccccgacattccattccgttgacagatgtgtacgtacatgcgtatatacgtatctaagacggagcacgcggaagcgcgtgcagccttccttggtcacgtcttcgtcttcgtagtcgtcggtacggtcggctataaaactaggttattagacagcgtgcggccccttcactcgatcagttttcgtggtgcttggacacttggagcagcagccaagtggttgcggtatttctagtgcgtagcgtaggcgtagtatcgccatcagcagcgctcaaaataatactgcgcgctcgcttaatttgttttctagcttttgtcagcgaaccttcgccctgaaaaccccacccactcttcctctccgatcctcctagcgcctcacttgcttcattccattccattccattccactacccaatacccatctccccgccggcctttcccctcccgcgtgccgatctgcctccggaggctagctcgaccggccgatctagctcgcgcgccgccgctttcagctcgatcagctgccgcacgtcgtccaccgacccgccgtcctgtgagcgcgatcgacagattactaag

SEQ ID NO: 10854 - DNA, 1500 bp, Zea mays
tattgagtgccctttgtgctgggctcaaacctccagctaaaacacaaatcatggtctctaaataaattcggcaattatctttttttgcttttatacacgcgtatttttgtgaaacaaaggaaaaagttggaaatcccgagaaagcccctgagttagggattgaacccgttgtttggggctgcactgttaccagaattaatttgaggcgccgaataggggcaaagttcgaaacttttggagcaaacaaaaaacagagatggaataatttatttcctttttacaggacacacatgacctgacctactctttttctactcctactgctgctgcagcagctacattacccttctcagcacattgctattgtgtattgcaaaattttggaggctttgactaaaaaagcttcgttttttcgagcttgctcctcccccgaaaaaaaaatcggggcccaaaaagttcgcaattctgggggctcccgtggccgcaggtccgcccgaattagcgcgcctctcggagatgatcctgcgccggtgagttcccagtagatccctcccgctgtcagcttctggttgaggtgcgtctcgccgccggccgcggcctggcgcggcagatctggcgggtgcctagggtttgggtccggctcgccgggagtccccgattcgtggcctcctggaaccggtggcggcgctgggttagttccttgtcttcttgaggtcgtggatcacgcggatcgaggcgtttcttggctcgattcgtgctgggggttttgcgaggtgctcgtgaactggtttcaaggtgccttctaaggggcttggtttgtccatttcgctggggtttttttttttgacatgctattgcgggtgggttcaagatttgtggactcgcgtagaaagtttggatcttttgttccacttgctcttatgaaagacacgatttttgttgtgggtattgttggagttgcgtgatctgcttagcttagcagctgcagatcaaagatggaatgctgagtaaggatgctcgggagtccgaatttagtgaagtgaatctcagtgccgcttagtggtttgatgggagtgcatgctctgtccgagctgaagttaatactgtgaaatgtcagttctctatgagatagaactatcgatgagtatggttttactraagcgctcacttctagattattttggatctgaaatgattagttcaaacgtggtagcttacttttctgggacttcttcagtgcttgtttacatactgcttggtttctcacttcagtgctcttattcagtccttttgtaatatgtactgttgcatcacagagttctttcattttgatgttgttgttgagatttctaacctagttgtacttaactgcaggcaaaggcaatgaagatctctaatctggatgcacacttaatcttgtccagctcttgatcagttgatcttgtgctttgctgctcctgctcaagttaatttgttggccaatcaagttcagaggcgcag

SEQ ID NO: 10855 - DNA, 1500 bp, Zea mays
caacttatttaactcgagatgaacatgggattagtattgcacaataattcaaccttgggtcaataaatagacaataaaaatcaacagcttaagcatagaatttgaattaaccatctaaggctctcccatggtctccagtccatctcgaggcacctgcatggtctagttggcacagtttggtacccatctcgggatgggtccataacggtcatccaaaagagcctttgagacccaaaccatacacttgtgctagatcagtaatctaaaagggaaatgtgcccttgggccatttctaagtattttggtgatcaagtgccaacataaatggtttaagtgtgaaactatgccaaatggtggaagaagtgcaaatcaataaaaaggtatgattctagacttagtacattggtttttgtgtactaacatatcttgtctaagtgctagaatcaggaaaaactcagcagtctgggtgcaccggactgtccggtggtgcaccggacaatgtccggtgcgccaggctgtctctagtgaaaaggctgctctcgggaactgaacagcggcgttcggctaaaattcaccggactgttcggtggtgcaccggactgtccggtgagccaacggtcggccgcgcaatccgcgcgtgacacgtggccgggccaacggtctgaagggggcaccggactgtccggtgtgcacctgacagtgtccggtgcgccaacggctccaaattgtcaatggtcggctgcgctagaataggaaagaaatctgcaccggactgtccggtgcaccagtcgacagaaggcaagaattgccttcctggattgctctcaacggctcgtagctgccttggggctataaaagggacccctaggcgcttgaaggagtaacaccaaacattctttgagcatccttaagcactaagactccatttccgcgcttttgattctttgtgatagcaactagagctccatttgagtaaagaactcttcgagttgtgttgcgagctcaagttgtgacttgtgtgcgtgtttgtgctctgattttgtgtcttgtgtgtgttgctcatcccatccttacttctgtgcttgtttgtgattatcaaattgtaagggcgcgaggctccaagttgtggagattcctcgcaaacgggaaagagtaaaggaaaaagaacaccgtggtattcaagttgatcattggatcacttgaaaggagttgagtacaactctcgtccattgggacgccacaacgtggactaggcaagtgttgtacttggccgaaccacgggataaatctctgtgtctcttgtgcttgttctcactgtgtcaattgtggttcacaagagctctcctctctactcacttgatttcactgttctaactcttaatcaagtttgtggtgttaagtttcaagtttttacaggatcacctattcaccccccctctaggtgctctcaattggtatcggagtcgttctcttcaagaaagggactaaccgcccgaagag

SEQ ID NO: 10856 - DNA, 805 bp, Zea mays
cctattatagatgaggcggtgcacataagtctattccataaatttgctggaatggacttatttatcagattattattaattatagcttatatgaggaatagaatgatgatagatcaactaattcgattccacaaaccaaacaaaaaaacgatgagtgagaagatgctggactacctcattcctcaaactaaacacactgtaataaagcgtgtagaagcgcattccatattccagcccaaatgtttgtgtttcacgccagaaaaaaaggcgacttgcactttgataagaatcattttcagtcaggaaacaaaatgaacgaaattgatttttccagatgccaaaagtacggatacgttctattcaagttatgtttcacgtgtacaaaacgagacaaccgatcgatacggtgttcttgagtatagaaacgacaaggtgaccttggctttttttttggtgatgaaagggccacaacagatgaccacaaaacgtgcagaatgtgtagcagagcatatattgcacgaaatagcatggaaccaaacctcactgaacgtcaattacaggcttgcaaattaaagccgtccctgtcaacatcgtattttgttggttgtatgagctggcggtacatgcatgtacagagattctagtacaaaacaaatgtcggaaattaatggaaacaatccacgatacaaacggttcagcatctgctgtagcctatatttataccaacagtttccatcagcatccgaaggcagcaagccagcagcacaagaaccagagtccatagacatccatcaagccaagaaga

SEQ ID NO: 10857 - DNA, 1500 bp, Zea mays
tccaattagagaatattctcctcagatccggaaccattccgctccaaaaaaatcaaccggacggagccgctccgttcccatcccgctctcacagtcacgctccgttccattcactctgcaaccaaacaaaaaatagagccactccgttacagattactaaacacagaacagagcggctccgtttctagaatcaaggatagaacggctctgttctacttgctcctcaaccaaacactacctcgcgcggccgagatcgggaacttgggagacgcagagcaaaacttgtggctgcggataaaacaacggaagctaaggctatcttctaaatttctcattccccgttatttatttccgccaccataaaatatcgttttttctttcaaccaccataattacctcccattccccgtttatttatttatttgttcatgattaaatcatgtaacatacatcaaagtaaggtggctaaattttttatacaatgttactgatgcataatattgacttgactccgaatgttattaattaataatgtacgtacgatttttcccctcaaaattaataattgttatcatgttactaccagatcagagacaagctactaatacatgtctgagaagtaacaatattctcgccttaacaaatgactacacaagatatttaacccacgggcgacgtctatctaattaaaaaagagaagaagaaaaataagaaagggacatggataagcatcagagacaagctactcaaactctccacgaaggaaatttcattggcatataatgcatgctatctgatgcttctgaatgtataaaatagattatcaattataagttctataaaagaaaaatagcctggtagggtgagagtacctgttgggcgagctcctctccatccatcaggtgctccatcaagccgacagaagtggactcccatgggagggtacttctgagttctgagtcttgcctccgccgcggcgccggcgaccaatgtagagctctaggtgcaaatccatggcagcacttaagatatggtgtcttgctacgaggtataggtaggtggccgccgcatgaacggagacagtagctgtcgggcgagtagtgggccgaagtccgcgtcagagaggaggtcctgcaggtcgagaatccgatttctcttctccatggccggcggcggccgctaccacgaacctccagctccaggtcatccgccgccccgcccacgaatgttgaaagggatttccgccgacccaaagatccccagtcaagcgggagtgccaagagtttgtgggccgtctgttgtcccacatgtcagacgctggctaacttatcaccggtggtcgttactccatttaacagaccgggcccacccactccacttgcactagcagcaggtacaccaatcgcttcgtccccgcgtctcgccgcgtaggcgccacagaaactcgcacgccgctccccgccgtccggcccgagtcgccgtcgccgccgaatccaatcc

SEQ ID NO: 10858 - DNA, 882 bp, Zea mays
agcaaaattaaatacatatataggagtaagatatttgaggatctgacaaaaaaatacttagaaaaatctgtagcaaaaaaaaaacgtgcttaatatgaatctttgatatataaaggatgagatatagaaaatatttatagacgattgagacatagagtgtaactttttttagaagaatttataaaaaaacccgatatatatgagaggtatagaataacaatagaaagcagggaaatagttcttttgcgtcgacggtcgatcttttgggaattttgcctggtaatcccagcctcggaggctcggagccctccatatgccgccttccccactcgggatcttctgtagccgcaggctcgactacagagtttagttccacaagctacaaaattcggctcgccattggcttgcaaggtggagaagtgagccgtggacgctgccccccacttctcatcgccctctttttaatttgcgacgatctttggggtggtgagcggaggaggatttctaactggatggtgaagttgtcaggtgaaaaggacgggcgcgacgaatccgaccatcgatccaacgccgagcgcgcgttggaggagggacctgccaggccccacctgcagtgagagactatagatagatgccttcctctctcgatcacctgatggctgatgccttcgccgccgtcttcgcctgccgctgccgctgctactactagttgccttgctcgcttccccccctctcgccccagccgcttccgccctctcccttccgtttccttcccaactcccaattcccaaccctggatccaaatcccaagctatcccggaaccgatacggaggggcgcaagcaattattagctggctagcccggcctgtagctccgagatc

SEQ ID NO: 10859 - DNA, 545 bp, Zea mays
gcaattgtcatgaagcatatcaacgcaatcatctatcctctcttccttctcttttgtcgatcgaccgtgctgtgcttattaatgtccttttgttgctatatatgctgcagtgctgcatacatatacagctagccagctactagctagcttcttgcattgttccaggtcgccctgccgcagctgcaagttcaggaatgaaaaaccattgcatggcatggcattgcgcgatatgtggtccgtctccgtgtttggaagcatcatatcagcaccagcagcgctagcacacgccggccgtaccgtacgtcgtcggaaactaataaagggccaggggcgggatcgatatgcctggctccctgtatgccactcgcatggctgccaactcatcatgcatacactgctagctagtcgttggctccactgcggatggcgtgcgtggagccaagcatgaccgatcatctcctcctcccgttttgtttagtactaacagtacgtaatcgtcgttcatctgatgaccaacaagttcagagttcaagacatctctacat

SEQ ID NO: 10860 - DNA, 801 bp, Zea mays
ggaacgcgaggggagaccaggcgcgggaagggcgggaggactgtgaagagcgcgaggagggcagcggcggcggcggcggcgctgatgctgatgctggtgcaggggctgatgagccggattcccgttcggcgtggccgcgtggggagcaagcagaagtgcagaactgcacaaggagagggcccacataaccatttctatgatattgcgcgtgtctcagtgtatcggcccagtttttcatgggctgacccggttatgtggccttgttagttttcgcctaatttcaaataacagcaatttcttagtggcccgtacactctgcagcagtgcggtgcgggcgtgcggcctccctttttttctccagttcctccggcggcggcgtgcttggcggtgcgccaggtgcccagatctccaccatcttagtcgccggcgacgagcatcaccaggtacgcccaatccttgtctctcgttcctgccttgcgaaacggagcacccaaaccctagcatgtattgggagaatctaatccagttacgagtcttgcatacttaacttggttgcccctgccggcgacttcttaatttcttatggagtatagatggcttgtgtggtgtattcttgtatacttcaatccttcagccaccctcgatgtctgctaccagaattttaatatgcattatgtttttatttatttaaaaaaatccgtgtaccttctttggggaaaaaatgccgtaccgacttatctgtatgactatataggcgcgataccgacacgcgtgtccttatgtgtgctgcataggttcccg

SEQ ID NO: 10861 - DNA, 1297 bp, Zea mays
attaattagacgaaaggacacctatctttcttaataaaagcaacacaaaattttgtagtttatgaatagtattgtttaactctagtaaaagttttagcttaataagataataaatgaatcagagacaaaactcttaagttatttttgtgtagtttttttatttttagtaattaaatggcttctagaaatgttatagaaaattacagctaacataatatctaattatcgatttgtgtaaaattgtataaaattttgatggtagtagaaaaaacagaattaaaaaaagacaaaatagttccatttaaacaagtgtcatgtcatcataacagttaactaaaattatttggaggttatttgtccgcttttataaagtttagggctagtttgggaaaaccattttctcaagtgattttcattttatcaagtgaaaatgaactgatttctcttgggaaaataaaatctcttgggtaaatggggttctcaaactagctcttagatggttaaacatctggttttaaaagtgagagggtgaagtagagcatgctctgaaggctagagattacgtatactttctgaacgaagaggcgcccgctgtcgagagtctaagcaaacccacctgactacttcagtacctgactacgaatccaaataggcctaggtctttaagcccacctggcgttcctgttcttcatccggcggagccgcggaggccacaagcgcctgctggcccacgaaagtgccctagttcttcttcttcattcctgtcggcggtgaaggcccatctgttttgctggcccacatcgtgcggcagccctggctggtcttccgtcttcctcgaaaccctgacgcggccgccacgccatgctcgccgcaagtcccctgcgccaagtgccgccgccgggcatcccatccacctcccgtcctactccctgaaggcatgaacccccgttccaagcgccctataccgccgccatctcccgttcccctttcctttgttctctttcgtctgctgggcaaaccaacgccgccagccactggtcgatcacttccagccaaggagtggcggacgcgcaggggcttggagtgtggcggacaggcggatcctgtagcggcagagacaggtacggacgagagaggtgagttctccgcacgatcggctgggacaggggaacgacgcgcgcaactgtgtggcctgggggggcattaaacgcttaaacggcgatcaatcgtcgcttaatcgattgctgtcgggtactcctggcactcagaagaggttgaactaagatagggatattca

SEQ ID NO: 10862 - DNA, 135 bp, Zea mays
gctttcgtaagggggccgagagccgccatcgtcagggaacgtgcggggcgccatcatcgcctatctagcggagcgagccagatgggacaccggtcttgttccccgtagcctgagtcagcttggagtagggtaatg

SEQ ID NO: 10863 - DNA, 1197 bp, Zea mays
gatcgtccctccccaccgtacaacttgcagcgtgctgtcgtgcgtcagtctccgcgacggcccgtgatctgccgaggatgcgccacacgcgcagttcggacgagggacgggtgacgaggtgtgcggtgcgcgtgagtgaggaggcaaggcttctccatctggcaaccggggaccggacgatcaactcatccgcgcgactccgcttcgtcacgcggcgtcgccggcctcctcccgtgcccgtggatgcgtgcgtccctctccctctccctctcgtactgttcccacgctttttagtcactcgcacggttcaggatcttggcgtcctgcttcgtggccgtggtgattgccattttgattgggaggaggtgcgcgcgatctgcctggtttgatttggatccggtctgatctgacgtgggtatgggtcggttgctgctgcgtcagagagagtggcttgtcgcggcgcggaagggggaacgagcttgcagtcccagtcctggccgggggacggtagccactagcaagcgagtgcgcgtctgcctcggagcgacgtctcgctcgcctttcccccctttcctgcatcctgtgcgctgtgaggaatgacggtctccgcactcactcctccaacggtcgccatccccgaaccacatggattattgtggtgagcgattggactctcttgttctctttggtttgttttcgtggtgggcgagcaaggtgagcagctggcggtgggaaatcaccgggccttttttttatgcttctcccgtgtccgggctcgtcgttgattgattcactgctcttgcttggcggctgaggggctctgatcggcgcatcgggttggagcagtcgaccttgggagatttcgtgtcgctctggaagggatcaaatgcggcgcctacttacttggtggtctggcactggctggagagctctagtgtcagccagtgttcctgctgtcgcctgcctcatctaggtcccctcccttcgttaagctgttcttgcgagttgttaatctaccgtatcgagggggggggggggggggggtccattgcggcgcctacttacttggtggtctggcactggctggagagctctagtgtcagccagtgttcctgctgtctcctgcctcatctaggtcccctcccttcgttcagctgttcttgcgagttgttaatctaccgtatcgaggaggggaag

SEQ ID NO: 10864 - DNA, 1500 bp, Zea mays
acagatctctgcagataaaaaaaaacatgtacatgtacacacgttatttgatatatactgaacatgtgacattatttttcaagaaaataagagagaaaagagccagtacacatgcatataaatatacagcttaggctgtaagctaatctatcggtaacgcatccctgatttaccgagccatacatgcggagtaaaatgcatctggtatatttcctttcttataatgcgcagtcaaattacgaagattcacgctggagaataggtgagcccagatcgagcagggattagagaacggaatcagggttatgtaatgtaagttcgatgtgcctggcccaaggcttgtttcttcaagtttacagaatcataatttgtgttcaacaacaacattttcttcggttcagaaagtttttgggatttgcctggtacaatgccttgacatcatgacaggggaaaaaataatcaagaggaaccgacttctgagagtactgtaggggatacagaacatacgttttaattaatctaataaattagcggaacgacatttacttttcgtgagcaaggatcgcccgacgatgaggcaggtggagaagcatatgtgcggcgaaggaatatgatatgacggatgaatcggaggagggttattactacactggactggagcgaatgactttttctgttggggaggaaaacagcgtgcatgcaaccaccacctgcatccgaacttacttcacagacgattttggaggtcaaggaaaaaaactcaacaaccttctagatacccattgaaaaaaaattagatctatgggcagacagggaggaagagaagagggggtggacagggaagtgaggaagcggagggggagatgtgagagttaacttcagggctagtttatttaataaagaagagattttcatggccaattctggaggctcccaaactagctctcagtgaataaaaaattatcgctaccaacttgtatttggagctagcaacgaagattttcatggccagatcctcttgttggaagcgrcatgatttagaaccgacggtgcatccaaaacaaaacgacggtgcatccagaataacgccgctaccactggcagcagtaagaacatggtcattgaccccgtgacaaagcacaagaagcacaagaaaatgttcatgcctacttttttttcctgcacacaggtgagatcagaaaaccacggcatttgcatagggggcgaggaatgcttctcttgctggaatggaaaattccagtgctgcatcatacatctcgataacataaaggattcaaaaaactgcaagcagcaaaggttctcaccagacattccctataattggttcttttctcaaacaatcctacaattgtttctgacagggagaatgattatcagatataaaattatcatcagtttcactgccctcccacacgtaacagtggagtccatcttgaggcttcagccagtccagtttcatattgctatcctaaccctaca

SEQ ID NO: 10865 - DNA, 337 bp, Zea mays
ctaaaaccactattatttggacaaaggaagtaaataacaagatattttgaatagaaaacagcctcttgctcttgttcggtttgtaagggatagaaagggttggcgattaagtctctttcagtcaaaaaaaaggaaggatttttaatcccttaattccctctaatcactgtacaaatctctctaatccccttgctgcaaacaacaagaccgtaggtatttctgctggctcgctgatggaaacagtggaaacgcaggtcaactagtcttacaccacaggagagcaaccgtttagagacttcgggtaagacacgagcccaataccacggccctgccagcg

SEQ ID NO: 10866 - DNA, 563 bp, Zea mays
tggcccatcgtccatggacatggaccagaggccctcacgctcacgccttcctagcacgctggcattggtagtactacaaaaacaggcgtcgtttttctttgcctccctcyccaccttgtctggctcccttcttcgctctccatgagctgagcaaggctgggcagcaacacggcgacggagaaaaatctcttccctggctcagagattccccccacaagaccacggcatttccccttgctactgagcaaacatcgcagccttttctttttgcgatttttcttcacatttttgtagacaccaacacccatcccttcagtgttctgaatataaataaatacagtagattcatccagcagaaaatacagaactctcggtttgttctgatcactcggttccatctcccaaagcgaccccgccgccagtagatccatccggcaagaactcggttctgctccgtccttctgccgtgcagaaacgatcccgccgccttcagtagcggtagcagaaagccctatcaagcgagtgaagactcagcagcaggcaaagaggtcgagtctccagcg

SEQ ID NO: 10867 - DNA, 82 bp, Zea mays
ttgcatgcctgcagcatgtggcagcatgattttattttgaccaacctgtggcttcttctcttatatccaggacgccgggcct

SEQ ID NO: 10868 - DNA, 249 bp, Zea mays
tgattagtggtacttgatcagagatattgtggtacaggtggttatgagattgatggttctggttatggttatggtgctggtaagtggtattctttccgtttggaaaggatacattgggttaataacttgggttaatgctaaaacttggctttctactagtaagtaataacctgaccaactaaaagcaactgcttgacttatccccacataaagctagtccactacagccaaacaggatacttgctgagt

SEQ ID NO: 10869 - DNA, 1500 bp, Zea mays
tctgccctgcctgtgcctggtacgtacgtgtctgcgccgcctgtgaatggccaatttatgtgctcgtttgtgctgatcgaggacgtttgcagtggcacaggatcacccgtgcctgaggttcctgctggtggaccaccttgtggagcatcctggttgtggttgggaggaggaaacgacaagtgcatccagagaacccagccaccttatcctttgttgtggagcatgctggttgctcgtcgactagtcctattaggtcatgtgcagtgaatgtcttcaactgcgccttattacacggtatttagagggtgagatgtctattagctctatgctcggaataaaatacattgataattgatacattgaatttattcaatactataattggtgcaatgattatagcaacacacatgttttagatacatatccaatgtatcacactatatcttagtgtgtccttgtgcttcgagtaccgtggttattatacatacccttagtccattcacactgctagattttatattgtatttctaagatgctacataatcaagaaagaaagaaaatcttggttgaaacagtctctcatagtgaagagtttcattcgacacggtttcataggtaacatgtaaaagacaatatgtctagataactgtgtatacatggtttcatctccatgaagcccatttaatctctttcttcattaaatacttgacacatcatctaaactgctgacatggcacaccattaataagaacgaagcccctatgaaactgaccatagaaaatggcattagcatctaaggtgcacaaaatagtctttatgtcgtcttaggtagcccacaatgaggggtgcaactttcttctgttagactgtatctttccaaactcattttgacagtaagtgtacattcagtgaatatgtgatacattatttcaaggtttcagaagcacaactgatggaaatagttatttggatagctccatagttaattggtgtactttgttgtttataaaaccaaaaattacaatgttcgagagggttaagttccaatagaattttttgggttccatccttattagaataggtaggtttgacgtcacgactcttctcgtttattagagtttgggayggttgagcaatatatgcgtagttcttcacattcgtctaaatttataatgttttctagactaaactaactattgaaatatgacacatacacaattatcatttactgatgttatagagataagtttctctcttcttttggtttgagagatccaaagggattaagatactccatttgctctaattttggcagttcctcacactcgtcatgctttcacgaatcattcacgaggctggaagcgtcagtgccgttggatttgagaagatcacgagaccaacgggcaacggcggacgagaaaccgccattcggatagcacgggcgcacctgccgaccggcgaaacccagccgcatactcgcgcccattctcgccgcgcacg

SEQ ID NO: 10870 - DNA, 1500 bp, Zea mays
cgtctatttcgacaacgcaaactgtgaaacgcggacgacgtcgatcagtttcgtcagatacgcgcccggccatggccatggccatgccatgcacacgtctccgtcatcgaataaccgctctcgatccatcgacgtacgtatacgtcgtccatgcatgaactggacctgctggacggacgacacacaagtgcgtgcggcggcaggccgggcccggctggccggcgcgcggcacacgtgcatcgtcgtttccgccatatattgtgacagctagcgcgcggcattatatctaaacagaggccggtcagaagagtcgtcgtggtcgtcgtcgatggatcgactcgtcgcgtcggaccagcagaagctagccaatggcagcatcagcatgcacgtatcatcggatcgacgacgggaacgtatggtaccagcaggacgtatagctttatgctcctgtggatggtgtgtggtgcggtacgtgtgggataaggtccgctttgctgccgtcccggtcctgtccctgccccagctgctagctgctgctgtccctgcgattttgaccgtggaatctctctcggtcgcggcgcacacacacacacggatcatcacatgcaagccatggctgcgccgctgcatatccttgcatgcatgctgcaggcaatggatggaatggggtcgcgcgcggccgtccaggagctggagagctcagctgagccgaagccgagcgagcgaggagtcgtcaaggggaagcctctctgcctgcctttctttcacagcggattcggatcgtcccctgtctgtccctgtctgcctttctttcttacaagctaaggaatggagtgcctgccttctcttctctcccgtatatatgtttcacatccattatatattatataatataaataacgcaaggcctcctccactaaccaccaaaacaaacaaacaaaaaataaaggggccgggaagctaaggcaaatgaacaagctagctagccccgcatccggcctcctttaattttattccactcgctcgcttttgccatccgcccggcgcgcgggatcccatctctttcttctcctagctagctttagtttccccggcccccttcttcttcctctctatccctagtggcactagcgcagagaggcccttatctcctctccgtctcttcgttccgcttcgccgtcatgcattccattccagtggtcgctcgcggcatgcagcagcctgctagcgtagagagcgagagcgagagcgagagggctcgccgctagtggatgttattctccgatccacctttaccatcgatgatgcacccctccctagctcgcccccatccttgcatgatccgatcccctaaagcgcctatatacccttatcttgcaaactaaagcaagcaggagagagctgggcgactgcgaggaggaacaaacaaacaaaccaaccagaaaagaagctctctcacacaagtagtagcaaaagatcaaaagaaatcaattctatacc

SEQ ID NO: 10871 - DNA, 1500 bp, Zea mays
ctttggctggaagaagggcgcacgtcgctgtctctgatgagcaggctttagttggatcaaggtcgctgttgctcggtttatatggtccagtctaaatccgtctactgcttctatgcccaaaaaaagatcgatccactctctcgtaggatttgtttttgggaaggaaaaaaaaacaattcatatgccttgagtggaaaaaaatcgaaatggaaatgaaaggcttgctaattatcaaaggacattagctaagctctgcacatcactctaagtctttacccctactagtactacctaaggtattaaaaaaggagaataaaaaccaaaaggaaaaaaagaagaagaagaaaacttgtggccagggatgctttggcagcgtaacgttaacgacggccacaagttggggtggggtgggtggtgtgggccccgccgcaggatctttctgggcctcgaagctggccgcgtgacgtggcgccgaaaaagcgcagcgagaaatacttgtggccacgctttttgcggccacggatattcttcttttctttccctgcacaagcacagcacagcacggtgcacttcctatattattttacttttctgttacaaaaaaagagaggaaatgctcttggaatttcttgtggacacgacacagctaggaatttatccttctttcttgttcgtttcctttttcttatctagtaacgagaaaacggtccgggtttatccgcggaaaaaatatctgctatttgaacggccgcagatatttgcggtgttttctcttttattttctctacgctgcttcgtgccctattgtcaacacgtggaaaccttcctatccactccaatcacttcactccacttctcaaattttcagaacaaacttctaaatttataatgaggctcaatgaaatatttaatttcgatacaatgctatagataaacaaaaccaccctgagaaaatggggaaaaaaaagagaaagagaccctctatctcaaaagggaaaacagaggggtcagaacgtaaaatatccgcagagggcggaggtgggccctcccctcccggggcctccccagccactcgatccctggcccttctcgaaatttccagccctgacaggcggggcccacggccgacgtggcccgcctcccctyccctcccttcgcccccagaaatctcgccgctcccacccctctccttcctctcgccatttccatttccttgcccttgccagccagagcgagactccaccgcttcctctccgccgcgtcctcctcccctccctccgttcctcacggctctccggactcgccccgcggctggccgtgctgagtttcgttctctggccggcaaagaagcgatttttttgtgctttctggacggatcccggccggagaagggaccgaatttccacgacctcgaccgccggctgctcctctgctgggctctccgtgcgcaagaagagcctaccaaggtgaatccggagatttgagctccgggcccgcctc

SEQ ID NO: 10872 - DNA, 61 bp, Zea mays
gaagtgcggagaaggttctacaagaactggtgcaagagcaagaagaaggctttctccaagt

SEQ ID NO: 10873 - DNA, 61 bp, Zea mays
accgtgacccgaccacgaccagccatggcgaggagtctgatgacgataggatgtgattgtg

SEQ ID NO: 10874 - DNA, 1411 bp, Zea mays
taccgtcgccttacaaattgtactgtgagtacmktwctactactcttcttktagttgtagttagcccttttactcctgaaatctttagaatcagttaggttagccacaggttcgtgttgtaaagattctgccgaaaaccaaaagagcgtggcggatatgacgtttcctggagtattcaaaaccgcagccgaacgtacccaaaacaaattgaggacgacgaatatggtccaggcgacacgagcgtccggacaaaccgacatccaagtaatttagagcatgcccgcttttttttatcggacggtgcattggtgtggcgcgacccaaggcgacgagcggcaatcacgcgccgcctgcctgtgcgtcgcgcctggcgtcggaacacgcgccgctaggagtcgattcccgtccacgtcactgggccgtggacgggacggcccgggccgggctgctcgaaccaccaggcacgttacgctacgcctgcggaatggacttctgtttggtccgtttgtgttagcatacagtattaggatattgacgagaagagcggttggctcaacatccaactgacgataggggctggtgctggtcgcaggacacggatgatcagttttttttaccagctctgcccttcttcctccggatcaggaggaattcaggatgtgctttgccgacgtgctcgctggcgctcagacagtcaaacggacttcccacaccagaaccgtcacgatcgatagtggcatcatcatcgatctcagccaaagacacacaccccaaaaaaaacatccatcccacgccacaactatcgcgaattcgcgattgatggcgacggcgatgcttaacgtgtcgaactgatcagaatcgccgctgcccgtcagcgcggcgccgtggtggatgggttgcctgctttaacgagggggtgctgctagctgctttatggccgcatggtcctggcagacgtttcccctcctcgagatgtttgcaaattggcctagcggttgctgtcttggtgcgggctcaagcttcgatttggatcctcgagcggtggactttaacggccaaccgtcatggacaagaggatgtgatcagcacgcctttgttgacaatttcgagagtgcagtgtaccttgtctttgtcctgttcgcctctggcttttaacgatcagtgtttgttgccatgagaagcttttttgcagtagataagttcggagctttggtggctgcaacttgcaagccgaatcacctttggcgctccgaacaaattgggaccctctgagattgccgaatttttttaatagcattatattacagcctgttgccagtgtaaagtcagaacgtcatgtcaccagggggaaaaaaactgatctttgcaggtgaccttcctcaagtgcggcggcgtggccgtgggcacgggc

SEQ ID NO: 10875 - DNA, 81 bp, Zea mays
ggagtattccatgtgccttgtcagttttgatgttctcgccatggagtatttctaaaaatattgtgttcatttagggactag

SEQ ID NO: 10876 - DNA, 1500 bp, Zea mays
ttggcccgacacgaggggcatagcttggcctaacacgaggggcaccagtaagctcggcacagttcagtatcgtgtcgggccggcccagcctatgggcgttagagaccaggcccgtcacgggttattcttacacgggcctgtcgtgccggatcagacccgtaaacaaaaaaactccaaaattcagaatttaaaggtattattcaaatttattttagatttagttaattatatttataattttagatacatatttagacaaagaatttcagatacacatataaacacatatcacaactcagaatgctctcatataataacatattataagtattatagctaaaaatagactgttcgttacaaaatcagtccctcaaacgggccgttaccgtgcctaccaattaaccgtgccgggcccgtgcctgcaccgcgggcccgacggtcagcccaagcccggcacggctattggaccgggccggcccgggtacgcctctagtcgggccgggccgtgctcgtgccgggccacgaccgtgccggatcacgggcccactgccgggccggcccgtttggacatgtataacccgtattgctgctggtgacgcacttgcacagttgcacggagcttctaccctactacgactcgttttgccgggctcaataccagccgtcggatgcttcatccgacgtctccccgccacctagttccggcctaacgaaaaatgcctacgccctacctagcctagacctaggcgcaccctgcaaggctgcagctccgtctcctcccagcagcagtagcacaggcacaggcaggcacagcgctgcactgcactggacgacgctgacatgaggacacaccctccagtctccagaaggaaaattccctggccctggcactgcccgacctctgctctgctcggttcggccgtcagtaacacccaggaattcacagttccattccgagagattgtttgcgtgcagagggttaaaaatggcagcacggcagagcccgcagcgcagttactggtaccggcagcggcagcttcccttcccccgcaggctgcagcagcatcaacatgggttgctcgccccccgcagttaattcctccctcccctgcgcctccaattgcatgcctggcctgggacgacggtggggccagcgcgccattagcgcaacccaagcaagcttccaagatcattcatcgcctagattagtaccggcatttaacactccccccgccgctttttttaaacttgccgaacttccctccaaagttgccgcgcgcctttccggaagaggccgggagagcttctttcttcttcctcgccctcgatcttctccttcctctcctataaatacgtggcgttacgcatgcatgcaggagcaaagcagcaacggggcgtggcgtggcgtggccaagaattcgaattcctcggcgggcggcaggcacgcgcatagcgcctatagcttagcttgcttgcttgtttgttccatcgctttttcca

SEQ ID NO: 10877 - DNA, 1108 bp, Zea mays
tgcctgcaggtcaaccggtcgaacgcgctgacatttcacggcgggcggacgcgcgcacgctcgatcgcctggccccggggcgccagccagcgggagggagagagagaggacaaaggcgacgacttttgcggcgcctccacctccctgtgcgtctgtagcgccgcggcacgagggacgtcgggtagccaactttcggggttccctttttggaagcggcgtgctagacaagctgcaagcaaggtcgcgaggtgaatgtgggggatccaatgctggtaggcggcgcgtcgtcgatcgggtgaagtgtgaggtgaggactgagggaggagggcggtggccatggcgtggaagcttctcccttgtgtgctccctcccgttcggaaaggcggcgagaggcccacgaccacgacgacgagtcgaggcggaaaaaggcaggcggaggagggcagaggaaggaagagagcatgcgcaagcaaagccaagcccggaaaggaaccgcacccgaccgtaccttgggaaccgaggccgatagatagggcactgaactcaaccatcgggtccgagagacgttgttgcccttggccactgctcttgaccgagatgcagtatactactcctactaccactccgatagcacttggtacagtagtggagcacagcaagactactcatctgtgtaaatgcaagcttcagattgaaattattcaccgtttttttttaaaaaaaagcagccttgtaggagcacagcaagactactccaatccaaatccaaaaagagagacaaaaaaaaaatgaataggaagagacgggcacgggcagggcagttgagtttgggcggagttcaattgatagagtccagcttacgccaccgccgctacccctataaaacggcggagccgacggccccttcttttcctctcctccataaccacgagccaagcgcgacggatcccaatccatcttctcctcatccccaccacgaccaaaaaaaaatccggtcgccgatgccgtctgctgcctgacatcggtcagccagggtagatcgcgcaggcaggcaggcagccccacacacatacgaaacccaatcctgcttcgatcccgtcggccggcg

SEQ ID NO: 10878 - DNA, 1011 bp, Zea mays
catcaacatgcacaaatttcgccggctcgctaccgtcactcgcatgcacaatcgggcgggtgggcggtcgccgccggttgcctacgaagtcctacctccggtgctcactaatcactatcgaccatgtaaggcccgcctacaaaatgcagtagttgtttaaactttagttgtgttttgtttttagggactaatttgtagtctctttatttttattctatttgagactagcaatttagggactaaaaggtaaaaattactcactagaatccaaacaccccctttcttacctgaagcttacagtttaaaataactaattagtttgccgccggttataggaggagttgtttggtttaaaaagctcgaggccccaacccgagccccatcaaaatccaacacactcgatgttgcccggctcagacaaccttttgcagcagctctcactcaaacgaccatatataactgtaatgcatataaagaagacacggacttaaaggtgatggatcctatgcttggactttggcgggaccaaggttatatatgccacagttggcagttgcttgatcctcagctttaatatagagatatacactagttttctcaaatatggcgtttagttccattttgaactatatatttttttcctaaattttgtacttgtgtatataaaaacaagtgagtactctctccttctccagctcaaaaaaaatattcatcttgcatatccaacgcacgcagagagtgcgctctctggcacgtgtcagcgccccattggcagtggcgcaatcctgaatggaggccgcggcccgcgagcgattcacgcggccacatggcgctcacacactggccatcaacttatccagtcagataaggtgggctggcgcctggaactgcgatgcgagcgacatatatttttttgccacgctgccactcgggcacgagcacgagactgctcggccgacgaaataataaagcgcgcgcgcgcacgcggagaggctcggagagctgagtgag

SEQ ID NO: 10879 - DNA, 1414 bp, Zea mays
caacatgttacatgcctagtagggtgaaattattgtttttttagctttcaacaaatcctacggttctcgtaacaaacctcttgctccataaatccaacttctaccaaaaaaactaaagtctccagaccatgcaacaagtccaagttattagttcccgaaaacatcatactatcgttgttccaatttatgattcatttgacttttttatttaagtttggccgactcgtcttattcaaaattttataactattattaattttttactagtatatcaaatagcatatgatatattttgatttttttttgcagaaaaataaataagacgagtcgatcaaacttaataaaaaacaaatgaattataaatcaggacaggaacaatatataaattgtagcaatgaaaagttactgaaatacaaattattaatggatagawttccaaatataacattatcctttagatatttcaaatgttggctcttatcactgttattggataatttcggtttttatcaatccatttttaccggaagtttttatcaatcttctgctcatctaggacttcattttgtttgatatgtatcatgtgtatgtaaaatattgtggtattataaatacaaaatagccagactttgtaaggtatttattatacataccaaatttttttactccttagtaattttaagtagccatcctttaaatcatcgcccgccactgcatggcgcatgcactcctatcctgggctgggcccaacacgttggggtcccctggtcagtaaagattttcttctctccatatttcagtttgacaatttatacgcaataaagtttggtcgccttgtaccctgataaaaaagagcgaaaaatcaggtcaggcacgggccttagttttagtcaatgggccggcccaagtaaaaaagaaatgtagttttctcatgaaatgagttggaagtaaacaaaaaggcaaaaacgatggcaaagatgtacagggtcctttcaaatcacagtgagctgagaggtcaccatcgtctgttcttcattcgtacaagttggaaatctgaacccatggacatgcatggaccggaagtgtgacaaaatcacaaaagtatggcccagaaaagatcggaccgtgccatgcatcgttttgtctccgtacggtacggtaaacgcgcaatcttccgagggacacagaacttgcttggattggagctgcaagaaatgaacaacgactatataactcagcacatgtccaacacacatgtaggtgcaaaaagttcgtggtcccgtcgtcttrccacgccgtcgcgaaccaacattacaagaaaaaaggcaaagagtgtcggcaaaaaatcacactcttaaacttagtacactcttaaacttactgatactcctttaaagttttcttgtagtgcaag

SEQ ID NO: 10880 - DNA, 938 bp, Zea mays
tccgcaatgcagtttttatttacggtgctattggagtatggactttgtttttggtactaagatttttagagagattataatccacacgtattgaaagattaatttttagaagttgttggagaggctctcttcatcattttgcttgccattagtttggtggtgcgataagttttagaatcctaggcccacaattcgactgggcccagctccccttccctcgcagaaccttctcctttttcaatctacggacgagaagcgagctcaacacacacctcccttgaccacgacaggtcgaccccagaaagcgaggcagctagagatgaaaacaactacttacttagatagtaatttttggtcttttttggattatgaataaataggatataaaatctactatataaatttaaatttttatttttaacattgagctcgtaaagttttataaaaagtaaacctcaaattttatcacatatcttatcgaataatagatataaaattcgggataattcagatatggatacggataattttttcacttttttattgtagagagaaaataatatataattaatttatacaaatttttagacttatctataataatgtgtatgataacacaataaaatattagcatccaattatatatatatttatttatatatatatctactttaaaacattagatttgtcctaatacccgttttgcagccctgtcctcccccgccctctgcccgctactggcgtcgaaactgtaggtgagctcccctccaatcaccgcctccgctgttacgagtcctgtaaccctagattgcagcgcccccaggtcctctcgccctcggaaggtcgaaaccctaggccaccgtccactgccatgcgcccgctcgattgtccggatttatgattcttcgcctatcttgcagaatcggggaaaaccacga

SEQ ID NO: 10881 - DNA, 556 bp, Zea mays
cttgtcttctccctcgactcattgcgctgcagctaatatcatatcactgcttatgtggcaccatctacacgtagtagcgcgtggactccgttccggccaaaaaaaatcctgcgtcgtcaagcaggaatcgatgaccacagagaccggccaaaaaaaaaaaaaaaccaaacgtgttattgctgcacctaaggaaacgcggccgaggacgagagtgggccagcggggtcgaggaggtaaagaaaactaatggcagcgaaggagggaggcagtggggaaggtgggaagcggctgcccaaagccacctccaccaccaggccttcttctacccccatcccaacgcccaggccacaccagcgcagcgagctctctcctcgtagcggagtcccagcccctcacgccctcccgatcgcgctcgtcggcgcccttgtcgactcgagcccgcttctgggccgatcgacagcgagagcgagagcagcggcgcgccgaggagagctctttcggtgctgctgtataacgacgacgacagcaggcggcagataacacataaaggcgcgcg

SEQ ID NO: 10882 - DNA, 904 bp, Zea mays
aatcgatcgatgtgttcacatcgtcgccatcagactcgtggccttcgctggcccaaatgtagtcactgccgctcgtcgatccgttctgcctgcttttgtgctttcttcgctcgctaggaactcgatgaaaaggcctcgcgttgttgatatcgtcatcgacccccatgccttctaagggtggtacaacatgggcaactctctggtcatgattgtcatgggcaccattcctcttgcttgagtgtcttcttcggccatcaggtgcttggtttgccatcttttcctccattccagcatattcatcagcatgtgcaggtggtcttggaaccctacttctcacggagacaggatcatagattggttcacgcttctggtaaattgtttcttcggtgccactctgcttgtggccatttgcgccttgatttgcatgtttttcaaaatttggcttaacataaggaggacgcatattggttgccttctctggcacaggctgcctgtcttcagcaaccttctcgcccattggtgctctgtagggcttagaataaggaggaggcttgttcactgctttaccattcaaggtggaaattggatcaatttcttgtttttctatgcccagagttttaagccccaggtcagcatgaccccaactacgatcggggccaccggaaggtttcatcgcaccaacatcctgttttttcaagccattgatgtctaacacctccacatccatcagttccctccgacggtcactatcctttttgccagatttcttcatttctttctgaccattcttttctttcatgtccaaaggaggcaaaggattatccacgtgccttctctcactaggtttatcagagtagttctttctgtttttttcacctaactggccaatgccatcaggaacgac

SEQ ID NO: 10883 - DNA, 228 bp, Zea mays
ccgatcacagcggagcagatccaccggtggcagcaggcgcgagacgaaacggtgcgctctgccgcgtgattgtcgtaggcgggttactccatcgtctgctccgccaaccaggaaattgcaccgcgaatagagcccggctcacgatgatgtggggaaccgaacgaccccggcagccgggaactatcgccgatcctaagcgctcttcggcaataacgccggagaacaata

SEQ ID NO: 10884 - DNA, 122 bp, Zea mays
tgtaggttaaatcctttctttgattgcctgcgtctattgctttatagcacatggtagaatgcatatgggccaatgtttcatttactgtcgaattgtcttagttttagtcagctttatgtatt

SEQ ID NO: 10885 - DNA, 235 bp, Zea mays
aatcaaattctcctacgtgtgtgttatgacttggaaatttatctggcatctaggtgaactgccaaatgtgaattgaacacattgtggggacttgaatgtttacctaaattgtgatgtatctatcttgcaggaatcaagaaaaaaactcaccataccacgaagatcaatatgtccatttcagtgtcaacatccccgagtaagcaagcatagccgcctctcaagatggagtacactt

SEQ ID NO: 10886 - DNA, 1085 bp, Zea mays
aagtggcagtgtgcccatgtcgttaattttacttgtaagaaattgatgtgaagggaaaagttaccagagggtatagactatgaaatggtcagaattatgatgatagtagtgtagtgatgattatcttgttgttcagttctggtgttgtttccttctacgagaggctattacaccctccttgctcaaggaggtgctgatgttctttttctagatgatgattaaaccatccatccttgctttgtgctaaaccttgtcatattctctttgcattgaataaatccctcgtatcgtatcctatcatctgtatctacgaatgtactgtgcgtgattcattcataactaaattgctctagaaacggaactgttgcgactgatgtacatgttatctctttggatcaacgatggccaaactgtacaagaacgtgcatgtgtacacatgcacacccgccaaactattctacacaaaacctaacatctttctttagtagaaacatcagacatggccacgagaagctccagatatctcttatgttgttgttgtaagcagctgctgcacaccataccataagcagttcccagcaaggagcttcagccaacttttcataacctctactagattactcaacagtcagtcatatgcaatggcgtcttagacaattgatcgtcggtttccatcacgagagacacatgtataatagctgcatcactcaacagtcagtcatcagccagtcagggatcgagatcctacaaatagcactcagtacctcctattcttagccagctagcgagagagaccaaatcctggcctcacatgagatcgactggttcctgggctccttctctcctccccccgttaagttgcccgtcggaggaggatcctgagcacatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaagg

SEQ ID NO: 10887 - DNA, 1140 bp, Zea mays
gcatgcctgcagcgcaagcctggcaagggaaatgagaattgacacgatgttgggtcaagattgatgtgatatatttaagatatgagatgtattttatttgagaggctaaagtttaatctatattatattttagcataaatttattagacgtgtgtttgaatgtactagagttaataattagttatctaaaaattttgtttataaaattagctagctgacaaataacaagctaactattagctaatttttgctaaaagtagcaaaaagctaaacaatcgtctatattgttagatgtcttcatctaattttagcaactatctattatctctagtctatttaaacaagacctaagcctaattaatttatgattagccaataaatattgtagcatcgtaaagacgaaccataaactaattagatttaatatattcgtcttattgtttagtcattacctatataattagttttgtaattagactatatttaattagggatgttaatagagaattctccgtcgaggaataactttatatcttcattctcatgacagaaaaatttctttatatagatcccacaaatgcttggggaagaaattacttccgatccctatttctcatgggataaacccgttttgcttaaattataatgtacgttatttgttattgatgcaaaacattaatttatacacattgaaagcgtacgagtcatatatccactttaatattaaatttatttttttatagagaggattcatcgtatgggcttgccaatagaccgttgacagttcgtgatttcggcaagaaaagaaaaggaaaaagtttaaaatcagttttctttctgtcacttttctgctgcatggaaacttttttcactcgtccatcgtggccgtcgtcgtctgcagatattcgaaactacgcaatgggatttagcattgtttgactcctggccgggttctgtgggctctcgtccatcgtgcccgtcgtcgtctgcagagattcgaaacgaaagtgagagagcatcgcagaggaaaggaggcacccttcgctggctcgatcgccgctgtgttcacgcggaggaactagatcagcacgcgaaagccaacagcgcagtcgaggaggaagcgagcagtccaggtccagg

SEQ ID NO: 10888 - DNA, 97 bp, Zea mays
attaaaattactgtcatgtcagttacaatactttctcgccaaatgtcatgcaatttgtgctctgtaggagtacagttgtagaagcataaaaggtgaa

SEQ ID NO: 10889 - DNA, 596 bp, Zea mays
gtgataaagtgatgatgtaaataatattatttattggatttacatttagtggaggtcttgatgttgtattaagtctgggtaatttgtttgatgggttattggaggttattatttattggattggatttatatttgatgataaatttagtgaaggttatgagtgtatagtgatttggtcagatgtttttgcaaagtttaaactgctgtacagcttgatggttattttgacgaagccgtatgttggtgtgttctttttttttaaaaaaaatatatctcactgtcatagaagacaaggtacattggcacaaggtagcctagagatttgccggctgctggcccctgcctgctgtgcgcccgtgcgccgcgcctccctgcctgttctaagcaactgcaagcagcaatctgcttaacgcacgtcggcgcctcgccggcgcgacgggcacaacagcccgcctggcatttggcccgtgaccgtgagccacccaccctacgcctttggcaccgcgacatgccttgccggcacaccccatcgaggcgtcgaccatccccgccgccgatcacccaaacttcgcacggcaccccgcccaccttcgccg

SEQ ID NO: 10890 - DNA, 782 bp, Zea mays
tatatatatatatatatatatatatatatatatatatacacgcgcgcgcgcaaaccgtaccgtttaaaatggaaactaaactgaatgtaacgaattcagtgatgaaagctagcgtacctaaccaaaggacccatgctcaaagacattagtgaccttatccacatgagttgacagcgtgcagtgtagtgttgctccaagttgtgaacatgtaggcgttccctgtgcgtaccttcaaccttcaccacgtagaacaggcgcgaaaaagagagagaataccaacaatatatagtattatctaacatttgtctcgaccgtctccgtcgcacctttcaattcggcctactcggacgcgtagccacgcccacgcgcggcgcaaccgccaactagatggcacaacttctggcatccacggccgcagcccgtcgccatcgccctcttcaacactgtacgtccagtcgcggttgcgtcgcgtgtcgcaaatctacttagcgagccgctcgtagcgccacctgcgcagcgcaggctccgacccagccctccccgccagggcgggcaagcaatcactgttaaaaaaccgactggtcctaggggtgtggttagtcggctaattaatccaaccgtcgcgactgacccgcccaccccgctcgggcgcttacaaatacccgcgaaacggcgtgcgcaagcagccgcagggaaagggaaagggaagcgaatcaaagcgcgctcgacaagccttccaagtacagactacagagcagagcagggcagggagacggcgggcg

SEQ ID NO: 10891 - DNA, 889 bp, Zea mays
tgcttgcattgtgctagaggatgcaaatatggatttggtgcggcaagcatagtgaaggatggaaaggagcaactttctaccagggagtacaggagagaatgcatccttatctggtcgttgttgttggatcatgtctaccctgacttgaggatcgcagggaaggagccttttggacccgtcttgcctgtgatcaggattaactcagtcgaggattgcccatcgcgaccaccactccacccaccgcaattgcagcaacctgaaaacacaatttttctggtttccgtcagcatcggcaccaaactgtcagcgtgctgtcagcgtaatctaatgaatctaattcagaaacccatagtgttactaaaagtacaagcatagctagctatcagcgtgctaacaacgctggtgacaaataatctgcaataaaagctaccaggtagctcgtggtccttcagttaggacgaacagtgcatggctgcaaccccacatgcagcaatgcttatgcaggagcatgatatgtgtcctttggtgtgcccacaaatgtccccttatacaaacacacccagtatgtatgatctgtatatttatatctagttagacagtgtttttctctctcctgtatgatacatgttttcttcagttgaattgtctggcagcgaactccgtatttttgtttggtacaacaattggttctgagctgtataggaattgttttctgaacatacccttttacttgttcagatggtgagacacattcttcagaggaatgctggaacccaaacagcctgcctgacacaccacagtcaaaagcgagcagtgaagccaaccagattaaaccagaaaatttggaagttctgatccagaagcttgagcagttgagcaactacaatca

SEQ ID NO: 10892 - DNA, 374 bp, Zea mays
ctttcagacccaaatggagtaggaaatgccagtagaatacaacgaagtgatttgtttttcttggtccaaagacccaggcacctggtggccaccaagagattgggtccctgtgccaatgcgctatcggacttctcgtcttggctttaacctttttcccttttgcaacctttttcgaccaaccttcgtctccagactcgtccaccctataaattgtctcgccagaccattccaatccggcaactcctgctctgcctgagcctgagcgtaggcggctaccagagagaagggtaggcggcgccggcggcgggagcaatagaagagcggtaaatccaagagagatcagagcctcggagggaaacagaagcgcacagagc

SEQ ID NO: 10893 - DNA, 989 bp, Zea mays
tgtccagtccgtccgtccattgcagccagaaatactgccacccgccccagattctcaagtgaaaataaaaaagacgaggtaggcctactgcaactgcaagcacgacaggcaaaagtgcaggcaggcccgtgccgtgctgctcctcggcgttgcggccatggatggaccgcctccacgcagacgcagagccgccgtcctcgatcgtgctaatccaccaggctctagaacggccgtgacggaatcaacatattgattactacttgcccactttggcttttccgggccccaccacttggattaatcgctcctgcctgtttctatctgttaaataatccagcacgagccgagggtgacgaccgcggcgtgacgccaaccaagctccgtggacctgttccacggctgtcgtgtcgcctcatggatagcgaggcggcaaacgtacgcccgtggaacggtccgctcgccctgcaccgggtgcgggtgtccaggcctcccggggccagccgcgcgcgctccatcggttacggcgctgcacaccacgacacgaacgaccacggagaaaggagacgacgacgagtcgacgacccgctcgctttgctcaggcattctcttcgcctcccccgtctttaagctccctccctttatctatcccttccttcgcctatcttcgtctctctccgactctccctcgcccgcgcacctttccgcgccgcctccttcctttcctcgcgtgctctggcgcgcgcaaggatcaaaaggcgccggccactagaggcgagtgagtcgcatgtaaacgaccaccagctgctgtgatctcaaaagggagcgagagacaaaggagaggcgagcaggtcgtggcggcagcaatcgttgcgaatccgcgcgggattctgtcctctgcaccactgcttcccgctttcctgcccggcggaagtggtataattctccaacgcggttgactgtattgcctctcgctctcggtgggtgggggc

SEQ ID NO: 10894 - DNA, 312 bp, Zea mays
ttattagcagcgacgggtgagaaagttgtactaaagcggctgaaaaggaaagcaaacctaccaaggttaccgtccatagggctttatttatggcctccatcaaatgacagctgatggcttgcaccgagacatcgatcgacgatatatacccaccctccactgaaatatccattcatttccatacactactaccattctcccaggcaaggcgaggcagggagctttccaggctccgtcgtcccgatgactgcgcagctataacctcgggggcgcggcagcatgcgtcttaacgaaggataaagacctgctaag

SEQ ID NO: 10895 - DNA, 379 bp, Zea mays
tggatttgactaattcaaggaattcagaactaccatatattgtagtttacattatattattacagtttcatcgactaaaagagcaagcacagattctgaagcatgaaactgagagcgtcgctgaaatttctaatgataatgtcagatctctaatggccttgtttttccccgtgtaacgtagtctggtgggagaatgttgttgccactaattgcgccagccgatgcacccgtttatgtgaacccaaaacagtacgaaggcatcctctgtcgtcgccgtgctcgcgctaaggcggagagcgagaacaggctcaccaaaggcagaaaggtgtgagaagactcttcttgtagctgggtgacccccttgacccttcctactttc

SEQ ID NO: 10896 - DNA, 1500 bp, Zea mays
caaaacaagtgctagattttcctcttctttaaatcttatttatttataggtggtccatcattaaaatgaaattattatgatatcattttgaatgaaaacttacattaattttccctctttaaatcgtatttatttagggtatgtttggttgagctatggctgtaaaaaaagctgttgtargctgtaagctgtagaaaaaagctgttgtggattctgagctattaaaaagctaaaatcaatttattggaaaccactaaaagttattaaaagttgttcgatatatgttttcacagttccatccaaaatccactaaaagcatgtctaggggtgcttttagttttatactgcaaaaagtgagcttttagaaaaagctgcttcctggatccaacccttttgttggcttttagcttttaggggacaaaagccaaagccaaaccaaacacacccttataagcttccatacaattgtcaacaatgtaataattaactttaaatttcaaatattttaacaaaacatgatagtgtattattgtatgctctaaatttcaactattttaaatattctactattgaaagttagacctatttgtttgaacttatatgtaaattctcagcatgaaaaaccaaaaacgcaaacaaatagaagctagctacctagctttttagtgttatatgaaaagttgaaaaatctgattttatggacattctatagctttctatgtttacaaaagtaataatatcattaaaaagctatcgttgttctctaaagatcaaaagtcctacttttcaaaaaaaaaaagaagatctaaaaatgaaagagcctacttttcaaaaaaaaatctctaaaagctacagttaaagcaaaatatccgctatagcaaccactacaaagatgctatcggctatttagtagtaatcatattaaaggctagtttggcaacactatttttctaaagaatctctatttttccaatagaaaataaactaatttttttgagaaaatgagaatccttgaaaaaataaagttgccaagctagccctaaaataaggaaaacgaagaaaacgtaggcacctgtttcttttcatatacagaacgggttggccatgcagacgtgaaatcgtcgtctgtgctgcacggcaaacatgcacatcaaaattacacgcaccacaggatgcaggccatccgtgcagaccatccacaccacaagcactctttacacattataaatacccgcagaaaagaagaggagaaacactactggcctgaagcttctttgcatggaatattacgataactcgtggctgcttcgaggaaatggtacaccgccaatccgtgaatagtaacgatgccttgtgcactaagaacatcccaaacatttacttagtgggcctaagaattccaggaagcccgatgactgcggcagactctgttcctcagcttttgatggcaggtgtctaaggaatgccctaacagcacctgtcaccccgtcttcagattcc

SEQ ID NO: 10897 - DNA, 1500 bp, Zea mays
catggatggctcggggtgagggaggcgaaggtggccaggagaaaagcacactggatcctgctgtggtgcaaaatgaagcccctggtccatggaaatgacatgggtgccccaacacagtatgggtgttttcttgtcctgttggagcccgagaaacatttctcaggggagaaacaatttctacctatcttctttaactgtttttccacgtcagcaaaacatctatatggcaagataatcaatgctatggaaactaccatcgacacttttgggactgtcctaagaagcctcaaactaggccaatatgacaagttcttgtacagaagatttgcaaagaaagaacaaaaactatgaccaacgatccacatatccaactcattatcaaatgccctcgagaactttagctcttgccatacaccatagatggcctcatctctaatgtttaggtgttaagactagggctgtgatgagaccttgatgaacttctcactaaaatgatgtatctttagccaaatgttggttgctgtagtagttttggtaggaaattgcccaattttccatctaccatggcaatgatgagtggggccttgactggtggtaaccgcatgtcatgcggtgtttttggcaagccctggctttgtcgttacccatactagatttgaaagcaaacccctctgcaacagcatggtttacgtattagttaagtttccttaccttgtggagatcctttgtagcaaaaggaaaaaattagttgcctcatatgtttgattttttttgataaatgtattacttttatgtaaatgaaaggcaaatataacaccaaatcagtaagccacatttttttctcctacacttttgtagccatagaagaattacttttgtagtattatgatttctagtgctatccacttgcacatgtttacattattttctatttaacgacatttgaattgtgttttaagggcaattcattttattacgcttgtaattctgtttcacgaatgaacctaacctggtttaactgcagaatgcacgagagggaatgggaagaggaaaagcgaccaagaactgaaacgaaaaggaagcaccgaaaatagctgatcaatgttgacatggattcagttgagcctcataatttttctccaagcacagtagtggatgcacttgaatttcatgctttcgtgttgtgaggaaacatacttcagcatatagctaagcagatcgtttattagtgtactgtgccagttgcgggatgtggcctttcctgtcgagctcaccaatgcgaatttaacagatgggagatgagtcatgtttagcttcatacattttgtgctgtaaacaatgtacaatgtgtcataatgatttgtactgtgaacatagatggatggctcaccatccgggtattatgtattttattactaactgctaagttgtttggtgtaggaagcatcaccatttttttgcattgtgtaggaataatgttagggatgcagcataattgaa

SEQ ID NO: 10898 - DNA, 1500 bp, Zea mays
cttggtaacgaaccctatacctctcttgggccgattggttgtttgtctggtccccttatccaaactatcggcgctggtcctgtcgccccgttctcaatcgattccgaattcctctttcttccattccaagagagttttgccccctccgctgagatggccgacgtggattccttctttgcgtgctcggcgcgctgctgattcggtcagtctactcagtgacccgtgctccgagtggattaggttttcttcctctcgttcgtctcaacgacagattgtgctatcggcacccatacgagctctcagggccctccttgacaagtcccagtgtcctgtgctatgtgctgaattctggccgtctgcagtgactaggtttcctccggctaggtttagggtaggtttcctccggtgctgtgccagagccagaattggtagcctggccgaccgctgcctgttctggtgaagatgtccacaagcatctcagacccattccttttgtgctcatgcataaaggccctactggcttgtgtgtatgttgtggtctattcaagtggtttgtcctgtaccatccttgactgtgacgattcagttccaaacctagccagctaaccgtttcgcgccggaaatgcgttacctacaaccattttacgcacaacaaccatgcatgtatgagctttccatctaggtgatttaaccgttgggacctgtgttgtactcactcagatggttgcattgtgtagcactatctttcatgtgcttccttgttctaatttgtgccatcgatgaccaaacctagtttggttgtcatttgttgcttccaaatctagttccttgtcatgttgccttgttggtttagttactgggttggagggctctagtaagtataacaaatgttgcatcccctgtggctgcattgtgccgagtcgttggtatgtgtgattctgccttgtttgattattctctggggtgcctaagtaaaacatcatacatcagttaccaatgttttcaagtcgtccgattaatcacgattaatcgtcgaagtcggtttggaccaatcacgattaatcgcccaagtcgtccgactaatcgtgattaatcgcgattaatcgccaaagtcggtcagctagaacgaccagcaagttgtccgacttgaaaatattgcaagttacttttgatatgttaaatggattggttgagctattgtatttatagcttggctgataaaattctaattggctgtatctattttttggtgatatcttgtcttggttatttcttccccaggcccactcatgtgggagcaggcagcactaggtctgtccatctccctacaatatttttttgctatggtcacagtggttatgttgtgtacaactgtaccttttcttgttggactttggatgccttttttcagaaaatgttgatagctagatgtttctcctacatctgtataaagctttgtatgaatcttatggtttgtttccttgcacagttaactaaaca

SEQ ID NO: 10899 - DNA, 1475 bp, Zea mays
gtaattgctaggctgacactgaaatgagttttctttgtattcgtctgtttctagagtgcattttgccagcatgtgtgtgtgggtggggcactatgactttcttgggacaatgacaatcacctaagatgattttatgtctacttcgagttgattatttccaaatcaactttggatctattatgggtttaggcaatatggagaacatgacttagactcatcttttaatgggataagaccacaccctctgtacccattaatgccttattcggttaagggtggattgagtgagattgaaggagattaaatcctcccctatttaaatttgaataggagaagatttaattcactctaatcccttcaatccacctctaacggaactggccctaaaggattcaacaactcattgtggccctaaggattcaacaactcattgtatttttgtacatctattacgtaattttatcttccttttccaatcccttgatgttcgtcccatctttttgtgagatccgacaacgctctaaattgttttgttgatctaaggataacctcagacgtgcattcacatccgcaaatagatcttcctgaaaggtgtttttgagattttacggcgatgggcaggttctaaattagtctaaggtcccgtttgtttcatttcattttgaggacttagaaccttactaacagaataggctatttttgtagaatgtgacattccaccacttaacaaggttatcatataagcctatctcaaattcatgggtgagagataaaaattgattctatagatttatatgttattttcccgatgtcacattcttgtacttgcttcgctataacataaatgtaatatataaatatctctctcatatgatttaggataatatacaaatatattacatatataaatatataaatttaattarttttatctaaattataattattaaaataaaattgaattccaaccaaacaaacgagacctaattgatctttaaatcagttttcttatcttgtagttgcttcctataataaaccgtgtacggtcttagttatgctagcacttagctgatttatgatctagggtcatttcgacctcaacaccaacaatattttaaagcaaactatgagagccaagacaatatatatttgaaaattttaactataagactaaaagtttacgtattcgattatttaaagactaaaataaaataaaaaactaaaaactagtccctaaaaatcaaaatattttgagagtatgcaatgcaaagccaacagttttggtaattggtagagtaaatgggtttggggagtttaattaaaatcaatcgtatcgggcaggggctgcaacccaggctgtgcgggcgcggcagggcagcggcggcgacatctgcatctgcatctcccacctcgtctccctcccgcatctgccctgcctcgatcccgccgccagccatctaagggagccgggagcc

SEQ ID NO: 10900 - DNA, 124 bp, Zea mays
tatttattatcacttatggcgggaaaagattgaaatgataactacagtgaatgaaatagattcctcactgtggtttaagaaacccactaagcctacagtaggctcaccttaggatgaccttaag

SEQ ID NO: 10901 - DNA, 1500 bp, Zea mays
ctatattcatacttctttataatcatctaaactttttatctcgaccaaccaggaccatgttatgactccataccaagtttaactattgtttgagcaaatttggtatttatttatttcggcttgaaaaggcatttgaagcatagaaattagtaaatggtccaaaatagggacatctttacatgaattaagtttataacagttagaagaacatttggtgcaccctttttggcaaaaacataaacaaaagttacaaatatagctcaaactgtatagatcaatggtatgaaacgtagtggagatgtgtccatttttgaagcacctgtattcatacttctgtatagtaatctaaactttttatctcaaccaaccaggaacatgttatgactccatgccaagtttcgctattgtttaagcacatttggtatttatttatttatttcggcttgaaaaggcatttgaagcatagaaattagtaaatggtccaaaatagagacataaacaaaagttaaaaatatagctcaaattgtgaaatttggcatttgatctgaaatttggtaattccatatttgttctttccctaatttttcaagttttcccaccaattttgttgtggacccaccgtacagaccctacaaacccatctgctggctgtacatagcggcaatgtgatccctaatcctcgcactctttcctcacgcaacttctcccactactcacgctactacccctgccctaggscacgtccaacagcctcccccaatccgtcctttggcttcgctggcgacggcggaggctggtgaaggcaggaattggtgagcgctccaattcggggattggcggaggctggtgcgcgccacggcaggaattggcggcggctggtgcgctccagttcgaggaatcggctgcagctcacagaggacgcacggcgtgtgtttccttgccctcggttgtaaggctgcaccaaatctgggccatgttttcacttgtctgagtactgctgcatttcatagcagtttccttatactttagttcaagtaaccttgtactagttcttattgtttctgtagttagcagatgtatagttcctctgatttttgtaactagatattcatagcagtttccatatacattattttacatagcatcctgttaggtgtttttcagaaactgcattgcagacacattgtccatagttgtgggatacttggaggtagtggtagtaatgtcaacttttacatgacttgtttttatacgatgtctaaatacttgcagacacattgtactttgtttgaagttttagagatgttagtaaaacaatttttcctcattgagttgggctctgtttcagactccaagtgttttattaaatcaagtcagttgataaattcttttctatgttggccattgtatggattaatgctatgttttactgaactccatttacatttctagaccaactaattacacatgataagtttttattttggtatgccagcggac

SEQ ID NO: 10902 - DNA, 1500 bp, Zea mays
tttcgaaaaaataaaaaattcaaagctacatttaaaatatattatatactaaacaatattaccgtaataattaacaataattatgattttttaaataagacgagtcacttagagtaagaaagtcaaacgaattatcaggtttcttaaagaccaggtagaatcttatattggatctttttttcatagagccatagaagtgtcaacgaggaatttctcgggatggctcgccatcttgttcctgcgaggagaaaatttctgtctctgtgaatgctcacagggagttttttcttccataactgtcctcacacaaggaatcattttcttgagagtccctattataaaggcagatataaataaattatatcaaatcaataaaaattaaacaagcaactagcaagattaaaaataataagaaccatctactttagagtttagtttgccaaagttatgtgttaagtttttgatagaattttaatacatcaaagtaactaatttaggtaagagaagttcgcgggacgggtacgggtacgtgggttcctggttaatgcttgtttgattaagaatggattgaaatgtattggaagagattaaatcttattaatcgaaattaaataaaaagagatttaatcttctcaccctatgcaaccaacattactggttttcgtttggctgagtcgggcgrgactcgggatcgggacacccgcggccgcggtccgcgcacgagggaaggcaggaccgggccttgggccgccacctcgcctctcccgtccccagaccccagtgccctacaacacggcacaccgcaccgtccaacaacatgtcaccacgtgttcaatccccgaatggtcccgtgcaccggatcccccacctggctcgcgcgcatcgccgacgacagagacgagcgagcgtaggcgcagacgcgcagtcgtcagtcgccaccgacgccctgcgcgtccggaaagtccattctccgcgccgggtcacaaggcactgtcatttcgggccgcttttttgtgtccccacatgtcagtggtgcgcgccagtttgctaaagcttcctcgtgacttcccctttcacttttcgctgggacccgcaagatggagaccccacgaggcagcaatgatatgatatcgctcgcgcccttcgggcccgctcgccagtcaccggcgtgtgggagagaagagagagagaccacctcctccgctctctctctcttactctgactcgcccgctccggttcgccgctccgccatcgccggcgatcactccactccggcaacgccgcgtctccgacgatcccaccgacgccgggccccgcgaccccattcctccgattgcctcctcacgtcttgcggttctcccccggcgagggtacgtgctcttgcccagatccgccccgcctccccgcgccccgccacgcgcgccgatcggcaagctgcgtaggcttcgctaccgctgctgcgcgagcgagcgtcgcagccgtcgatccgcgcgcccgcc

SEQ ID NO: 10903 - DNA, 583 bp, Zea mays
ctaaaataaattttaatttggaatagacggaagcccaaagtctacgtaattctcaagccacgatttatcaacggcatgtcgtatgctgcaacctgcaatgagtttggcggcatgagaaagctaaactacgagtatatatacgccggcgcacaatcatccgtacagatggcgccgcagaagatcctttgcggccggcggccggcaatagcacggcccggatatatacaaacctggtgagcgctaacttgcgcgacccgccagcttgaacatccaactgatccaaccaccgacccgggcgagcaagccatctccgtttccttgccagtcccgcgagcaccattcaccacaccagcgcagccgccatggccgacgtcgagaaggccacccccgtggccgcaccggccgagggcgcgggcggcgacgtggccgccgggagaaccggcgcggtggccgccctgctgcggcggtggcggacccaggacctgctggaccggtcggggtccgcgctgcgcgccgcggcgtgggtgttctccctgctggcgtgcctcgtcatggcctgcaacgagcatggggacctggaggc

SEQ ID NO: 10904 - DNA, 170 bp, Zea mays
aatctcgagggcgagattcttttaagggggataggtttgtaacgccctgaatttgggggtagaattttttcttcttttctctcaccaaattcgggcgttactctcttttctcttcccgtttcgctccttcttcccaatttcaaaccagtatagtgacaggtgtccgtgtc

SEQ ID NO: 10905 - DNA, 1500 bp, Zea mays
aataattcgggtggttccgccacagtaccagccacgctgcaatgccacggcgccccggggagggttgtcagcggtggcaagaggaaagcggtggcggcgggcgcgccggcagagccggggtatagggacgtgaaagggaattaggcttacacctaagtcctaaataattttggtggttgaattgcccaacacaaatctttggactaactagtttgcctaagtgtatagattatacaggtgtaaaaggttcatactcagccaataaaaagaccaagttttggattcaacaaaggagcaaaggggcaaccgaaggcacccctggtctggcgcaccggactgtccggtgagccaccggacagtgaacagtacctgtccggtgcaccaggggactcagactcaaactcgccaccttcgggaatttccagggcgactcggctataattcaccggactgtccggtgtacaccggacagtgtccggtgcgccaagggaggtcggcctcaggaactcgccagcctcggattcgcgtggcagccgctccgctaaaattcaccggactgtccggtgtgcaccggactgtccggtgtaccagcggagcaacggctctcttcggcgccaacggctccctgcggtgcatttaatgcgcgcgcagcgcgcgcagacgtcagacatgcccataccggtgcaccggacatcaaacagtacatgtccggtgtgcaccggacacccaggcgggcccacaagtcagaagctccaacggtcagaatccaacggcagtgatgacgtggcaggggcaccggactgtccggtgtgcaccggactgtccggtgcgccatcgagcagacgccctccagccaacggtcaagtttggtggttggggctataaataccccaaccaccccaccattcattgcatccaagttttccacttctcaactactacaagagctctagcattcaattctagacacaccaaagagatcaaatcctctccaattccacacaaagccctagtgactagtgagagtgatttgccgtgttcatttgagctcttgcgcttggattgcttcttttctttctcacttgttcttgagatcacaactccattgtaatcaaggcaagaggcaccaattgtgtggtggcccttgcggggaagttttgttcccggctttgattagagaagagaagctcactcggtccgagggaccgtttgagagagggaagggttgaaagagacccggcctttgtggcctcctcaacggggagtaggtttgcaagaaccgaacctcggtaaaacaaatctccgtgtctctcttgcttattcgcttgggatttgttttgcgccctctctctcggactcatttatatttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 10906 - DNA, 465 bp, Zea mays
cgaccgaacttgtgttttaagtatagttagataccgagaagataagatatactatatagtataaaaaacaatagtattaccttgaaaaaataaaaatacttcacttttgtgtggttcagtctcattaatccaggcctctcataaaatacactaatacagtactacagatctttgtgacgtccccacgatagggttacggcagcagccacctccagtttccttttgttgacgatcgccgaccgcccgtcgtaacatcaacgggcgtgatgccctcacatcccttcctcggaccgtgccatccccatcctctacgtccccacgcgcgcggcgctctgtcacattcccgactcgataaacccttctctcgtccgcctccgcgcctcactccctctcctcctctgcttcgtcttccccacccgcggcgcgcagcacacccaaaaccgtaaccctagattgcaagaggac

SEQ ID NO: 10907 - DNA, 717 bp, Zea mays
gattattataatataggtatctagattatataaactatctaatataaatctatattgtttgtttggctcttaatttgtttaagctaaaatatataatttggagagtaaagaaatatggtcttagaaactggagaccccttttcacatgcgggacctgagggggtgcctgctggctgctggacggctgcattgcacggcacccagccttgcgggctgagccgggccgctcggcgttcctcggtagttgtccaaacacaatcaatcctgtgcaagctgacccgagctcgagcctcggttgtggcttgtgtcggatcgcccgcgtcagcaattgaaacgttccaccgccggctcgatacttggcattgtcgattgtctccgtagtccgtaccttcccttcgctatcgtacattcaatcatttctgaatttcttccgttccccgccggccggctcccgtccgtccttggacgcacgtcctccactacgcgtctccatgtgcgccgcgcgtagcgcagcaacagaaaaaacaagtgataaaaaaaatgatactatcaatgatgcgtcagggcttatgtttgctcctccatccgagttcggttgccagctcgagcgttgacacttgcaggttttaccagtagcaggagccgccccccgcgtatcgcacggtcttcccacccaacccaaggaataggatcccaagctctcgatcggcgtccacc

SEQ ID NO: 10908 - DNA, 1500 bp, Zea mays
gacattgctagagtagtttttctgcgtaaaaccctatattttaatttgagacaccaatttgaggcatcgccagagargctctaattaggcttaataggttaatcttgttatttagttcttatctgtgtaattagtgttgtaattagactatatttaatattttttctagcatctaaatctctgacgtgacatgggctaaaatttaatagttctcacctgtcgcaggtatacgttgtgcttaatattttttcatataagcttccaagagtacaaaatatactaaggctaataagatatggctcagattgtagatcattggatgaacttaaaaaatggcactctaaactgactattggctgttgttggtagcctagagtactagaagtctagaactccagatactgtagaaaaatcccagcgcatatagaaatcaactgccataccataccatagctaacagacaagatgaaactggaacgaaatactagtttaactgaggagagacggggacagatctggatcatcagatcaccaaaaagattaggacctgattaagcaaatagtagaatcaacgccactaaaaaacttttttttgtactagaccggatggctgacagtgacttgccatgtcatatggcagcatcagcactcgccgtggtttttacagtccggtactccggtctacagccagccataaacaccagcagtccccggccagcaagaagatgcacaaaacttctctgatctctctctcggtccctcgtcccctcggacccctccggcctccctatcatcttcttcctctctgttctccttgtctataagtaatgacaaacctgcaatcatccataaccgaaggcaaaagctctttgtcatttaattctagaccgaattcgtgggggcgccccacctgcctgcctgcctccgctccttgtccttgctgtgcctagacatctgcttctcctcatctcctgtcagtatttcttgccttgttttgctccactcggttgggtattgatgctgtcgcttcctccagtctgcacctcaacttctcgtcttccttctcctcgcgcagctctcgtgcttcgccttttcggagacggtcgtggcgccagcggcgttaaaattcgatttccggcgagcttgtcggaggaaaagttggttttttttttggttgggattgctcgtggctacaggaaaccgtggcccatttctgcttcttgatttcggtccgtgctgttagtttggcgtgatttttggccactaaactgttggaccgaagattccattttcgtttcttgcaaacaccaaagcggtgctagtggggagatttggctacaaggcttggtgtttgcaaacaccaagaagtcaagaaccgaatgcaccggcgctggtgacgagattcgaatccattttgagtgtgagatcaagcacctgtgaactctgaataccggttctaaagacaagattttccattcgaggaactgtcgctgaggggag

SEQ ID NO: 10909 - DNA, 1213 bp, Zea mays
cagcggcgggaatttcttccgaggttactagcccggatcgttgcatcgcttcggagatgggaacagtctccgaaccttcagcttcgcctccctcacgctcaaccctagcggtagaacgcactctggccatttaattctgaatatgtgggaattaaatactttttcttccgaagctttttcttctgacgaagtaggcttcaagctggagcttcgttcgattccgagagtcaagcttcggctatggttaaaaatttkggcagcaaaactgtgcaaatagcaatgaatgctgtggtaacttcacatctacccgtctgtttatatagtgatgcaggtaagaaggcgaatcgccaggatttttacaccaggcggacagctgcttgcacccgctgcccggtggaccgcagagaccaaatagtaactctgcaaggtgggaccgttacgtgctcggaaaccaaatcgtttctcggcaacgagctcagggaaggtgttttttcggaccttcggcttcccgaagcttaagagacttttttcatggatccagctcgttacgaaaaacgatctagcacagcgaaggggctactgttgggaccatgctttgtcgccgaaggtcctgcagaaagaaacagcttcggctgaagctgtccgcatgtgacgaccgaaggttgctcttcatgaagcttcggagttacgaaccgacttaaaagtagaatgaccttttagtccataagtgtttgagtcgttgttataaacttttacgaagggcatgattgtaatttctcacaggctgtgtcctgtgcctataaatagtgaacagtattcctttactgttcacgcattcctgtaattacmatcgcatcattcgggaatcaacctttgtcaaggcaaatgtataattgtattcaatgttcagatacattaaatcaatataatatggaagtaatattgttcatttataatttatttatctttgatgcttcatatttcacttcgtataatctgtcaaaattcaattacgaagatctaaccttcgtaatcatattgtctttaaccttcgtccaaggttcattaatccttaagggaatgatgtttcgttgggcgaagggcattaacatttaacattttatgttgccttgttcttaattcatagcattgagaacaagtctccaacattggcgcccacctccggtgaactcacttccactttcctgaaaca

SEQ ID NO: 10910 - DNA, 435 bp, Zea mays
tgcagcggaaaggccacggtcgggtcgtcagagtttgaattcggtctggccagttctgcgttgcgccccctctccgttcaaaactattcgcgtttcagtccatttgttctgtccgcctcttcattaattgctccacctcgctgacggagctctgctgctgtcttcaagaagcagaataggagtgagggaaagcccgttgctttcgcttcggttttctcccagaactccaccgagagaggggaaggactccacaaggagaggggccgaggggggagtaaactcgggtccgtgtgacggcagagagtttccgacgaggagagagaagcagctgggaagggcactcacggagcttacagagaaaaaaggggtcgaggttcatgcccgtttggttcctcggttgctgcgtgaggcggccggaggagtcgtgaaccggga

SEQ ID NO: 10911 - DNA, 780 bp, Zea mays
cgcatcggtagccggcggtggtggctgctgccgtctgccatggacgactcaggccacggttttcgacgtacgtacgttcacgttggccggtggtggacgagacgtacgcagcaggaacagagagtgagtgagagagagagaggccaggacgcaatggtcgatccgatccgatggaacggccgccctggtccgcacgacgccccgcgaaaacgaccaattgatggagctccctcttctgtctcgctgttgccgcactgcaaactcaaacaactgcgttcacgtgccactttcgggaaaaaggcagcgaaaaaacgatccgtccgggaggggtctcagctagctaagcttccctcccccggcggccaaaaaaccgcgtcgatcgttggaattcttccaggagccatcgcatcggtttcactttcaccggtcgtgccactcggccaaagtacgcgggtgcgtgcgtgcgcccgcccgacattgtcacgcacgcacgcacgccgagccgagcggagcagcaaccgacggttcgcaccaaacctacccgcaagcaggctgcatgggtagaaagagaaagagcagtgggtgtgggttggctttggcttggctggtcgcagtcgcagcatatataccacctcggcattagagcggagcggttgctctctccacctcctctctctctttctctttcggtatcgcagtcgtcgtcgccgctccccggccgggctcgctcgcgtgcgcgacccacccagccagcacaccagccagtcggcgcagcaaagc

SEQ ID NO: 10912 - DNA, 48 bp, Zea mays
gaaaaaacaattgagttcaattgaattgaaatcaatccgctttgattt

SEQ ID NO: 10913 - DNA, 564 bp, Zea mays
ccggggacccggtgatgctgtacagtcgacctgcagtaatctagcgacgggtttttcttatttatttatttatttatttttcttctctccctccctccctcagatttgttttcgttttcattaatcgttattaccagcaattaattaactttatctattgatttaccaaaccgcaataaagaatatatatatattcttttattaaggtccagtaataagcagcacagaagcgcaggtgcagcagcagcagcgtcagcgcccgaggcgcgcacgagagaaacagaggctgacgaggtggggcccgtgcgggccttgaccaatcggagttcgacaacagcctggccacccacaaacacacactccttcgcctcgcgccggccgtcgtcgcctccctccaccgaacgatccctcctcctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcg

SEQ ID NO: 10914 - DNA, 598 bp, Zea mays
ctaaccatacctaacggtccatggcggatcgggccatccgtttagccatgcctaacggtccatgcacagccactgaaatcaaataaaaagaaataaaatggaacaccgctcacgtcagtctctgacagcccccaaaactcccgcgctctcggcacggtaggcggatggcggggtgggcgccgcgggactttgcggcctcgcgccgtcccctgaaacgctcagaatttagtaaaaaaaatccctaatctttccctccctccacggcgtgccgcaggcaaaactcgaacgagtttgcaaatcgaggccgcggcgatcgaaaccgcaaagccagagcacccgaggctcttccctccaaccggagctctcccaagtcccaaatccttcgaattcaaaaaaatggcggtcccctctccctccattcccaccgccccgcccgctacttaaccgcgcgcccgccactcctgctccgccctccgcttctcttccgtggtctggcgtctatccacctgctcctgcggtcctgcccccgctgctgcctgctgccgtgcagggacagccggagcaggagcaacgccgcccgccttcaccgtcgtcgccc

SEQ ID NO: 10915 - DNA, 1136 bp, Zea mays
ctgttctcgtggacgtggccttccgctctcctccctcttcagctttttccacctcttctgcagttcttctcgtgcgccctcacagtagacgtgctaggctgctagctaggagcagctcgctgcagtgcttgctgccactcttctgtctcctcttgctgcttctcgctcgctcgtctttaaagctgtcgccttttgccgctctcggcgactcggctcctgcctcctgcctcccctcctcctagtcggctcctcctgaacccgctgggttcctcgtctgtcgtctccttctgtttcgacattatccggcaaccgggcgggctagccagcactgctggttctgggaggcgtcgctgggcgggtgcgcgcgtgttttgcagtcgatggccgaggctccgtgcaccgtcgcggggggcggtttgcgcggacgcggtggtacgctgtgatgccggtcagcagctggcgacggtgcccgtgcgtctcttggctgctggtgcgcgcgcgcggaaagctgaacaggtgaacgcgtcattcctcagagcccccgtttcgcgtacctctgcggcgagccattgcgtgttcttgcgatttttttgggatttctttcgactctgtcaagcgatcttctggttgagcttttatctgcttttgcgtgggaagtgtgtgtgtgggataaaaattgcggatttgaactgccgctcatcttgcgcgttggattttgtggcctgcaatctcgtcttgcgttgcggaatcgtgcggttccagcgtcgttttcccgatcccctgtccccgacgcggctaatcggccgcatttgcgtgttctgcttctgcagtggccgccccttttctctcctcggtttcaagccaaaagctgactcctttgcgtgcttttctacgtttctttgcctgatggatagagacggcacttcgttttttcaggttattaaatctttgctaacaccgatttcgttggaatctcgcaggttttgatcggtgtgtgagaaggtggaattgcaggtagcgacggcgtgagaagggtccgtttgagtgtttgacaaaggggaagtggtggtcggaggcggagaggacgggtgcgtggtggagttttgctttcggtgctggtcggtggccgtgcaacg

SEQ ID NO: 10916 - DNA, 1500 bp, Zea mays
gtgatggtggaggtggtggagcggggtcattgttaaacaagtttccacttgtcctgtaaaatgacgacaagattgttgtacccatcccatatgcttaaataccaatcaccacaacagttgcagtaaaggtacttactggagaccaaagagaaacaaggttgaggtgggccaaggactggttgaacagcccacttcaatcacagtggagctgaaataaaatagttcactcaaaaataaagagtgtgagctttagcaacaacgccaataccatatgttgatccctcttgatagtatgacgattcctatattcaatgacataaataaaagtcaaccaagatctcgattcttgagtattgagtttaatcttgaatatgtctcaaaagatttttggatgtgattcgctcttcatgatatatcttctttgggtcctgcataacttcacatagacgtttcatgctcttttgactctttggcatgagcatgagcacttcacaggatattaagaactatacacatgctcaaataaagttgttagtacttttaatctctttgacattcaatcactaaaaccctcaaaagattaattgctcttataatctctctctttttggtgattaatgataaaataattaaaagtgacgtagataagataaacacaagattttttaatacttatgactctccctaaatgtgtgcatgtgatgaatttcacaagaattggcctcatatgccattcatgcatcacatttagagagaaagtgtagaggtcacataatgcacatgtatctgagaggtggaacaagatgtcatataaaatgtctataaaacaaatgcatatgacaagacatacacccaaaaataataataacaacaatacaccacaaacaaaagagaagtaaatgacacaaaacttaggataacagaaattcatcataatgaaataagttcacctaatttactattacaagctagatgtttttgagatcagcacacaatcacaaagttattttacatcccaagagttgaagttctctctcacaactcacaacaagagtgggtagatagataaaagagcaaagatatcacaaacttctccccatttttggcatcaagcaaccaaaatgaagaaaaaaataagatcaccacccaccatagggaccatgaccaccactaggatcaccaaagaagtaggtgcccaagtctggagcggaagcaggaggaggaggaactgaagcagaagcagcaggagtaggaggaactgaagcagaagcagcaggaggagtaactggttcatcctcagagatttcttggtcggacgcactgaagggaactccataagtttgttgatgccactgatcaagagtgtcggccataggaggtggaggattatacggacgaactggaagcaacggttgaccagcgacatgacgtctaaaattctgatccaactccattgttcttcgtacaagctcagctgtgtgaattgagttctctcgatat

SEQ ID NO: 10917 - DNA, 148 bp, Zea mays
tgttcttatcccttcatgtttgaggctctcaactagctcttagtgctaaagctaccccttccggccacttccgcgattgctaacctccgtcgcggcgcggccgaaccggcgaaggcgccctcctctcgtttcctcccgaaaccccggc

SEQ ID NO: 10918 - DNA, 845 bp, Zea mays
cgtatatatgttttatactatttttttacttccgtgataacgcacggacacatatctagtcattatattatgctactaatggtacggtatacgttagcaggtgcggatatacgtaaaatatgagcatctaaatttgtgctacaaccacaatttgcaaataaaaaatagaaatcctgaacattgaaatgacgtaatttaaatttcaccgttgcgattggctgtaagatttctttttttgcatttctccatttgatgaggcaattaattatgcaaaagacgagatatataaataaacacttttctgggctttgaagcctttgatcctcgcgcgacggcccatcaggtacttccactcctcgtcgccggagcacacccaaaccccaggttccccgccccaactcaacttctccgccgccgaccgcaccgtctcgtactcgtgcaccgcgcgcgccccgcagcttgcgtcatcccacgtcctcgcgcggtctgcgccttcttcgcggccgcctcatctgcccgcccctctccaccaaggagctcgggcaccggctgccactgcacgatcctgcgccggcgaccgtttgacgccgccgcctcagcagcagcagcagcagcagcgtgctacttcacttggcacgctctccttctggtatgaaggcatcttgcggccgcggggaatatcgatcttaacatttgccttatttggcgtacttttattttcgcgtgcagactgggcgctgagggtgcggaagctggagtcgtcatcgatggcgaccgtggagtagcaccccaaagctggcgcgcttttcttgccgtcctgccagcgcttctagcttggtttcccc

SEQ ID NO: 10919 - DNA, 425 bp, Zea mays
ggtgtgcatgtgttacaaaaggatttctagcagtaggcggggcttccttcaacattgttaatgttacaaaaggatttctctaccaagttttattggggaaaatcagtatcttgtagtttcaccaaattcttctaggacgttgcaattttggttgatgacgactgctcatacgtgttgtcagccgaaagacatgccttattagtgaagaaccggtaggtggaatttaacttctaccggtatcacgactagtcgacttagtaggcatactctactctacagtgatatcctcgtatctttggtaccctgtgcctttgctacgacacatgcaatgcaatccctattttgattgtgcgttgaactacttgtacattggtgacaaaaaaaatatttgttgctgacttctatgcaaaatttctaggaacaag

SEQ ID NO: 10920 - DNA, 1500 bp, Zea mays
gtatcttgattgtaataaacaataggtgaaatgtggtatataagaaattatgtgtctaaaaataataatctttttaaaatgatcaacaaactgattcccgacacgtaaatatttaagaaaccaatagcacacatggatagggctggaaacgagccgaatcgagctcggcttggtgactgaacgagctcggctcggctcgtccatttcacgagctggcgaaagaggctcggctcggctcgaccttggctcgcgagctggctcggctcggctcgcgagctggctcggctcggctcgcgagccatattctggtacttatcgttgcattatttggtgaattaacattatatattcatcatcaaagactaaaaaatgaggtattatccataaaattatctaatattcattattattccataaattgatcatttttgcaaggctcgcgagctggctcggctcggctcgctacaaaaacgagctcgaataagaggctcggctcggctcgttcgaggctcgcgagccgctccgagctcgagccggctcgcgagcctccgagtaattttccagccctagacagacacctggttgtatgtgtgtgtgtgtgtataaggaatcgggcgctcttgctgttaagcccgagcttgcaataatggattcttgctggatcacacatttatacttagaataatcgaatgcttgcttccatggttacaagatgttcttggataattcttttttttgttccttgtcaattttctattccggcgacgaagttgattaaactatagatccccttgttggtgtagttctgaagctgagtgttctgtgtcttggccctgtgcctttgttcaagtatgtatttcatcttttgaaaagaagctgtgacacatactattaattaatttgattaatcttatgtccctttgatatttggatgttgatattggaggacatagaattttgtaaagctgattctaatttccaatttcatgctccaatatctgcatctgaacggagtattaccgaattcagctcaacatataccattgccctcaaggttcaagagcaaaagcaggttgatttggcacttatttaaagtatacacatagtggcaaatttagaagaaatttagggcaccggtttgcaattctgtgaagttatttattagttttagcaggatggccattgtgccatgactgtttctgttgggtaggtggcagactataaaatttcccaacactgcgttcacccctgccgctctcttctcccactctctcgcctcctgtagcccggccaggtctcagtgctcattctcactcctttcaaattaccggcgacgagtatccactacgtacgcgcaccccttctctcgagttcccgctatttgactttcgtactggcctgtgatccagttacgagacctaactaagtagcactctaggtgttcgatggaatgcctctgtcaccggttgtgttcatttctgtcccgctgtgtccaggacg

SEQ ID NO: 10921 - DNA, 838 bp, Zea mays
taggagtaagccctagtttagcctttctctaccttgaatcttcacttcactttggctctacgttaactagaggcatcttgggtggcctgccgacgccaagacacacactagaatcttttctctctgacggggtacctctcgtgaggcaagatataggactgctgtgaagaagatgaccctctgcaccatcgcggatcgtccgagccctaggcatggaccgtctggacgtacgcacagaggagccgctcctgcgcctaggttgtggaccatctagccagggtcgcggtccgttcgtgcctccgcagagagtaccgtcaggtggttctttctcgtgtgtggcgcctagatcggtgccaacaccgacatttgcgattgttgtgagaatatttatttatcttttgtttcctaaaatgtctagcaagactaagagaattggcatggagtatcttgttagtaatactgtaatagtaagatattaagataagatgtgtgtttggttccgaatcttacaacaatgacatcatatatatgccgtcaggtggttctttctcgtgtgtggcgcctagatcggtgccaacaccgacatttccgattgttgtgagaatatttaaaatttatcttttgtttcctaacatgtctagtgagactgtgagaattggcatgcagtatcttagtaatactgtaatagtaagatattaagacaagatgtgtttggttccgaatcttacaacaatgacatcatatgctgttaactaagtctttattttttttgggaacattcattcaggtgtcaacgggactggtggactaatatataatccacatcagtaatttgata

SEQ ID NO: 10922 - DNA, 959 bp, Zea mays
tatatatatatatatatatatatatatatatatatatattcttcctatctcttaggtttgttttgataaaactttgaaaaattatagtaaatcacaggaaaaataaaataaaatataagatacaattttgttgaacttccatggtatattttgatatagagtttttgttatatctttagatatatgatttttgcaattaatttataggtacaatttatgtgagcgaattacgataaactttttataattatttatttatttcacgctttagctataccaaaaatccgtgcctattagatcatgtacgactgagctatgggtttatcagttatagatgattcaacaagcacggaattttctagagctcgggcatgcaatacctagtgtaccataaaaaaaatattagaattagatcatagaactgtagttatggaaaacatatatctaaaaatatgacaaaaaattatactaaaatatgttatattacatgtttaccgcatagatcatgttatataaaattgaattaaattatatttctatttttatttttttagtttactataattttttaagattcagttaaagtaaacgtaggaaaaaaatacatatgaaaacagtcaaagagcttatgtatctggttttaagagatgcggaagaaactatattctgtgattgttgagttttttttggtttagtgaacggactttttcgacgccaatttcctaatcctactggccgtggtctgcaacgaggtggggcagcgtgttcgaggttcgagcccaagtgcccaacacaccgggccacacatgacttgactggctggctcaattcgatcgcctacgcggctacgccccacgcaacgccacgacgtaccccgcgaccgcaaagcgagcagcgaagcgagccccaggcgccggcgagccgggagtgcgtcgccggcggcggaggtggaggcagta

SEQ ID NO: 10923 - DNA, 585 bp, Zea mays
gtgtagatttagagtacattgttacctctaccgggcagctagcacttcaaaacaacatcatcaggttattcaggtcggcaagccataggagcaaaccaaggtgctcttcttacttgccgtagtaggatcggggacaaatcatataccgtatgatttttgaaagaaaacaaaagaatcaaatttatctgatttacaattataatttatatcgaccgtgctagctcagtagctctacttattaatgattgtaccatatagagtatacacatgatgacgacactaaactaaatccctcgcttttttttttgcttaatttgcgatcagctttgccatgctattattactagtaccttaaaaatagaactatataatctatataaatagggcctgagcaatgtacagccactggcagacgaacactggccgtctccctcctggcctcctcagtcctcacgagagaaacgcaagcgagacagcagcagagcagagacgctgctaccgaggcaggtgtcactggccgcctagccgtggccggggcagtggcatatgcactgaaagatcgattcaccacgagaagagaaccac

SEQ ID NO: 10924 - DNA, 850 bp, Zea mays
ggtaaatatagggtgggcttcagaaacgctatttgcagggtatacaaggctccaactgcaaacgtacgggcacatgcaaagggcacagctggtgcagtacgggcacatgcaaagggcgcagctggcgcaatagatctgcacagcaaacggagtaaagtaaaagaaaataatataatatatggtagttgatatagagttgatatatagagtaaatatgaccgcggaagattgtgatatagagtagataatattgctgaataggatagaatattttttttggagtacgaatttagggtagcatgagtgcggatagcctaaagcattgccgttaacggctctctgccgctgtcccagacttcccaaatctactccaccattgttgcctctcccgacgcccctccctaccctacttcaaaacatttcaaaccactctacgcgactacgcctccttcctctcctcaccccctccccctccactcgctcgccactgaggcgcctgaccagtgatcgtaccatctcccctcgaccacagtccaccgcccgtcaccgccccgccccgcccgctcgacgaggccgcggccgccgcgccgggtggtgaagaggtgagtatcctacttgcgattctcccggggtttggatccggtcgctcgcggcatagcatgcattctccgctgaggggaagccctaggtttcgagaggtgggtgcgttggggtgttgtctcatcttcctgtttagcgccgtggaactgtttctctggggtacgtggtctactagtgcgcgcgcgggggtatgtgtgtgttgtcgcgaagttgcgtttgatctgtggaatcacgtctgtagggtgctgct

SEQ ID NO: 10925 - DNA, 543 bp, Zea mays
agtggcatgtctcaagacgaagaactgcaccgacttcaagatgaaatgaccgattgatccatgagagtctgtgtcataattgtaatcttttgtaaagggcatgaatgtaatatctcacatgctgtgccctgtgcctataaatatatgaatagtacccccgtactgttcaggctggcttgtattcactcgcacgtcacactcggattctcgctttctgtcaagccgaaggtataaatgtaattcatattatccatatttgttcatgattatataataaaaatgtctgaatgatatcatatgattattcatgttttttatgtgtcatatgatcttgctttccattgtatattgagatgatgaaggtacgtccttcatgaccttcgtctgaagatcattatatcctaagggaaataatgcttcgaaggacgaaaggtctttaatcattaacttttgtgttgtcttgttcttaattcatagcatttgagaacaagtccccaacattggcgcccacctccggtgaactcacttccactttttgagctg

SEQ ID NO: 10926 - DNA, 792 bp, Zea mays
tgttgcgttcctctcgatctttgtccagtcgccgcctgcaacgaattcgatcgtctagtcaaggatgagacgaccactcactcaccaccgcaggacgcatgcggtttgtcagcaacctttttctctcaaagaaacattatctgaagcgacgcgagcgggaggtgaagaaagagataggcgaaggcaactgtgcgtggagtggaggcggcggccggcggggtcgacgaaaggaccaaggcccacgtacggcacacatggcaggctgtccatgccaaccgggtctcatcagactgccagcgagctagccgagctgagccgagcgcccgcgtcgtggccccggcgccccgtgccgaaaacaatctggctggctggagcccaccgcccccaaactttcctccctcctcgtttcttccacctccctctccatcgcacgcgcatcttggcacggcacggccacgaccccttcatctcataaaaaaataactcggcagccgcaaaccctgcggggtgcgggccgcgcgtcccctgacgcatccgcactggtctcggcgcagccgtccgatcagatcgcaggctctcagcacccctcatctgcgccgcactcagcgctattactttactagtatacagtagtaccaaaaaaaaaaatcaccttgctcacgcgcgctctgccccgcttgctatatcctcctagagcccagccaaatcccccgacgtcctcctgttcatctcctcttctccctctcctcctcctcctcctcctcgtcccccttcctcgggttggaaattgga

SEQ ID NO: 10927 - DNA, 176 bp, Zea mays
ggtaagtctacctctactcaacatatattgaaaaaaataagagacactcgatacaacatcactgccagagtggcctagccagcaagtggggatgcttgaactattcattacaagggaatctattattctttgcattcattgtactgatttgggtcttctcccaggtcgagggtctg

SEQ ID NO: 10928 - DNA, 313 bp, Zea mays
cacgcggaagccgttgcggcgggcggggtaaataaaaggtaaaaggcgtgggaagggtaaaaggcgtgcgccgtgcgccctctctttctgtcttgtgccctaaaaaaagggcccgctgctctgcttttctccccctcgtctccgcatccgcagtcgcacacccgccattgcattcgcagcaccagcgccgcttctccttcctcgagctcacccccctctcttctcctattcgctcgcgtgctctctctctctctctctccgctgcctcagccgccctcgctgtcgctgacccgagagattcatttggccggtc

SEQ ID NO: 10929 - DNA, 1500 bp, Zea mays
gagcgatactagacattttttagtagcactcacttatatacgtgtatcagaccgtttgggccgatttggatacagcccatgaaaggagaacagcccaacttacctctcgcttcatgcgtgagcgtgacgttgacggcgtaggctagcgcctagcgctagacccgcccgcggcccgccgcaccctcgcagtcccgactcctgcacaacgacgctgtcgagcctgcctggcgagtgttgtccggcggccggcaacggggaagagagcgtccgacggcgacgcactcgagcggcacccctcccaactcgctccctcctcggcccctgcagccctgctccgtggcgcgcatcactgggcggctcgccgtacaatcagcgagcgggtggcggctacctccatactagcaagactcaatcggcgaagtgagtcagtcactagtcagttcctccctatctcctccagccttctcctctgatcttccgtgtgctccctgttcaatcagatttattttttatgtattgtggccttattaagctatgcactcaaattatatcttatgcactatggttgtgcttttattatactttttttactgatactatgttattccatattacattatgagttattgatttttatttttcctcgtatcaatgtttttttggagaatagacacgtatcgtatccaataaccgaatccatatctgggcaacatagcctatcagactatcagtaattcagtatacacgagtagttccttggtgaagaaattacatgtacaagaatacactagtcacatttctggttttctaatgctagaaatgcagaggaagttagaatactgacatggaaaattctcaacgagaccagcaagtattgtgcccaaagatgaactgaaatgcctgaatctaaaccagtggttgggttcttgtgtgaaacgagcggatgaacattgaaataacacatcttgaaattaatcaaactgatgatgcgcacacagatagaacaatgtaacagcaaatatcaacagcgctgtctatgttcatgcccgtccttggtttgaggaaataaaaagagagacccaaacaagccgcagtgttttgtgcaataatgcagtaactacagatcgaaatgtaaccagatattgcaaacttgtccatatatttcagatgcgctcaatgctaaaagatatgaaatcatgctcaattatgtgttacatctgctatataccccctccgtcacaaaatagtattcgttttaagatgttgatggactcatacaatatttgatgtatctgttttatatatgtgtctagattcattgtcttccatttgaatcaaagaaataaagtgccaaaacgattaatatattgcaatggagggagtattgtataaattctataatgtggtatttatatatacaaaacataaggctgttattttttacagtcctttgtattttgaatttgaatactattttcaagatcctgggcgtgcctgcca

SEQ ID NO: 10930 - DNA, 1500 bp, Zea mays
tggctccctgactcaagcatcccggactgtccatcacctacatgcggacggtccggctgactcaggcggacataatgcccatggtcagaggtgtcagcctccacacaaagcgaaaaagaagacacacgagcaaagcacatataacatacatggtcggctggtcaaagtcgaccctacttttgatcgattgctctctaaatacgttagcaagaaagctgttctacgcgatcggccaaaatagaaatcacgatcacctgctaaaaaaaatggtctgaaaggcgacgcaacaagcatcacctattcatctagtgatgcaaggatacttcgcacccgcctactcatcatcggtcaattgtcctattcaaatgtggaatgatacgatgatgaacttgtggtacatacatagtccatttgcctattcatgctggggggcacatccattttataccttttgatcctttgatgagatggtcatggccgagaargatgcaatctgaaacgaccctttatgcactagagctctattgaatgatcaccctattgaattgaaaagccgatgacttacatcaggcttactgtctatgcttttggtttgtcaaccttcacaaaatacatggggcatatgttgaatgccaaaattgtccaggcggacggtccggacctccacagtggcagcgcagaccgtccgcgtatgcgcagaatcagtaaggtttcaggatttcttgtggatttattagctaaacctgctggattaactcgagaaccgacttataatagatccagacctcccctttacatagatgaagggttatggtcgattgaacccccacaaatcgatcaaatcaactctaattattgtttttaccttatgcattagtagtaactctagtttagcctcactctacctcaaatctttacatctatttagctctacgtcgactaaagacgtcttggatggcctgccgacaccaggacaccctaagatctctcctccgtgacgaggtcccgtccggtaggccagatctaggtttggtgcgaagaagatgactcactgcgctatcacagaccgtccaagctccatgcgtggacctccggaggtatgcggaggaggggccgctcctacgtctaggccgcggatcgttcgtcaggtagttcgtaccagtgtttgacatccagatcgatatcaacaataatatagagagagaatgtatcttctcattgtcttattacagtcgacctaaataactttagtccaaaagactcacagcgcgatccatcgtcgaaaccgagcttcgccttcatcttgcaatttgtaacagatctcctacgctctctgcccatggctcttcttccagaataaaaaggggtcccgacaccgcaaggcttccattccccggagttcttggagtcttgtcttcggcctctcgctaaccgccatcgaccacactgagccccaagccccccaactcccgagccctcggacctccatccctgtttccc

SEQ ID NO: 10931 - DNA, 1447 bp, Zea mays
tgtgacacacaccctccatgaacttaaatttcttcagaattagtagctgtgggtttataataacacatccacgtgaccacatctttttccagatttagatattcgagatattttttttctgatcgctaacctaatacaagtaatagcaatctacaatacccagtggcaaccacacaattgaaagagataaacgcttcactgcttcagtgcagaatccttgcagatatgaatgacgtccagggaaaaaaacatcaccatcaccagctagcacttgtttcgacatgtcaaattggctggctccaccagtaaatctgtctcaatcttaaatattggcaaagtggagggatggccggatggaggcgaaccatggccaaccaaatccaaacaaatttgtcaagagaacaagtataggattggactaccaaccaaccatcagatgaaaacacaatgctcaacatattttgaccagtaatataaattgtctagaaagaaaaacatgttagaaaaaaaattatacaaaatagattgtgtccatttggtccctaaaaatcttaaaatataaattccatgatgaatcaaaatatgcttattccgtgtcataaatattggtgcttcttgtatatataaagctgtctatcagtcttataagattggtttgacataagacaaaagtcacaaaactaacataagtttatcaatctttataacatttaaaaatatcgcatataacttgaggaattaaggcattgtatggagaaaagcgtcactgcgtaccaaggatcgtacggatccgtgaagggcagacgcggcagagacgcacaccggcagcccggcaacggcaattcacccacgaaacggatcggagatggtccgcatcaacgtcgaacgcacgacgggagaaggcggctcgatgatcagcgacgtagtgcctgagcgacctccgggcaagtgcctggcggtcaagtcaggcaggagcacgtcagctcgccgcagtgtagaaggccgccgttcgccgatgcgagcgagagggaaaaactctggagatgcggggcaactagtgctcgtgggctgagccgaaatttgggctcctgatgggaaaacaagcccaccatggcacgcacgccggtagtacaggactaccctaattccagattttgcaaccatctcttggagtactgtatagtgggctggcgacgactttttttggatcttcaagcacatggcaggataacaacgaagaacgtcactggtcaactcaactgattcgcttaggactgaagtagctggcagatggcaggctgagagttgacggaagaactttccctgttcattctataggaatatataagattcccgagcctgctcctgtttgctgccacaactccaattcatcttcctgctggcagcttccctctccctccgctgctgagcaagctgatccaccgcc

SEQ ID NO: 10932 - DNA, 296 bp, Zea mays
cgtgagtatccctgctccaacagatccaagtccctcgccgtcggttgcaatggttggtgcgatcggtgggccattctcgttcggtagacatcacaggatttccctctgcgatttagaacgatcgtacatggggatctggtggacgacagcggctgcatgtagctttcgacggcaaaacatttcactcgcttctatcacgttcacgcgctcatgtgtaggacaagtcaaaatggacggtgggtctgatgagtatttgatctcaaacgtgctctctcatatctggcaggacggcaatc

SEQ ID NO: 10933 - DNA, 1167 bp, Zea mays
tagttttccagtattatctcattttgctagagatattcttcttgttcctgtttcgacggtttcctctgaagcaacatttagcacagtgggtagaattattgaagaaaggaggccctctctttcacctgagacattggaggccatcacctgccttaagaattggaaaagagaaagcaacatcaacttgaagattatgaggttgaacaagcttttgctgatttcagccatgattagtgttacttttatctagttcatgtggactgttattgtaatatggactattattgtaatatggactggacattaaaactttttccgatctgtactcttttccttacagaggaaggcccacactggggtgtaaggtttttaacgaggcagatcgaggaataaaaacattttccctctaaaatttgtttgtgttgtctaatttattgtaactgtttatttaaataaatgacttgtttctgtattttaactgtttttaactggactgttgtttatgttgcgtgagagatttggacttgtttctatatctgacctagtcatatgatgattaattgcgagccgggtctgggccagcatggtccaatgcaagtctgtcgtgttttatgaccgtgctggacctacgttttaggaggtgagcacgttttggtccagtccgaaagaaattcgtgctagcacgatccgacgtatttaagcccgaagctcgacggacccgtgccgggtccacctggcccggcccggcccaacttgtaggactagatcaaaaggaaacagctgccaaacgatacgtaattacagaaacagctgcgggaggaatcaccgaatcaggacacggccggcggaattccacttcccatgcattattagccgaggcggggccctcctgttggtcccaccagtcagtgggatgtgtggatgctaaccagtgcagtggaggattagcgatcttctagaatcgtgtgcgagctggacagcaggaagagccgtagagttcgacgcgaggagcgagcgagtgattagctcgtgcgtgctgtgcaaggaaagtaacccagcagatcgatcggtcgaggcgggtaggacaggatctagaggtagctagccatggcggaggaagcgtctgcgcctgcggcggggacggaagcgccgccggggaagatgacg

SEQ ID NO: 10934 - DNA, 1107 bp, Zea mays
tagttttccagtattatctcattttgctagagatattcttcttgttcctgtttcgacggtttcctctgaagcaacatttagcacagtgggtagaattattgaagaaaggaggccctctctttcacctgagacattggaggccatcacctgccttaagaattggaaaagagaaagcaacatcaacttgaagattatgaggttgaacaagcttttgctgatttcagccatgattagtgttacttttatctagttcatgtggactgttattgtaatatggactattattgtaatatggactggacattaaaactttttccgatctgtactcttttccttacagaggaaggcccacactggggtgtaaggtttttaacgaggcagatcgaggaataaaaacattttccctctaaaatttgtttgtgttgtctaatttattgtaactgtttatttaaataaatgacttgtttctgtattttaactgtttttaactggactgttgtttatgttgcgtgagagatttggacttgtttctatatctgacctagtcatatgatgattaattgcgagccgggtctgggccagcatggtccaatgcaagtctgtcgtgttttatgaccgtgctggacctacgttttaggaggtgagcacgttttggtccagtccgaaagaaattcgtgctagcacgatccgacgtatttaagcccgaagctcgacggacccgtgccgggtccacctggcccggcccggcccaacttgtaggactagatcaaaaggaaacagctgccaaacgatacgtaattacagaaacagctgcgggaggaatcaccgaatcaggacacggccggcggaattccacttcccatgcattattagccgaggcggggccctcctgttggtcccaccagtcagtgggatgtgtggatgctaaccagtgcagtggaggattagcgatcttctagaatcgtgtgcgagctggacagcaggaagagccgtagagttcgacgcgaggagcgagcgagtgattagctcgtgcgtgctgtgcaaggaaagtaacccagcagatcgatcggtcgaggcgggtaggacaggatctagaggtagctagcc

SEQ ID NO: 10935 - DNA, 545 bp, Zea mays
gtttgagagtgtaagaaactgtcgagccctttttggagcaagccttcctacgtttatttctataaaattaaacagacctgtataaaatttatatatagttttgtgaaatttctacgttccaaatgaaccctcaaataaaagttttgacacaaggttgaatcaataatttaaacaaaattttctgttgtaccttgtgaatcttcgtagatttagatcaacttattaaagtgtcaactgtttgattacctggaaggctggaacctatttctgacgcgttcactcccgattaatcaatgtgtccatactccatacacttcgacgctaaaagccgaaccgctctaccactccactctcgaatgctccctcctcgctaacggtcgcgaggggcattcccgtccttctgccgccccgcaaacccccgaaatttcaaaacccgacactcgaaagcgggcgtctccatttcccactcgccccctcctcgattcgatccagctggacgccgctccccgacgacgaggacgcccgtggagctctagaatcaagcc

SEQ ID NO: 10936 - DNA, 1500 bp, Zea mays
aaattgcacacggtataggcgggccaaaggtcacctcaaccaatcctaaggttggcctacaactatactatatactatgctcatagacgaacaatgagcgtgttacaaagacacgtcgttgaaggagtcccaccgggagcgtgatatacccatgagatctttttaaaccccaaacaacacatggccacgacaaactccgtctggacgtgccgcgactttaggtttccctaactggacatattgctatagggcttcgccaccattgatccaccggtcgtgcgacaacaacaaataacgagaagtagatgggaaggagaggataaaaggagtaagatgtgtttttgttgattgtttggttgtatacctcaattagctatgtacccccatatttttagcaagtaggggtggtcttatcccattaaaaaacccaattaggtactattttcatttcatgttgttttgtagactttttcttagatcaaacagaaactggtatgggttgattctaaaaccagactaggtccaatttgaatgtaagaaaaccataaacgggagttttaaaatatacaacgaatagcaatgatgttctaacccatcgactatttttcctttaagtgtgatgcatccatcatcatattagttcttagggtgatattatatatcgattattgttgaaaaaatgtaagatttttgccaaccactaggtcaataacttttcaattacctactattaaaaactattaggagatgatcaccttgcaataatgcctctatcatatatggattcccctcgccgcccctagtgccaactctcgacgctcagcaaaggttaacgaccgtcaactttagacggccgctgacgaccctttgccgagcgccgccatcgtcaagtgtttggcactcggcaaagatatctttgccgagtgtaattctttgccgagagtcctgctctcggcaaacgcgttcgttaccgagagcaagactttgccgagtgcggcactcgtcaaaggtttctttgtcgagtgctcgacaaaaagcactcggcaaagcaacggatttcggtagtgagtggtggaatgtcaaattttaaactaaataaattactttattgaggaaattacaattcctctaaaataaagagatccaaacgtcccgtaattctatttgagtaagatctatcttaagtgtaagatactgtcgcacgcacgtgcacttagctattaacatttacggatcggggatcgggttgatacgttttgtaagtttatagagcgggtaggcacaggaagacaagtgtgtattttactcgttttttttacaagactggagcaaatctgttctccagcttccatgaattccatgggctttctaaatttctgcctccggcccatacaaattcctcctgatgaaggttcgtcggcccaaaccaagtagcgtctagggttttagcctctccaaccgcacgatggacaccgacgcgagaaggcagggggagagaaa

SEQ ID NO: 10937 - DNA, 1500 bp, Zea mays
gagaaggagaagaaggacggtcgtgctggagctggagcgatgaacgtgagcatggtgcgagcgccacgtcgacttgcggtgtcaatactcactagccagtactagtgttcgggacgcttgggattctcagcaggcgcaggcttgtttgtgctgcttggcgacgaccgacgagacgcaagaattatttgggctagtcgggaacccatttttttaaagaaatttctattttttcttcttaaaaaatggagtttctaaaaacgtcatattttacctttttgcgggtttccttttctaaaccatcgacagagcagagcctgcacgattcggaaagacatcagaagctgttagcagtacggcacaagcgatgatgcaaatcagaggtcgattggatcaccagattcgttagtggagtgtttgtttcaggaattacttcatttaaaatgatatagtgtattataattttgttttttaaatttggtgagatgatctattttaaaaaaaaagtaaggagtaagaaaataataaactagctcagtcatcaaatcaaatacctgtagtttgttggtcgtaacctcacatgcaaaaattctaataatattttataaatctagttaaacttaagattgttaaacttgttttactttgcaatttttaagacgaagaggttatcaggacattagaagtattacactacaagtataatattttcacaagtttctcggtttcgacatacttcatttttacataaagatttggatatatatatttatacttctttctatccaaaatatttagcgttcttgttttgtgagaagccaaacacgttttattttaacgatgtataaaactaaagtattagtatttttactatacttatgtaaatagtatatttatttattgatatgaatggtaactaacattttttaaaaaaacctagttaaatttaagaacgtttgatgaatataaaaatggcataccgttctgctgcaaaataccgtacctcctgcccttcattcaaatgtgaggataaaagctaaagagcaggaaactcttaaaaaagatcgtcttctctaaaagtttaaaaattaaactcctttctaaataaaatacaactccacatcgagcaatctcgttcgctgttcgtgggtctttccctgccccaagggtgcaccggtgcggtacaggcagggcggcaagatcaaccaccagcaaatcacaagaacaagagaagaatcaatccgacagcacccctctccctcgcatctacttgctcgcccagcagctgccccaaccctcgcgtccgcatcgattcgaggcagctcgctcttatatatcccattccgctcggttggattcagcttcccctcgccctccctcgtcgataaaaccgatgcaccgtgccgcctcgcgaaccctagcggcggcgggacgaggggaagaaggttacaggcacggcgcgtgaagggtcctgtcctgcccagtcccgtctggtccgccgcg

SEQ ID NO: 10938 - DNA, 1295 bp, Zea mays
ccccacatggtcttccatgcaccaccacccacatcgtctttctccccgtgtggccgccccacttcggtctcttcctccccgcgcaaccgacgttggcgccatccctccatcctgtcttcttcctccctatgttgccatccaccattattgtcctcgtgcccgccaccccatagtcatcctctccgcgccttcaccccaccccgccacttcctccccgtgcgaccacccttggtgtcgcccccgccacatgccgccgtcactagcgctgcctcgccccaccctctttatccccgcgccaccgccgtcccctcctgctcgcctacatggtgacacagagacgaacgaggtgttcaccaaaatctccctcagccagggccatgccccatcgttgcttcttgtccggagcccaaggccaggacgtgtcgccgcttcttgtccgaatccttgtagcagcaacaagcatttgatgtagggtaagcttttcctttctaggtgtagatgttatgctctctgttacttccctcatcacaaattaaaattcgttttagtaaatttatagattcatacaatacttgatgtatatgttatatatacatatttagatgtatcatcatttatctgaatataataataataataataataataataataataataataataataataataataataataagagctaaaacaaacactacatctgcttcttgaatatttatcgtgggctagtttatttttaaattaaatcacgataaataaaaaaatcctgttggtcaccatcacgtttttgggtgtgattatgctgtgattttgtttgacagatcaaactagtatttctagaaggtcaaaacatgcaaacctcgaggggaagcaaagcaaacaagctaaaaccatcaattccccattcgcaaggtactggcgcgcaaaatacagagaagtaaaaaaaaaaacgagttgaacctttactccctctgaccgttgcccaccttccgcagccgtcgccaccgccgtcgccggcgtctcctcctctgccacccagcccaccctcctccgccacagacacaccgctatcgcttcccacatcatctctccaggtaagcggagcatccgtagatctctccccgccgccacatcgtacgccggcgctgctcctcccgctagcacacgccgctgcggatctagatccgacgccggctgtgcgggattaggcggcgtgtgtcggtgtatgcctctgaactctggatctcactgggatcactttcggtgtgttcggcagcgtccgccgaggg

SEQ ID NO: 10939 - DNA, 780 bp, Zea mays
tcttttcatttctcatctttttatttagtttgagtaataaaataaattaatttgtcaccatctcatttcttatggttagttattattaatacgaagaatataatcattccactaaatttgaggattagactcataagagcatctccaagaggaactcctataattgaggcctcaaaagctaaattgtacctgattcaagttaacttggatcaacattttttttctcaactccaacagcaactcctaaacccacatggtagttaactccgtgagattagacgcacaggaataggtcccctgacttgggtgctatatttagcaactgtgacttcgggtgctatattcatttgatggaaatttataaaatagcaactttattggaagttattttgagatcttaactcctatatttaaatataggacctggcttaagtcctctcttggagatgctctaatatatcattttattttgaatggagtaacacgctaaaggcgggcaacggttgatatttaattatttatcgatcccagtgcctacttgtcccgctataacctgtgattatagtacatgactgcattctgtcacttcccagtgtgtgtgtatatatcgtcctccgacactattgtatctgcagttccttcggttgctaacatctctagccgagacatttgacattttgacttgaacaatctgctcatctaccactccggcactcccacgccgggccgcgcggatcgcatcgagtttgagtggagtaggcggcgggcagcgaatcagcg

SEQ ID NO: 10940 - DNA, 821 bp, Zea mays
cgtggctatatatatagtgaggtataagggttaaaatttaaggtatagcgttccaacgcatccggcggcggagacaacgagccagatccgctccccgtcaaaaaaaaaaaaaacgagccagatccgcttgctagctgctgcccaacccgcacgaccagagtaattacgaaagggaactatagcgctcgcccacgcacaacggacagcgcggctgacggcgacaaccttttcgtctcgcccccgtctcttatcatgtttcggtttttgacagcttctggccactaaaagctgttacggactgctaaacacttagcttttcagccatcttctataaaatttgtttagataaaaactattcaaaatcaacataaacatgtaattgagtcgtcacaatagtaataatccatcattttatagatcctaagacccatgaacaattttatcttcctccgcacgtaatcttaatgatacttagtttctctacacagccaaattctcctcactcctcacgtctagattctcgaaaaagccgatcagaaaaaactaaaccaaacagaccatctgtcgccccgtccccctctcgtgcagggacgccccgcgcccgttagaaatactcccacgcggacgcgctcgcagagtcgcaagagaagagccgcatcgcgtccattaggtccatagcatctggaggggacccgtctggcgtctggcgtctggcgtctggcgtctgtctgggaccgggctgcccagccgctcgatcgacgttcggcgaggacgctgctccggtactccggttggttggaccggagggcggaggcgcggcg

SEQ ID NO: 10941 - DNA, 1500 bp, Zea mays
aagaaacacactcacaaccgatccagacggcccacccagcgcgaaccggatataccacacggatgccgctctataaataagaccccgcggccagcctactgtacttttccggcctcccattcctcgcgcggcgaccacccgattcgaagcgtgcggagagaccgaagaagcgggagaggtatgactcgagcccgttccctcttccctctttcggcggtttcgttaattcgagaaggcggcgttccgtggtggttcttgcgatcgtgtgaattttgcatgttttattttttatttttttttgactcgactcgtgcgttttggggatcggccgagttggggcttccgctggatgcactgcagcggccggcggctatggtgtgctagggttgcctttcggtctccttcgacttgcgcggatactgcttgtcacgcgtcggtaggggtacttccaactgggtttgggtctactggttgggtactgtagcgattatggaggtgatcttggcagagctattacgatctcttgcaggatcgtggtgctgctaggttttgtaggtgaatgtaagggtggttgtactcatggctctagcgccctttggattttgttgttattggagatttaagtggttcacacattggatgctactcggaagttcgtatattagaacttctgatttatggactcggctattgttcttccatttagttgtagcgatccatgcttttattctctcgtggaattgcatcctccatcttgattgtaggtaggtgaatttagggctttagtgcttattcacatagttcactcactctcaggaatttaggtaggttaatttatgaattcgacacatggatgttatggtagctaatttggattgtatttaatggtctgtaagtgatttgttatgtaataccgattatatattttttgttttctgtaattctgtttgatttagtggacttggttaatttacttgcccctgtcacacagctgacgctttttttatttcaatccaccaagtcagctcatgataatagccgacaggttgtctgctaatcgaacattttattaatcaggtcgttgagtatgatttaatggtttttgtttcttaaacatttgttactagtcatggtgttatttggagtactgttctatagggcggtccagttatagtgctagttgttcagtcaacaaatatcttcaaattctattatatagtattagaaatatgtttgaacaaaatgcttgttgttctattgtacctgaactatcttatatttcatttataaataatgaaataatgataaccaaggtgaccgattggaaatgattatagctgagagttattgtatccagtattattagtagtttgttttacacagcagaaattaagaaatctgtgcatttgctgatatgagaacagaaggttactagctgtttttggttagattttgggcccctgaatacattgtgatgttttgccccctcgattagtgcag

SEQ ID NO: 10942 - DNA, 875 bp, Zea mays
actttgagagctcgatctcgtcgcctgctgcctccagtccttcattggcgcctccagaagcaacaacaacgcggggccagatctgagcagggagggagaggacacaacaccggcgcagcgtgtgaggaaatcgggtgaaattcagaagtaagatgtgaagatacgttacgacggctgggcgaggggaacacaatgggaatggcggacgcacgaacgtggagaggrcaacacacgaagccgctgccagaaatcgacatcaacggttgggaaaagattccgagcgtccctagcgatgcgggtggcccgcgagtggaggtggttgtggctagcggagattgcgcgcgcttaattcggagctcggaggttgctgggcgcggccagctgcgggcccatgcgatcggacggtctagattcgtmgaaggcagaacgacagaacgggtaggctacccttgcagccttaatatagaagtatagatatagattctgtttttttattaattcgatttgtgaggtttagaaccaaaattattttgattttctgaaacatcaaaattaataacgactaattcggttccaaccttaatatagaagtatagatatagattctgtttttttattaattcgatttgtgaggtttagaaccaaaattattttgattttctgaaacatcaaaattaataacgactaattcggttccaattaattccggttcgattttttggttttagtttagtttgcatagaccctgcaccaggccccaccacctgccagccgagccaagccattcccacggccccaccactttgcaaacttccatccgacccctccatttcctcacgcatccccactgagcactgacccccacgccgccggcg

SEQ ID NO: 10943 - DNA, 283 bp, Zea mays
ttaggaatagtgatagtagaatttagttcaccgaatgtaatctccatcagtttatttttgctgcatcgatcttgtcttctccttttgcactgcctcctgtgacgatcggttcttcatcatcagaaggagtgcgaagccttgcacctcgtctctgccgtgaaggcctgctgtagggatactgccggaaacgccgggctggtgcacggcgagcagccgccgctgccgccgcacgggactcacctgctgccgcacgagactcacctgctgccgccgcacggacctc

SEQ ID NO: 10944 - DNA, 1500 bp, Zea mays
aaagatacttccggctagctggaaatgcacgggaatcaaatgaataggaaactctggacttgcacggcaccacaagaatttctgatcaaattgggcatcagagaaatcaattagtcaatcgtgaacaacacacatctcaatgttttggtagaggacgagcagagctttgaaaacacatcaaagataaagctccaaacctgcaaacgaaccggtgattttagcagctacttcacagtattacaactagtttcatactgcaattatttattattcttagaatggaaaatatattttctgaatggagaaagagaggtaagcagatgcaaagactgaagagtttgagtcgggactcgggagacgggcgtgcccggccttcataggcgtattttttctccccgccaaaactagcccgaaccaggttagacattccccgggcttccaaatgcaggcgtagccacaccggtgtttccacaccgaggagctgggcaacccgtgttttggccagaaacctcgccggatttaaggctcccaaacgaaccctaaggccatgttcgtttgatcccaaaatcatagggattgaaggggattggaagggattggagaggattttgacttataggggatttaatccccctcaatccctatgaattggcacaaaacgaacatggccttaatgggacaaccgtctagatccgagcaacgcacggaatgaacctcgctctgtcggcgcctagggctaggtggaagagcgcgtagcacgcccaatccagaaaaaagaaagagaatacagagggggctagacatagaacaactggtgtcgcagaggccccttcaatcctgatgaggacctaagcctaagcccccgccccgatacctcgggcttttagccaccgcatccttcaggcacccgttatgtttgggctaagcttatttaaattttaattttatgaaaatagctagctcattaatagtacgagtatgacataacaaattaccgttgtaacgtatgaagatatttgctaattattgtcaaaatataatcttctaagattgacgatatgagcgtttccttgctaaaagaagggtaactgtttacatacatgcgcatttgtttatttccctaaaagacaaggtgtcatgtgcaataacactgaaactgagtccccctcttgtccggccgccgctgccagcttgtatctcgtaatatcttactcattttttccgttaaaaaagaaaagcttttcattttacacctcacctccccgtcccaccacgtacaaaggcgacgcgagcagcgtttgcttccctttccctgctgtgctcggcctcgccgcttcctctgccctggctcaacgattcctccgcttttcctttttcaaaatcgccctttcctcgtgcgcgtgtcgactccttcctgctcgccgccgggtctgggctgggtgacgctgcctcggatgaggccgcgctgaccggagccgtagccggaccacccgcccaccc

SEQ ID NO: 10945 - DNA, 504 bp, Zea mays
gagatcagtgtgaggcaccattttcttgtttttgtggaaaacacgatctatgttggtctgctgctagttgctagattgacgcaagcaacttcctaacccaaatagtatatcatgacagtcaagcaacggaactcataagatacctgtaccgttgccggccttacctaacacgccaattatccacatttgatgatttcagtctgaacaccgaatccacagcgcattctcttaaacaaagccctaaacaacacaatcgtctacgtgttgcaatggcaggatcgattcctgtcgaagtaggaaccggcagttcaccagcatctaccaactcgttcgatttccatcgcggaccactcttataaaacccacacaggtcaaagcctgaaatcggcgaaaagaagaagaaaaaaggcagcggcaacagaacactacccattccgggaacttcctggcaagctaggtggtctggtcacacgtcacgtctaagcaaacacaagcaagtttgaa

SEQ ID NO: 10946 - DNA, 688 bp, Zea mays
caaaaacaggatttaacagtatttctggagtttaatgtgtgaacatgcatcttcggactcaagtcggtatcacagcagaccagaataatacgaaggtttatacagcgccgaaggtgtgagcaggaaagcttcggcatgatagcaacaaaatgaaaccgacttaaagatgaaaaggctatttagacctcgatagattacaatagaattattatcaaatgtaaagggcatgaatgtaattttgcataggctgtgtcctgtgcctataaataggtgaacagtaccccgtactgttcacggggatctggcattcacttttgcgtcacgcttgtactttcatctccttcaaattgaaggtacatttgtaattcaacgttatttctgtttatacatgataataatatataattgtttatgttgttcattatattccttacaattcatccttcgtcattatataatgtatttatgaaggtacgcccttcataaccttcgtccgaaaaccattatatcctaaggggaataatgcttcgaaggacgaaggactctaccgattaacattttctatgttgccttgttcttgactcatagcatttgagaacaagtccccaacattggcgcccacctccggtgaactcacttccacactcttgagttttcggaacatcttcggcgatcataaaccttcgtt

SEQ ID NO: 10947 - DNA, 1500 bp, Zea mays
agcatgtatgtcaaaataattttgatagctagcagttaaccttgcactgcatgttgggacatggcccatgggtattatacttcacatgaatgatgaagcagcagtgagcggataatgcagcatggttttggattctgccgactgttgcgcatggatgttggcgttgcgcatcattttttgctccgtcagcagtggctagggaggcgattccccggtgccgtgtgtttagaactttagattaggtgattgtaacttacaaaggcgtccatacatacacaccatccatgtatcccacggtaaatttcgaagactgtatgtataagtacatatttgttatacgatggtaaagacaaaagctatgtaggatttgcgtgctctcatgaaactatgatacgtggctataattacttccggttcccgctgaaatcgctagaattttccattgactacattccatcccggtatctcggtcggatcccatgtctcgatcgtttttacgtgattggaaaactgaagctgaagcggccagccccgatgccaaggctaatgtgactttatttttctttaacagactgttacagagatgtataagtttctttgacatggtaacttttttaagaggagagagaaatgggtcatgataggggtgtttaggattgccctggatttcagctcttggagctgcagttcataatataaatttattaaatagttttaatttcttattttaaataataaataaaataacttatctaaatatattttgaaggtttataactctagccccataatttgttaagcatctactaacctgtgtcaccaaattcaatatattttttttggagctgaaacagtctcaaacacccctaaccctctttggctgcaccattgagaaaatcaggtttactccaatttcaccagaaaaaaagcctggttacgcacaacccttctcttgtacataaagcatcaattttcatggttctataatcgtcatgcttctctatatttaaatgataaataactaaaactatatataaataagaaatgaaatcatggctattggctctaacgctatcttcaacagcttattgatccacatactcatatttaaacttcactctgcgaataatagagattataatataaaacaatattttgagtaaccatatgagtgaataataatgttttgagtgaccatataagggaattgaatattcaaacttgtctagccaacaatacatgcatcttttgtactttatatttataaatgaaaaccgagggcaccttgctagtagtagtagcaattggagcaaaagaaggcccaaccagcacgtcacactgctgcgaaggacaccaggcccgccgaaaattgtgtgaacgcccctttcttctaccccaagacgaactcggtgaactctttccggttcgttcccctacgcccgtttctctctcgtcgcgcaacatcagagcacaagcgaggaacccagtccagtcccggga

SEQ ID NO: 10948 - DNA, 135 bp, Zea mays
gaaacgttcytgaaccgccgctcggatcgaccacgagtctcgtctcggcgccccctaacaatttctctggagggtgaggacaaattcggctgtttcgttgtgttgattttctcggcgccgtgcaggtggtacacg

SEQ ID NO: 10949 - DNA, 1500 bp, Zea mays
tacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacracacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggcccggcgccgcattggagctgcagccccgtttcggcacggacacgggacacctcccgttagggtaagcccggggcagtgggtaactgcccagcgccactactccgaatttaccctccttttatttttgaagcttgggagaggggagaatggatggatggatggatggagggatgtagacgcgtgaaaaagatgcgcgagaccggcagcgtgtgctacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgcc

SEQ ID NO: 10950 - DNA, 1500 bp, Zea mays
aatcttattcatataccttttactatttgcaaaatgtttttaaaagaattttacaaagaatttgcaaaaacaaaactagtggtgcaagcgtggtccaaaatgttaaaatgaagaaagcaatccatgcatatcttatgaaaatgtaaattggtttaattccaagcaacctttgcacttaccttatgcaaactagttcaattctgcacttatatatttgctttggtttgtgttagcatcaatcaccaaaaagggggagattgaaagggaaatagggtcaatcttttcctaaatgattttggtggttgaattgtccaacacaaataattggactaactagtttgctctagattataagttctacaggtgccaaaggttcaacacaaaccaataaaaagtccaagaaagggttcaaataaaaaggagcaaaagaaaccgaaggcagccctggtctggcgcaccggactgttcggtgtgtcgccggacagtgtccggtgcaccagggtgaatccactcgaactgctcagcttcgggtttctggaaatgccactccgctataattcaccagactgtccggtgtagcaccggactatccggtgtgccagcgtagcaacggctagcgcgccaacggtcgtctgcaaaagtgaacagtgaacgctacagtgcggactgcgtgcgtagaagtcagagcaggcgccagaaggagtaaaagacagttaacagtgactgtctggtgcaccaccggactgtccagtggcccatttgtcagaagctttaacggtcgaacccaacggttgggtgacgtggctggcgcaccggactgtccggtgcgcccgtcgacagcagccatccccaacgacctactttggtggttgggggctataaataccccccaaccaccacacttcaaggcatccaagttttcagccaacacattcaatacaagagctagtgcattcaatacaagacacaaatagagtgaatcaaaatctctccaagtcccaattccactcaaagcaatagtgactagaagagagagttttgtcgtgttcttttgagctcttgcgcttggatcacttttcttcttcctcctttcttgttctcaagatcattgtaatcaaagcaagagacaccaagttgtggtggtccttgtagtggactaagtgtcccgtttgattgaagagaaaagctcactcggtctaggtgaccgtttgagagaaggaaagggttgaaagagacccggtctttgtgaccacctcaacggggagtaggtttgcaagaaccgaacctcagtaaaaacaaatcacctcgtcattcgccttatttgcttgtgatttgttttttgccctctccttcggactcgattatatttctaatgctaaccccggcttgtagttgtgcttaaactttataaatttcagagatgcctattcacccccctctaggcgactttcaactggtatcagagcccggtacttcattagagcctaatcgctcgatgtt

SEQ ID NO: 10951 - DNA, 442 bp, Zea mays
tgtatgtgggctaaatattctacccgtgggtctgttattgggcaaaaatcttcacccaatgggtaaacgggtattagaacattccgcctgcacccatacccgttaacccgtgggtataaaatacccaatataaacttagcccaagcatgaacttggactttagtcatccatcttttttactatttaacaaaccataatatcatagaaggcttaacgacaatttaatgaccatgtaatggaacatgtaatgtgctatgtactactatcttagtgttactattttatccaattatctttggtgtgttgaatggatggttaaatgatgctagaaaattttgtaattgtatttatatggatatacttgacatttgtatagtataatattttgatacatgtttaattttcgtgggtacaggtgacccgatgggtgacccatacccac

SEQ ID NO: 10952 - DNA, 445 bp, Zea mays
ggtaaatccatacccaccaggcctagtttggaagcccacttctccggggggattcagcctttttcccggcaaaaaaaccccgcgtgagaatgggccacgagtaattttgctggcctgtttggagcccggttccccgggtcagtgtctcccacgaattgccaaaacaccagagaacgctcccccgagtcgcgaccccgggcaggtttccccacggacagggcatccgaccgcgacgaatctctggcctctcaccgccgccgtgacgaatctctggcctcccactgccgccgcaacgtccagctctgctctgctccgacgtccagctctggcttgtcgtcctccgcgcgtactccgcgctactggatctctggcttgctcgtacgggatctctagcgcgtacaggatcgcatgacatccactgctcgtcctccgcgctattggatct

SEQ ID NO: 10953 - DNA, 355 bp, Zea mays
ggtgcgcctgcatgtactaccagacgtacggcaccgggtggacggcgggcgtgcagggctccgagaccttcaccttcgggcttgtccgccgccgaccaggcccgcgtccccgggcgtcgccttcggctgcagcaacgccagcagcagcgactggaacggctcggcggggctggtggggctgggcaggggcagcctgtcgctcgtctcgcagctcggcgccggcaggttctcctactgcctgacgccgttccaggacaccaacagcaccagcaccctcctcctcggcccgtcggcggcgctcaacggcaccggcgtccgctccacgccgttcgtcgctagcccggccagggcgccc

SEQ ID NO: 10954 - DNA, 316 bp, Zea mays
gatcgttagagttggatcttgtaattaatacgaaatatatatatatacatagaagcttcagtcttagcgttagtctcagtcttagttagtcttagttagacagggtagtttgctatatcctgtgcatttatgtttgtcatgatgaactatgtttggtttggatctttgtaatgattgtcaccagagtgtgggtatcccctgcattttggtttacctattatgttaatggagttagttatatagttgggaaaccccttttattccactttcctttctatctgagaagctgtgtggtctgtgttggagatcagtgaag

SEQ ID NO: 10955 - DNA, 428 bp, Zea mays
atctttcggaagatcacgacgagtcagacagtcaccaaagctgcagagcagaaaacagaaaagaaaggaggagagaagagtatccacagaccaaaaagaaacgaataccacgcactaccaggtgcgtgggcccccaccataaaaaggacaccaacgtgagtgacgcgtgggccccacagtggccgtaacgacatctcccaaaagcatcaacagcaccttttccttgctatggtggtctggagggaaaaaaaaagatgaatagaaaatggtggagatataaaataacagagcagccgcaccagcacacctgccgcccccctccagcttttcttttgcgcagccaccctctggcttgccgttaatttctttcccgtttcactcctcgcgtttttacacttggcccccaatccaatccccgccaggccgcc

SEQ ID NO: 10956 - DNA, 776 bp, Zea mays
tgctgctggtaaatattttataatgtttatggctttataatgtttaaacttgtcctaatagctgacacatgacagactctaacctttcagtttccttggaaagcagtaggccagcagccacaccccaggcgacagatggcgcgatcgtccacatggtggaggtggatagcagcaatccaggcttttccagtttggttccaaggcggcctccgtgtttttaattttacacacacatatatacatcctcctctcgttttcttcggccacttcttttttcttcttcttcttctttttgttgcacacatatatgtattccagggaaatttcccttggtgtgtgccatatacatgcatgtggaggagacggggatggagagctgtgagctagtcccctttgtactacagaaagaaagtgcgtgctgcccttatttctggaatgaaaaggcagaatgggaagaggggggaaaaaggggatagatagatgtggaggttgagggagacccacaccaccatataaacccccctcttccaaactagtcacacatggcacaagcacacagctcatcagttcttcttcgtcgtcttggctagctgcctagctagctagctagttcctcactcctctccgagaaccccctttttcatctctctctctctctctctcggtctcgcccagctcctttcgatgttatcgtctctgctggcctcgcaactcgtcgagagagactcgtgaaaaagaatccagatatagctagagagaccgagagggcagctagc

SEQ ID NO: 10957 - DNA, 150 bp, Zea mays
cgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcgggg

SEQ ID NO: 10958 - DNA, 1500 bp, Zea mays
aaggtcaaaaaattatagggcacactctcaaccactttaaatatactacatcgtagtggcttaccatattatctatatttaaagttttactattggagtagaatattttgttagtattctaaatccaataaaatttacccatttttaaattatagggtatttttatagatcgcgggttggagatactcttacaccttcccaactttctatcccttgcaaaaaaaagatataaacatattcataaaatatagaataaaactaaatagaccaatgaaaaaagtaaagaaagaatggagtgagaaaataaaatgtgaaagagaaaaaggaaaaaatgaatggacgtgatcatgagttcatgaccacggatgaatcactcgagtcccaagcgcgcagcgtacgagaaataggcaaaagaaacaaaatgtcaagtctatatttgtggtacatgtgaaagcaaaagctagtgaagaagacacgtccgtgcacgtcgcgcgaaaagtatcgttcggccggagctaatcaccgcaaccgtcttcaaggcatcgagcacaatcgtgtccgttaagatgcggtttgtcgttcaccgcggcgcgacgaaaaaaaaaggaaaagaaaaaaaacgggacagagaaaagaaaggaacgagtccacgcatgtgcggtctatcgttctccccgtccgaatcgcgcaaacgaccgcgcaggcgcagatggaattggcgaccggttggcgcgtcgtcggggtcggggggcaatgcaatacgctcgccacatccctaaactttcgaaaaacacgcctcattactttgtttggcggaacttcgttaactccggcaacgccatgcgttcgttaactccggcaacgccatgcgtgcctaacaatatacaggtgcctagttaaggaaacatgcagatgaaaaaaaaggagaggtgagctcgatgcaaaccttcctcgaatcaacgaaagctcacgcaatggtatgctcaattcactctccttggagtttcttgctcccaaagtcccactcccatcccatctcgcttgccgagtgccgagcaggggcagattggcagctggtgaaggcccacatgtcacatcgtgcgggcacggtggccgccgccgccacccacgcaaactgatgattactccgctcgatgcacgaaccggagcagggcacattggatcccccgtctgcccgaaccccaaagtccaaccaaccatgaatagcacactcctataatcctacccgcctcgcaagtcgcaagcccgttagcacggcgaccaataaagaactcgctgcccccacgcggccacggccgcgcccacttcgccactcggacactgctcggccggtcggcccggatcggtcgcacggacacgccccgcgcgtcgcgggctctcacctctctcctcctcctctgcctgattggcgtgcccccatgcggatgcggtggctccgacccagctagcccccaggctggggctgcgcccgcggcggcg

SEQ ID NO: 10959 - DNA, 1500 bp, Zea mays
aagattataggttcaggtcgttttctcacgtaaagttcagggtccatgccaagaccaaagatagatgatccaccgcgcactcaaagccttcagcaagactttggcatttgggcgtctccataccatagggctgcacggtgcccaggtatatatatctgaacgggcccaaactgatgcgcggcgtggataatccaatccagctttggtggccacggcccgctctatatataaactgaccagtcaacagtcagtgcaaccaatcctcgctgtcattagctagaagttgggtcttgtctcctttccttctcctgtggtgaccacagagacctaactgtagatccgcttagtctgccggccctagtatatagtgcactgtttgcgctaccgctttagaaagagaaacaaataaaaagagggcaggcaacaaacgaatagcttcggataaaaagaaaaccagacgcacgcaatcatctcatcctcatctgagccagcgcaccaaccaatcgattggtctaaccggccgctgctacaggacactcgatcgcacagttcttcagcgaggatcgctacagaggagaatctctggctccgttggttacttgcatccctccctctcccgttggcagcggtttggccgtcgcattccgcgccgctcttcgccggaccgatgatctatctgcctcgcgctaaacccagagcgttgtccgcgcacgtccaccagcagcagatcgacggcgacggatgctgcctgctgctgctgctgttccccggggcgaccgacgcgtggatgtatgcgtaggctgatatggccctcctcgatctgctctgtagcctccatcccttgcttgcaacggagcttgccgcatctatgtagaatgagtgaatgacgatcggttcagccttgccttgcgagagcacaatcatttcctgcgcgatgctcatcagtggcgcgcgtacttgtgcacaccgtgcaggccgctggagcaggaacacacacgccatcgggtggccttggcacgagccccgaacgacatgcatgcagcaagcgccacggtccatgctcaaacaaaccagcatcagcacgtatacgtatatatatatgttactgctgctccatgcacgtactgttgccccgtctcaacaaggtgcagtgcaggtgcagctagctatatataaaagcgagcagctcggacatacacatacccgcccgcaccaaaaggacccaaacaaagtccagccagccgagctcaattagctcgtgcgcgcaccgcccagctccttcccgcttcctcctcgaccgagacctctccgtgctcagctcgatcgcttgtgcttagctcgccgctcgcttgccacacccacacggccacacatgagctgctactagcgccgcatgcagcagctgccggccggcctacaagcggagggaccggtgacggtgaggtccgttccgtcgtccgcgcgtggccagggatcgacgacgcgcggcggtatatatgc

SEQ ID NO: 10960 - DNA, 172 bp, Zea mays
gctttcccccgtcctcccttccctcgatcccctcgccggaaaagatcccattccatccacctccacgtcccggcgcaatcagagtttccggcggcaaagcaggaaggcggaagcgaaaggaatgttgcacctttaagtagcgcggcgacctggtgtttcttcctggccggcg

SEQ ID NO: 10961 - DNA, 1500 bp, Zea mays
tgtgacttgctattgttcctttagaaactactttgtggctatttcagatccactattgtgctattgtgaatttgtgatgatttctagtttatgagctgtaactgtaacagctgtttggtactttggttgtttggtattttgtaaaaggctaacagctgtttgtaacagctactaaggcgtcgcctaggcacccgcctaagtcgcctaggcggtcaggcggtggctgggcgcctagttccgcctagccgccttttaaaccatgatttacagttcacaaaggccacctctgtaatgtttaccaaaaacagctagaccttgtttccccccaataattctgatgtttaaaaaaaagatccagtgccgaaggcttctacatgagtggagtctagaaaagagataaattggcaagctttcctctgtacgtggagatactgtttcgaacctacgccatggtgactcattgaggttgaaaagttctactgtttaggcaggtttcagttttacgttgtgtccaataaaattgtagtatattttcttacaagggtggaaagttgtaatttactgacaaattctgagttagttattattcttttgtgtttggattttcattttgaggtgatggtatctggagttatgaaagaaattgttcagaactgccagctgataaacatcaatcatacagattgaaacgagcaaacgaggacacatgcagtggttacaccttttcccaatttacaaggtgttccgtcatttgcagcaatattgctgacctaggctcctagcattttgtgctgttgtacgcatatgcagctgcaagtggcccctgttgccctgtctcttgctctctattggtgtctggcaggggcagatgattacaccacatgtggggagatgagatgagccccactatcatgtgagtattgacccttggagtcgtctatatcttgtaggcttcctttcttgcctttttgccgacggaaaactggagcgatgattttttttactaccctttttaacagctgaaaagtctgatggtgaatctttagaagccagcaatgccaggggagatggaagttgatgtttgctgtgtgctgaagagataaccttctttggttgagacgtgaggcagtttccaagtaaccagtcacaatcttccacgtcgcctccctcttggttagaaccctccttataatacataaaaacagacaccttcttcattccagttcaataattgaggttccactctgtctgttccctccttcctgctgttacaatgattgttactattagccagtctgagtaatacatgtgcatttggtattgtccttgtttactagtagctaatagctgttaagatctaaaaccagccatccgtcttctgggaagaagaggtatagtctcccgatcctagttctgcctctccagttgcatccttcgtcactcactctccctacatcctgtcacgagactggtgttcagacctgagagacctttactccc

SEQ ID NO: 10962 - DNA, 252 bp, Zea mays
acccctgacgctgctgatcattcattaatatccttgcttgcactctgttcttcagttaatttctgagttttccaaatgattagctgaccgacttttgcaatttcaggagccttacttcaattgcaaaagggtgcaagaatctcacagatcttgttctcactgattgccagttactaactgatagaagccttgaatttgtagctcgtaactgcaaaaagttagcacgttctgaagatcaatggttgtcagagc

SEQ ID NO: 10963 - DNA, 190 bp, Zea mays
cttcatgccttggaccaaactgatggagacagatccatagaaaatagtgcatggctttacattttgtttgtgttattttttcatagctttacaggcattgtaaaatgtaatcttgtttcaccttatcctgatcattctcatgtttcctacttgtagaaactaaggggggataattggtgtaaggaacaaa

SEQ ID NO: 10964 - DNA, 1083 bp, Zea mays
tgctttagcttgggagttccaaggttcaacaacccctgacatcttcattttttatctcaggaaaatttgcaagctcagccaatctctcctgcgaaggaaattgcatcgaaaaccccgagcggcatctggtcgctttccaaatccttccccacggaaaatggaaacacaataccctctggtgctcatttagacttgttaacccaaaagcacaaatcccgtgcgtaatcagtgaaatccgcagtgcagtgcaggctgcaacgcaatcgcaagcggctgatccgcgattccatttccatcaccacggcaatgcttcacatcagatcaccccaggataaattaataaaaatcccaagcgcatgcaaccacctgacctgattgagcttatcctgctgaaaggccaaaaagaaaacagagagggacggaaatcagacagcaaaagcaagcgcacaagccggaaatcagacagcaaaaaattgcaattgctctgagcaagacaactaagcgcccttctttactcgcaaagcgagtcctgcatccaaaagcagaattgcttcatacacttgagctcattcattcatgctgctgaccgagaacccagaactgcacacacatacccttttttagtttttttttattacttcatggctaagcatcaagctggggctctgctccaggatgtggcatggtgttctcagctgctgaggcaattacttcacggcaggcaaggcaaccataacatgcatgcgcccgcgtcaggccaggagctaaaagcttgaggaaagtggcaagaggcgcctgcctaagatttccaagaaccgacacgggcattattaaagacagaccgcgcatgcacagtcaccagggatcaaaagggtgacagtctaagggaagaagaagaagaagaaaaggagaaccactgctcgcgctttgcaccagaccactagctccgagaagcggcaggcaggcaggcactcgaacaaatcagcagagccgggacacatgatatatatatataatatataaaccgagagagcacagagccaacccaagagagcagctgagcagccagccgtggaggaagag

SEQ ID NO: 10965 - DNA, 664 bp, Zea mays
ttggtacctattgtaatactgatgacatgtgatcatggattgtttctcatgaatactaaggctttttgattctgtggaaagtgattttatgagagagatggttagtgattctctaggaaaaactctattgtggaagtgattctatggaagaagtgaatcaggataagctaatttttttcggttcccgcgcccttagttcatttcagaatcagcctagaatcactttacttctatgtaaagttgtaactataactatcaagctctgccaaacaggctgtgcatattttctttttgaacaaattctgttttctcacctctatggcagcattgatacctacatttccaaaaaaaagaaaagaaaagataacatcggatgacaagctaacattttgttttatagtccaccagtgacatgaggtttcaagatcttcccagtggagtaagaggtttcttcagcacacatgttgtggatcagtgccttgtttcttcagaacatacaatacctagattttctgtgaatattgacaaccactctaattgggatgagatggttgattcatgtgctttgcagttatcacatgacttgattcgacatcatgtttaatttttgcatgatgaatctcataagaatgataatcatcaacaaaaagaagtgtttgcttcc

SEQ ID NO: 10966 - DNA, 337 bp, Zea mays
caaccaagcaagggctgtctgactstgtcaaaggcccagcakagattgttcacacaaagtaagcgagcgaaccgaaraagggaaggacaatatagtcacgtcacgtgttaagtaaaaaggaaaaacataaaaataattaaaaaaaaggttagagtactgttttggaggaccaaatcacttataaatactattagacagaaggttaacttgtgagtattataatgagaagcctgttaaaaggagtaccataatascaaaaaaactcctctggagcatcgaccgactctccacctgaggaccgccagctccttcctccgcctcgacaagcgttggagag

SEQ ID NO: 10967 - DNA, 95 bp, Zea mays
agacagcataaccttcaaacttccctccaactacccagcttaacttgaaaaacagtgcaacagagaatcctaatgttgtaaatcaggttgataca

SEQ ID NO: 10968 - DNA, 1500 bp, Zea mays
tgctaagcatatatgcatgtttatactagttagattagatattgtgtgtacagtacagactgctgatacaaccatccaattactcactaattctattctggtttaagcagtggtgcactagtacgagcagcagcagcagcgtcgtgaggtcacaactcacaactcatgacgaaggggatcaagcgaccagacacaagtcactgtttattaatgcgtcatttggagcagcgatgagacgcttagtgatcttgtcattgaacaggctggatatataaatggacacacatgtgagtgtgtgtgcctttgtaagcatgtcgatgtaatcttttttgtgtttttctcttggcctgttggcctagttgtctttaaaaaaaaactgagctgacagaggatgtctgcagggccattgcaataagtgataattcagtgggagacggtgtgttggcagcaatgtaatgatttctagttagtactaacatgaggaatgatgtcatctcaccaaatttgagaaatagactcacatcttagatgaagtgatttctcaaaccaaacacttcctaattattcaacctcaggggctatgagattctagaagtgttagatatctcaactcttaaccatctcgtcactgtttgtactctctctggaatgcgaattgtaactttcttgttgacagtaagtacgaacgaccagcttttctttcttgatactagctagattggtttctaccattttctggtggtgattcagagactggatatggaagctatggctttaaaacatagaaacggagatgcatgatatacagtccatcgtcctctcgatcagagagagtatcctgtctaaaaggattcagaggattagtttgtacaagaacaggacaggtttccagagacgaagcagccattgaccggacgtaatctatctccaagccctcgtagaagccatgaactgcaaaagtcagaagaagcagctgagtcagtaacaattaatcctgatctgattcccagccgaagcttctttctgtccctccaacggaatctgtccatggttcatcaaccatgcgtgtgctgccgtggcacggcgtcgactcggcgcgaatcgacgccgtctgcacttgcctctgtgcccaatcatcgtcgctactgcacgccgcagctgcgaatcgatccacataaaacaactccgtgtcagtaagcatgcagaagccaactgattcttcgtctccttcgaaagccagcttgtgatttgtttatctttaaccctttcagctccagctccagcctagctaatactaacagttatagagctgagtgactgacacccattggcggctggactattaatttatgcttggcgtttgtaatgctcggcctataaatacgcctgctcagtgatctgatgctccttcatccagatatatatagatagatagctttcttgttagcctcgaatcgcgatccagtagctcatcagctgattcacaagtgcaagcatttg

SEQ ID NO: 10969 - DNA, 123 bp, Zea mays
tgaaaggtgagtgggctttttttgtggtgagcgggcctactcatcacagctagccagcccccacatttgcactgtttcgcctgatagacttcccccaatcttctcccatcgcgagccgccccc

SEQ ID NO: 10970 - DNA, 142 bp, Zea mays
attcaaataaatcctgtgactactggaagtcctctgtaaggcctatcttgctctgagttattgctttcttgtcatgactattaatagctctagagaggtcctcatcatctagtgctcatcaatcatatttcctctgctgcaa

SEQ ID NO: 10971 - DNA, 209 bp, Zea mays
cccctgcacacaaaaaatgtatttagcaaagatgctaaggagcactcttgaatgatttcacaggaaggataaaatgagaagagtggaaaccacccaaaggtgaaattcgtactgtccgagttgccttagatacagcgcagtaccacattgatgttaccgagacagcagagaagggcacagaaaatgtgtatggaacatttaacattcta

SEQ ID NO: 10972 - DNA, 253 bp, Zea mays
cgtgttattatacggttccgttgcaacgcacgggcactgatctagtgagtgtatatgttgcaatctctacttttgacctaacatccggcctccacggctccacccacgagccagtggaatcttaccgattcggcaaccgtgctaatcgatatccgtgcaattccacctcccgaaccgaatccctccaccgacccaaaccctagcgcgcacccttctccgtcgtcctttcctggcgcgcgggccggtgtcggag

SEQ ID NO: 10973 - DNA, 514 bp, Zea mays
ttccggatacactccatagtgtatgcaagcaccaaaaattcgttgaactttgccaaatacaaaaagtgtccagcaagcacatttgttttatatggggagaaaaacctcatctatccatatggcatttggccatttttatcattcgcaccagggacggaggtggttgtggcaacaatcaaatctatttttgccttaaaaaaaactactggagtactattattttagatttcactatgccgacgctgcagcaagtcgctttattaatatctcgaaaaacggtactgtattaaataaggccggaagtggtcgatttaaaaactaatcccaagaccgaccctttgtcctcctctctcgctttgctctctgtcttccattcagatcccctcgtccgcgatcgtcgaagccaggccagggccaggccaacaagcggccaaccaaacacagctgcgcaacgaatcccacagcccgaggcccgatctagcgccggcgacttggggtccgccagcgccccgcc

SEQ ID NO: 10974 - DNA, 819 bp, Zea mays
gtataaatgagagaggggcgcgggaagaaacctgtcaacgccgcccgccaaccaaccctatagcgccgccgtcttctcgtcgtttggaatgaaagaacaggcaggtcaatcaaaaggtctgcgggcgagaagcaaaaacgcagcacgctagtcgccccgccgtccactggcaccggcaggccagcgcgctcgtcggctccctcgcggtctctctcgccctgctgcgcgggccgcggcatgccgcgccagcaggcggatcctgtacgcgtccacctgtgcctgtgcctgtgcctccttaattccaagtggttgagcgtcctccagtaaccaccatcattaataggccaccctccccaccccacctctcgcccttcccagttgcttggccccacctgacatgtcttggtcttctgaattctgatgatggagctcccagtcgtcaatcatgtcgtgtctggctccctcggcagcagggcaagagtagccgccgtaacacggtcggattacgctgatgttacggagcagtggtatacgggtttcccactcgctcgtagtacttgaaccactcgtgtacggcatacggttcgaagaagagtggttgcctcgcgtgcctacaaatttgactgctccggcagctggatacgccacaagtttcaacgggcaggtgcttccattcccctccgtctccctatatatatttggagttgcccgcgtgaccaactcacacataagaggcgacatcacatcgcgttccgccgcctcacacgctagttggagctgtagtattagccaaccagccagcctccgatctccatccat

SEQ ID NO: 10975 - DNA, 1438 bp, Zea mays
ttggcactagttttttccctaggtggaaagaaaaacatcaggtatatatatacatctcttacattatacggccatgaaatctgcattgtctagagccttgatgctgctccactttgcgctgaggcatcaaggctcctggctctagacaatttaggaggctttgctcgtaaattcagccaccacacactatgcgctgaggcccaagccattttgtagttttatgaacccaatactaagactttctctggatctcgtgctgtgctttgttctttccctctcaacgtttcaatgtggataacctatgcaggtcagactaactttctccgggcatggccctacccttcacttgccgcctccttattcaattgttattcaggtgatagaaactaaagtttatatcctataaagaagcaatcatatgcgttaaaaaaactgaatcgatgctgttaccatcgttgggatgtaggaatctgaagatggaagctggcatgtaccaacaacaacaggcgatgatattgaaaagccacggcagtggttgtgcactactagaaaatctttgaggtagatgtgatttaattttggcccagtcaagttgacacagaatggtgccaagttgccaaccttggtgggaactgggaagggtggtggcgtgacaaaccctgaaaccagcaaagcttaaatgcagcaacttgttggcccgaacgaaagaaagctgattggagtacaagtgatgaatatgagcaggccatggatatggaaagccttttgttgtaacatcgtgagctgtttattgctagcccaggttattctagagtagtttgagaaccgtggtaaggtaatttgcttcatgtgagttttacttttattaaatgacgtgccatgccagtgatttgaaggatgtggcaggcaagtaatcaaagaaagagatgaatgttatctaatttgtcattagcacacatacctaacctctggcgccccaatggtttctgacggactggtgaatggtgattgatgagggactgcgttgcaccgtgagttttggtgttaaattttcttaaaagtttaattaaatttagtatatttatagtaatactaatacgtagtcgttagactaaacatggaatatagtttacaactttacatcgcataggatatgtttctttgtttgattattagtggaggcagctggccacgtgggtgacaattaaactacaaaactcgcaaaaccgacagatcggcaagcatgctacgttgcattgcatttgcacggaaaagagacgctttttaattcggcaccgacagtgccagctgcccctccacgggaaggccagcaccgtcggcgggtcaaccacccacccccgcctggccgcctcctcttgaaaactccctaccccggtggcccggtcacctcaccttcacccaccgcccggcgcccgcc

SEQ ID NO: 10976 - DNA, 1500 bp, Zea mays
tggattaacttgaatataatgtctgcctttcattttcattgctgcacttgttatatgttgttcaaatcgttttaataaaaggtacttttctttttcaaaggattcccttactgtaccgactacttataaatgtatcctttttttctgtttcaggttggaagggtttgctgtatcatgcattttttgtggataatcttcattttctcttgagtcaccgattcttttgttgtcttcaaaatgtcgggcttgctgaacgtatgtacttgcacaagtatacttgccattgggttttcttgccaccattatgtattcatgttgaaaggcaggcctggtgtagtggtgagagctgtatcactgagtcactaggtcatgtgtttgaagcagcctccgcatttgtgggggaaggattgcttcgatttacccctttttcagaccccactcatgcgggaccctccagcacttggtctgcccattatgtatttatattctttccatttgtttaccacattgggtctagaatggatgtttttctttggtgaaagataaatttctacaactttagtcgtcagcagacaaatctttttagagatttcatgcaagagttatatgaatggaatcatcatcaaaactacattgccagttgtcacaacaatatttgtaatgttcgatatatgttacttatattaggtgaagtcaaatttgggcactgttagacagccatatttttaatgtttgatatactccctatgtctttttgcctgttatggcattgtactgtggtccacttcggacctttctctctttcaatataatgatgcacagttcttttgcgcgttcgagaaaaaaaaaacaataaaaaatccggttaaccaaatgtccaggtcgtggcgctatgcggcaagggctccttcggactcggcggctcctcaagcccaaagttgagtgggtcgagagcccaaattgaagtggcccgctcgagacaagcaggatagacccgctgtggtctgtgagaccacacaaacacaatggaatcaaccgacttacatttcatatattgactcagtaaaaaatgagagaagactgtgtttcggaaatcaaccaacttagatttcacattgactcagtgcccaaaagggtactcaactctggaacgaactttcaaaaggtgaagtgggaacaaggtcactacacccaaaatagtagcgtgtatgtatcttgtggtacatcatatagaacaatcttgtgtagggtaaaacagggcagccagtagactatttttcccccatccgtacggcagagggacccactctttgtacctaagttacaattacatagcttacaacatatggacgttgttgtctttcgccattgccacccgttggcagagaagaatgacgtggacatcttggatctttcgttctcaaatcctctgcagaatcttcggtggacgtacaaattattgttggtctcggagggacttggaccttcgtagttcatagt

SEQ ID NO: 10977 - DNA, 1500 bp, Zea mays
gtgtcaagaatggagcatctgggaggattggatagatgcgaggactagaccaaatatgatggaagttgagagaactgctcagggcaattttagcctatccaaaccttaatttatatactttacagtaggtgaacattaggtataagaggttataaaaaattgagagggatccttctatggatacgacagcgtcggaaagaatgagattggatgaatagatgtgaggattagaccaagtaaaaggacgagagtcgatagaactagactaattcgacgaggagacccataacatgattgttttagcctatctaaatcttcatttttaaatatacttaacagtaaataaacataatatataaaaggtcataaaaattgagggggggtggcatatggcccactttgtcccccctctgcgtccgcccctggtgttagagcagcaaggtgtcattatcttaccccgatagatcttgtacgtgtgtcggctaccagacgaccttcaacaggctccgtaacgacatttatgaaatttttattattatgcttgagttatgaatttttaattattattatgaattatataattttattagattagttacatgataatcatatgtatttgaattttaacaaagcatcatgttttatgtcaattaaaagtttataaaagaaaagttgatgtaacgatgaaataactgtaagctaacaataaggataatacaataaaacgttatgatagataaggtctaattatggttaatataaaacagtaatgtgatggtagatatagccgacaacgactaaaaccagtcttataattggaaacagaggaccgtgtgtttgaatatggttcaaagtgccaaattgatttcttgtttgagcttacgatggtgaaagctaccattgacacttcgaagccgaaacaaacttggctaagtggcttacttgcctagcagttgtatacttgtatagttgtatcaccttctggattggattggactcaaaagaaatagccatggccagcatggcatgaaaaaaggacgggaaatagccatggccagaccaggaaagtatctcgcctatactactgtgccgcagtgcatcttctggatcgggctcactgacgtcatgcactcacatggagcacgtcagatcagatagtcacgaatgcctggcggaacggaacgagaaaagctcgcgcgggatcggctgttgcgtccagctttcgcgccgcaacacctgtttccgaagcaaagcaaaacctctaaacagctgtcaccagccatctaatccctcatttacagcatgattagcttactctaactacggtgcgcgcaaaaaaaatcaggcgtttataaacggccgcacacgaagaaagtgctcatcacagaccgaaaaggaaaatagaggcgagacaaacgagagcgagcgagagagaaacagttcgagctcaccccggcgagagccgactctcaagcgataaggggcgtgggcgtcgtcggc

SEQ ID NO: 10978 - DNA, 731 bp, Zea mays
gccctcgaaacagagcatgtcaaagttgtcatcacacgcttgtgttactttttcaatgtggtttcacaaaaagtaatagctttagaagacttgcactatctaaaggcatacatcatcgagactatgtgcaagcttgaaatgtgttttcctccatcattttttgatatgcaagtacacctaatcatacatctcatggatcagataaaaatattagggccactatatttacatcatatgtttcagttggagcgatacctgggagtattaaaaggttatgtgcgaaatcgcgctcacccagagggttcaatcatggagggatacactacagaagaagtgattgagagcacaaacatcgtttcagcgaatggttaatggacaaaaacatcccattcggagactctttggaagagaaaacaatgaagaatttggcttctgggccatcgtgttttgtgacatcatggcaagcatatgacatcaatgggtacacattctacactaaatcaaaagacatgaaaagtgttgcacaaaatagcggtgttcgtatcgatgcttttgacctacagggacagaagaccacatattttggattcatagaggaaatatgggaacttgattatggcccaagcatgaaaatacccttatttaagtgccaatgggtacaacatcccgtgggggtgacagtggataactacggactcacactggtagacttaaagaagtaggatataaag

SEQ ID NO: 10979 - DNA, 1500 bp, Zea mays
cacgaaaagatatgttcagtatgtagtatggaccttcgtgcccacctcttctttacaccatgtctggtacgtcggtccaacacgatctggtaagccgagatctaacttttagcgtgacacgcaatattgtttttgaggccatgctatcaagtatcaaagtcgtggcacatatcatactcatgcagtacacttgtgtacatgactgaagttggtaaaaacaaatctacttaggtcccctttggcagggctcctactattctcaaaacaggttcggctatggctcctctggcttcttggcttctctagaagagtcagagccgttttgcaattcatttgataaaacagcttctgacgaggagacggtggcagaggctgtaatttcgtaaaatattattgtgtgccggatagaaggagccggcagaagcttattttctcgtgcttcggcttctaatagcaaaaacggctctggctctttgatggctctcggtgaggagccgttttttttaagaccgtttggtatggcttcacgaagagccagaaaaggagccaccgagagagccctgagcgttaggtaatagatcgagattatgatataataaaccatggcctgcttaacggtttctagacatcttgtcaaatgccttttgcattaaaatggtgtttccatatgtgtttcctaaggtttacaagcttcgcccccaaatttttttctctcttttttttaaaaaagatcttgtaggagtgttttctctgcttcctctgtttcaaataagcttatttgacgtctacggaaatgcagtgacaagtgcatggaaacctgaaacattgcccctggcgtgcacccaccatggtatgccaagatcaggtcgctgtttactgcaatgaggcaatgagcaagaggtaaaaaaacacagcaagcctgccggaatctatgaaacagattagtgcacaacgaacactaaactacacaccatgttgccactaaaaacaaatataataaggtgtcgtaggtggactgtaaaagatgttatgtcagatttatgtgacgcggaaggaagagaaacatagagagaagaaaatcgggttgttcacgggtagctagttgaaagcggattgtttacggactcaagacaatttacgatagaaaaaatggtagacacattattgaatataaatattataacattaaagggttattatatcagtatatatttttagttagctatatacgaaatgacaatatcatagattccactgttagctataattactcgtattaaactctgaacgaagataacttaagcaagcatgtccacccacttcaccacctacacatatcagacctatttattgccatgtactgtatcggtttcactctcaccgccctgtgcctgcagctgcaccctgcagcgctcactcgctcactgactcactcccctcccctggcctcctcctcctcctcctctctctctctccactatctcccacagccgaaccaac

SEQ ID NO: 10980 - DNA, 1500 bp, Zea mays
aagggagagagggttatctaacgatctaaaccattgattttgatggtgtgttaagcctgggtgcaatttgttggtggatttagtaaaggttatgggtgtgtgggtgattggattgggtgcgttttgcaaagttgaaactagttgattgtatagtggtataggtaagtacttcggtccacccacacaatcgccatacttaagtttacgccggtctaagggaactgacgttcttaagtatgtcaacatcgaagttttctctctcctttttttcaagctcgtgagattatggacggtgaggaagcaggaactgggctatgcctagcaagccgatctgagactcgacccatttaatagtgccacggtccgacccgacacgattttattttttattttcaaattattagttcatatatatttataatgtctatcttttatataaacacaaaccaatatgagataccgtggttagaggcgagcaccctgttcgcttttggcgtgtgcagggatgcgagcgtggagagaggggatgacgcaccatgaaagtcccactttaaaggtgtagtaacttaagagtgtaactaatagttagttggactattagttgacgacatccagttgcctcgagctaagagaatataatagttaaactattagttgagttgtttaaacatatctagctaatattagcagctaactattagctttactgtatttaaatatgatttaagattgtctcctgtagatagagtaaaatagataacgcagaactatagataatattatttgatactgtttacggtgtgaaatttgaaacatttactgaatagaggatctgtcggagaggcaacataacagtctagatgtgacagtgggccccatagacggaatccgtcaacccagcgtgttttgacgtggcctctgccacttctggcattcgggccccgccagcctctgccagcttttctccaccaccaagaggaaggggaacgcgcagcgcaggcggcggcgtcttcctccgcggatccctcctcttcgcggacgacgcgattccacaccgcaaaccctccctccctccctggattgatcgagctgctcgtccacctccgctccgcccctcgcctcgccatttcgtagcttgtttctttttcccttctccctccctttcggtttctgctcgattcatcaaattagtttattggaggggagggagacgttaggtgggctgggcgcctcagcgcctgcgtgctccgcctcgggagaagccgagaaggtcaaaagaaatccccaccaccaacgcaggcgactcccgcaatccaccatagcttcctattctccccgtcgccagacgcccagagccccccgcccccagctcggagcaagcaataaaaggcaaaggtgccgacttttctgaaccgcttgccctccgtccacgccatattggtcgattgctcgattcctcggtcgggggagggaccccgggcccggagaagtcagcaagag

SEQ ID NO: 10981 - DNA, 496 bp, Zea mays
tgctttttgactgcaagcacatgtgcttctacttcagcaacatagaatgggcgcctgattctgcgttgcccctgctctggtgaccatttatacttatttgctagaactataggtcctattgtgggatcttgagagcacctagaggggggggggtgaataggtgatcctgtaaaaacttcaaacttatagccacaaaacttgattaggtgttagcacagtttatgccaagtggctagagaggagtcaaaacacaataaccacaagaatccaatcaagcacagagtgacacactggttttatcccgtggttcggccaagaccaacgcttgcctactccacgttgtggcgtcccaacggacgagggttgcaatcaacccctctcaagcggtccaaagacccacttgaataccacggtgttctgttttcctttcactatcccgtttgcaaggaatctccacaaattggagtctcttgcccttacaagtatatgatcacaa

SEQ ID NO: 10982 - DNA, 394 bp, Zea mays
ttgcagggctccctgctgggcaaaccgctgccgccagagcgcatcagcgagctaccggactttgttaaggacaaacccgcggcgctgacagcggcggagtagaggctggtttctgccgcctgtagctcctctcttccgcgtgcgcgctgagtgtttttcaccttcacccgcgtgcacgctgtgtgtcttttctccctctcccgcgtgcgggagagggccggggtgagggccagaccgcacccaacccaacaaaaaagccgcagcatccccgacaccttcgctcagcttccagtcgtacggtgcaacatcagtcctgaatgtctctgaggacgcgatatcctctccgaaccaatccatgtaaactggcgcgcgacatttccgcagcggaggagcc

SEQ ID NO: 10983 - DNA, 156 bp, Zea mays
ggtatagctaaggctctccgcacatgtgtactctacttcagcatttggtcgttattaacgtggaaaggaagtgattggaggggggcttggttcagaactaatgattgatttttgaaagataattaatgatcgttagattctttccactttatttta

SEQ ID NO: 10984 - DNA, 246 bp, Zea mays
tttggtcaattggtcgatttttatcggttgttggtaaactgttaccggtgggtagcggttttcgcataggaaacggttttgtaaaccgtggatggagctgatgagagacaaaatacgttatacgtagaaacagcaagccgcagtttacacggtaccgtatcaggtttcccatttccatcactgacctgacttgaccggccgtcccatcctgcggctctatctttctcgcacgcacgctccggcgtc

SEQ ID NO: 10985 - DNA, 1500 bp, Zea mays
taggccttatatactcgaccgtggggcagtacatgtggatatgatagctacaagtagctgaaagatagtaaacctctcgagtttatccctacgtaacccttgccgacttatcctcgcatggctctgttgcatgggggcttcagcgcgggaaagtcgggtctctgttgcgatttactcgctcgacgttgtgggccgtctgggtttgctccaatctagtcttacgtcttctccgcttcgttgattgtctttccccaggcccacgaaagaacgaccttacgatttattgggcctttgggcctttcgtgaggtcttttatctctttagtggacccaggggatatctatcccccacaagcccccgatctttgggttgatttagaggtaatcaactcaaagatccaaggtccgaaaaatgacttcctgctgtcttctcttgctccgatcactcgctcgaccaaagtttagttttgtgcttgtgccttagaggtcggcattttgaattgtaggattctggacttcattgggtgcaccggaggtgcacccaatgggtgtagcccccgacctttgagtagattttagaagataatctactcgaaggtcttccccaaagattatctccattcgcgctcctgcatctcggttgagaattggtcttttcaatcttgtcccacgccttagaagtcggcgctatatcggtttagaatgataatccatggggtgcaccggaggtgtacccaatgggtgtagcccccgaccttcaaatggattttttaaggataatccattcgaaggtcttccttttgcttgtaaaaattggcatgaagctaatcgcattatgctttggaggtcagcattatgtcatcaaaattttgctgcagaggtcagcatatattttgtcttttagcagccgagtttgcaatccatccatatcttgctaggtaatgcaatttatttgcttctgcgacttgattgaacgtttgatggacgttctctgtctagtcctcacatcgcttctgtcggtcatatcttgtactttgctggctatatttggctttcctctgatccttactgatatctcatttttgtcttgaggtatttactgcgtgccctgcacggatgtgaccgttttgaaaaatatactgataattcctgggcgtcccctccccaatgggtgtgggcaagggacggcttggtacgctgagtgttttagccggctgcttctgagtagtaatgtgatgggacggctagtgtaatcatatcctttgcgctgttgactggagtcccaatgggtgtagtgttgcatgaaacggcgtcagccgtctgacgtgtcttcagacgggtggaagtgcttattgaatgctttgcgactgttcagtgaccacggttggaggtgagcggttgcctttcctttctataaataacgcccttgctcctctggttttttcacatctcttcgctgttctttactgcatccttctcttctctcccgtctgcttccgcc

SEQ ID NO: 10986 - DNA, 1064 bp, Zea mays
tttaattatgaacttgtgaaactttgatacttttttctccgaagcaggcttcaagatggagcttcgttcaaatctgacaaacaagcttcggcgatggttaaaaattttggcagcaaaacagtgcaaatagcagtaaatgctgtggtaacttcacacctactcgtctgtttatatagtgccgcaggtaagaaggtgaagtgccaggagttttacaccaggcggacacccgctcgcactcgctgtacggtggaccgcagtgaccgaacagtaactctgcaaggtggggccgctgcgcgcagggaaatccaatcgtttctcgacaacgagctcagggaaggtgttttttgagaccttcggcgctctgaagcttaagaaacttttttcacggatcaagctcgttacgaaaaacgatctagcaccgcgaaaggggctactgttgggtctatgcttcgtcgccgaaggtcttatagaaagaagtgatcctcggatgaagctgttcgcacaagatagccgaaggtgccttttcgcagagcttcggcattacaaaccgacttaaagatagaatgaccttttagtccataaaggtctgagtcaacgttgtaagttcttataaggggcatacttgtaattcctcacaggctgcgtcctgtgcctataaatagtgaacagtattacgttactgttcacgcatttttctgacatttgcaatcgcatttctcggaatacaacctttgtcaaggcataggtatcattgtattttatgattcaatatattaagtgaatattatataatgcatctgtgaatcatttattcattcttaccttttattttgcattattctacaacgtttattgaaagtttattacgaaggttcaacttcgtaataagacgcttatcaaccttcgtctaagatccattatcctcaaaggaataatgcttcgcggacgaaggacagtatcatttaacattctatgttgccttgttcttaattcatagcatttgagaacaagtccccaacattggcgcccacctccggtgaactcacttccacttttctgagctg

SEQ ID NO: 10987 - DNA, 1500 bp, Zea mays
tttgttgatgcctcaacatgtaattttcttcgccattgtatttctcaatccactatatacaaagaggttatagggtatatattacacatcttacggtccgaacctatatttaaattacccatgtattgatgcctaggcggtatccagcaacagagtgtctctagcacgcatctcttactctatttatcaactctcccccgaatacatgtggttccttattgtcactggcggatctacagggtgtcaccctgtagtccggtaccggcataacatattagctttgtctatttcatgacttcaaacatgttgcaacaacctacagatgcgttcagtctatctatatacaagaggaagaatacaagtgacaaatctaatttgtgaatataagaattattatgctggtttacatagaataccaaattatagcacacatttatcattccttattgaatttctaaatgtatttcactgaattattcatgcatttttaatttggcataccttatagtaaaattctataaccgctactgcttattgtcattatgcgacttggaagacattttctacctactgaaagcggtctgttttttgtgttgtcgagagtgtgatgggtaaccatagttaataatgcactggatctatcactactcatacaggtcccatatgcctaataatgttgtgaagaccaactcatctgaccacatctgtccctaccatgcttgtacaccacactacatacatcactcatcactggtccttcgtttcggtaccctcctcccacaatgttcaatgtatatactaatagttctcaaataaattcctgtggatgttacaaaaacccacggtctttggtttcctgaagaagtatttcatggaggcgcgcacgtccatcgtactgcgtcctgcagctatggccgcccccatctggccaataaatgtactaggtcacttgtagccaatagcgtttcaacatgcacacagcttttcccccaatagtgcaggtccttgtattctcctccctctccctcacctcaaatctcatccacacgaacaggcggcacggcagtattcctccacagccctcctctctataagatggcacagccctctcaggtaggggcgagtgtctcactctcacatagtaaaaaaaaaaaacgccccaaggttcttaagcacaattctctagctatcttggtctcctacacagcctatgcacatgagcccatgcctctcctctccttgcgcctgcatagagaggtggtatgatcacctggaaagtttttaactctctctctctctctctctctctctctctctcttacaagcctagaccttatgcatggtcggacggacacatctgatcataggacatatgagtaggccacactcctcctgcccctctctcgtagagatcaacacacactgctcttagtgccaggacctagagaggggagcgtggagagggcatcagggggccttggagtcccatcagtaaagcac

SEQ ID NO: 10988 - DNA, 1500 bp, Zea mays
ccgtgacagcatccacaacatgggtaacaggcagttcacatacactgtgcaactagcctcagcccattaacagcctgtgtggcctcaacttcttggcatacacaatggcagcccaaaagcaggagctgtttccggagtcactcatgttcgttgagttttcagctccgtctctctcaggccttgttcgtttgggtcgaattgcacccggaatcgttccaggtaatcaaagtttatataaattagagaagcaatccggctcggaatcgttccgacccatcaatccgacacaaacgaacaaggccttagggctagtttgacaacactattttcccatgggatttccaatttcccaaggaaaaatgaactaatttccctttggaaaacgaaaaacccttggaaaaatagagtttccaaactagcccttagatatttaatttctctactataaattttctctattttcctgtcacctaaatcagaccgaagactaaggccctgtttggttcctttagtcactagactaaattttagtgactaaagtttagtcgctaaagtaccccatttggttcagtgactaaatcggactaaagagcattaattgctgtgaataatgactattttacccctattaattaatggatgtttgctatacgaagaaagtggaaaggttaaataaggtaaaaatactattttagtcctttttagttacctacttggtgactaaagaactaaagtttagtcaccccattttaatcaccatgtttgtttttttagggactacatcccaaaccaaacggggcctaagatttcaccgtgacctctgcatctaccaatcacaagcacatgatcagcccgatgccaactcacacggaacacgcatggtgcacatggcatttcctcctccttttgccactgctacttaattataaaagaaaaaaacatatcaacaatcatcggctggtaggagggcaattcggtccgccgacgaggcgccgacagatcgacctgctgcagccggtcgcccggcccccactctcagcgtgcgcggcgggggacaggctgtggacagcgacggcccgcgcgacgcgacgtggacgtgcacgctccagccccacagcatccagcggtcaggcaccctccttgcagcgagctaacggccaggatcacccttgctcctccccgccgttacgtgtactagctccaccgccaccggcactagccggtggaaggcgactcccaccaactcaactaaactaaccgagtgagagcgggggagtatgtaatagaggagaaggaaggtgcggagaggaagaggaagcgaagcagcagcagcaccaccactgcgcggcattgcagcgagcaagcgggagggatctggggcatggtggcggtcgctgccgctgccgctcggatctagagggccgcacgggctgattgccctccgccggcctcgtcggtgtcggtggagtgtgaatcggtgtgtgtaggaggagcgcggag

SEQ ID NO: 10989 - DNA, 1387 bp, Zea mays
ccacctcacattcatttgtatccaagttttcaaccttccaactacttacaagagctagcattcaattctagacgcaaccaaatagatcaaatcctctcccaactccacacaaagctctagtgattagagagagtgatttgttgtgttcatttgagctcttgcgcttggattgcttcttttcttccttcattcttgtgatcaaactcgattgtaaccaaggcaagagacaccaattgtgtggtggtccttgcgggaacttcgtgttccgtttgattgagaagagaagctcactcggtctaggtgaccgtttgagagagggaaagggttgaaagagacccggtcttcgtgaccacctcaacggggagtaggtttgcaagaaccgaacctcggtaaaacaaatcatcgtgtctcgctctttattcgctcacgatttgttttgcgccctctctctctcggactcgcttatatatttctaacgctaacccggcttgtagttgtgattaagtttgtaaatttcagattcgccctattcaccccccccctctaggcgactttcacatcccaatgccatcttctggcatgcgacagaggggttagttaggcacatttttgttaatggggccattagattgagttagggatcaaggtgaacacgctkgatctttggctcaargtctgaaattcagaattccccattgagtccccacatgagaagcttgttttggggttttatttgaattattttggccaagcttcctgaatctttattgttgcttaaagaatatactccaatgtttataattggcccaagccatgattttaaatttttcatacccttttccccattttcttgaattttgctcatagggctcacttagggtttttattagggttgcaacattattacctttttgaaagacccatttgtattgatcatgatacttttaagtataggcttggtgggttcttcattcttaagtcacttgatgttcatgctcaattgttggtccacataagatgatggttcataggttagcactttgagagaaaccctaggtgacattggggtgtcacatatagcttatataagcatcggcgggagtaagtactgtctagtaattgtggatgattattctcgcttcacttgggtattctttttacaggaaaaatctccaaaccccaagagaccttaaagggattcttgagacgagctcaaaacaagttcggattaaggatcaataagataagaagcgacaacgggacggagttcaagaactctcaaattgaaggcttccttgaggatgagggcatcaagcatgaattctcttctccctacacaccacaacaaaatggtgtagtggagaggaagaatagaactctacttgac

SEQ ID NO: 10990 - DNA, 80 bp, Zea mays
cgcctttgcttctctggttttttcacatctcttcgctgttatttactgccttcttctcctcccttctgtctgcttccacc

SEQ ID NO: 10991 - DNA, 429 bp, Zea mays
ttataatgtaaaatttagagcccattgtcacctcttaattagacgagatcgaaatagattttgacttgctatgaatttaaatcgattcaatatcactcaatctacatggattagcaacaaaacgaataaaccctcattttactattaatccatgtgaattagttgatattgagtcgagttaaatctataataaattaaaatatatctcagtacattttatacactataatctatatagaattggaataactaaacaagtactcctgtgaacttatcgtgggttctaaatgccaaatatacttttaatcttgctgcttctaatagaccgaaggagtggaggtcaaatagcgaaaggacgcacgaaccccaggaggcaccgtctccaaagtccaaaccctaaccctagcgcccccaactcgtcgccgggag

SEQ ID NO: 10992 - DNA, 809 bp, Zea mays
gcagtatcaatactccaaaaaacaatgtagttttggcaaaactgaggtatttaaaacattgttttacaaagttcaaccaaacaccttttggtccagaatactgcagtattctcaaataccataatattgcattgaaactgtaaataagctttgttaccaaacaggcccttagtatttatctgtaatgtctttaagtactgcaacactagtcgttgcaactctcccttttatgttctgtaccaattctgtcgcccattgtttatggtgaaatctataaacgaggcatagtgtgcattgattaatataaacagaggcatgtagaaacaatagtagcaatataaacagatgcatttttacaactttgtcctgaacgtgagtgtcttgaacccggcacaggtgctaggcaccccttgtgtgctacactgtaatgtaacagcatcatgttgtacgggtgcactccattagtttttatggcaacaacaagctattattggatagtagatatcttgtatacatttgtttagtttgttgccttttctttcttttttctttttttctaaacattttaattaatcactaattacttagtcattgcaagcacatcaaaaatgaagggctaaaatttatttgaggtattacctcctatgaggtaagggagtaccttagcaagaatgaccacaagtccacaatttgcttattaatatgcattcgctctctgctggtttgtggataaaaaataattatctatgcttaagtcattggtcaaggtccacatccttcttctgttaactctgcattcttcttgaata

SEQ ID NO: 10993 - DNA, 315 bp, Zea mays
gtaccaaacttgcttggcagcagaactctagaaacaatctttagccaaataattgcaaaattcactttgatcttaaaatgatttcctattactcattaatcatgtctttcctattattattgctgttataatactaacaatatcgcccagagacattctccgtcttcatccactgcaaagccccaaaaccctcactaaagcaccgcagaagggcccctacctgctttgctattgctacccagccgccattaatatcactaccaccagaccgcctcactttgaatctcactcccctccactcacacgctccatcca

SEQ ID NO: 10994 - DNA, 864 bp, Zea mays
ggcgattttccaatatgctgcagatccaaagatgaggaacggcgtaatgaggtgtgcaatgcggatggatcttggtgctgcctacgccgcttggggtaagaaggtttaggaccgtcttgggacaacaaagatgaggtacggtcgacaacgaaggcggcgacgcttgggaccgtcccttctccgattgtcagccaaccaagacggaggcggatcctccagctcggcgagacgaatctccttccccgccgaggcctgctggcgacgccgccgttcctgggtcgccggtgcacgcgccttgtcgtcgcttgcttccaaatcgccgctgccttggatccgcccgaactgctcggcggggcaataaatcggacgaagattgctcatgcacggcttcggttgcgccggagcaagatccggcactcatggatagcatccagggagagtgggacggcgccacggcaagccggaacttgctgtgtccgccgccgaaggagacttccttggtccggacgagcgcgcgacggaaggagagaggagaaccactgtcgccgctaaacaaggggaggggaggagtgctcgcgggaagcgcgttcaagacagtctgaggtgcagatgcctcttccatttcctccacgtttggagctcaaacgaagcacaactgagcttgtggcccacaagcaagcgacctcaatcccgcttgccaatgctatattaagcttgttcatcctgcaggcaaaaggttacccatcattaccgttagttaggcaccatgccatttttaggataatcagcaatctcctcgcatgtagctggtcatcatccgtcctccttggtttagtttgttctccaatggatcctccaaatcca

SEQ ID NO: 10995 - DNA, 1500 bp, Zea mays
ggatcgacagaccacccgagacgcctctagacgacgtagagccgaagagaagcggaaaatttggggattgagagattaaactaaaactactcctaatgtctaagataaaaacaagagataaactgattattgatttgattgatcatcattaatcgaccgtatttctctatgtttatagaggagggggttggacccgttacaaacaatctcccgagttaatttcacgaatttagctaacaaccgtagcaaaaactcggaatcctaattgtctctgtgcgcgcggactgtccgccagcggaccgtccggtccctcgttttagtgctcaaccatgatcaatctttgtgcgtctattactacatgggatactttgagaaacttctacggaaagtgaagtggctgatgaagatttggaaacgaaaccgtggttgacaatcggaagaatctgtgcagcggggtacacrttgctcttctgtgctacgagtctattcctcgactctaactgctatttcaacgccttgcaggctaggagttgtattgcgtgaacgagttagttttctgtgtgacgaaatatgttgtgttagttgttacagtacattattctcaatttgtgatcgtgaattcagcatatatatggtgcaaattctgtcaagaaaccgcagtggtttaggatagtggaaagtcccccatcaagaggctacgtggtgaacgtcaagtcgtcaatacgtcattaacataaaaaagaactgaaaagaactttcaagtttataaatttgtttcttgcaagacacaagaggtaagggaaacaagcaatccagcaagttttattttttgaagttaagttacaatccagcaagtattgacattcagttccataaagaatataacaccgtcaattccttcactcaactgttgactggagcaagcagtgatgatctaaaaaactgaagatttctttgaggagctgtgaagcaagtcaatgctattttgtagcttattgttgtatcttgttcttgctaattgcaaggtagatggagtgttcagtgaaaacaatatcaagtggatcaatacttgtattcactttgtttcatatccaatttaacaatctcaatcgctatgaaattttgctctccgcactctgttttattggcgctgtgctgatggtgggtgggtggtgcagcctacgggagccacaggactggaaaaaraaatatgaaaaaagtggaccgaatttgttctgttgggctgctccatacgctaaaggagagggcagcagatcaccgttggtttgaaratcgacgagcgcacggcagcctgccgtaaggcagcggatctggttccgtctggctcggcccgtcaagccggctgccggtaggagcggaggagacggcgtctcgccgctcgcttcgtttccgccttccccctcccgcaagtcgccgccggctcgcattcgtggttccgcgtggggggtccgtggaaacgcgacaagagaggcggaagcg

SEQ ID NO: 10996 - DNA, 1500 bp, Zea mays
tataatgtgatcttcctattctaacccccttggttaaataatgaatctccatgagattaacaaaattctctgcagaaccatggcttgatatattgttttcaagggcctttttttgtgtgtgtaccggggtctataatttcgtttgcatagataagaattttgttttgttgaccaaattttgacttttatattttaaatcgaaatctacttaaatccggaacgaaattcgattttcggcgagtaacgaaaacgaaataaatcacctaaatccgttgatcccggtccgagaaagtgaacgctggtgtgaacgctaggcggagtgtgtgctgggagcaaagtaaccttgctttccagctgttgagagaagtacaatgaccagggagaggcaatgagagaattcaacaaaataaccaactcaaagcttgaaacatacctttgaaataatatttgcttgtccacactccacaccacctgctttacctccttctaccatctttttttagacatccatttgtatcgtgctgcttgtcatcactttttttttttgtgctttacaacaaggttagcgagcggacaagcggcggtggatcatgcaattgtaattattttgcatgtacttgtcactcggttagttagatattttgttgaggctttgttcgttgattatctttgttctgctccatctacgatctgtgcccatgcttgcggaggtggtcggtgttctggctagaaaacactatttgtgttggcattgttcggtagttatagtagttggtacgtctagatattgagtcagtttggttcgggtcagttcgtttataagcttgagctgacttgtttaggtcacaaacccaaacataaaaaataatcaatgcgtttggttgcctgcatctgcgcgtgcttgcatcgtggaatacgggtagttgctgtttggttgctgtgacctaggctatgtgcgtgcgagctctatgtttggttgcctgcatgcatatctggatccaggctcgcacgatcctcaaagcactctgggccagactcaccagatacgagcagattggtcgcatctgcggagccaggcttcagcggtcctggctcacacagccataatggctgcttgcatattagtcgttgctaatgttaagagctaagttttagtggattcctcttgttgctcggcccctcctgcctcatctcaacaaaagatgtgtactctgtagatgcgcgtgccattaaaccccaacccaagagccgagaaagcacttcctgcccgtcgcatgggagatgctgggcctatttgtagcacaggcccaaccgcccaacccagattctgtcgcgttctttcgacgccaaccccgacccgcggccccaccacccagggccaaatttccctgtgctcctctccatccaggtctcctcttgctcataccgcaacgcctctatctctttcgccgagctcctcgaaaccctaggtgcgtgccgaccggcggcggcggcgaggtg

SEQ ID NO: 10997 - DNA, 569 bp, Zea mays
tacactattcataataaatgcattttgcacatggacaaacgcttgtctagatacatagctaaagatatacagtagtatctgttttgctataggtttgggagtgttcgattataatagatatagacacagtttctgcttctttcttttgagagtttctctacaatttattatataatctaaagaatcccagttttcttcagaccgatttttcgtcccttgagatttcagaaacaccgggatgagcaacagagagagagaggggaaaaaagttagatcgtgacgcaacagtttttatgagtgactcactcaaacatccatatccaaaaaataatgctgggtccctttcaacaatctggagagagagagcggttcttccctttggtcccgcagctgcgatccctctccttcctcgtgggacctgggaagctcgttttccacaaccaccatgcgaactgtcctgtgtctgtgtgtgctttggctgcgtccatgaccatgaatgaaccagtggctggttggttggctggcatgcaggggaattcgcggcattcctgacgggggcgaacctgatc

SEQ ID NO: 10998 - DNA, 1500 bp, Zea mays
gctcgagtcatatattggaaaaaaaactgtaacttaaagtatgatctatatatggattatttggatgggatgtcattttcgtatcaccaaccaaaattacagtgtggtcgtgcgtagaaattctacctactagctagctgaaacaacggctgctatgtattactactggtactggaaagaatactagtcattgactcaaaattagaatgcatgtgtaagtcatgcgtgctaatttgttctatatatcagcatacggcgaattccgaagtccgtacgttgttcgtggagctgaggaggaaaacatcagaaatgacaaaactagacggtgtgtgcttctacactgaattcatcaacatctgttttacttttactagagaatggcatcagatggaaaaccgctgaaaaaacaagagaacaattggaccccaaatatgtacagacgctagctagctatagccagccactgaagttgacatgcggcagctagctagacaccttctctgaaacactaacatttgtaccttggtcgtgtaagtgtagttagtaacgtatgttgacgcgacttaccgaacaaaaatataattgtcccaatcaagctagggacgattgtttgtttccaaaatgttgccatttgcttaatcaatcctatattgattcatggctgttaaggtgagataaagcgacaagaaatctctctctatatatatatataagatcccgaaggctagcgacatttttgatagcaaaatatgagaagttggcaggttctggtagcaaatcaaataatatggccagaataatcgtggctagcttgattaaaccttcagcttggtgtattttggaagtcgaccaaccagctgggccggggctcgtcrtagtaccaaaattacagcctgcttccttcgtcgtcctgtacgtaatgcagtacagctgtctgtctagtagagacgattttgagcaggcacacacattaagtgataacataaaagacggcttcattttatttcataaccaaacgatatggtcaacacacacctatagctaccaaatttgtacaactatttagtgcgaaaactatttcattctcaagaattgatcgcttatatttattattacaggtttttaaatgtataaatacgctatattgcattgcatggcaacagggggtaattagctaggcaggactatatatataatagttttttttctgtaaattcttgaaaggatggtgaagttggtaactaggcaccttacttgtgcgcatatttttctgtggtcaaacagaataaaactagacgggatgcagaatatttttttccttggaaagcagctcatctctgtgttcgagtacgtaattgaagaagtatgtaatcgcactacacctacacgtatgtgccgccgtatccgtcctatatatatacggggtgcaatcacctagttaccaaacactcacacataacgtatagctctctctctctcccgtgaacgacgacgtcgcta

SEQ ID NO: 10999 - DNA, 992 bp, Zea mays
tttgtgcgaattatcggttgcagccatggcccctcagggtggttgtgtctgtcccggtgactcataaggatggtggtggcgccgctgaatggtgagtttgtcaacttcactgtggagtgcgactggatgctcgtcggcatcaaaggttaaattattttttgtatatatttaggggaactgttggagattaaaagaaaatccattcccaataatttttaggctgctcccaaaaaccatgtttttgggtgattttctggaagtcttttggaatataagtccatcacaactttgtgatatcttttatcttcattcttccattccatgtctacacttgcttaaaggcgccctaatcaattcagtgaatgtgttatctaccattctaccttaacttagcaacaattggtggcagtagggtcattgtattccttaccttaatcttgtgccagtgtcaaagggactatcagagggagtagtatattatcagtaatttgrttgacggggtgcccaagatttactgtttgagtttaatacatgttttttattgagttatgtcaactaaaaaaactctatatatgtacttctctctgtctaaagtaatcaagtaaataatatttcaacctatcaacatggaaatggttgtgtaagtgtgctattttactatcaggtttaggtgcttgattcggcagaaaattgtttaggcatctgacgctacggtttggggctgagatataaaataaggtccagcacttgtcgatcaagactgcaatccagcttatttttgaatccaaattgtaggttgatacgtcagtgtcatgaaattgaaaactgatagttgtttttgaaaaaataaaactgatagttgtagcataggcgcaggccaagaatcattttctgacttttctgcttctagaggccacttggttattcctgcacaacattatctggacacggatatttatttatttgttccattttttcatggaggcagattg

SEQ ID NO: 11000 - DNA, 258 bp, Zea mays
agtaagtcctgaaccgagcctcccttgttttgttttttttcattttttgcaatcaccagagcatgcatcggttgcgtcagtatcttgcgactagggccctgtttggtacagctgctgcttgttgaaaaagcagcttatctgataagctggtgaaaagcagcttctgcttgttggctgcttttagtgtattctgagaagcagctgaactgataagctgctgcagaagctaactgtttggcagaccttctgcttaaattt

SEQ ID NO: 11001 - DNA, 1500 bp, Zea mays
tgtgacattagaaatgcttttgcagtaagaacttgtgaacatggcaaatgagaatcagtaatccgctactgcaatacaaattgtgacgattaacaataaggctacatacttgtatttaaccctatggcatgtcttgctagaaaataagtagagcaagtcattgaattttatagtacagagcacacaaaacttgtctatctatatatatatatagaagtgatggcgatgattgaactggttttgtgtgagacatgtttattcttagaagcggtaatgatgaaaaaaattgtgtaaacaaataaataatttgtttcggtaaataatagagatggagcaggaatatggtaatcgttatgcactaatattttattgaatattttgtatgtcgtcgtaacgcacggtcgtaatgcactaattcatggtgatattttatcacggattttacataaaatagtgatgtttgtgggtcttatctatattttatactaattttttactctcgtgataatgcatagacacagttaacactaagaaccgtccatcagttttactccccaaattattacaccgggaagaattggtgattgtcctcgaccaaggaggagggatccccgctgggcccatatcaagcgtgccaaaggcccaaagctgaggtcgtagccgtgcatggagtcatccggtagcctcagcgtctgcagggcacacatcacgcgcaccccagcgttcatcttgacatgacattgaaacagtggcggatgtcgaaggagtcgagacgcgggcagccatccaggatagccgcgaggccgacgatgctgaagctattgccgaaaagctgcagggactggaggccgcgcatcttttgctgtttccgtggcttcactgtcgccgccggtgccagactcccagggccagcggaagtgatgcttgttcaggtgaaggtgcttcaggcgagggccggcgtcggctgtggcggcgaggatctcagcctcagcgacgttgctgcagaagcgggagagggtggaacttgagtagtgtgacaccttcttattgcttctttgagggccagcatgcggaactttcttattgcttctttgagggccagcttcgagattttgtagcacgagatgagacgaagactcttcagctgcggagccctgcagtttagttgttggttttttcactgatcagtttaattttctggtgcttcgtgcaggttttcggttttcttgagcaatctctactactacttaagttcttagtgtagacgtccacaacaaacgatgtacggttctgccatctatcccagcttggaaggttcccgagatccccgcctccctacgccgatccacccctcgcgccgcgtctctctcgctgcgtccttccgtagtctccttccgtagtcaacgcgtcctcgccttaccatgccgatctagccctggctctctatggaaggtgtgacctctgcacccaactctacagggaaggcgcggtctactctcc

SEQ ID NO: 11002 - DNA, 62 bp, Zea mays
cttgattaggcgagatgagagataagaacccccctcgggtactgtagcatatatataggcat

SEQ ID NO: 11003 - DNA, 1500 bp, Zea mays
tataacacgttcttcagctcactagaawtttagcacataaatatcccaccatatcacaaacagtagcataccaatatattatacataaatatatattatcttaattaatatgtgcctaaattatactccatccgtcccaaatttcactcgcaccaccgccaccgccaytaccgtcatcaacctctcccttgcygctgttgttgactcttctcctttcctcctcgggatcgtagcgttagcacgagctatatgctagtgtgtttatgcatataatgtagatgtatatatatgtttatgaatgtacttcacgtggaagaatatatgtgtttgtgaacgtaagtggtatatgtgtgtgcacgcgtgtgtgaatatatcatatatgtttatgaatatgtgtgtatatatgttattgatggatataaatgattaatttatagttgggtaggctactttttgttggctagcaaatttctgtcgactgctccgagaaattaactactttttgtttattaatttgcaagagtcagatgtcggccgaaattagcttattccatrggcatatgctacttttggtccgcttttagccaaccaaaattatttagattactactgtgcatgtgtatggttcatgtaaaaaccccatgcatgcattcaatttgtttgtgaactggaatagaatgagtttgtggattgaaatagggtgcatcaatgctatggattgaagaagatttaatttgttataggttggattggatataacaaataatgtgcattatattatttgttatagaatgagaatggaggtagtatgttgtagataatgcgcattgcatggcctcagacgattttcaaatggatactatatatctcgccattaatcctacatctggcctgcagtagtaaaaggttattggttgggacaagtggtacacagaacatatgcaaattgccatcggttacctcccaaaccatcctttggaacggagaatggatcagaggcgggccgggaacgaaccaaagactacgctacaagaagaaatcctaacggcctctcttgattttaattaatcgacccattgccaaccgaatatccgatcaaaagagaggggaacaaaaaaaagaacagccggcaacacatgtcctttctcatgagaacgaccatgcattgccatctctcgaaagaagccatggcggaccggagagatgctagctatctccgctcgatctgagacggcagcctgaggaagaaacaacgaccgtagaacgacggcagagtgtacaaggcgtacagctagcttcacgaagcgttccacagtgttcgtcgttggcactcgaggcatagccattgaagaatccaaaaccgctctttcagaaagaaagaaaaaaagaacttctcagtccggcccgcttcacctgctgctggggcttatataaacccacagcaagcgcgcatcgtagatctcacacagacatacatttcaccaccgtacgtaaataaag

SEQ ID NO: 11004 - DNA, 1500 bp, Zea mays
gggtaggttagccgtttggtgggtgggtgggtgggtgtgttgaaacaggcgtgggcccacgaaggtagctcagctaggtcctgatcttagcagtttgttcgctgcagctttaatccatcgacttttgttttttctacagtattttgtctatatggattacagttgcagtagttcgaacgatttttatctagtcacagtgaacaaccccccacagcctattcgcttcagattaaaaccagttgtcctgactgttgtaactacaatccatagaaacaaaataatgtagaagtagtagaagccggtacagattaaagccaagcgatatctcgctcgttcggatcacataaaatagaaaaagttacactgtaaatgatacaatttacacagtgaagttgaaatagatgatttaattgataatgagatatgagagctactggagacgaccttatgctattaggaaactaatttggagtagtcttatgtcgtttcatgtagttccttagcttgagccaaaactaggatacattgattctaaactagtttaggtctaatttaagtgtctaacacactgatgacctaatccgtttgaatgatgacacgtggtattcatgtaaacagatccaaggttcagaacaaataaggagatttgaatttgatgctcagatgctgccgaacccaataccaactcgaccagaccgccacacatcacgacaagtaatatgcaattatatcttatgtgcaagtatataaatgatgtttctggtctgttagattatgatataattatagacataatcacgttttgttaggaggttttatatatatatatactaggtgagtgcccgtgcgttgcaacggaaacatataatatcataataacttatgtataaatatgtgaagtgtactcatggtgccgaaccttaagattatcactaagaacatgcaaacataccaatgcctctgtctatgtctagctataatccatcaacattgttgagttttaacacagactgctattttaaaattcgggcacttcaacagttcacttgtatccccaactcaccagaaaacaatatagatcacgtttaatctagatgattcttcattaagtgaacaggtagctaaaccagatctaatgacttgactgctacaaaacttggatccaatcaacaaacaaataagtgccgcaagctggttttgaataatcctagtgtggctaaaagtagtgtttctcagttaagtagtaccttattttgttgtgcaagtacaatgaagctagaaataattcaagacctgacaagccatccaaattttcgtccacaagtcaacgatgatcccttttgtgtctggcggcagatttgacttccaacttccaagagaggaatcgaaagcctcttttgactcctgctctttgtcctccatttccatcgtcaccaacacccaacccaacccaacgcacactgactgaaccagagcgcgaggacagcagctcgctcgacc

SEQ ID NO: 11005 - DNA, 1500 bp, Zea mays
attaatgcactttaattctgttctaagtaccttttaagttttaattctgttttaataaataacatatcacatttatattttcaaataaatgcaccgtcaagacataattcatgtaaaccataactaatttggtaagataattgttgttatatttgtttctaataacttagatcaaattaagagaagtttgacttagcatatacgtataatgaactttaatttgaaaatgggagagtaaacgacaagatcaatctaagtggagctatttgtttctttgttaactaataataaatcgtccagccaaattcgagtagagtgaactcgaatactggggaacccgtttagacccattgaattgaatttcattttaataattataatttagacacaaatcaactaatctagtgtagtttcatgtgaagtatatttgtatactaaagttcgctatatgaggagatattaatgatagcgagccaaaaaaacgtgctataagctacaaattataaacatagtctagtaatacgtaaaatcaaattccatctctcaccttttaaatttgaggatagatttatatctgaagtttagaaaagtggtggaacgctaaattcaaagtcaaatagctttatctattaagtagattccaacttctctgcaataacggattaaaacaaccctttagagttcttttattcttcagagtgtgtgcaggatctgctcacagcctcacaggcactaactgtggatcggagcgctggcgatatgcataacgtgacaggagtaggatgcagcactagctcgtggccgtggaggtaacgcaaagtggagtacgagacaaaagtcacaggcaccaactgtgcccgtccggtgccactcctcctcgggtcggagaaacggacggtccggattgcccccatgatgtccatcaatcagacgcggcacgcaaaacgtacaatttaattattacaccacatcacccccaggaaaccaagactttgggtataaactccagctcctagtagcacgacggccagcgcagcgcagcgcactgcagatcgagcgcgcgcggcagaggcagaggcagagccaagcgaagcgaagcggtcggcgggcgggcatggactggcacgcgtggctgtcgggggcgcggctggagccggcgctggtgtacgagtacgcgctggtgttcgcgcgcaacgagctggaggccgacgacgtggccttcttggaccacgagttcctgcacagcatgggcatctcggtcgccaagcaccgcctggagatcctgaagctcgcctggcgcgaccgccggagccgcggccgcgcgggagccggccgccccgcggcggcgctggcccgcctcctcctcggccgcgtcgccaggtacgtgcgctcgctcgtgcgccgcgagggcgactgctcgtccacggcgctcgtgctggtgcccccgacgacccagccgcagcagcagcagcagcgccccggcgacggccgcagcccacc

SEQ ID NO: 11006 - DNA, 1264 bp, Zea mays
cttttcctaataacatactttagtttcctaaaatatatgatttagtttttaaccaagctcaatatatttttagtgtcctaaacactttaaatgatatggtatttaaattttttgagacactattttaaggtacatcgttggagatgctctattaatgcactttaattctgttctaagtaccttttaagttttaattctgttttaataaataacatatcacatttatattttcaaataaatgcaccgtcaagacataattcatgtaaaccataactaatttggtaagataattgttgttatatttgtttctaataacttagatcaaattaagagaagtttgacttagcatatacgtataatgaactttaatttgaaaatgggagagtaaacgacaagatcaatctaagtggagctatttgtttctttgttaactaataataaatcgtccagccaaattcgagtagagtgaactcgaatactggggaacccgtttagacccattgaattgaatttcattttaataattataatttagacacaaatcaactaatctagtgtagtttcatgtgaagtatatttgtatactaaagttcgctatatgaggagatattaatgatagcgagccaaaaaaacgtgctataagctacaaattataaacatagtctagtaatacgtaaaatcaaattccatctctcaccttttaaatttgaggatagatttatatctgaagtttagaaaagtggtggaacgctaaattcaaagtcaaatagctttatctattaagtagattccaacttctctgcaataacggattaaaacaaccctttagagttcttttattcttcagagtgtgtgcaggatctgctcacagcctcacaggcactaactgtggatcggagcgctggcgatatgcataacgtgacaggagtaggatgcagcactagctcgtggccgtggaggtaacgcaaagtggagtacgagacaaaagtcacaggcaccaactgtgcccgtccggtgccactcctcctcgggtcggagaaacggacggtccggattgcccccatgatgtccatcaatcagacgcggcacgcaaaacgtacaatttaattattacaccacatcacccccaggaaaccaagactttgggtataaactccagctcctagtagcacgacggccagcgcagcgcagcgcactgcagatcgagcgcgcgcggcagaggcagaggcagagccaagcgaagcgaagcggtcggcgggcgggc

SEQ ID NO: 11007 - DNA, 1500 bp, Zea mays
tgcggctaatctctcccgcgcgcctgggaaggaaggaagctagctgcccctctctgcgggttcacccacccttggttgccccgccgcgccgtgcacacgcctgcctgggctttctttgcttgcgttgcgaggtcgggatggatggcgttggacgctggacgagtcgagtgccctctcgcctctgcccactgccgctgcttttattctctcgccgccgctgccgccgcgccctactctttttattggaacaattggatctataccattaaaagatccaaactttagatatataccatggaccccacattagggatgaaaacggtttcggaatttttcggaattccggaaaccgatttcgaaatttttcgatcggattcatcggtaacggtatttttcgaaaatggaatcggttttcggaattttctatcggaatcggcgtggtgttttaccgaccgtttccttcggttactgatttttgtcgaaaattacccgatttgtgtctcggaattttccggaattgtgtctcgggattttttttggaattttccagcatgtgattttttcgcatcgcctgtacgtctctagataaggattgcttattttgtattttttggacgccttaagattttttgtgatagatggtgttggaaggccgtgagatttaatgatttggtctctcgaatgaatccattcttttctatgcacatgttatgtattagtaatatataatgatagagagccgacagtctgtcttttccacacgctagattttagggttttcctgtgaggctgtgaaaaaactctttatgtgaggaaaaaatatttcatgagtaagcatgtcatgtcagctaaatcgagtggatattgtgaattgtgaactttgagtctgtgaacttgtgatctttatgaacttgttatactgtaaacttgttatctttgtaaactttttatattataaatttgtgatccttgtgaacttgttatattgtgaacttgttatatcatgaattgtgaacttgtggtttttatgatcttttgtcaacttttttgtattatgaagtttgatatgtttaccgatcgtattttagatttcgaccgttaccggtgtattttccgtaccgaactttcgtttccgatgttttcgaaataccgatatcgtttccgtttctggagttaccgttttcgatttcgtttccgataaaaaatatgaaaacggtaatggttttagtgtttaccgaccattttcatccctagtaacatcagatgctacttttgccctccaagtccaagtccaagtccaagtccaagtcgtccttctccttccactagctagcagaatgctagcttgccgtgagattttttattgtttttttgttttcttctggcgcgcgctagctgttacagtctctcagcataaattaattaaactagtatatgtagacactcacagcacacaggaaagcacactatcttctgtctccataaacaagacctgcagcg

SEQ ID NO: 11008 - DNA, 1111 bp, Zea mays
gtgagttttcagaaaccagtttaagaaaaaaaaagttgtgtagggtgtttgaaaccgtgtttctaattgtttttgatccataattattagcatactattcctctattttaaaaagcgatgtcaatagatgtaagttccataaaaccaataagggcatgatgtaactaaagaaacaaaagctgattttatcgagggagttggtttttaagaaattgaaaatccggtttctataaattaggacataaattggtatatttgaaactactatagattcttaaaaattggatgctttaaaagatgctcttaatattatcttatattatagatgttatagtcattataaaataaatcccagatatgaaattttgaagaaacgatcaattagaaacatgaattaaatgatgtttgatagtttttcaatgtatgcttggtagactaaaaacacaagacagcagaatacgtaatcacgaaaacacaatcatacatatcatattcctatctcgaggaacaaaaacagatgacaaaaggttcaacaaacaattgcttgtcatgtttatgtagcgcatcaaacacaaagttgatgttactgtacggcagggcatcccttgcatccttccctaccgttggatctgaagacggagcaacgagcagcggtgccgacagggacgccctaccggccgctataaaggctccccgcgaggctggcggacagccctgctgagtctctcacctgctggcggaggcggcccccaaaagccaaattccccaacccacaccacctccacactccagtaagcacyccgcctcccccctcgatctccctcctccaattccttctgctgctgcgactgaatcgaattgctccactgctactaatctctatactactactgcttgctcctgtttcaatcgatcaatcatgccgcgcgtaggttttttccggcgcaaaggtaacgagcgaacacgagccccggtttcccgaccccctctcccagatccgcagcgcgcccgcgcgattccgtccgcccgacgcgagttcccctgtgtattttttttgtgatgatttttttgacctytttgcctggtctagggttagggtttgctgtcggcg

SEQ ID NO: 11009 - DNA, 332 bp, Zea mays
gaatcagctgtataaagtataaaattgaaaagaggaaaggagtcagaatatctttgtcctgataagccacaagaacagagcagatcgcccgatgtttcagcccatcacatcacgcccgccaaccccatgttagggaaaaaaagaaatacttgagacatgttaggcgcgaaaggctacaatcccaacctcccgccatttccctcgcccgccaaaacggccccgaaaccgcccagatcgccactatttgtccccgccaaaatgcccaaatccgcctcccgctcccgttccccaatcccagcaccgatccccgcccctccgacgcgccggcggcc

SEQ ID NO: 11010 - DNA, 529 bp, Zea mays
aggagtgtacagatttcttatatagagatgtgagaccttaaaagtaaaacagatatttgcgcacgtaacctaactggttacttcactcaagtcggggcgtcgtgcgtccagataggtaacgtccagtaaaaaaaaactcagagagccgagcgctccttggcccttggattggattgcgtacgtcaggctgttgttgtagtagtcagcacaggccgggccccaggaatccaggaggcgttggccccgcagtcctccgtggtggggcgaccacgtcagctgggccttcgaattccgaaatgaaacagcggcacagcgctcgccaggcgcacggcccgaggaggaaaaggcaggcagcctcacgggaaagcgctgatgcgaggcagaggtccgtccgtcgcaatagggctcgcaataaaaccgctccccactgtctccggccgcaccgggctgaggaggccatcggacgcacaaggacagcaagcagagtgcagggccggagcgagcgaccgagagtgtgtgtgagagagag

SEQ ID NO: 11011 - DNA, 448 bp, Zea mays
gaaaattagcaaaagtttaggcgtgttaaatgtattagagctaataattagttgactaaaatttgttagtgaaattagctagctaacaaataactatgtaacgattaactaatttactaaaaaactaactaatttaccaaaaataactaataaccgaactattagatagagtgtttagatgtttcaactagccactgattattatgtctattgcattaaaacaccaccttatactgtgataaactttagcggaaaattggaaacaagcatgctcatagacacagcagtttctcaaacactggccgagcgcaaaatttgaaaaccaaccctcaacctcaatcggggtgccggcgtccgacgaagtcgacgggccatccccattccccacccggcagtcggcagtccccacaccccaagacctctgaagagtcggaagaagaagcgggcg

SEQ ID NO: 11012 - DNA, 306 bp, Zea mays
acaacaataacaacaacactagagcttcttgcttgacagtgccgcggcacgtccattggccggtccagcttattcatccattatcgatttgagcaatgtgttgttccttttttttgtttcctcttcaaaaattcttctttttatttgtcttctgtcaactaaaaacgttactgtactaattttggtccagcaacagtcgatccatgtactaagaactgtacttactaccagtgcttctgtcaggagccagggcagctagatcatctctctgtaactctttgtacccatatatgtactgcttgcctg

SEQ ID NO: 11013 - DNA, 832 bp, Zea mays
tatacatttttagattaaaatgtatctaaatttacttaattagagtattaacactagattgtgtaggagctcccatgggtcaacactaattttgccgatattttcaacccgctagattttgaataaaacattcgctgccttgtgttctaatacttgtcaaatatgtttgcaagtgttttcataaacatatatagatggtacgcagcccggttgaccgttcgaaatcaacctaaaagttgcggttttacactgacaccaatgaatcatgttttattaggcaaaccctggcgaagggggccttgatagcggccggtcactctggccgcgtcaaccggcgcgtccaatcacatctgccgatccacgatcagacggccagtggctcgcgggacgcctcccaaacgccggatccatccacgcgttcggcaatgctcgcctttcctgcaccagtcgcgacagtccgcctcctccattcccgctccggctgtctcaattttggcgtaccaccgcgtgcgctttcccgaaatactttcgccatctccccgatacaaagcacgaagtggagagggcgcggcacagccaggcagccgcacggcacaactgcaccgcactctgcctcctccgcccgtcctccccccttgtcctcctccgctcggcactgccgcattctgctcttttagccaaacacgcgcaccagcccaccgcccagccggaccagagaggcggagactacagcgccggcgtcgcacggcaggagagggagacgcagccggaaaaaggcgcagactttgacttgctggtgtccggtgggagtgagatacgccggtacagagcc

SEQ ID NO: 11014 - DNA, 1500 bp, Zea mays
gttttgtttaagtcaaaggaaaagcatttgaaacaggaggagaaaatttcaaattttgaaaatgcttctttcaatcttattcatatacctttgactatttgcaaaaaggattttgaaaagaatttaccaaagaatttgcaaaaacaaaactcgtggtgcaaatgtggtccaaaattttaaataagaagaaaacaatccatgcatatctattgaaataattatattagtttaattccaagcaacctttgcacttaccttatgcaaactagttcaattctgcacttatatatttgctttggtttgtgttggcatcaatcaccaaaaagggggagattgaaagggaaatagggtcaaaccttttcctaaatgattttggtggttgaattgcccaacacaaaaaattagactaactagtttgctctagaaaatatgttctacaggtgccaaagcttcacaacaaaccaataaaaagtccaataaagggttcaaatacaaaggagtaaaaccaaccgaaggttgtcctggtctggcgcaccggactgtccggtgtgccaccgtacagtgtccggtgcaccagggtggatcaactcaaactcctcagcttcgggtttctggaaaatgctctccgttataattcaccggactgtccggtgtagcaccagactgtccggtgtgccagcgggagcaacggctagcgcgccaacggtcgtctgcaaaagtgaacagtgaacgctacagtgcggactgcgcgcgcagaagtcagagcaggcgccagaaggcgcaccagacagtgtacaggacctgtccggtgcaccaccggagtgtccggtgcacccgtcgacagcagagttccccaacggccactttggtggttggggctataaataccccccaaccaccacacttcaaggtatacaagttttcagccattgcattcaatacaagagctctagacttcactacaagacacaaacaagagatcaaatcctctcccacgtctaaacatcattccaatcaaatagtgaccagtgagagagagatatttgtgttcatttgagttcttgcgcttggatcgcttttcttcttccttctttcttgttctcaagcaacttgtaatcaacgcaagagacaccaagttgtggtggtccttgtgaggggtctaagtgacccgttgattaaggagaaaagctcactcggtctaagtgaccgtttgagagagggaaagggttgaaagatacccggtctttgtgaccacctcaacagggagtaggtttgcaagaaccgaacctcgataaaacaaatcaccgcgtcacactcttcatttgcttgtgatttgtttttgccctctctttcggactcgagtttatttctaacgctaaccccagcttgtagtgtgtgcttaagtttataatttttagattctgcctattcaccccctctaggcgactttcaattggtatcggagcccggtacttcattagagcttaaccgctcgaagtg

SEQ ID NO: 11015 - DNA, 215 bp, Zea mays
tgcatgcctgcaggcccaccaaaagaaaagatcacgacgcgacccgctcgctctcgctctcgggccccagtccgatcgggtcggtgcctacccacccccgctggccgccgcacccaggcgaggcgaggcaaggcgcgtcccgaacaacggaaccaactgcaccgaccgagtcaatcaatccggcgagtgaccgagtggggtaggttgtgtgcggc

SEQ ID NO: 11016 - DNA, 538 bp, Zea mays
tccaatccagtggtttaaaggtagtagaacacacacgggcatgcatgggtacacgcttggcttattgctaacacgtgtggttaaaacaaaaacacacatgcatgtagcgtcacgataaaacccatggtacgtaacttggtagcgcaccatctagctaactttgctttctgttagcctttccaaacaaaatcacttgtcctatttgctgccctgcaggttcacattgagtgcaaggccgatgcatttttttcttctttttttttgcctctccagaagtttctgcagggaggcacagcaagagagagagcccagcactagataagtagggggggaaagaagagcatccaagcgtactcctcgatctccttcaagcagctaacataattaactcatgggtgcatagagatatgccgccgacgacccatcatatctatgggtccctccccttgcactgcatctccttcaattcctagtgtttgcttctccctttcttgacctttgcttggaaccattgattgatagttacttattattgggc

SEQ ID NO: 11017 - DNA, 835 bp, Zea mays
gtgatcgttgatcgttacatccgagccagcgctaggaagcatcccagtgaaaagtgagattttttcgtgaagccagccagaagacattgttaccggcatctcactagtcatcagatgtggtgagctgcccagagaaaagaaacctgcggtgcgaggtcgcaactgacaaaacgcttcctacaaccgaagcggcgcgctgctcgcagcctccgatgcagtgctgaaacggcaacttgatgcgaaaattctaggtttctgttgtgtcatgtcatgctctgcataccctgtgtgaactatcgaataatgttggcaaccgcaccgcaccgcacttggcttcccatgaccgggaggatcagtgtgtcgatccagaaattgttcactggctcctggctcgctaatattaacaccatctgactgatctgacagcttgtaaaatttcactgctggtttacgcaaggctgcactgaacaagcttgctagaagaggcaagttaaagcactaattagtctacaaattagtgactcgtctcggcggtcaactgaacggtaaacagtggaaagtggatgatctttctctgcaatccgtaaagcggtcaactacaccgacggtagcattgttttgcacaccaacttatcacctacaaaagcgacgcgtcctggatcgattgcaaatctacccccaaccaacccagctttgtatctgctaactgtgatcaccaaagttgtgctgatacgatgtgcaattctcgctctttcttctctagaatgttcctgccgatgctttataagagaaggttggtcagcatatcgatctctgccagtgtctagctgagaac

SEQ ID NO: 11018 - DNA, 446 bp, Zea mays
tgttcactttttttctttgggtgagctgggtgggtggggggagtatcagacttgtctgcaatgtcaatgaatatagaaatcctatagacaagtagtttcatgaatttcctaggatatgtcacttgttcatgtagctttctctgcaaaagaattcttctcgagctacctatgataaaatatattttttctagtcctgttcccacaatatacaaggctaaccaagtatttattttgtcttcagctttgtctgtttcagcttcatgagttctgggaaagcactggcatccaacatctcttattcaacagtgaacagcagcatcatctttctctgccttttcgcgggatacttgggaattcctggtggaagcttcgctggaggaagctaatttagtcttcactgtagtagaagtttggcctaagagtttgtaggctttcaagcttcagaa

SEQ ID NO: 11019 - DNA, 200 bp, Zea mays
tcgcgagccaactaataagctcaagcaggaaggaagacgcaacgcaacacaaggctctgcctctgcttcgcaagaagctgctgctatgctactcgcagagagtcctaggctgaactgctaaagtgagctggacaacacggaggtcggggagcgttcacgagcgagtgcgagctcaaagaggcacagaggcgaacggatga

SEQ ID NO: 11020 - DNA, 992 bp, Zea mays
gcggcagcaagctggccgcgccaagaagaaacacatcacaccctaagttcctaatccaaatacaaaactctctctctctctctctctctctctctctctctctctctctctctctcckgtckgctcgctttcttctcgcgcggtgcgggagaaccggagaaccgccgcctcagctccgtctcgccgtggacgcaggtatagctctcctccataggcttcacaggtgtagacctaggctaccaacacatcgcggcgcagccgagcggctctaggccgccggtccctctcctctctctgagggatcctacgcctgccgcagctcagtccgccgccgcctccgtagcgccgctcccttatcgtgctagcggtgtggatatccatgccggcgcggatttgaaagtaatcctaagcttgttcggatgagttggttccatcttcaatcgaatcttcgtatcctccccgcaatggcccaatctccattcagtttgctgtggattgatgtgttgctgcgtggtggcctaccaatccaatcccttcttggccaatcagtggatttggttaaattcaacattagttgcccccttagcaccatatgatttctcgttgccaaagtaagtgttagtgtagtttggtttccaaatagggtttcctgtggaacttttatgccccacaccaagtccatccctggttggagtaactttagctttattctctacctattttattcctgtaaaaatcattggggttgcatatgaaacacaaggtcctttattagctttgtagtaattcctatgccacgtttatcggatgttgttgcttaattgcaattctggagctgatttagtgtgaattttgagaggtcatcactcatcatacatttgaatctgttgatttcaaatggtaactatactatatttagtgtgagtttgtccttgttatttctatatgcagctgtgacttaaggcaattattggaatatcgaggatttgctg

SEQ ID NO: 11021 - DNA, 1500 bp, Zea mays
aaaacttctctgcatgcgtgttttttatgaacaatgatgtgcatagtcaactaggcaataaaaaaaacttgcatgacatggtatatatatatatattaattatatgaatagattttattaagacataaaaatgtgttctattgattaagtggatgtcaatgtgaagctaactactaaagtttaaactcatatttttacatatattttttattttatttttacattaaacgggaatggtaacgcaggacaatgttgaaattagtgctttagggtatttaatgtactaaacctaataattagctactaaaattagttgaagatatcaaacactctagctaatagttctattagctatttttggtaaattaactaataattggctatctatttgttagttagctaattttaccagtaattttttagcaactaattattagctctattatatttaaacacttaatatagtactctttgtctcaaattaaaattcgtttcaggtatttagtggattcatttaacattaatggatgtgttttgcatatatgacttcgtcgtctatttgaatatagatataaaaatatatttgaatatagatataaaaagtagttgatgagcgaatactgatttcgaacggagggagtggaaaaggtttaaagcgcgaaaaagtccaactgaacaggccagttgtaggccaccacaagcgaaaaggttcatcattgcgagcgatcgataaacctcccagcactggcaaggtccggggatcgtcgcccctccctccgtctccacgactccacccccgcccctaaaccaaccacgtcggcgtccatctcctccacaacacaacacccctccctttccaggattctcctctcctccaaaagatcggtggcgggtgagacgagaaagaaagaagctgacaaaggcgagaagggatagagagaggagagaaagggaaggtagaaactggacagaaagtttctccccgctagaagtagctcggcggtgagggagcgagagacctgccgcctacccttgccccaccgtttttttcataccgtctcgccggaatcctgctttattttcccggccagtccaccgccttctcgggctaccacgctgatccggcgtcgtctgcggtccttccgaccaactcttcaatcttgtgaattgcttttcgcccagttagggcagatcaccattccttgcaggagttcgttgccgtctctccaatcctccctggctcgactgctcagtggtgactgatgtggtccactgccctgccctgcacctgcaagttagtttcactcgtgatccgtcagcttgccacccagcaaccgctgattatcagaaatccacttctcaaagcttcaaggagcatccttcgaacaagttcctgattccttcgcctcccgccctccccgtttcttctctggcatccttgtccgttgaccacagagggaagaaatctgttccgggcaggcaggcgcattctccgccaca

SEQ ID NO: 11022 - DNA, 351 bp, Zea mays
atactgattttttagattaaattaaaactgataatgcataatttttctaacacaaaacactcacgccaaagtggcaaacttttcgaattggggctcaaatctttggtcgccggagcttggtagcctgatgttgggagaactgctcgagtctgatggacgagtggacattggcctcggccatagtgcaagggagaactgctcaagcctgctgggcgagtggacctcgctctttcacttgggccgcttctggatctgtacgcggacgcccacgcactgcttggccttcgtctccgcttctcttgcgctttcgactcctgctagctggcggggcggctcgcctctcgcgccaca

SEQ ID NO: 11023 - DNA, 262 bp, Zea mays
gcttgctgctgcctgcccgtactgcttttttcgtgtgtgtgcgcgcgcgcgatcgatgttcaattcatgcccagctacttcggcgcttgcttgtacatacatgtttcatcagagcaccgcccgtagtttagtttcgttattgcttcttcacaattttgtaatcggatgaacatatatacaccctatgcttacatgtacatgcatgtttccttccgctggttaatctcttcggtacttggatcttataaagaaaaatataaat

SEQ ID NO: 11024 - DNA, 1500 bp, Zea mays
atataatgaactttatatttttgtagtttttaatgtgatatgtatttttgatgtttccctcttttccatactttatttgaattaaaagtctgtttcattgtgtatatgcgtatgtagaataaaagttaccatgggactaatgtgactgtaggcttatggtaaaggttgtacgttgaaaagttgtgatagataaatgatcaatagtgtgatggcggtatatataagcctgtagtattggatccggcctaagactaggtgtactcgaaagacgtcgctatttttggctcgatctcactttttaactgaatttctagatgaccccgttttgttttatgttatttgagacaacacgactctaaatttctcctacaacatgctaaactagtcytatttgtaaaggattcatttacgagaatgaccgttgtgcttccgttgtgtatgcagataaacatacaaataagagttataaacctttagataatgatctaactgtagatgtaaccatagtttttgttgggatttattttgataaagttatgtaagttaatggtgagaggacttaagtgttaaatatgacatacggttgaatcacgatctaaaagttaaagaaactcaaagggtgtttggttttttgactaaaatttagttagtgtcacataggatgtttagatgccaattacgaatattaagtataatctaattatcaaaactaattacatagatgaagactgaatatcgagacgaatttattaagcctaattaatccatgattaacaaatgtttactatagcattatatgtattaaatagatttaataaattcgtcttaccgtttagtccttatgtatactttctctgttttaaaataatatttgttttatctcttagtttttatgttatatttaactgtatgataataattatagacacatatatataagtattgtacgtatccactaaaaagttaaattgaattttattttgagagagagatggagtataattttgtttgtaattggactatttaacattttttattagtacgcttgtcgggaataaagtttagcccattgtattgtcggggcctcagctcgtacgcttgtacaccagtttctcattgcacagcaagcaatcgttcccttcatttgttaagaatttaataaagaatgtactgaagcttatcgaaaaaagatatagagatagaaaaaaaaggtgtcgctcgaaaaacaaaacccgaacctacgaacgaacgtgccgcttgtgggtccccagctgtcatcggcctgcctagtaaccgtaggcagcgagtagcattaaaatcttccaaaaatgaaacagaaaaaaaaaatataataagctccctctggttccacccgcaccacttcactcttctccctaaacacctcttctcgtagccggtagatcttccggggtcgccatctccggccacggcggccggcactcggagtaacgctggagctcgaggcggtggtcggcggcc

SEQ ID NO: 11025 - DNA, 96 bp, Zea mays
ggtactttcctgatgcacctgtggctattgtgccatcataaaattaattatgccttataataaggaagaattgctggtaaccatcttcatcatttc

SEQ ID NO: 11026 - DNA, 964 bp, Zea mays
ggggtctggtgcggtggcaccgctgcacccgcagggccggtcctgtatgtatagatggatattgtttgcatcatatattgtgatatgcctatgggcttgggaggttaagcccctaacacgatcgatgcctgaccggccctcaagtttgaccgctcttcggcccaagcccaacccttctccttcagcgcgttctgctcgtgtgggcgcctggccgcccggtccagcccatgtgtgagagcttttgtccgattaatttggttgcggtttagctttcagttttgcaacttttggctttggcattctaaaaaaatcattttattgtttttttacaaagaacgggaagatggcattgctgtaagttgcgtgctcttggcccggaccgcgatttaaaatttcttaattggggagaggcccttttcacgcctgcatcatgatcaagtgcgcgatgaatggtgatgggcaacttttgatattatttttatatatcgatgggagaaaagggggagtacatgttgtggcacgcctagtcagctcagcgtcatcacttctttctttctgtggccctcctcggctcggccgctcggcacagagcagcagcacaacgccacagccaccgcaggccagccgagcgggacggacgggacacgtggcggcacgtgtctgttctcggccaccgtcgccgggataaattttccgaacccagttgacccgaccgccgatgaaccctggccagattcctcggcacgtgggcccacctcaccagcctcagctgccgcctgcctgacttgggccctgccccttcctgtacctgtcctcaaggtctcccccgcgctgcccatccccctccccctcctccttcctcggcagctcgtggcgctccagtccacagaggagaggacacgacacgacgaggggccgggcagcaagctctgctcagtccgttccgcgggccggtcggtcggcg

SEQ ID NO: 11027 - DNA, 1123 bp, Zea mays
attgggtatgtcgaactatctaatggttttattttctgacactaaaactgagaaaggattatgagattaaccaacagtagtgctgtttttcactttatggattaccagatgtgaaacagtatgtttcatccaaaatgtgacctagtttatttctgatcaaatatgctttgtttagcacatagaaaaaaaggtgcatgtgctgcagaagctaatgcatattttgctggcagctaatgactccaatgtttcaagccaattatctggaaattactttgattaatgaggataaagcagattggtcgaccatgatgctccaatgtttcagtgctacatgcaggcttggtaagtttggagttattttttttaagatgtcgaaagagtaatttagaagtttcactcacatggatgtgtccattaccccttccttttccttttaattaaaggggcagaacgaatgttggaggctctcacatgagtagggtctagagaagggataaaccgaggcaaatctttccctgccaaatgcagagagactgcttcgaatccgtgacctggccatttagcgagacagctctccccacacaactaagcttgcccttctccttttcctgttaactgtcggcaaaaagttttagtgtctttattttgataagcaacatcttgcgtgcctttatctcggtagaaaagatggcttctgtgatgtgttcagtagaaatgtttttttatatgacaatcagatagattgcttttccctgcgcttccactctctttacaaaccttgtgtaaaagcagatctttaaaagtaggctgaatatgtgtcatgtcatgtggctttcacattggagataccaatccttaattgtgtcctataaggaaggaataaagctctgatgtaaacgaaggatcaaagggaagtataaaactttgagcatcttgggacagctagtttcttcttgcttcatgactgcatcctggttggagaacaaataccctgctgtacttttgcctctatttattcaccaattggtcatcgaacaggtcgcagctcacaacaccatttgtaagcaggtgatcttccattcagcaaccttctcagctggtacaagtccgagagcacgctaca

SEQ ID NO: 11028 - DNA, 148 bp, Zea mays
atcgatcgagcagcgcgtttgtctagttggtgctgtaacggctaatagtgttagtgtctcttctttaaaaaaatcagccatggcaggggcaggcgcggtggccttcatagccacagtctggcggcgatgggaaacaattgtttaagat

SEQ ID NO: 11029 - DNA, 110 bp, Zea mays
cgtaaggaagtctgtgctggcaacgatccgcctcgtcctaccagccggcgcagcccgcacgggaccggcctccagtgagcccagcgctgggcccctaccgggtgaacctg

SEQ ID NO: 11030 - DNA, 243 bp, Zea mays
gcgtgattttcaaggcgttcccctgaattttcttttcaatctgaggccggccagacaaggcataaatcaatccctggatcaaaagcaaacagcaagctagcaaaaggatatgatccagcaggtgagcatcacgccaagctttgcaggcagctttcttcatatcctcgttctccatcctctgctcccaaaaggagctagcgctagctaggaaacacacagagagacgaaataagcagcgaggca

SEQ ID NO: 11031 - DNA, 263 bp, Zea mays
aaaacagggtaggccaaataaaatagtaaataaaacagtagctaataataataataataataatttaataacggaagtaaatgctgagggcgggcgaaccgggcgatcggtttccttctcggactcttcgtcgtcttctccgatctccccttcctccctcgctctctcccgcccccgtggtccaaaccctaacaaacagcaatcaagcggaacccctgcaatcgtaatcggttcgctgcctaatcccctccctttctcatctc

SEQ ID NO: 11032 - DNA, 1201 bp, Zea mays
tgtttattttaaagacttcaaatgaatcaagggttaggcccctccccacatttcctgtctcccttttttaggaaagttgagggttggttttcattatttctcatgctggagtttgtatttacaaatgagcttttagaactacaaatgtttcttaatcattattttacaagaatcttgactatgtaattactaatggaagttactaacattcaatacacacccaacacataacttaaagcatcgggtacacattgaattatgtgatggtatgtcaaaagatgatagaaagaaaaaggaaaaaggaaaataaatgaaaaaagaagaagaaaaagaaaagaaaatgattagtatggacttttattcagtggcccatctaaaagcccatcaatcagcacaaacccaagttccacaagacccacacgtttctttactttcaagtctcaaccttttcactgatccagcgaaggcatactgccgccgccgtttctgcatctcccatcttcgcaacgccggcgctccatcttgcgctccctccctcactcgctctcggtacgcaggcggcggcggcggcggcggtggcggctctcagattcgggctctcagcgacggcgtcagcagcttccactcccgcctctcgccagttgcctcgcgccctcgcctccggtcctccgcacaccgccggttacccttcgtgcgtgcctctctctctctcctcccgcctccggtggatcgtcaacggcgcccagccccggcggctgcgccgcgcgcggcctgagggcagcgggagccagcaaccgctgccccaccaaggcggtcgcgccgctttgggagcgcatatgccccaaagcgaaagcaaaacgttacccgttcgcttagcgcttcagcgtgcgcttaccgccgcttgttgaaccctgctcattctcaaaggtctatacagtttgcccagcaatcaatctagagtacctgtgttcaaccaaacccaccagcagcagcatgaagatggcccaaaatcaacctttataacggcttatatgttaggatctatgttttggagaaatttgcaatttcgccacctagagtgttgctctcttgctattatgccatgccacctgtgtctatgatctgtggacctgtctgtctatgatttgtggatccgatggcaaattagcgatgcccagcgttttgagtggaaaaattgcaa

SEQ ID NO: 11033 - DNA, 91 bp, Zea mays
gccgtcgtcgtcggagaagaagaagaaaggctagtgttgtgctgctgtcgcatcagccgcccgccgagcctcagatccaccaccagcaccg

SEQ ID NO: 11034 - DNA, 691 bp, Zea mays
aattactttacaatcttctacatgatgattagattataattcttttgcaatcttttatgtgttaattacaagaactatcttgtgtttatcctccatagtgtcatttggttgacgcacctttaatacgctgttaaggcgagcttcaaaattggaacatgtggattatcagttcataaagaaacatctgtctgaacagtttaatgagtttcactcactttccactgtgaatattgtagatttgatcactttgttactggcgcatgaatgaatgcttgttagctgtgctcgtttctgatctctttctctagacaatccttacaaagcctagaaatgcattgattgatttgattctaatactttaataacagcttgatgtcacaattttacccaggagtgatgataaattcatctgcattatctgtactagcaggttgaaaggttttgaacatgtacagttgtgtgctagtctgctagtacccttgattcattgttattggttattgccracaaaaaytttattgtagttgtaagcttttctgtatgtttgtataaatattaattttgtttggcgtagagatcagacaacctttggctgccactttcaatttaagatcatttcactttccagatatattggtgcatgcatttggttttactataatgtttcacatgtggtattaacagttgacgt

SEQ ID NO: 11035 - DNA, 1500 bp, Zea mays
ttcccgttttccgtttcagcaatcagcatcagtggtggatttctacgcgcctgtctttttccggggaccggcgttgcgtcacctggacggcgagccggcgggctgatcggtccggtcggtcaccaaccctcaccatcgcgttgcggcttggacggacgggctcattttttttcgatttttttttctgtccaccctatccgcgacgcaaccgcgaccgcgagcgggaggaaagcgtcggaacacggaatcggcacggcaaagtggacctgcagtcctgcctgcgcttctgtttatctgtttggttggtgagttgcctggctgctcgtcgtcgtccgcccggctaggcaactgttgcccctggagcagtttttgcctgcaatttttgtcgagactcgaaccaaccacacscaactgtccgtactgtccttgtcccgtttgaatgtatcagatcatccagtcgtctccacggcttggatcgacagctgcctggtctttgcctgtctatcgtttggtttcatgatttttgcctgtcgcctcaagccaacgaaagggttgactttcacccatcaatataaattttcatctctccccggtgcttccgcaaccgcatatgccagaactagtgagtaattttttttcatctcttcccctgcggctagcggcggaccgctcgctgttcgtcggcgcgggtggcggaggttatccggagccgatcttgtgctcagctcgagcaggatgttgctcaccgtgatgaatgccatgaattcgcccagctccacgcggaggtattgcgaaagacctgccagcgacaaggatctcgacggtgaactcgttgtagcagaagacaaaattgaagtttgagatgctaggggaaatcgttcagaacagaagtggcttacaagaaaaataggacatcgttcttttaatggttatatgtacaatagcttctatcattctttcaatggttatatgtacaatagcttctaattgggaatgtgaaagcctgaagaacatgaataaagttatcatctgcagcgatcaacaagaggaagacatgcgaacagcaacgctaatccagtaatcgtagattagtactgctcaaattgttaaactcggaaataatagcccgaggctttctagaccggaaaggtaagagcaaaactgacgaagacgtaacaaagccagcctaacttcaatacatgtagtaacatatgggcaacgggtggcagcagcacatcaccaaaaagccaacaaaatatctgcttcattgcgcagcccctgcatcaacctcaacctccggctttaagaaatcaagtcccgtccatcctccggcttaagacgtcaagttcatccatcctctgcactctccacggcttggcaagctcgctttcctcaacacctccatccacatggtcaccattgatatcctgttaacctttgcgtccctcaggcactcaaatacgtccagcacagcatttgccattgggtgttgctgctgca

SEQ ID NO: 11036 - DNA, 588 bp, Zea mays
ttttcttttcacaaagtgtccaaccggttgtactcgtatagtttggactttggagtgaaccatttatagagtagattttttctgttgatacaatttctgttatttatatttattggtcgtatttgtttgtttccgtaaacccgtttcatctgttccgttccggttcctgctcccgttttggatgatgaattgttgtgggagcgatttttttgggtacgtttcggtctgtttttcatcgctaggctgaaccaaacgtgcaacgctcctcgcacaaccaaacgacagcgcggcggcacggcatcgccattcgcccaccgaccacgggcagagcccaagcccagagaagtagtagaacccacggattctgcgcgagccaaccaatcccccccaacctaacccaatcccgtctcgccctagccgtctccatcccaccacctccccccgtccgctcgtccggccgcgccgcgccgtgcgcgacccaatctaccacgccacttacctcccgtcccgtctcgttctcgtcgcacctcgccacgcccgcagagagagggggcgcgctcgctcgagccgtgcgcgccagccagcgcc

SEQ ID NO: 11037 - DNA, 181 bp, Zea mays
ttgaagcttagattttggtggttttggtgatgtgcctcccaccatttgcccctttgttgtgtatagaacctaggttattgtgctatgctttgtaatgtcttcctcagctggacccttagaaagcctactatatttgcctatgtacccctcgtgtttaataatttgagcagcataataatct

SEQ ID NO: 11038 - DNA, 285 bp, Zea mays
tgtaagtttttttttctcgctctctctctatatatagcgcgctatggctataaatacttttaatttacatgaagagctattttggaaaccctattttttcaaaaaatttcaattttcttaagaggcagtagttcattttcccttaaaaaatagaaatcccttggaaaaaatgaattttccaaactagtccgaaatataggataagtggtgaaactaaataatagagctttgacatgacccacgtacggtcttgggggtgcatgcaattatgcgtgcagtggatgc

SEQ ID NO: 11039 - DNA, 205 bp, Zea mays
gaccgggaccgaccttgggacatctgatatgtcggtggatccgtggaggagctagagctgcactctttctctgctgtgtgtgttgggtgttttcctcctcttttttcggatcctatttatttgtttattcatttgttatttcgaggcttgagacggagatgaggacgtgtaatcctaccaatttttcagacgggagctgatttct

SEQ ID NO: 11040 - DNA, 1035 bp, Zea mays
gatgtttattcaaatataataattgtttatttataaacattaagttatgtgtggtctgatggttaccccttatcttaggaataaaattgagagttaattatcctgcttaataatcaataaaagagagaaaaaaaatacttacatcattttctctctcaaatacggaaggagagtaagaattaatagggtgtttggtttgagtaatgagctagtccataattttctcacttttctttttttcagttgtaaaataggatgagttgatctattaacacctcattctttacaattaattagttaatactaatattaagaatgataaacttatagaatagacctgtgatacatcgtcttatttttatattaaataattctttaaaccaaaatccccttagaaattaatcatgtcactctttttttttcagaattactataggtcccaacacagccgaataacacaactgaatctgtccctgtcgtagagctacccagaagcttcctttgtctctatcgatgctgactccttcaccccaacagctcccaatgtttccaccttcccctctccacgctgctttcctctcccagcgagcagtcagcagtcagcagcaccaccggtctcctccacaacaaaaaacagatattctatcgtcagcaatcctgcgttccctgcccgacggaggtgcttccctcgttgctgcgttgcactgcggcggcctcgagcttgttgtcgattccagctccatgcgcccatgatttactttacttgtgtaagatcaccaatctccagtctctactgctatttccccctttgcgttgctggaaaataattggtttgtccatttagattcactaattttatgcgtgtttccaattctaggttttctcgagtctgtagcggtttttatcagctgcttgccttctgcagaagaaaaagaaaaaaaaagaacagctttgttactacttcccatcgttcacccattcatattttttttcttggttcacaaagtaagaggaagcacaaactactccaacttc

SEQ ID NO: 11041 - DNA, 111 bp, Zea mays
cctaaagcatgttatggtaagaaaaataaaaacagaatagttcctgaagcaagaactgacaacctacctaatgtgcaactttctgccctagagaacatacattacattcat

SEQ ID NO: 11042 - DNA, 1500 bp, Zea mays
acaatccaacgtgaacagtacgggatactgtttatctatttataggtaaccataaggttttgtgcgttattacatttatgccctcaacaattacatacagagtttcaaaatgccacaaagacgatatcaccatttatacttattaacttgaacaccttctccttatgtcgacttcccgtttcaccgtgacgaagcctgttaggcgaagcttgcttcgtcgagctcctcttgtgttatgtcgaagcttttctggtgacgaggcttctataatattcaatagtatgctgaaagcaaatggttaatcgtgtttttgaggaacttctgaagaggaagacccccaacagatattattattatataaatttaatcgcaatttgcatactttgagtcttaagaaaagttaaaatgaattataatttaaaatggagagtatgtataccgaaatttagatttatggataaaaaaacttataaccacatcacatgctcgaataaaaagctaaaactatgtacaaataaagatgtaaaccatggttattggctttaaatccacatttacacccatctatccaacaaaaaaacatatatttttatgttttatactctactcaaacataaatgtaaatcattatctttgatgattaagaaacatgacagtttcactcccagcagtttgcctcttgcgtttttaccttttgcgataattggcctcactcgcggactgcgtttgtggtggaccatgtggccactgtcagtacccataggtatgggtagcttaggcactatagccaaattaaacttgcccgtagaggcaggctatgggcctctccttcaaggtaggccaggcatataagaccccccccctaagagacaggcagaatacatggccagtaccccgccacgcgtcaatccaaggaaggtccattgtcatgtatgcctctatcgagcttccttcctcaatggaccttgctaccctatagtgaggtccggtatagacatgtggcacaatcaccccatgcacatgacagggtctcatgctaccatgtggtttccagggacccactaggagccccagacctcatcaataaggctccaatccccttagagggctctctatgttcattggctccatctactcttggggctccatcaaggaccragaccctagggtaaactccttcgtaacaaagcactccaccaactaccaagcggggcccaaggaggcactgtagagatggcaatgggtaaaaacccgctgggtattacttgcccaaacctgtacccacgaagaaaaaacacgcccgctaaaaaacccatacccgtgacgggtataaaattttgcccaaacccatacccatgcgggtttcgggtacccaacgggtttcccatacccactaacatcaacataaaaaataattcatcatgtaaatgacaatcaatacattaataagctagcataaaaggaacaagtgataactaattttagcctaaaaattgttac

SEQ ID NO: 11043 - DNA, 1500 bp, Zea mays
tgtacccacgaagaaaaaacacgcccgctaaaaaacccatacccgtgacgggtataaaattttgcccaaacccatacccatgcgggtttcgggtacccaacgggtttcccatacccactaacatcaacataaaaaataattcatcatgtaaatgacaatcaatacattaataagctagcataaaaggaacaagtgataactaattttagcctaaaaattgttacatgaagtttatttcaattagaacttattcaattaataatattatgagacatatttataagtaatattgattttaaggcgggttttaaaaccccatgggtttgtgggtatgggcagtggaaggacaaacccatgcccacgtacccattgggtttccatttgaacccattaacaaacccatggataaagaaattgacccaaacccataccctaatagagcaaaaacccaccagactgtctagcacaccggactgtccggtggtgcaccggacagtgtccggtgcgcgaggctggtctccagcgaactggccactctcgggaaactttggcggcgtacgactataattcaccggactgtccggtggtgcaccagactgtccgatgagccaacggtcgccagcgcaacggtcggccgcgcaatccgcgggcgacgcgtggcccgtgccaacggtcggctgggggcaccagactgtctggtgtgcaccggacagtgtccggtgcgccaatcagcccgaagttgcaacggtcggctgcgccaggaatggaaggaaatcgcgcaccggacatgaacagtggctgtccggtgcgccacccgacagaaggcaagattagccttccaagaatgcctccaacggctcctagctgccttggggctataaaagggacccctaggcgcatggaggagtcacccaagcatactttgagcattctaagtctttcacactccgtcttcgcgcacttgattgactttgttagtgatttgagctctgttctagtagtgaactagttgtgcttcattcgagctcaagtcttggcttgtgtgtgtgttttgctgcggatttgtgtattttgcttcccacccttactcttgtgctttcactttgatatttgttgtaagggcgagagactccaacttgtggagattcctcgcaaacgggaaaagagataagcaaagaagaacatcgtggtattcaagttgatcattggatcactagaaaggggttgagtgcaaccctcgtccattaggacgccacaacgtggaggtaggcaagtgttatacttgccgaaccacgggataaactcgcgtgtcttttgtgattgtttttctctgagacttgtgttcgcaagagctcgctacttagccatactaacacttaaccaagttttgtggctattagttgttgaattttacagcatcacctattcaccccccctctaggtgctctcaattggtatcagagccgttctcttcacgcaagggactaatcgcccgaagag

SEQ ID NO: 11044 - DNA, 150 bp, Zea mays
gtgagactgactttccttcttcttcattcccctttatttcgtcgttttcctggacctggacggacgggcactgatcgatgagcgcacggacacatgcaggccgagaaggcgatcgtgatctagaccatcctcttcctctccgggatcaac

SEQ ID NO: 11045 - DNA, 326 bp, Zea mays
cgggccgttttggttatgtatagtcacacgacttcattgccattgtcagcacatttgatccacagaaaaaaaaatgcatgtttcagttctgaacaaacaagtgccggcctgatgtgatgcatgccaaaccgagaatgcatcagcagacgaatcagatctaccagcccctgctccatcgtcaaacgagtaacctgacagctgcttcccgttcttccttttcctctgtccgtgtatccaagcagaggtgcacttcggcctaggagcaccgagcacaggagagagccaagaagagaggcggacggagggaggcgccgtcgaccgaggag

SEQ ID NO: 11046 - DNA, 822 bp, Zea mays
aaagcactcggcaaaagccgctggcactcggcaaaggctcggattccggtagtgaggacctatgatcaatttgagagtttaatgaagaaattacatctaagtgggataaaaggaattaagatgccaaataaggtactggacaaaactcaaaactgcagtggcatgagattttttttctcaatttatatatagtttgttttgcctgggcttttttttggtttttttttcttgcactgatttcaggatttaatttttataatctctcttggggttgctgaatcaagtatcagtgatgaataagttgctgtatcatttgagtatataactagtgatcgttcctcagtcctcactattattatcccgacaactttgtagcatcaggttgagggtacaggatctctttgttccccagtacacaagtgctatcatcatcatcaacatggtttcatgccaactgagcattgacataaagcaatataagaaacacactttttttaccctttttcagagatcacatacatccattgcctcctctccttttccttacttgccatgactctacctcagttacactgcaaatccgatcctacagtggaatgggttcgtctccttatcgttttaccttcgacattttaacctactacaactacaagtgacagaattaatcaaaaggatagctagcagcacaaaccattacagatcctttttagggcgcccgcaaccttactgtaattttgcacctgccaaacatatcatagtcatcatcgatcaacatcgaagaagctcttgagctccagcttcctttgcctcttgaccctcgca

SEQ ID NO: 11047 - DNA, 452 bp, Zea mays
cttttctttgaggtgaaaagcgaccggcaacaatctctatcttttctgacaaccagctgcccccacccacaggcacaacacacacacagcattatcaaatcccagatgcctccttgcaaaaaaaaaaaaaaaaaaaaaaaaaagcagcatgtgtctgcattgcatctatctcttgtctaccaccaatagctagcattagcagatccatgaccaccaccagcatgtgtctgcattggccatcgcacacctcgtctctcttctcctcgtcctgacttcccatggcctaccatcccctctcctccacatataaaaccctctcactcactccatcccatcgtctcatgcgttgtggcctctagagcggtagatacagccaccccccctgaagcagaaggtctttctctctctgtacatacattcttacccactgttcaactggtgtctgtgtcgaa

SEQ ID NO: 11048 - DNA, 1241 bp, Zea mays
cactgatcattatgtactattcaagtatattcaacatactgaatttcatattcaacacttagcaaacttgttatacctttaaatgtgttgttactcaattcaccaaaacccactaatgggctagatgcaattacaataggcttgtatctaaactttagaaagtggtggaatgtcaaattctgaaccaaataacctactctattaagggtctgtttggaagcacctaatttttaagaaactggtttatagaaactatatagtagtttatgtctcattttaaagaaactagattctcagtttcttaaaaatcaaaagcctactctctccaaactaaaaccaacttttgtttatttaattacatcatgccctattttatgaaatttatatatattgtcattgctttttaaaatagaggaagggtatgctaataattatgtatcaaaaactaacacacccacccaactttttttcaaaaaccaatttctagaaactgattatagaaactagtttattttataaaaaaatgttgtgctaagggggtgtttggttagagggactaaagattagtctctagtttttagtcccatttagtcccttttttgccaaacactaggactaaaatatggactaaaatgatttagtctttagtccttcacataggtgctaaaagagactaaaaactcataattatcatgttgcccttaactttttttatagataactaatattatgattatattctaaggtcatttgagtctttggaaagtgtatttaatgactttagaatttgtttagtccctagaaccaaatatgtagggactaaagtttagtcttaggactaaagtttagtcttaggactaattgaaaccaaacatggtctaaacaggccttaagtaaatttcaattccttcaaaacgaagggtccaatcggcccttaataacaaaagaaaaagggaatgtaagaccgctcatgtcatgactgttgtattgtattagctgctactccgttgggtcccatcccaaaggtcagcctcctgcttccctatacaagtccaccacaaccatggtttggttgatgctcaacgcacacggcgctgaacccgtcattcatatatatccagattcccctcctcccttcctcccgttcaacttcaacccacctttctgccacacacctcgagcgaagcaagcaccgcaagaattgaagagccagggagattttccgtcgctccgtccgatcc

SEQ ID NO: 11049 - DNA, 814 bp, Zea mays
ggtgacctagcaccatgtgtttttatgcttgtagacttgtaatggtgcagcctgtgggttaggacgggcagcctggcagtggatagttgctttacatcctataaggcaatgggagcaagcgggtaagtttcgaaaatgatttgacaaatgatattggtggttcttacttcatatcccctccaagctgcaatcagcctttcataacatcgtaggtccttgcatttttagcaaggataattaagatgcggttcataggtatgaatatatttgaaatgattagatgttggaggcggatttaagatgttgtgtggcttttgcttcttgatttgctgcttgcttccttcttttgccaatccagcggtttcttgcattgaaaatgtggagctaaagtgtgtatgttttgttacacaaacgttggtgttgttgtgctccttttgctgaagcactgccttttacggttagcgacactcaatgttcgatcacttgtacaaaacaagatatgtattttcttttgagcaattcttttaaaatatatgggggcaatgaagagcttcatattgtgttgaacctcagtctgtaatattaagttgcaagtgagagttttatacttacgacatgctacattttgttatccttatagttggttagcctattgcagaaggtggttgaacttgtactttgagaccaaatatatattgcatacttgatattatactattatttgagcttgtcttattgtactcttatctgttcttatgaagattagaggaatgtgtttggggtgagtaatttttttgtgttgtttcctctgtcc

SEQ ID NO: 11050 - DNA, 166 bp, Zea mays
ggtaagactttgcataaggtagggctgcatcacctgactccaggattggcaacaacgaccttccaagactggtggagagaagctgagtgccaggtgccaaaaaaccagaaaagaagatttaattccttagtgattctggtggcttggtggctatggaagcatagaa

SEQ ID NO: 11051 - DNA, 1500 bp, Zea mays
ggagatagaggtctaaaatagacccagtacaagctgccaaaaaaatagatcaagacagaaaaaagaagaagtaaaaaaaaggggggtgggtatccaaacaacccccagccacaccagcacctaaggccacaatctcctaagatctcttgcccctgccaagccccaccgaacagcatcttcatgaatatgctgcatgatgatgctgatgttgggagatgcaccatcaaacacacattcatttctatgcttccatagccaccaagccaccagaatcactaaggaattaaatcttcttttctggttttttggcacctggcactcagcttctctccaccagtcttggaaggtcgttgttgccaatcctggagtcaggtgatgcagccctaccttatgcaaagtcttaccttatgcaaagtctgccaccaagtgtctctggcaaacacacaagccactaagatatgctgaactgtttcctcctgctggtcacaaagggggcaccttacaggatgctcaagacctcgtctacttaatctattcgctgtccagcaacgatttagagaagccagccaaatgaagaatttacaccttgggggggcccaacttttccaaattctagtagccggctcaaaagagactgaaccagccataaaacgatcatatgccgatttagtggaataatctccagatgcagacggggaccatctatgcacatcaggaatccccggatgtaactgaaaaccttgcactaggtcccaaattactaagaagtcgatgataatctgggctgacaggctgccagatatgtcattaacccatctattgtttaccaaggcttcttgcacagatctgcttttcttgattctcactgtaatatggctgaccaaagtgggggcaagggcagatattgattgcccatgaatccagcgatcagtccagaacarggttcgagagccatcacctacagtagtgtggaccgaggcagagaaaagagctttgacattggaatgaaccttgaacaagaaatctgcccagggcctttctggttgagtttttttgagccaaagccatcttagatttaaagcccatccaagaacttcaaggttatggatacccaggccacccatgctaagtggtctgcaaactcttgcccaaccaacagagcagtgaccacctctgatatcttttctgcctttccacaagaagcccctccgaattttgtcaatagccttgatcacccatttagggcattgaagcactataaggtgatggataggaatggctgtgagcactgatttaaccaaggtcagccggcctgctgtgtgaatgagggcagatttccatccggttagtttatcagctatcttgtcaatgagttctagaaaagtatttttggggagtttcttgactgaaaggggcaaacccaggtatttgaatggaaaagccacctcagtacaaggaaataactcctgtgcagccaccatgtcttgttcctcacaatga

SEQ ID NO: 11052 - DNA, 910 bp, Zea mays
gcgtttaaacggctcgggccgcccttccctttatgggtctcggtctcggcggcatccttcctccccacctattttatcgctcgtgtgtccccgtctctctcctccgctcctcctccatcatagctcctggctcgcggctcagcttgccactaccagcaagcgctcgtcacccgtcggttctccccgaggtccgtatgtgcgtgcttctctttcgtgtccggcggccgtggggatgaaagaaagcttggttcctggacgaacgacgcgcgtgcgtgcgttctcgaacgggattgttgcttgggcacggatcgtctgagcgcgctttagcttgcgctagggttccaactgctttcttgaccttgttttgtgtttgattcgggttcttgagctgccactcccttggatatctccggtcacatggagcaattcagggagaagtttagctgaaagcgcgagactgcattcagactcgtagtcgtagctagctatgttgttgcccgttggggtgggctggggtgggggcaggcggatctgatctgctcccgaagatctcctctgctctttgaattccatcgaagaatcccaaagctgacttttttttctctcttctctggctgagcttggggatctcttgcttctccgcacaccatcactggctctcttgaaattcgcagtatccttttccctcccaaaaaaaagttgccccgaaattcgcagcgtcttgaccttcccatggtcctactcctacacctgccgcatctgtcttgtcgtcttcgagtcgtgctgacgtactacgcgatattcaaaccaaaagaccgcccctgccttgcgcagatccgcgtggctcttggcgtttcccggattctcatgtacagttcgttgctgcatgcagtagctcgtcgcgtcggca

SEQ ID NO: 11053 - DNA, 699 bp, Zea mays
atttacttattctatcttctatccatacttctattctaaattttattacacgcaatagagactatagtgaaaaacaatatcctgtacaactatatgcacggtctagagacacctcgatggaaacttgccgccacgaggttaattgagaccatgttcaatattttatcatatggtcatctaaaacattgttttgcactgtaaactacaatatttataaattgaagtttgaatatggatacaagtttgaatatggctataaggatgggagaaggtgtcacggatgtagacctaaatcaaatcatgtcataaacaaataaaagatgtaagcaaacgtagaggaaattttgcctagttgtccgatgaagcgatggagacaccggctccaaccatccaatccaacaccaacacacgctgccatgccatgaaatatccccgcagttaaacagctcagttcagctgatacctcgccggcagatccccctcctgctcatccgccttcctttctcgaagcgcccaatttattaccttcccctaatcccgcagccttgccagaagccaaattggtgctcctcttatctcgccgcgccgccaccgctccatttccgctcccccagcccccccaaaagaacctcgtaaccctactcgcgggattccgcaggccgccgcttgcttagggttcatcactcctgttcacacccg

SEQ ID NO: 11054 - DNA, 625 bp, Zea mays
ggaggagcacaccaagtattctctaagcattcctaagcaccaagacttcgattccgcgcatttgattctttgtgatagcaactagagctccatttgagttgtgaactcgtcgggttgtgttgtgagctcttgttgtgacttgtgtgcgtgttggtactctgatttcgtgtcttgtgtgcgttgctcatccctcccttactctgtgcttctttgtgaacatcaaagtgtaagggcgagaggctccaagttgtggagattcctcacaagcgggatatagtaaagtgaaagcaaaacaccgtggtattcaagtgggtctttggaccgcttgaaaggggttgattgcaacccttgtccgttgggacgccacaacgtggagtaggcaagtgttggacttggccgaaccacgggataaaccactatgccatctctgtgttgatctctttgtggttatcgtgttatgcaagttctcctctctagccacttggcttattcgtgctaactcctaatcaagttttgcgaattaagtttcaagtttttacaggatcacctattcaccccccctctaggtgctctcaattggtatcagagtcgttctcttcaagaaagggactaatcgcccgaagag

SEQ ID NO: 11055 - DNA, 345 bp, Zea mays
ttatgggcgaaggcgaagcgtcgctcgcttctcctgccagaggcgccgcctgtcccaccacggagttaatgcgacggggcgtgcggttcgcggggcggccgttgcgcgtgcgcgagccgttcgaggaacggctgtttcgcttcgtgtttttgaatcccgcggccggtccgggcggaacgttgaacgggtctcgccttggtctttatatactcgggggagggtctggcgatggttctttgctccgcttcctgcctccctcttaggttttcgcaacccgagagacttagccagagaaaaggaaaccgcccaccctgtcctttgcgccgccaccccttctgctcggtg

SEQ ID NO: 11056 - DNA, 353 bp, Zea mays
ttctcgttcccgtttctgatttcggcaaaaaaaaatacagtaacggtaatggtttaagtattttcccgaccgttttcaattattttcaagcttaaatatatttaaccaataacatatcgagctatatgctgagtattaaatccatggacatataacctgtaataattactgatcgacctgaaatttaaccgttcggtgtcttttccggcttgagcgggcccggcccggatgtacacccacacaagcccggacagacctgcctcgcttctcgtctcccgtctcctccgcgttcccgctttccacccgccgccgccgccgccgcccaccttaccgtcccctgccccttgcccagc

SEQ ID NO: 11057 - DNA, 1200 bp, Zea mays
catctttaaacaaaaaaaattaaagaaagccccaatgtccccccttttagattacattacgttacattccacgggatcattgagctagctagaacaggaaccactggcacctgctcagccgccgccatcattagtcatgcccgacggacctcacatcaagtacaaaagcgctcacgtaaacacttgacccaataattagatctaccctaagatccgcccaccctcctcccaaaggacatctcaaaagaaaagaatggcaggcaggttgcccgcctgcaatgatttaggcaagctctgtaacaacacaaacattgtgtttgtacgtacgtacacttttttttatatttcactcgcacagtttgacaaaagggggaaaaaacaacaacactccagtgaattattaagaaaggactaataatgtatagaagaagcatcatctcaattctcaagcgcggcgcggctgacatgaccaggccaccaccaaacactagactggactggcccaaatcgcatgccccaagatttgattctgttcaggtcccaaagtccacggtgaacaacaacacggccggccggcagaaaccgcggcctgacccggcggacgcgggcactgactgaccggaacaaaggaaagccaagcagcagccgcaccggcgcacgcacccacggccacgacccacctgcgggcggcgctcaacccgagtggatgtggacggagccgcccgcaggccgcacgacagacagagatagagagagagcacaggcggccacgcccgctcctaccaccgcaccgcatcgccacttacccctcgtgccgccgcgctgccttttcctccccgcgtccctttcgtccctcaccttgtcggagaccgacgcaccccccctctccgctctccgctcctcctccccacaccccaccccacccgctctccagtccacctcacgctcacactcccgcagcccgcccgccagccgccatcctgctgccacctctttcttccttgcgggggcggcaaccaggcgcacggcacctgctccctcccactcccactcccacaccgcgccagccaccagaataaagcagccgttgcggcgtcgcgtcggcgagcacagcgcagcgcagcgcgcagcggcccgggtgcatgaggagggggcggcggctgccgaggccgaggctgtgacgaaggagcgcggagggcg

SEQ ID NO: 11058 - DNA, 680 bp, Zea mays
gttccgatccggatcggatcgaagtgtccgagtcgttgcaccgtgtgtgccgtcactactctaggctctactcccgttcgttggcgatggcgaccagatctaattattattactactacgtagtacactctagtgctcgccgtcctttctcgttcaataaagaacgccatcttgaacgtacggggggttttcgccgtcgagctctgaaaaatcaattggcattgctcgctatctatctatctctgctcagcggccggctgggaatcagagaggccaggactgcacgatgtgtttcactacaagatactagctaaagagtgtggaccaaaaacccacgcttactaaaataaaccgacacttttgaactaagagtatcgccgtcactctgaaatagacacttttattcgtataaaaatatggggggacaacactcttaaattaaaagtatcagtacttaagttaagagtgtcggttcagcagacacggccggtgacgtggccatgcgctaaccaactctcgcggactcgggagattatgggtctgtttggttggactgtggctgtggaaaaagttgctgtgggctgtgagctgtggaaaaagctgctgtaggctgtgtgctgttaaaaagctaaaaatcgtttggtggaaaccactaaaagtcgttaaaagttcttcgatat

SEQ ID NO: 11059 - DNA, 677 bp, Zea mays
ctttttttcgtttctccatgtacaagtttaattttaagttcatatttttttaggtgatggaggaaatcataacttttattagactaatatgttaggaattttcatcattattttttatttagttttatatcattaaagttattatcttatcttatcactaacctatcaaaataataaaaaaatcataatataattttctattctaaattatgttattagctactaaccaataaaatttgaacttaaaactcaatttgtttataaaaaaaagaaaaattttgctaagaggtaacgtgaacccacgcaaaggattggaggaataaaatgaactaaaaaatactttaggcgattatgtgaatattgtccataggtgaagggactaatttgaactttttgcaagttcaaattatcctcttttataactgcttgtccaatacctctcgtgtaacttgtcttctaatttaaattggctcctatttaaccctggtcgcctcctgagtcctgagtcgttctattagtccttgyaggacttattgcccatagtggttgatggttgctttcctttattgatttgcagaggaattgaagcttctatataaactggcacctgcttctctattcacggcatcggcatcggcatcggcatcgaacatacaagtggttagacattggaaact

SEQ ID NO: 11060 - DNA, 799 bp, Zea mays
gcatcctcttgcatacctccagcttgatcttggtgttgaccttcatgttggagaggtgaaagaagacgaggatcagagggctggatctgcaataaagctgggcactaggaggaaaggacggcgtcgagggccatcagaagccctcgcaggcagcccgggctgggcagaggccggccggcggcgacgcggtggaggacgtacggtggtcggaggcggccagcccaggccaggcgtgcagggagggacgaggaagcatggaactcccagcgggccggtttaaagacgcccgggtggcccacgtggcagcatccccagccgctcttgtacacctacggctcggagggtagttcgcgacggttatttcggttacccgctgctggcaaaggctactttcgaccacgcgacagcgaccatgccctgtcatggcaaagacaactttttttttgtttaaatagattcattgacagcttatttattcatgtaattataataatagtagtcgtgtagtagtagtccagtagagtagaagaattgttaagaactgcattcacatgtcggtaggtcacatgcggtcggatggtgagagcctgagagggggtggcagcacagcaccatggcgcgcgcttcaccgtccgtcccgacgcgtcggtcgagtactcgagtcgtcagcggtcggtcagcactcggcacccgattcttccaaagccgccacttatgtcctcgcgagcttggttaataacgccgcgtgagctgggtgtgggtggggagtttgtcagctgggtggcgcgagcgtcaggcg

SEQ ID NO: 11061 - DNA, 1500 bp, Zea mays
caaaaacgacattagaacctgctgtgatcttaaggttggcgaagctcccatacgaaatacccccagtatccggggagggcctggggttcgcgaccttcatggctgtcgaggtggatccaacgagggatcggaacccctcgaggctccgaagccccgagtgcttttgcatcctgtcaacggtggcggacccaatacagggacatggcacatgggtgaaatgttagtaggcatcaaatagccaaatggctttaagttagggtttgggtgctcggtttcgcacagcaagagggggaataaatgggtgggagtacctggtgggtgctcgtcgccggcgaagagatcgacgaagcctcggcacctggcgtagggcggcggtagcccacacccagtcgtcgcggagagagcgcgagcgcgcgagcacgcgggtagtgaatgggaatgcggagagagagagcaagcgcgcgtacgcggggtgaagttgaaatgaggcgcgcggcagccgagtctggggttgttcggcccagtcggcacagtgaaagcgcaccagcaccagcgcgcggcacctggaccgctatttttcacttttttgcaatttattatttttcgtatgtctttctttatcttttttatttattcttcttgatttcatatttattatttccatgggacattgctaacggttagtgaaatattttggtttcaatatttttgaaattttaaagtaacagatagaagggaaagagatatagtctctatatagagagaataaaagagtgtaatgtctattagcgccctgttgacgtgctgttactttggccatctccagttgcaaatgcagaaatgctcatgtgatgaccaagcgcgttgagccggcacacaggtgaaaaaacggattaatgtttttttagcagcagatattttaataacgccccgtttggatcactggaattgaattccattctaataaggccccgtttgtttcctttcattttgaggaattggaatcttactaatggaataggctatttttctagaatatgacattccaccactttccaaagttatcatataagcctatctcaaattcatgaggtgagagatggaaattgattctatagatttacatgctatttttccgatgtacaacttatagcacactcttctacttgcgcctctataacataaatgtagtatataactatctctctcatatgatttaggataatatacaaatatattacatatataaatatataaacttaattagttttgtctaaattataattattaaaatggaattcaattccaacgaaacaaacgggcccttatacaaaagatagacccgtttataattatgtacgaatggaggaagtagaatcaagcatctttgttgctatatattattaagtattaacccccgctacaaaattctcggttccactgccgcactaagaaatagtaaatccaaccagttcatattcatcagagaagaacccaaaa

SEQ ID NO: 11062 - DNA, 250 bp, Zea mays
cttgctagctgtggctgctgcccctcgagacgaaggcgaacaaaggttacagacgaaggcgatcatatgttcgagtgcagagccacaacctacccgtcaagacggccaagtacagatgcacaaatctggagagagagaaaaaaacaaaacaaaacaggtcaccagacactgctcacatctatatctatctatatataaagcccattggactgtggacgagagagagagagagagagagagagcgctggca

SEQ ID NO: 11063 - DNA, 689 bp, Zea mays
tacagttcgatgggcattttacggaagccagacgccggcatatctccacgccaacggcaccaccaccgtggcctgaatcacgaggcatagcgacaaacggtagtagaaggaaaagccgagaccggggcgtgctggtgaagagccgggggtccccacggcacaaaaaaaaaaaaaaaaaaaaactccgtggacggcaggatccacatggatagacagaccatccgcggcgccgaggcaggggcccggcaagcgtgagcgatcccggcgctttccccaaaaaatccttcgcttttcgggaaagaaccccagcgccgagaggaagaggagggatctcgtcgacacgccgtcgggaacgcgtcccccgttccctcgccgctgccccgacacggtgccgttctcgcccgaatcggcgaatccctcccaccgcttcgcctataaatctccccctctgtggccctgatcctcccgtacaacagtgcccagtgcccaccgcggcagatcttcgacgcctccgaggtacattccgtgctcccccaccgcccccttcccaccagaatattttctctgaaccatggctgccgcgtgatcttttttcgagcctcgctctctctctcgttttcttttctttttccgggatagagtaaggattttcggaacttctcttgaaaaattcgtgggcggacagggcg

SEQ ID NO: 11064 - DNA, 1500 bp, Zea mays
agtctcctgtccagtaaatgcatctcgaccgagcatttactgtcaagtaaagcgctgacacgaagggtatacgtataccgctacagtaagctgtagttgtttctaaggaatccgagcataatacttgcccgctgtcagagaatttgggcttggcctaaataataatttctataaatcacaaagatccattcacacatgcatagtacatggtgtgaactttagtaccactttattattttaggtggagtgatgtcaacttacacttggttgaaatcattgaggagatgagaaaaaaaraacctacgcgtgtgctcgctcgcctcaccgggcaatgggagcggrcacacgacatacgtgaatacttgctgtcactagcactagatatgattgatagacattaaatgatgggtaagtactctaatgtgataaaaccggataaattcactggtgtggatttcaataaatggcaggcgagagccataacgctatgggcgtgttttgggtcgtgaataatcctcccggatatggatgtcatctagagggggtgaataggtgaataaaaattaacatctggaaattcttactcatcctcacggtgcaggtgctaggcggagccggctagggcacggatgcaggtcgtacgcacgcactactgaagattgaatgggggcaggtttttgtgggctggcttaggtgtgacgtggcccacctagaccccatgtgggcccgctctggatgtttgtgcgtatatttattatgtcactagggctagtatataaactcttagtgagttatacatatattaaaatagtgttgcttctcgtattttttattattatattattattatcaaaattaattttttcatctctaaattgctattatctccaacacccgctgccacactgagagtataggtgggacgagcaaaaacttgaagcaaggaacctaacagtggattactaaattaataaagaacatcaaaatgtgagaataatactgcctttacacccccacagcttcagttacaacctatatacacatgttgagaatcaatacgggaggatagagtggagaaactaaaaagactctttataagaccaagacttgcacatccgacctatatacacatgctgagaatcacctcagatagaatttagacaccttctgttttcactttccagcacagtccaactccctgctactctgctaggaatcaaaacccagataagctcctctgcaggacacgttctcgcctttgctgctttttttcatatatatataaaaaaaatgctctcgcctttgctcaaggcaacgaatattactgccttgcatgcgtgcacaacaaaccgggcctgcagctgtatataagacgtggatgtatctccatcatggtgtgcaagcaagacgacacaagacacgcagcagcaacactagctagccagcctagcagtaacaatgcggcgctacgggcagtcgctgtaccacccgcagagcccg

SEQ ID NO: 11065 - DNA, 455 bp, Zea mays
ggctctcagctcggtgctgcaatcccatcaaaagctagggtttcacgcctctcccgacttcacagttcacattcctctcctccccttcccacctccccaactcggccgccgtagacgcggtggcgcacgaactgccctagatttgagcgagccaccctgcgaatcttcacctgacgcacaaagtctgtcagagacagtgaagaattcgaacacgatcttaaacatcgttgattaagaccacacacaaacacatctacctgacttcccccctatcagttgtttttgtgtgtttttttttgctgtttcggacgattcataagaaccgacctgcaaggcttgcagatctaccttgagaaccagggcccttgttttggacgtccagaacgaacccttgaccctgcggatctgcttgatccgttttggatctgcttgtttttttgctggatctggagaga

SEQ ID NO: 11066 - DNA, 1500 bp, Zea mays
attggctcttccaactatggagacttttgtacagggacaaaagttcttagtgccagcagaatttcataattttcggttgagtagtttaggagatatcgaattttgatgttaactatgttgctgtgtgaaacaaattcagtcagttatcttgtcagatgttttggaacttatagatgacaaaatttaattatccgttgaataccgaagttgtagagtactttgtgtagatactcctagaatatttgttttatatcaccattgttataattttaaagatacagaattacaaacagcgctgctgctgtttggcatgtggttcaggttgggagtctttccaccggtcatggttccaagtgtaggagcgatttgttgattgttggcaaatgtttgtgaaatatttgtactaagttttatgctcgctagcaggtggctacactcctgatcatgcctagtacacttttcttcttcgatgaaggcaagtgaatgtacggtggttgctaccattttgacttgttgtttttttatcgccgacactctaatattcagaattatggatttttttcataattgaactctatggtgatgctttacttgcttgtattataatgatgctcaatcatatattgatgatgattatgattcgagtatgactcttgagattaattcacacccctgaaggtaaatgaagtattatttgaggttggtattgtatctgaaggtaaatgaagtattatttgcggttgtattgtatgtgtaggaagtgaagtatattgataaatgtggcatgtcgtatacattgcatgattcacttgcatctgaagttgggtcgtgacctatggtccgaccgtatcggtacaacttagcatcgtacgttgcccgaggatgggtatgatgcggcttcatacccttagaggtatcaaggcagagaacatatgcattgcattcatatgcattcattgaagtgatatttgcagatgatgtggttttataccttcagaggtatgaatacagagtacctacactttgcattcctatgcatacattgaagtgatatttgcaggttttgttgacgcagggaagtgttatagaacctattgtggttgttcgaggaaatgagatggtattggttatattgggactactgagttctatatctacaagtatttctgatcttaattgtgattcttttaaaatgttgattaattcaatttgtggtttaaatatctcgtcaaaacaattcgcttgctgagatgtttcatctcactcttgcattactcaatgcaggtgcttgttgctcatcaagggaagtgggaagtagcagcacatccaccttcactctcataataacgctgcttaggcgcaatcatgatttaattagaagcttcttgtcaaaggatgtttgtttctaactagttgtgcgcactggttaatttagttcatgtcgttatggttgtcttcccattgctagcagattattaatgtcgattatgttttcttatc

SEQ ID NO: 11067 - DNA, 601 bp, Zea mays
gcttatcctctgtaacagaatataattatcttctgtaaatatagggatgataatggatcgcgatccaaatgcttcttcacaaaatgataggatcctaaataaagttaattcaaaaatctgagccagacgcagccaaaaaaaaaagagagagaggatagtgtcatggtgattataattagctagtgatgcggggcatgaacgtgtctcgcgtgcaaattaaaacagagacaatccgtcgtcgttgttgcctaatttaacgtgatcgaggggagcagaaccaaacaataatccaacgtactctagcttgttgcctagctagttgtttcacgtggtgcaatttaataaaagagtgtttggtgcttagctacacgatgtccacatatgcttgttaatataattatgtcgagcttatcgcatatagacttggccggatcgaaggctatatataaggaagaggtgatcatcaggagttgccacagctagcacagcactcataagttaagttgtatagctagagatagatcgagcgagcagctatctatctatctatcttagcggcatatatcgcgaaacatagctagctggagtgagttttgtaatc

SEQ ID NO: 11068 - DNA, 430 bp, Zea mays
tgtgttttcctctaatttcgtggtgaaatatttcaaaagttttgaattcaggtcctcccaaataccatccctatctcaaaaaaagcaatcgtatcgtctatcgtagcacggtaatcggaagcgtccaagactatcttttcaaaacaaaaactagaaatcacggggagcgtccaacgctacttttttttaaaaaatcaaaaacttaaaagaaatcacgggtagcgcctccggtctcccactctcgctgaagtagggtcccccgtttcaaattgacaccccgtccaacgcaaacgagagggaaagccgaagcgagtgcgagtgcggccctcagctgctgcagttgctcctgctcgtttctgcctgctcgtttctgcggcggcggcggcggcggcggcctagcacctgagcggggcggcgagaggggacggag

SEQ ID NO: 11069 - DNA, 645 bp, Zea mays
agtccatttctgaaattttggtaatgcttctgaacacacaaagtgcttcattgctgaaaactggattgttaaatagcaagcaaatgtccacatgaaggtggtccttgtgatgaatatccataggataatctgaggaactaccttataatccaaagaaacatacaattggataatatatattatctagaagacaaaaataagatgaaaatgtaatcagcatttgataacaagtagttggagtccagattaaaataacttgaagaaattttcttccatgaatttctctgtgatcaaattattccatagatacttgtaacgcatcagttgaagcctaccataatcagatgatcatctatcatacagacttcatagatcatagtaagataatcgtctatcatacaaacttcatagatgctatcgctctcaatgtttttccaattgcattataccatcttgccacttgtttgctaactgctctggtctcaaagttactgctgcagtaacggtcaaactctttacacgacaacaccacttgcatgtatataaataggatcaatctatttttgatgcgtccctgttattgatttattttgcatgctactctgatttggtcagaaaaccatcactgagaaaaaatatgtgggc

SEQ ID NO: 11070 - DNA, 765 bp, Zea mays
ctatattaattccaccttttgtccctcctttatttcagttgcactgatggtggaggaatactaggaggtattttggtcctcttatgattcatttaatgttttttaatatttttagtccatagaaccaaacatagactaaactttagtctcctacttaaactttagtcctggactaaagaaacctaacgggcccttagtcttaattttagtccttccatttaacaaaagaagatactgatgactgtttggtaactctattttctcaagagatattaatttcccaagagaaattagtttatttttttaggaaaataggaattccttaaaaaataaagttgttaaactagctttaaatgatataaaaacagggattaatgtttagtccatctaacggtctaactaaacgaggccttagcgaaaatccccaagtttttagaattatccgtacaggttttccggcagcggcagggtcgcagggaggctcaggcccaaagtaatcgccaaatggcaaaatagcaaatttctcaaactaatcgtacagtagatgggcgcgagtaaaacagaacacagggagaagaaccggtggcaaacgaacagggaaaagggtaaattcgctttcagaggcaagcgctgcgttgccacacagcgggaatcctgcccagagctgccgaatcgggtccaatcccgtcgacctttctggccgccgccgccactggactccatccagaaattaccttcgattcggccggggccgtgggagcgggg

SEQ ID NO: 11071 - DNA, 486 bp, Zea mays
agaatttgcttgagctccactaaggctgggcagatttttttcactctatttttcattcagaactaagcaccctgattgtaatgctgtgacactaatgcggaaaaggattacctggacatacctaattgggcctaggtgacataataaaccgctagtggttaggcccagcccagtgcccaccggccaacgccgacgctttcccgcgtgctgcccgacatacaaccgggctgaatacaaccggactggaaaccccgaatcttccactgacgatggcgcctcgtcgcgcaaagaccttcttgccgagatctgaagctgccaagaagggccaggggcaggccgagcgcgtccgcgtgcggctcggctcctcgtgctccgcgactcgtagtgccatccagacagagacgctataagtggagcagcgcgacggcctggtgactcgccacacgtactgttccgtcgacgacaaggcggaggagcccggccggc

SEQ ID NO: 11072 - DNA, 260 bp, Zea mays
ctgcagtgtgccgggccccacgcccagccctcgaactggtgacaccagaaaagggggcctcgctattaaagcgccagccagaggccacggcggcggcataacgcaagcaaagcctctgctgcgtgctctgctcctatctctcctccatttgctgccgcagctctccgagctcgccgccgccgcctcagcgcaggcgcagcacagcacagattcggagagcctgcccttagcacgcagcgccagtgaagaaggccgagata

SEQ ID NO: 11073 - DNA, 1500 bp, Zea mays
aacttaatgcacctgttgggattggtagattggtagaggacacaggagagcctcgctttatttgtatcgcggcccgacttagaagcacgaggccggaagtgcccaggctgctcacgccgcgtgccgcgtgccgctccgcgcttgtgcacgctgagacccggctcggctgcgtccgatggggcacccttcgggggcgaccgggcgaggaggttttgcaatcggcgtccgcagacgcacggccctttccttgccactgctggtccycgtcatcggcgtggcgcctatctctactactattatgtgagcactgtaggcgtccacttcgcacggtgcacgttctgcctctcccctcatgcccacggacgaacgctccgcgaagccacagccgccattcccgccgccccgccgcgcattccatcctcagcccgcggcagagtcctctgttcccagcagcgcctcgccccgccccgcatcactcccggccgcgcatcactcccgcagcgccccgccccgccggcgcatcactcccggccgccaagcccgcttcccgaggccgccaaggtttccatcccgccgctcgctcaagggttccatcccgcggccgcatccagcgcattccatcgcgcaatcaccgctcgctcaagggttccatcccgcggccgcatccagcgcattccatcgctcaagggtttccatcccgccaagcccgcatccagcgcattccatcccgaggccgcaagggtttccatcgcgcaatcaccgctcgcgcattccatcgcgcaatcaccgctaccgcatccatggcttcaatcggttgcccccgcgatccccttccatccatggcgaggtcgctggttatttttaacagtccaccgacagcactcgctcgcactaaatcctttcgctctcagatcctgcccctcgctcgccgcccaatcaatagctcagacgttgcctcggttgtcctgcaagtttgtggaccccgacaacgtcgtttcctccgctctagtggcgcgtcgcgtgcggtcagacacgatgagttgcggcagcgatgtgtgccgggacagctgcagtagtagcggcagcgaggagttcaggcggtcgtggcccagcaaagtcaccgctgatgattcagtggcgcctgcccggagctcggatgtcgcagcgccggcatcgtggattgataggaagctgcttgttgatccaaagatgatgttcgtttgggacaagattggggagggagctcatggcaaggtctacaaggggaagtaaagatgtatttgagacgtgcatacccgtgcttattttttcacatgtctttgctccaagccacagctactttatcaactgggctgattttgaagtatctgctttagttgactcgaattaaatgtgtgttatgcaccagacccttgcaaaaaatggctattagtatgctttaaattaattagtttctcagggtgcccaaatcctgcatctgttatagtatcaagcagattc

SEQ ID NO: 11074 - DNA, 171 bp, Zea mays
agtaataccttgaggaatggagtgcatcaaattcaacctttgggaaattacatataggctacatgactctagagacaatttttctttaccagggaacacacagttctcgaatggcacagtgaatccatcctcagaaaactatattcagagtaatgctattcatgaacatca

SEQ ID NO: 11075 - DNA, 371 bp, Zea mays
cccccggtttggccaaaggtgtccgaagaatatcaatgttttgatggtactctaaatagttaccttaagaattgttggagcataatccattcttttgacgaattcagtattcggcacatctctagagttgagaatcataaagctaacgatttggcacaagatgcatcaggttatcggataaagagagggaaatttcacaaaactgaaaatctgataaccagtgcaaagccaaattcccaggtcgcggaccgtccgcgtgatgacgccggaccgtccggggttaccagaaatgttctcttaatcgattcggctgacaatgaagccgatgcaagtgattggaggacacctatactcatcaatcagctccaaag

SEQ ID NO: 11076 - DNA, 1500 bp, Zea mays
agcactcagagttggatgcgtacatatccgattatcattcttaattaatgatgatagagcagttgtaccaaatggagtaaacacatacacgcatacatcaagaataaatactccctccgtttaattttagttgtcactggatagtgtaaaattgaactatccagcgacaactaaaaagaaacggaggaagtatattagtttcaagcatttattaattagcactggttaaatagcacccattcagatgtgcatgccacctatacatggctctctaaagagctaatcactttttctgcactgagcagatggccgtgagtagtaatgagaaagtgtttctgcataaactttatcattcggaaaagagaaaatcaaagagaaacactagtggctatcgattccaaaactagccgtgtgaatcaacatgttgtcggaggcaggagaatgtttttgaaaatataccagaggagattgaaaggttatttcgaaaaatcacgatggctgcttgcayctgatacgtttacaacaaaattaatggctaagtatttatattatcttgccgatgctagtataactctgattttttatcggtatttagaacctgctaagttaaacacaccgaagacagctcaacatacgtggaggtagcatgaaacctttagacatgaactatgaataaaaatataaacaaatgaagaaaactcgtttcgccgatcccaatacaatctaaaatttaggagtcgagggagtgggggacctgagctttattctgttgatgaaaaacatgcctttgtggtgctaggtggaaaaaaattgatctgaaggctgattctgcaatgtcaacaccaagcagtcagcagtaattgcctaattgaccgagaacgtatctaatgcacatggaattttagtgcacatgatgcacatattaaatcatcatcacttattttagatctaacgtctgtagttgtttgatatatttgctaaggacaccctccgacgtaatggactgtagtggtgtaatgtgttatttgtaaattacaatgatcaaccagtgacgttagatctaagatggatagtggtgatttaatatgtgcaccatgtaaaaaaactttcatgtgcactggatatgtgctctaattgactaattgacctgctctcgtacctatagtgagaggtaagaaatgtcctactattcgcactaataactgagacgcaaacgcgcaagcggtaatcggatgctggatcgctgttcatcacccattaccgtaccgtacctcgtcgcgcaagcctcgtatactctgttcccgcgtttgggttctccgccaggccggcgcgttcgacccggtagcccgaaaccgcccatatatcttgccaactttctgcgacacggtggaggcgtggagctaactacccccacgctggctcgccaccgccgccgcagcaggcgtgggaatctgggcagcgccccgcggagaagaggaggcagcgcgctctccgtccgcc

SEQ ID NO: 11077 - DNA, 228 bp, Zea mays
tgtccggtacatatttaatattttctccattccttaatcagtttttgtggtgtcatttgagtatgttgtgaatctctacaatattccttgtggcaatacttaggaatgaagttggttgatttgacgaagaagaaaacatttttagtcttgtggctgcgcgtctagctgttgatgcagctgatgagaagtcggctatagccaagagaatttcagtcatcctacaaaaat

SEQ ID NO: 11078 - DNA, 286 bp, Zea mays
cttgcatgcctgcaggccatcaagaaagctgacgatggcgaggaatccttggacgaggatgacctgacttaaaacgatctcccgagccaaaaggtgaacgtcatagtttgccatcggtgggggaacagctgtaaaaagaggttatgcgagttacatactaaaaacttgtgggcagcattcccagatctataaacatgaaatttgtagggcccaattgtgttgtatccgtactggtggtttggtgttacctaaactttagtggtatgtttatggtgccctgtgctac

SEQ ID NO: 11079 - DNA, 513 bp, Zea mays
atttaaatctttatttgtgtatacttttaatattttcattatttaaatattgggtggtcacaaggaccatgggaacccagaaaattgatgcgtttaatacagtagaaaaggaagaatgacaagatataacggtggaaaccgtggtgctgcgctgcagcagccacccaacacaggatttctgcagctgtggcctgtgggtgcagacagccacaaagtctgatgagctgcagttacaagtattgaaaaatattaaaaatggaaggagaaggaagctgctctctgaaccggctgcaagaacgatgtgctgcagcctgcaggcagacacgagggccccactaaaccgcgtcttcctcctgactgtctgttttcaaacgcatcccttataaatactcaaacctcatattcctcccgtaagctccacgaccggagagagagagagcgcgcgctatcyaagccaagaaactccccccgtagtccgcggcccgggctcacgaccgatccggtccgggcccg

SEQ ID NO: 11080 - DNA, 458 bp, Zea mays
caccgatgtcggaggtgacactgtgatgacagaggcgacggtgtgctcggataactccacgtgacgagagaagttgaaccggggatagccacccgacgtccggtgaccggggatgtttccacgcgggatttgggccgagaccgggccaataactctgcgagtctgccttccaaacatgctagtgtcgtacccatgaaaaaatcccgcgtgggccaccggcacagggaaaaacgcgaattccacgcgaggaagcaggctgccaaactggccctaagggagagcgagtaccagggaggccaagcggcacgcgcgcatccatagaagaagatccgagcagaggggccaggggcgagcagcaaggcgacggcgcggcagcttgcaggggatccggcgccatggaggggcaagcaccagggaactgtgagagagagagatgggcgcgctgacgaggaagctcc

SEQ ID NO: 11081 - DNA, 148 bp, Zea mays
tgtaagacattattagagtatagtatatatatatatgtatttcttgtcgatcgtcgacaagcagcgattagcacacgacgacgatggcatgccgcatgcatgcaggagatgatgatcgagccagcgatcccggggcacgcgctacctg

SEQ ID NO: 11082 - DNA, 1500 bp, Zea mays
ccgcccctgtgtcagactgctgtttgacgacgattggctgctgctcggaggaaggaatccctcactgaagagcgtagcggcatagcgcgccgtggcgaacgccgctcggggcgaaaacaaacggaggtgcaggtgtggtggatgctcaggaaaaaatgtagcttgttacccttgattcttttgtagtatataatatggcctctgcctgacttccactgtgtgatcaaatcccaagcccttggtatcagtgaatagaggacaaaaaaaaaacattgcaaatggctcttgaaaagttggaatacagtgtgtgcctttttctgtctgtgtgtatgtatgttgttgagaatttagagagcaattgtccccatttgctgtttaagactgataaatgccgagttgtgtccacgttcttttggacaaaaatttttaaagatcacgctgtccatgtccgacctgtatttttctctgttttcatgccgcttttgcatgaaaacgttgctggcatacgttgtccaaaaaaaacaaaaacattggggtgagagaggctcgaactctcgacctcaggatcactcaaatttagctatgagacctacgcgctagccaactgcgccaccaccccaacgttgtttcttgttaagtttcaatattgttatgcataatataagaggacagttatattccttgtgcatgtgagattcgaagattcagaattcagtcctataaaagtgaacaaaggattttatactctacggaagttgtatctgccatgcctctgctaacaagaaccacggcaaacaggtagacagcaaagcatcatgccttgcagttgcagagttggttcggcaactagtgcagcagtaatgaacgcgaccgatacgggttcagacttgctgccttccacttcacacgtggtcgccagacaaatcaaagttgaacaggaggaacatcagcacggtgccgaatcgcaaaatccacaggagatccgggggacgtcactggtgatgcgatcttgcgccctcccttgccgccgtcggatcgcgccagcacaccagcgcagcgtgtatgaccaggggtgggctgggacgggaatggaagaccggggcagagctggcaagtggcaaggctgcgcagagggactttttgtgtaaaatgcggtgggaaggtgcgctgcacctgcaagcagaggtgtgctctactgacagagtttgaactcaagaggaggcgaggcagaaccgcaatcgcgaccgcgacccgcaggtgacatacatacggtgcgagcgccggaagccggaagcaccggtgacgaagccttccgtgtcatcactcatcaggatctcaggtgcatatttcgagcggaacagcttcgtattatttgcgccggcgaaatttctggctcgtttgtccccgcggttctgctgaggccagatttcctcctgcggcgttgaattgcgcgctcgacctagggttttgtttcgtttcgcgggcgttgggaatccatcc

SEQ ID NO: 11083 - DNA, 1500 bp, Zea mays
cagatagcaataatccgtactttgcattgaaactcacagcgcaaacgtgactgtaatatgtggatctcataccagagttatatatgggcatagtagatgaaaacatctcgaggcaaaataatatcgctttctcaaaaaaaaaattgccccgttgaaaaaaatatgtacaagtgggcttccacccaagaacttgaaaaacgctctaacaaatttacaaaaaaaggaagtcaagaactaggccatccaacagcagtcgtgttcttcaactcaaggacacaaaagaagcttccatgcatgcatggatcaagattaacctacaagtgggtttaggtttctagcttccacatccaaccacctgcgtgcctgagccaacaccaccacatgtcttggcggaaagcggcggagcgcgtgtgtatctaaaacgtactaacaaaagaagaaggaaaacctacggcaaaaaggaaattcaaagccaaacgtgccgatctcgatcataaacatagctactgggtcatataaaaacatcttcaagcagaacagtttttttttctatagaatagtccagtgcttttaaggtgttgtttagttcacgaaatataacgtaaatagcaacggtagtgattaatactcgagtgattgcggtattaaatttgaatgggctgttatcatgcattttttagtgtggtatctgattaccggtatcaatgaaatgttatcggttatccattacgttacaattacgttaaccatacaacacctaaaatgcattttaaggttatctccatcagacttcatatcacacaatctattttaaattctactcgataaacagcacagaatcccacaaaacttgaagaagactaattgaaaaaagtcagcacaaaatcccaactgaacagggaataatcgttggaccaaacataaacacccagaacgccataatcaacaaccaagtaccagtgaacaactagtagaagctatccgggtcgaaccacgcctttcaaaagcaaagcatggtcacacaaaaccgggtactattctgggatatatacccaagcagcagaatcggaagagaaggcagagaatacaatcatttttagcaaaggcaggtgtggcagtccccagtccatgcaccctgtccacacgccgaggcaggcggagagcgctggtgccgcgttccccatctcttttttttaaaaaaaaattggtcccttcccttgtcttctcttatgtcgcgtggtgcccgtgccgtgcccactcatcctcctccctcccactcggcaacgacagtgaccagcaaccgcggcttctcctattaataggcagcaacgccttccatctgctccaatccaaatccggctcctcctcctcctcctcctggcactggcagcgaagatccaaagatagcacaatcgcatctcacacgccgagctatttctacttgagagaatcccccttctcccacaaggagcgagtaatttgaggcagagaccgacagag

SEQ ID NO: 11084 - DNA, 83 bp, Zea mays
gaagaaactttaaaacttgatccaggacgtcgctaagctgctggtgatcgagaacggcaaaattcaagctggatgctcagata

SEQ ID NO: 11085 - DNA, 183 bp, Zea mays
tgggtacgagaaatcaaatggggaatcgcggtgggtcagagctagggtttgggtttcgagagctccctgcgaaggagtacagcacagcacagcgcatcgggaggaaatgttggagttggattagcttcacgtttcccgcgcggacgactgcgaaggcgggtagtttgcgcgggcgcgcgtcgc

SEQ ID NO: 11086 - DNA, 275 bp, Zea mays
tgtttctcctccgcaaaaatcacacgcgtacacacaaaatattaacaacaaaatgatattagtagggatctgcttgtactaagaattagtgaaattgaggagttagaggtcaccacatataagcttggtattaaataatttcgagaagattaaactatacactgaccaggactaaccgaactcaagttgtgtgtgatgtccacttggcttgggcattttgtcgaacaagtggtgcacaaggctcgacgtctacaacagcagcgcggacgacgaca

SEQ ID NO: 11087 - DNA, 98 bp, Zea mays
attaatcaccagatgccaaagataatatccagtcagatcgtggggaggatgccattaaccaagcgaaaaaggatgacgacgacattggtactgctctc

SEQ ID NO: 11088 - DNA, 131 bp, Zea mays
gagagggaaaaggaaaacaggatataaatttaaacaatgtggcgcaccttttttgaggcggtcatcatgacgaaggcgaaacggcgcccgcttcgcctgccagaggtgtcgcgtgccctgccagagagtta

SEQ ID NO: 11089 - DNA, 514 bp, Zea mays
gtcaaaggttgtccacaaagcggctgattggttggactgctgcccgtggcctgcctcaggcgagcatgccccgtgggaaacagaagtttctagcgtacccgcccatgcagcctgaagagatatttttttgccagcgttgcatctgccggtacaacttgatctcgttttatatgcacttaaccaaacaaaggctagtgttgggtcaacgcacgcgctcaaacgggacggacatgtgcagcataccaatcagaaggtatataaattagacaaacaatccagctagaaattatttcgggtgctcaatccactggaaccgaacatgccccaagatggtttaagactagaaaaagactttagcccaggtttccagctccgccgtaccaccagcgctagcttctagtttataacataatatatatttttcaagaaatacaaaagttgaatacaaaggtagaatgagtaagtgagttttaacttaacacgccaataaaaatcactaaagcaaataagattt

SEQ ID NO: 11090 - DNA, 210 bp, Zea mays
tgtaagcagtagagatatgtctctggagagtgttagtgaggttcctcaaaatccagatcaagaacctgatcataatgctagtgaggggaatcaggagcctagaggggttggtgctgacacaattgatcctacatttttggaggcttcttcctgaggacttgcgagctgaagttctttcttcacgtcaaaatcaagtgactcagacttcta

SEQ ID NO: 11091 - DNA, 903 bp, Zea mays
ccacttcctagccgttgggccattctgctgagcgcggacggtccgcgtgccaggtccggacggtccgcccctatagatcaacggctgaaaatgcaacggtcagcagtaacggctatatcaacggctatattgcatttaatgcgtcgtcagatgtcagataaagccagtcgcggacggtccggtcgtgcactccggacggtccgcgaggcactctataattcatttctctgaacccgtcaccttcgggtttttcggcttcttgcctaccggactgtccgcgctagaggccggacggtccgcacgaggacccagacggtccgctcttttcctccggatggtccatagtgcagacttggatttttgcattggttctgtccgagtgtcatcctcgtgtcgcggacggtccgccgcaagggcccggacggtccgcgcttggcctgtttttccaaaaagcttctcctgtccggaataatctacggtattccggacagtcgatttagtatagttgtagatgaacctttggcacctgtagaacatataatctagagcaaactagttagtccaataatttgtgttgggtaattcaaccaccaaaattaattaggaactaggtgtaagcctaattccctttcaaagtgaccttgcactaagttatccatccaccacatatataacactagtaaaaactataatagcaagcaagcaacattctcaccgattactaatacattcaccgattgataaaaattacgaagtaaataaggaataacaagtttgttgttcgtttataaaataaaatgacaatatgcactaggtttggtcgggtttaaaaaacccacgggttcacgggtttgggtactataggaacaaacccatacccataaacccgccgggtatagattt

SEQ ID NO: 11092 - DNA, 835 bp, Zea mays
atggctggatgataggtacgtggatgtcggcacgggaaggcgccaaagccgttcggatggcgccacgcccggcctggatcgttggacgtacgggagcaagcgagacaccatcgcttccttccctatcaattcaggaggccgggctccaggtccccggccccctgctgaaatgttttcttacgggacgtcacatttgtgttcgcgtacgtgccagcagagcagcgcatgatgtgccctgccctgctcgtacggaacgtatatgtgcacgggtcgtgctcgtcgtcgtcctgacgtgcccctagctaccctactacgcggacgtgtgctcagaaactacaagtctgttctgttctatgatcctgtccatacaacaaaaacaaccatgcagtgcgggcggtgtggaccgacagtgaaaaggccggctgtctgccagtaggctgtcgattcaaccgcgagtcgcgacaagccgcggaccccaacgtcctcaccacagcactcacatcacatgcgcgcgtttccaagaacgacgagggaggacagcttgatggtcgcccccagcaagccgccatgacttggccgcgtccaagcaaagcaacgacggcgatcgaagtcgatggaacgaacgccagccacaactgagatagacggtgagacatggcagcagctcggccattgccaaaagacactccaaggcctcacgccctcagcccctcaccctcacatatataggcgcctatataaaagcccgcccagcttcgctcaccactcgctcgcaccgctcaacgtctcaacctgagaagctagctagagctagctagctccgggcgcccgcagc

SEQ ID NO: 11093 - DNA, 1500 bp, Zea mays
acatgcgacaaaagggggtatatgcccaaaaagaaaaagaaaaattagaaccatctcacgattttcagtattcaacaaacacacggttcgtatgtttattacgtattgtctacacagaaactcgcaacgaattgcgcagataatcggaaacattctgcccaaacatttaatcgcacctacctgtccgtgcagtaagaaaaaaggaaacaaaatccaccaggattggcaggagggtgaggctggctggctggcagcggatttttggagaatccagaaagcgcagggcgtggtggtggagatgatcgtgtcacgtgagggaggggttcagatcctgtcccattcccaacggtcctttcgccgtccccgtacacccacacccacccacaaagggatgggatagtactactataaaccaacgttaatccatgaactgcgaaatgcccaatgttatattttgtagagtacgtactgtacgtacgttcgatgcgagtaaaaacacagttgactttttcaaagagattaagtactaactacggtacgatggagtaacacccatagcaatagcaataccccgtctgccagccattcatcatgggttggtggacccacccaccccggaaacggcgcgtgctgttaaacgctcacacttcttgcgtgcaaaaaacagagacgggggaaggggaaagcgtagcgggccttcgtcgtgcgtggactgacgtctgcgtcgtggattaattaattaataaaagtggtattaagcttccaataacattgtcctactacataaaagtgctgacccagtgaccctttctgttttcattcataccttaaaaaaatcaattagacataaaccaacgatagactaatggtaaatatatatatatatatatatatagtaactcaaatagtgtaagcatggatgcttcattgttcatatttaaagcgctgattcacgatcgagtacgagttacttaaactagaaatgagctagctagctagctagtttgtgttctgaacttgaccgctaagctatagtggcctgccaggttatataacggtttactcgttgcgtcaaataaacgagagtgctaaaattccaacccatccatccgcctagccaaaaaaaaaaaaaaaaatcggggaggtcgatttgtggaagcaaaacgtccaagaaagcataaagccgcccaccctccgctctcccactccaaacatctcccctgcccttcccctcgcgcagccaaaaaaaaaccaaaacgcctcctccgcttcgtctcctccctccccctcgccgccgcgactcccgccaccagcccaccacactattaattctgcccctcccccttcgtcctcttccacgtccacaactcccatcccacgtcgcagagccgttcctgtctgcgcctcctccctagacacgcgacgcagagcatatatatagcagcaggggcaggggcaaggacgaagggacgaaagagccgtcgccgccgccgcgccgcc

SEQ ID NO: 11094 - DNA, 69 bp, Zea mays
ggggcacaaaaaggtcggcaatatcagaacctagttgagtttggctagagagatttgcataggctggaa

SEQ ID NO: 11095 - DNA, 227 bp, Zea mays
ggtaattataacaagaagacaacatcgtaagtgacaaaaatctaattgtctcatctcttttccgttcgccaattcgaaatcgaatccgttccccaattcgaaatcgaatggggtcggtcttgtcgtgcgtgcgtggctgcgcgagcgacttgactgcacccgacccccctcctctcagtgcccacacactgcgcgccgccgccgggtcctcctagtgtttcgccgcg

SEQ ID NO: 11096 - DNA, 643 bp, Zea mays
cggcgcggccccgagcgctggtacagccagctccaagccaaggaatcctttcatctgagcgtgaagaactactgtcactgtatagtaatatcactgcgccatcagaagagctaagtgctagccaaggctcagcagccgcctcccctccccatcaaggactagaggaggtagggcgggctgacgattctctagcagccatagcaaggaatgctgcacaaaaagatgtaaccacaatgcctacgagtagttcgttgggaggggctttcatcgcttgggtaaaagcaggtgccgcctcccataaattgatcatcaatgacaccaaggccctgattcacaccgtcgacgacaccgcaatgctcgtcaccccagggatcttcaagcgatatgtgctggagcacccagagcttgagaagatcgtcggtaaacctgggacagcggcctggcagcatgttcaacgcgcctttgagaaagagaagagccaccagaagaccagcaagcagctgaacatctggacctacgatgtaataggtccaaggaagaccacgcagttgaggggctacctgcttcttgacccgaagctgatattccccgagcagcccatgaataacccaagcttgagacgggtgacggaaggggccgccga

SEQ ID NO: 11097 - DNA, 1290 bp, Zea mays
aaagggaaatagggtcaaaccttttcctaaatgattttggtggttgaattgcccaacacaaataattggactaactagtttgctctagattataagttctacaggtgccaaaggttcaacacaaaccaataaaaagtccaagaaagggttcaaataaaaaggagcaaaaccaaccgaaggctgccctggtctggcgcaccggactgtctggtgtgccaccggacagtgtgcggtgcaccaccagacagtgtccggtgcaccagggagatcaactctgaactgctcagcttcgggtttttggaaagtcactccgctataattcaccggactgtccggtgtagcaccggactgtccggtgtgccatgcggagcaacggctactacgccaacggtcgtctgcaaaaggtgaacagtgaatgctacagtgcgcggacagcgcgcgcagagtcagagcaggcgccagaaggcgcaccggacagtgaatagtgactgtccggtgcaccacagaactgtccggtggcacaggctgtcagagatccaacggtcaaaccctaacggttgggtgacgtggctagcgcaccggacagtgtccggtggcgcaccggactgtgtccggtgcgcccatcgacagacaacatccccaacggccattttggtgggtggggctataaataccccccaaccaccacacttcaaggcatccaagtttttcagacttcacattcaatacaagagctagtgcaatcaatacaagacacaaattcaatagaatcaaagcctctccaagtcccatttccactccaagcaaatagtgactagagagagagtttttgctcgtgttctttgagctcttgttcttggatcgcttttcttcttccccattcttgttctcaacacatttgtaatcaaagcaagagacaccaagttgtggtggtccttgtgaggggtctaagtgacccaattgattgaggagaaaagctcactcggtctaggtgaccgtttgagagagggaaagggttgaaagagacccggtctttgtgaccacctcaacggggagtaggtttggaagaaccaaacctcggtaaaacaaatcaacgtgtcatccgctttcatttgcttgtgatttgttttcgccctctctttcagactcgactttatttctaatgctaacctcgtcttgtagttgtgcttaaagtttataaatttcagatttgcctattcacccccctctaggcgactttcaattggtatcagagcccggcacttcattagagtctaaccactcgaagtg

SEQ ID NO: 11098 - DNA, 1500 bp, Zea mays
gacgagcttctgtgcgcctgtgcctgggttcggagcccccgtcgcccctccgctggccaccggtgaggaactccgctcctttctcgagctctactgctgtttgctgctctctactcgctcagttcgatcgcgtcgtcttgttgtttgatgcatcgggataagacatatagaagttttcggtggagctggggcctggggtgcgcagcttggagctagttagggagtgatgtcgtctgtgtttgtgcgcttgcctttttttttatgcgggtgggtgggggctgccgtgcgttactgtgtcagtcgtcgctttagctgtctccctttgcgggttggtgcttgcggagctggaagctcgtaggattgcttagctttattagacacttcggacttttgaggcgggataggctggaggtgtgggggtaaacattgttgtgttgtgccccgatgtgttcggctcctggactgtcgcttcgagtgtagcactccagcgtaatgaatcagaaagctcataatggggggattgctattcggtggctgactgcatgctgtacactttttgaagatttcagtacaggagatctcgggtgtttttgtctattgcatatttgtcatttccattctatgctggaaacattttttggggtataaggatacaattggaatttagttttctgttgctatgcttacattgtttcttaggtgaattgatgtttgttgtggctagcgatgtttaattggatggctaatggttccatttccatattcacttttctcgagtttcttccgtttaggggtttggcttgtgggctttcagggtgttaaattaaatgttttaaacttctaacttctaatagtgttttggaattcttatgaactttgagacgtatacagtgttatgccaagcgggtgtgggttagtttgttgggtgggtgggtgcttaatggtctggactctggagtagccaaagtttgaagactatttcttaaagtaactccaaatgtatactcatgttatagatgagactgaatggtgaagcggcatagtgtgggtagtgtgccacacaaaaagaatgtcattcttgtttttgagaagtaaataaatctcaagtttgaccaaatatactaatgtttatggtgtgtaataagtaccatcagacaaataatgaaatatattttcataataaatctatttagagatacaaatcctgataatgttttttttgtaagtctagccaagtttaactcagtccaaacctagaatgacattctttttgggacaaaggtagtaaaaatcagtttccagtgggtagtttattggtgtgtaaaggatatatgttcttcataccaatgcttcatctatttggtgatgaaacgttgccgtgtcatctcactatcatgtatttccaggataccagctcatgatgtggaaatctcagctctaaatccgcttaggttgtgataccgtgacagtgtgggactgacataattgtcactgtgcaag

SEQ ID NO: 11099 - DNA, 503 bp, Zea mays
gtacacatttgctggtaaattttaaaggtaaaagaccttctacgaattcttcaggtttcgggggatgacgggcctgaaattctacacctacacctgcacctgccggtgcctgacgttcccactcccaaaatcccaaaaggaaaaaaaaaaaaagaggcagcgtgactgctgcctgctggcacctaactaaagccagcgcgcgcgttaagacttaagacatcaccgaccgtttcttcgctccccccgcggtttatacacattcaaactcgcgttcaacgtcaacgttccgattcaaaccctttactcgtccgttgccttccctcccatcctatttcaacccgtcatcctcccccaagcctcaacccagtcttcgcattgaactctccacacctcacccaccaagagaccaatccagcagcacacgcctctccgtcgtcgtctccgataattcatcgtcgaaatcctgcccttctagcttcgcttccttcagctaactggtttcg

SEQ ID NO: 11100 - DNA, 175 bp, Zea mays
aacgtcgtcagcggcggcctcctcagctactactagctagcttgcttgctggtgtcgttgttgttgttttctttgaggtctgcgaacggagagattggtcggcacggcagtgcagctgtgccgcgcacttgagaatcagtgttctaacccaagctccagacctgatctaactatt

SEQ ID NO: 11101 - DNA, 1387 bp, Zea mays
gatcggagaagaacacgacagagtttgttaccggcaaagggacccacgtccaacgatccatgagcacgcgatgcactcaaaggctacgggcgggtcccactggttggtcttagccggatcatgggtgcgcgatgcatcggcgaccgcttcctttcgtgtggggaggctgggtccgcggacgaagaagtggaggtgggccgggtagcggcccacacgggcgaggggaaggaaaacagaattgggctatggaggaaggttttggcccagccagctgtttccttattttttattgatttctgttttaaattttcaactttaaattcaaatctcgaatttcaaattgtatttgggtggaaaactagaatctagataaatgcacaatcaaataaatactcaacatgatgcatatttctatttatatatttttatagtaattgtttaatctttttggttaaataacatgcttcgaaatatgccatacaacaattttcagttttgaagaaatattaatttaaacctatagtcaaatgaaaggtttatccaagatttattaattgtttgttgtaataggagatatatatattctccaattacaaggtgcttttgacttaaccttatttagagaaggttttctagtcatacaattcatcaattattaattgtagacatccctgctttatttctttgagaaaataaaacctaatttcctagggttaaatataataattttttagatcactatttatccaaaaaaatcattgttatagatattttaattattgtttttgaagaaatatttataaattccaaaataaaattttggatgttacgttggtgcactggcctgggccacgcaccttgctaaaaccggcctgggccgatttctttgttccccgcacaatataatcacgagcataggctggcctcactcgtctctaaataggccggttctcttcaaacatcgtaattttgaccccaaattggatccctttcatttatatatgatgttttaatccgacttttgacttccagattattttttgctgtcaacaatcctagctccagctgtcatttatccaaaggtttatggtggcagatcttaacggctggcatacgtgcagaatttctcctttctttacagttacacccctcccctccccctcgtgtcggggagtgtgcagtgcacatctgatgtgtataaataatcacacgcacctatgcccactccacctcccgcgttcctccactccacggctcccccaccccactcatcacactctcccaccgcacctcgccgccgcggggcaccgcgccataaagtgcgttcccggctgcacggacgtcgaggagcagctcgcaagtgtttcttggtgcgtcgatcggcaag

SEQ ID NO: 11102 - DNA, 959 bp, Zea mays
aaattcaccggactgtccggtgtgcaccggactgtccggtgagccaacggtcggccgggccaacggtcggccgcggaatctgcgcgcgacacgtggccgggccaacggtcggaagggggcaccagactgtccggtgtgcaccggactgtctggtgcgccaacggctcccagatctgcaacggtcggctgcgctgtttaaggaaagaaatcgggcaccggacagtgtccggtgtgcaccggactgtccggtgcgcccgaagatagaaggcaagatcagccttccagaattgctctcaacggctcctagctgccttggggctataaaagggacccctaggcgcatggaggaggataccaagcaaccttagagcattcttgatcatccacactcagtctttgcgcattcgtttgtcattctcagtgattcgagctccgttctagtgagaactttgagatagtcttttgagctcgattcttggtcgtgtgtgtgcgcattttgctgtggatttgtgtgtgttgcttcccttccttactccgtgattctttgtgaacatcaaaagtgtaagggcgagaggctccaagttgtggagattcctcgcgaacgggataagaaaagaaaagcataacactgtggtattcaagttgatcattggatcacttgagaggagttgagtgcaactctcgtccgttgggacgccacaacgtggagtaggcaagttttgtacttggccgaaccacgggataaatcactgtgtcttctctgtgttgaattctttgtgattatcgtattgtgcaagaccttctctctagccacttggcgattattgcgctaacacttaacaagtttttgtggcttaagtttcaagttttacaggatcacctattcacccccccctctaggtgctctcaattggtatcagagccgttctcttcaagaaagggactaaccgcccgaagag

SEQ ID NO: 11103 - DNA, 67 bp, Zea mays
ggtaattgaccgtgatgagttggcatctctttaggaatttgcagtggagacaatatcacagtttgag

SEQ ID NO: 11104 - DNA, 507 bp, Zea mays
acaagccctgagtgagctctctcgcacgccgcaggccatgatgcttgatgagccattgtcgcccatctccttcgctattcgtctacaacgtcgcccatttttacacatgcaaacacaggaatttggttttttttattactcttatactggtgtttatacagtctgagccccataatccccgctaagtgtgctcacacgatgcgtcgtgcccgccaagcgcgacgtttcatgcacgacgtagcgataaccactcattgtcacagcatggttctagcttcaacaccgctcattctcacatgcagctagctaaaaatagttaagcaaatatgcactgtctaattacgtgaatcagaatgcaaatcgtgcacgggattaactaacaagatagatggcactgatctgtgtacttccgtaattccgtttagattggtctccggatgcatttcctgtatggacgattagttgggatcgtagctcagcaactgcttccttcttccgttgcccgca

SEQ ID NO: 11105 - DNA, 1500 bp, Zea mays
cttaatccaagcaacagctacatctgctgtccaagcgctgcatttgcctgccaagcgtctgctatccgctgtctaataatcaaccatctaatcattgctgctgaagcctgaagacgagcagggaacaaccagggccgttcctgacttttcagaggcccaatacgaaattcgatatcgaggcccatccatacacaaatatatatatatatatatatatatatatataaataattatacatatatttattgaatattcaatatataaaaattattatacattgttttgaagtttataagatgacaaatataaaacatagcaaaaaacacttacttgttacctgatatcattaaaaatatcttttaacattttgtgatacaaaaatcattgcttataccattgagatcaacctcttccaacaacttattttcgatacttagaatcaccaaaccgtttaacctctcttgaatcattgttgataaaaaaatagttcacaaaaatatttcaattctaaagagcttctttccgtcgatgtaactatcatgtgtataataaataatactcactctgtatcaaataaggagtaaagatatgatttttttatactgatagacacgagatcataaaaagtataaaagtggttacattggtttagaaagatatatatgaggccagcaggtggttacagtgatttagaaagattttacagttttaggtggaagtttgcattccatcttttttggagttaagtttttaaaacgtttgaagaaatcccttctacaaacctttttttgtagccactcgaagaatcaatttcgtttacgaattgccttcttaactatcggagacgctctaaacctcctagctcaagaaccatgcatgggcgtaactgaatcacacgagaagacacacaaataaccttttagtataacacgcgaacatccttttttaaacgcgcaaaacacttgacacgcaaactagccttggacggcagtcggtcgatcgtcgcctgccctgaccgacgtgcctccaagcaaagcctccaaccggcagccggtggaaaaagcgcaaaacgacgatggaattgcaactgcagccgcagcgacagacggccggccgggcgcggcgcgcgcagaccggacccccacccacacgtgacacgtcgcgcgcgctacggcgtcatgccgggcgccctcgagcgttgagggcatgcggaggccagccggcggttcgcgctcatgtcatgtcccatgctccccacctcccccgaccccaagcaaaaaaaccaccgaaaacgcccaaaacccaccgcaaacggccgcgcgcgcgcgcgcccgaaaccgtccgcccgcccgtccgtccacctaacctaacccctccttcgcatctcatcacaccagacgaagtgacgaacgacgcaactccaggagcctccaaccacaatacccacgtccttatatcccccggcgacggagagagatacgtactaggtcgacaagaaa

SEQ ID NO: 11106 - DNA, 987 bp, Zea mays
ctgaacactatatcagcgttttagaggcaacgccgagtgattggaaagcgacgccagcatttaagaggtaatgccgagcgactaaacacggtatcagcgttttagaggtaacgccaagcgactggagggcgacgtcggcgttttagaggtaacaccgagcgactgaagggcgatgtcggcgttttagaggcaacgccgagcaactgaacactatatcagcgttttagaggcaacgccgagtgattggaaagcgacgtcagcattttagcggtaatgccgagcgactgaagggcgacgtcggcgtttttagaggcaacgccaagcaactgaacactatatcagcgttttagaggcaatgccgagtgattggaaggcgacgtcggcattttagaggtaatgccgagcgacttgagtacgagggcaacgtcagcgttttagaggcaacgccgagtgattgaagatcggcgtcagcattttagaagtaatgccgagcgattgaatacgaggtcagcgttttagaggcaacgccgagcgattgaaggtcggcgtcgacattttagaagtaatgccgagcgattgagtacgaggttagcgttttagaggcaacgccgagcgattgaaggtcgacgtcggcattttagaagtaatgccgagcgtttgaactcgaggtcggtgtgttagaggcaacgccgagtaatagccggccgcatgagttattttgaggataataaccgagtgatgaagtggcacgtcggcttttttggaaataattgccagatgtccacgtggcatgctggggtttcggaaataaccgccgggtgatgactgggcactttttggaaacggtatctggcccgggaaaaaccccacatgtactgcattgttgagcgtctccacatttcgtgccctagttcttgcttttctgcatccaggccctctctgcccttttgcgattctgcttctgctctgctcgccggcgaggttgag

SEQ ID NO: 11107 - DNA, 1500 bp, Zea mays
taaaattcatacataggctattataaaatagcaaactaaactctaaaatagatataattttaaatcttgtttgttcaattttaatatattcagtttgaatttgtctctaactattgtattttctagcggggatagattcccgcggggataaattccctggcggtgatggggataggagcaaaagcttccccgtgagcgttcacgaagatggggatggataatttttctcctcattgggacagggatgggaggcattccccgacgaagaatttccgccattgccattcctaggtgcacctactcacactagaggcaaaaaaggaagaataaaaaactctagcactaattacttgcccattaagggttagggatgacaatgcggaattccccgtcaggttttagctccccgtccctgtccctgcgacaaaattttttccccacagggatccccatgaacgcttgtgggtgacatttattcctcatcctcgttctccgcggggataaatcctcgtcggggatcctcgtccccacttaaattataactatgacgtaattcatatgtcattaatgcaaaacattgtcacttatacacattgtcagatgtaagaatcattatgcatacatcaaaataaacacatttgtataatgagtgatcacttgacaagataattagttacttttaccattaactattatatgaaaacgtcgtcacgtgtaagtttaacgggtccccaagggaaacggggatggagaatgcttctctatccccgtccctgtttacccatctggaaagaatttttccctatttatatccccgtgaaggaagaaacttccccatccccatcccgtaatggatgaattcctcgcggggagccggggatctagtccatattgctgtctctatcmagggttagtttgtaagtaactagtttcttaaaaaaacttatttatagaaataagagtgattctaaacatgacattttatatctcagtttataaaaaccggattctcgttaaaaaaatgagaagttagactcttcgtaaaaccatttgatttcgtggaatttaaaactcccttatttgtagctacaaatgagttttttgggcttttcagaaataatctgccgctttaagggatctgttggagaaagtattaaaatataccactactaatttttagatatacttttaaactgattttctgaagtcatttattagggagcttcttataaatatgcctttagaaaaatttaggtagacgcggtcgcgtttgtagtgggccaaaagtttgctgaccattaccctcggcaaagcccagcccacaaaaggctcgcatgcctgacgcgcacgtgcgagccacgctgccctctcctgtcaaaaccctagtttcccaacatcgtcggctcctctctttcccaccgccttcttccactactcttcaccctcccctcctccccatcgcgaactcacaagagaaccaagtagacgagggagaaggag

SEQ ID NO: 11108 - DNA, 416 bp, Zea mays
aaaaaatagaatcccacaaaaacagatggaatagactctctcgtgtttccgtcctcagatttatgggcaaacacaaaaatatgtcggtccgttttcaacctgtctatgcgcatgagctttggtgtgtgacaagtggaacggaacactcaacactgccaaagtgagtgaccctgaccggctcctgtagtcccgcttccctaaaacaccaggccaagacggaaaactcccgcgaagccgtccacgttcacggttcatccctctgtccagagcatcattccgaattcccaacgaatccggacacgccgtgaagtgaagcccctcgtcgcttctcgtagtctcgcatccaccgctccaccgtctccatccacgcgcccgcgcgcggcccggcaacgggaaccaaggaaaccgaagccgcg

SEQ ID NO: 11109 - DNA, 1031 bp, Zea mays
atgccaccttttgcggtctttaggaccaatattttggtgcctcaacaaatatgtacatataactaggaatttgctatcaactatggttagcttacaacccattgtaatataacacatccaatctggacgtgatcctatatttgcatatcccaacttttcagtggtacaaacatatttatgcttacatattttttcattcatattacataccgtcttctacacatatattactaagatacacattgtttatatacactcacaacatcaatttacttaatgtctatatacatcaaatcagctatttaattatgttataaaaaaactcgcgcaaggcgcgagcaagtttctagttagatatatatccatgcaactttgttatatatattagacctcatgcagaagcgtgattttttaggacttcgtttcggacactgatgtgtttggtccctccataaaacaacagcggcaaaatgaagggaggaaatgcaggtgtttgtttggaatagaatagatggtgatctaataaggaacaagtaagcaaagacacaaatggcttcgtggactcgtagctgcggttccagaaatgggtcgcgagggccaacgctggttttccgatagatggagagatgctacagcaacacacggtatactactgatgcagagatgatcagtaaagctaaagcagcacagttaccttggcgtacaagtcaccacgtgcagacagaggggacgacgactggcccattgggcaagcagacaaacgctcgctaagcgttccagagccctccacgtctctctcctcgcacctgcaccttatctttattgttcttgtgctgctccagattaataaacgacccccgcaaccaaagacctctccccttctatctatctactatatatcgatccacccatccctcgcagctccaaagcattgaagcaaagaaccctgcaactgcaacaagccagcggcagtcgccacacgtacgtacacttaatacatcggccggcactcgatcggcagcagatcaaag

SEQ ID NO: 11110 - DNA, 404 bp, Zea mays
actttatcccttgttttataaattatactacatctttataagtaattaaaatattttaacctcacacatgcctaccacaattctactcggtccactaattcagctaagtgactagaatagcgaaataattcgccatagctgaatctggctcgataatcgcaagaactgcgaagtcggcgagaggttcgtgacttacgcaatttatcgagcaccttaatgcgcctcgtactagcacatcagtttatgcaacgatcgaactattttggataatttattagcttaccgtttcaatagccgattcgaatccgcgagatcggtagtgattttccgatccaggcaattgtcgagcgcttggggaatatcgcgctgctagcttcgtcttcacccgattcttgggattcttg

SEQ ID NO: 11111 - DNA, 326 bp, Zea mays
tctttatctccttccaactcagtgtcgcccactctcctctccacacacacacatacacacacgtaacctagcttctacacggatcgggatcccctgcagtactgcatgggccactgccgcgtgggctccgcgtgcgacagggcccacgcgcagtgacccaacggcacggtgcagtacgtcagaggatccgtgtcctaagctttcagctgcattagcatggaaggagacaaaggcaaccgatatgggaaacagtgagcgccaaatctcttcggcagagtactgcagtagcactataaacaatgtctaatgcataagaacagacaaga

SEQ ID NO: 11112 - DNA, 1414 bp, Zea mays
ttccgctgctgatttgagcgcggcccccacccccacccgcgcgctcctcgatgcgcgcgttcgtttgccggtcgcgcgggccctccaggctccaccaccagtccaccaccaccacggcaccaccacgtagaccgggcctaccgtaccctctgcggaccccactgtattcccgtccccgcgacgtgggccctcgcgcggcggttcaatcagtcaggaaagcgtagcgcaatcacgcgccaccaccaaaggccccaacccccggtcccgcggccgccggtgcactgcaccgcgtgcaccgcctccgcgtcccgttgcgcggccaggccaactcacccggcacggcgcagccatcgtctctctctcctccgtcctccgctccgagtccgaccggtggtatatacgtaggccgtctgcctcggcaccacagtgcttgccagcgagcactgtgccagagctctgcactgccgtgtccaccgtctccctcctcgcctgcgtcgcgagccgcgactgtgcaagctgctattgctggtgccgctgttccacgtctctgtctccgcttttaaggctgtcacctttccccatcccctgcgcgccctcctgcactctccccactcaacaatcaaccacggcgtcacaaccgcacccctccgaaccctagctagcaccgcgcgccggagccccggagtaggtgcctgcttgccctcctgcggtggccgtcgcgctgccgccgcctgatccgattcgtctagccgtgtcaagcgccaccaccggtgatcgatgcgaggcgccgcgggaggcggctcgggctcgggcaggctgtgaggagaggctgtccgctcgctgcgtcgtgcgcctgtctgcgcgcgcgtctgctccgccgtccgcgccaagccgtccctcgccgaggggggctgcctctcacggccgctcggcctcgccgcgcgtctgcttcccaccacccacgcaggtcagaactccgcgccccaggatctacctacctaccttggcttcctgcttgcctctgctgtgtggatctgtcccgcttttgaagtctctgcgtgctcaccgatgctgccgatttgatcgcttcagctgcctgccatttctcggaatcgttttcgtacaatttcggctcgtttgttttgggcaactccagttctagctttactactacatttctccttcccaccgctctcggaagttgttcccccgcttttgttgtgtgcatctcgtctctcgacccccagcatttgtacgaagtttgacgccttcggtgccgtagctcatttgcagccctccatttcctctgtctcccagggatcctcgcgggctggaggtcgaagcgcgagcggagagctaagagcaacaaggcgacgagatttgtgtggctacgattttgcgttgccgacggaac

SEQ ID NO: 11113 - DNA, 1500 bp, Zea mays
gtgtacgcgcacatgtacgcgcactaaatactagtttccattccacctgtcatggacatgtatgatgtatctcttaatatggttctattataaagaaatgtatttccctttattacatactataatattatcagattttttatatttttattagtccaacttagagatggcaatgaggacctaatcctcaaattcccgtaggaatttctctattaaggaatggggatgaggataatttagtcttcgcggaggatgaaatggggaaagttttgtccccatcgggttcgaccgttcgagggacggggatggagaaccaccccgcatactcgtctcacgaacttgatttttttttaaattagttcattaatatgttaaagttatactaaaagtttaatacatattctattatgaaatagaaaactaaactctaaagtagatgtctcttgcaatattaaaccttgtttgctccatttatattgatttaatataatcagtttaaatttccttaaaatatagtattttctaatagaggtatattttccgcaaggataaattcccccatgaggagctgggatggaagaaaaagccttctcatgagtgtttgcggcgacaggaatgtgaaaattttctcctagtcacaacgaggatgggaagctatttctcgatagagaatttcctagtgtcatctctaggagtattttaggaaggctgctcgagatagcctaagtgtcaagactgaagagggtgtatagttaaacaagatagaaaaaaaaccattttaagtattagaaagagatttagataggcctcgtcgcctcggaccggttcaaccggcagggcagccggccacaaccttggcagcacatggggtatgagatgactgctcattttatttcaacgggaggggaccacagaagctgattgattcgcggtgcaagtatgaccacgatccaaatcgacactagtctgtatctaacttattaaaacccgacgtcttttgggcgctcctccgcgttcggcggtctttgcgctgctcctggcgtgacgcgtatcccgctgtggcgctgtgcagtgtctccgccttcggtgcaacttccgcccacggcgtgccaacgcgtggcgggtgtgtcggacacgattttttcttcaattcgacagaatgagcatcgcgtacgtgaggtggctgccgcagtcccgcaatagcttcaatggaccaaacctcccagccacgccacccgtcacccggctaccggctccgaggaggagcgagaccgagcatcgcaaatccgtagtctccgctagggttccaccgagctggatgtggtgaaggcggcgcagctgtcggggcggacgctacagctaggggagcgaagggagaagtggcggcgagcatgctctaggcgcccctcccctacactaagcagatttacaggagggcggcggacggtgtgtgtggcccgctgagttaaccgccttgtgtgcgtgctaggataccgagcg

SEQ ID NO: 11114 - DNA, 1295 bp, Zea mays
caaatagaactttggtctggtgtaccactagactcggtccatcgtgccaaagcctctatgcccaaaacaagctctctggtactttagtttagtgctctcggaatagctaggcttagtccttttttggacattcttcacttgtttgcatttggctatattgttgagcacttttacgacttagacaaaattattagttcatccaactactctaagtcaaaggtattcatcattttgatcttctcaactcttttgctcaatttatttaaacttagctcctggaacaccattttgcatatctgctcattgtaatcatcctaaggtgttccaaaatgttcctagagccatttagaacttatccaaacactcaacccaagatttaattcttttcgaattatgccttttttcatgagttttgagctgtttcacacattgaatattctatatttattcttatgaacatgcaaccaatcacttagcgaaccgattagtttattaggttagcatggtatggcacatattaggttaggtgtggtgggctgcggttgggaaccaaactagacgtccccatggtagcaaaaagaaggctatacatctccaaacctagggctcctttggaatacatgattggtaaaatataaggatatgaaaaatgtaggattagagttgcatgacacttgcaatttcatagaaaatttttcaagaggctaggcctcatttggaatgcgggaatttcagagaaatcaatatagaaatttcacaagaatcagttcattttcacaagaaaaacacaatgaattaaaaaaattcccgcaaactcaatggggcctagatctcatgttagaaatccttcaaaatctcactacaattatccattccatagaaattttataggatttatagaaactcaatcctttgttccaaagggtcacataggaaaattttctatataatttaaattcttcaaaaatttcttcatcttttctttgttccaaagaagccttaacatttttggatggtgcacatccattttttcatgtccccctccccccatgcacaataggcaaagcgatatctagctccgtccgatcagaaccacacggtgcaggaaggtcccttggagaagaggaaagaaaaaggtcccttggagaagaggaaagaaaaataccgacaaaacgagaagtcgaagtaccccagaggcccagacaaaggcatctccaatctcctcgccccccacggacctgaaccgagaaccgttaccgccgccggagaagcgccgctcgctcaggaggacagcc

SEQ ID NO: 11115 - DNA, 964 bp, Zea mays
tggccgtatatgaaaaaaccgctaacataaaagttgcagatctttaaaagttataaaactttatagtgaacaattgttttatttgaaatcattttggctctaaaaattgcatatgaatttgtcaaattttaaatgcaaattttgcaaacgacctcggatgtgaaaagtagtaaaataaaaaattgtagaacttcaaaagttattgaactttgtaattgacattttttttgtttgaatctatttacagttcttaaacaatcaatttacattatgtttgttctaatacgtggacaacaaaactccaatttaaacatatcacggtatgggtggcgtgatagaggaggagggtatacgcgaggggtgaggttgtgggttcgactctcaccgatcgtgtagccgtgcgtattctgcgcgaaaaatgccgccgccggttaggtgatgacttccctaattaaaatattttttactatttttaaaaccttgtttatatttactggaaaagatgtttatatttactggaaaagattagtattgacggttttattatctcaacctttagtagaaatcgatttttactccttataaaaaattggaaccgctagagtggtgcacggcccttcttccgtatggaaatgtttgaagagttccgatccctttggcatgaaggccgaagctaccgatggatacaagtgttaatcagttacgaaccaaatactcctaagatcctggttaattagaaaatgcagcaatgcaaagcccatttccatccatcctgctggttatatatatggatgtaggtgtggttgccgaatcggccgcgtcacgcaaagcgagctacttactactatacctttgagctagctagttcagctctctctctctctatatatatacacatctgagttttgctggcaaagcatcaacaacgatcgtctgctctgcttgtgctgcatatattatatat

SEQ ID NO: 11116 - DNA, 1307 bp, Zea mays
ctggcgtcaggatcatttgcctggcagactactgcatgataggttcgaaaagagactcggcaattggaaagggaagttttgtcttcaggatgacgtggggtgttacttgactcggttttaagttacctaccaattttcatgatgtcgttctttaagattccggtgggggtgctggagaaactagattataggaagacacttggatgaatgatagaaccctaaaggagtttgtcctaatttgttcaatatagtgcgtgataaaaaaaaagcctcaataataaaagttcttcctctgtcgcccccaactacatcattctacatgcctttggtgggtatcaaatgggtgattgttgagcttggtkgcatcagttaatttgaagacgaatcaggatagttttatttggagagcacatatagatatggaagagctgctcctacagagaagttggagctagagcctttttcagagaagtcgaagccccatcgaagagactcttaactcgctcttagatcgtgtgcaacagttcacccatatgtgcatataaagatatggaagagctattcctacattgtagattgtactgttcgcatagtggagttttgaatatggatatagagatgagtaagttggtagagatggccttagaccattctcattgatagtttcatcacactatttcccaatgctgtcacgtcaataaaagtgagatgaaatgaagaatgaaatatgacctttcaatgaaaattttcataggctaactgtgacttaaatgatgcatctaaataaccaacagaaacaaatgaaatagatgaagacgaaacaaattgctctcaatgatagtttcacgcgctttctaataccttggaaacgggttgacatagtttcatggtaataaaactagtttcaccatttataataaatgtagtgccgtgtcatcaaaattctatgtgacatactaattagtgtcatgaaatctcatgaaaatgccacttagagcacttgaaagttaagaaccagcagagttgtttgggccggcccactcaaagcacaaagcagaggccagtcggagtaaggtggtccactggagtcattccacgtggattgactttgactcgttgaaatccaactcctgcagctgcagctgcagcacagcgaccgagccatctccatttgaatttcaaattcccctctcctcctcctccctcactcacccaccgcgcaccctggccattcaatttcttccctcctcttccctttctttttttccccagcaccaccaccaccaccaccagcagcagtagccagg

SEQ ID NO: 11117 - DNA, 325 bp, Zea mays
ggtgaggtggcatttatattcattggtcagcggttgtgcaccacatttggtgcaactcctactcctatgctgcaaggcattggcgttgccgtccattagcaacagtgacgtgacggccttcttgtcttgtctccctcacatcgcaaatgcgacgtgcaagttgcaataccaacagcaacaccatcacctccgaatccgatccctcacacgcccacaccaccttggtggtgggtcttggttcatgctgcccactccggcactcctcttctcatgacaagcgcgctgccgcacatgtctgagctcccggacggcggcgccggcggaa

SEQ ID NO: 11118 - DNA, 195 bp, Zea mays
atcccatgagttcgcattcgtatctgtggcagtgtgatgaaggaaaatgatcccatgtaaattctcttgttcgtaatacggctatagcaataattctgtgtcaactttgctcgtgctgttctcggtgtgtttagatttttatagtatgtgtacttgttatagaatttctgtagagcagcttgtttgtgtagtcta

SEQ ID NO: 11119 - DNA, 237 bp, Zea mays
caagtcagaagattattgagcttgaagcacaaatacaggcaatgcgtgcagctgaagaggcactcaacctagagctaaaagaagctgaggcaagtgtcaaagctgctgagaagaaaggctcagaccctcgagcaacagctcagtgagattgagaataaattagttgcatcaagtgaagaaatagagttgctgaaagagcgtattcaacaagaagctgctgtatcagcagaaagagga

SEQ ID NO: 11120 - DNA, 598 bp, Zea mays
aaagttgataactatcagagaggaggtgctcaatatcctgcaacgcgttgcgctttcggtgttccacttttttcttgctgctgatgtctggtgtctggtgtctggggcacgtaggttaaggtcgtaaaattgtctgctgattaggtcaaattatgcgattctatattcgatcaagctagcacgctgtgcattgcacaactgccatggatccagacaggccctaagtgagggcatagtgtggttcatgacttcccggctcgagttagtcgtttgtagttggcatccaatctatatagaggagtgcattacatttagcctggatttggatcattgactcatttgggtgtgcatgctgctttcagcaacttgcggatttcacctgtcatacactcatactgcttctgagcaagtaccatttctggtctagtgaaaccattgccttctcatttaaaaaacacctttgcagattgcaaggcttttttttccaagatatgcacgtacagtatttgcataaattttgaacgccgctccgctcaccaacatataatttgtgctactgctaacctcagttcttctgtacgatcagtttagctcttgc

SEQ ID NO: 11121 - DNA, 810 bp, Zea mays
cttctctatccccgtttttcgcggggataaatctcaacgagatcctcatcaccgtttaaattataattaagacatacgttctttgttatttatgttaaacattgtcacttatacattgtcagatgtaagaaatcattatgcatatataaaaataaacacatttgtacaattagtggtttcttgacaagataattattttattttttgttgttaattggtacgcaaaaacatagtcacatgcaagtttaacgggtcctcgcggggaacggggatgaggaatacttcgccatctccatccccgtttacccgtagcgagataaattttcctcgtttatatctccgcgagggtagtttcttccccatcccctaatggaggaattcccgcgggaaatcggggatcgagtccctattgccatgtctaacccaggtagtaacaaataagtttcttcttcttcttttcattttatttcctgcttgctttttatttttcctattttatttacaaacttcaaattacaaattgggttttgaatttcaactcaatttaaatggacaaacaaaatatgagcaatttatatttagttataaagttgtaaagtcgtttgttcctgaactaaaagtccgagtagtcgtgataggaccgtagaaatagtagattagattagattgggttgtaacaaacctggaatcccttgagccggcactatatatatgtaatgccatatggagggttgttctccatccaaaggtaggggctgcaggttccatctcgcacattagaaagatcgcgaggaagatatagctagcagc

SEQ ID NO: 11122 - DNA, 946 bp, Zea mays
agttctaataatttaatgtataattaagtaataactgaataattgttgtttcattctgcacttctccgtttaacaattattgtgattgtgttgtcttttttactgaaaatactgacattaattcgtaactgagatgccttggcagttgctgaacattttaaaaaatgagtaaatacaactattcagatttcgttactgacttaaatagaatgatattcactaggaaaattactgaatgtctaataaattaatgaatgattaagtaatgactgaataattgatgtttctttcttcgttgctgaagtgataattactggcaattccgttgaacagctactgatgagctagtgttctccttttactgaaaatgatgtcactgatccgtaactgagatcccttggtagttattgaacgtttctagaaatgactcaatatatttattgaatgtttccaaaaatgataaaacgtttctagaaatggctgaataaaacattagatgtttcatattgttctgtctgcactagtaattactatagttacttataattactaaaattaagagataaatgactaaaagagcacaaattactaaaatatgccgtagcgtggggtcttgctgtcagtctcttttagcccattcctaaaattatacataagaagaaattgtttcactaactagtatctccgttctcacatatttgttgtctactagtttatttttgaactaaatacgcaataaataaaaaagaattgcttgacatacacgcgatgccattttcaccggtaacggcattagcatcgcattggactatatatgatctagtgcaaaggatccaggcatccagcgcacaattaactagcaaatgcaatgcaaacccgctaggacaagcaacggaacaatcgagcttgtagaagtggtaacgacgcgcgcttgcatcgcaatcgc

SEQ ID NO: 11123 - DNA, 759 bp, Zea mays
ggtaatataaagtttggctttattcacaataacattgatggcaagagctaccattgtaatataaagtttggctttattcacaataacactgatggcaagagctaccattgtaatacaaatgctctagacatggtaactattgggaatagaaagtaccaccaattaagtgcaaagatacacaataacacaagctaaacgactagggagctaccatcacttagctgcacaaactagcacaagggagcacaatatatgaatgactaaatacaagcttgtgttatatattaccgtatacataaaccaataggaaggtgataacaagttgacacgatgattttgaccctaagatttgatggtttgtaattatattaaaggtaaggtcgtggatcctctttctaatggtgaacgcaagctatactatccacacaaaaagtgctccacgtaatgttttttttttcatcagtgagaaaggggagaaagtttgtaattggttgcttctctaccctaggcgtctctatcatggatgagggaggtgccgtggatggatgggccgatttgggccgccggttaggacagcacgagtggcccattcctagtccctcatcctctctcctccctcctcctccatttaccacctggtggtcagtcagtcacccaccccacaccgccgccgggaacttgttcatcgagccgagaggatagatagatagatagatagatagatagatagggtaaccgatcgaatccgccaaccaaaca

SEQ ID NO: 11124 - DNA, 73 bp, Zea mays
ataggtaagaacgacaaatgcagccgtcacgcttacttattactcatgaggtgtttgtgtgatatatctcggt

SEQ ID NO: 11125 - DNA, 300 bp, Zea mays
cgaagctgtctgtgcagtgtgcacatccgtctcacgtcacttgaagagtcgtgggagctcctgccccttccagaagcttccgcactcgtcgccagaccgggctcgtcgcctccaggcctcctctatccagacgcttctcacttccccttttgtctcctcccgtctcctcccccgtaccaaacaaacctcaccgagtcgcaactcgcaaggacagtgaaaacgcccaaacgagcgcgggcacgccaaccaaagcggcgaagcgcgaaggaaggaaggaaggaagcaagcaaagcagcagcc

SEQ ID NO: 11126 - DNA, 196 bp, Zea mays
ctgcagtctccatcagcgaccccttcagtgaaatctgagtgtgcatcgccgaggaacagtggtcttttggaagagctgcttcatgaagctcaggcactaagatctggggaagaaccaacaatcatcggtccgaagttcaagttcttctgctggcacaccttatgagactaccacggtggttagcccagagtttgat

SEQ ID NO: 11127 - DNA, 1365 bp, Zea mays
tgcaggagggagaggggatccatcgcgtgatggcggccggcggcagaaacccgggacaggattggcggggtagcgggggccgggggagcagggaactcgtggctatggtttggcgggagtcgtggcgtcgcggggacgcccgctcctgtgggccggtagctgttggatcaggtgatcagcactcgtcgcttggcaatggtagaaattttttgcagccaatgatgcacacagcacacaattatgaattgcatttccacggtaattgctctttttgacggcctaaaaaggtcaacaaaaaagcccgagagaacaaacaatcacacaacacaacccgttaacggcccaaaaaggtcaaaactgaactcagcacaagctcgttagtgacggtccaaaaaggctttctcattttgtgcaaaactgcagcaacaagacgcaggatccccgtcccccgtaacgggccacgtcacgtcacaagctcgcgaagcacggcacggccgcggacacgaccgggtcccttccgcgtccgggtcgcggtcgccgaagaaccctcgctcgagaccgaagaagacaaaatcgcatctcctcgcctcctcccctcctcccgagatccgggcaaagcgcgccgcgcgagaaccaggtcggtcatcccacctctcctctcctgagattggaaaaatgcactgctcgagcttcgtttttaccgggcggggctcccgcgggaagggagggcgatcggtacggccgggtgctggcggcgcccgatccgaatgctgccgatggcttgtcgcgttctcgtcgggggcgtcgggtctcggggattctgtgttgtcatggtccttgtggattcctagggttggggtggttattcggctgtgggcgggaggcgccccttcgcttgcaatttttttttttggaatccatgcttgcagggaggagggctgaggagcgtagggccgagggggcatcgggtaggcaaattgagtagctatggattgtcaagaggattgcgcttgcgcgatcggactatcggagtatgctttgtttaacatgttcctttagctgatccttccggtcttggggaaggtgggttccattcatctgtcgtcctaaatccgtggtctgtatatccagtgatagcatgtgacactaaaaagaaatgtgatgctgttcttcgatttcagaaattaggcaaggctgtttgttctatttccacttcttttgtcttctagtatcattctgctttgttccgtgctaagttcttgtggtaagaggctaagagctttaaatcagttgacggtttctcgaaataattggcaggatatcgatttaggtatatggacaaggtgtctgaaggtactaagtgag

SEQ ID NO: 11128 - DNA, 721 bp, Zea mays
gttcctcagaactgtcatatcacagatgatgaaaattcacatgctcccaattgctacatcatcgcaactaaaattgtaaaataaacagcttgacaacaagttactagctaattttactgcacatgagaacagaaaaaggttcaatctttacaggaactgtcccagtgccccgattcagcaccgccacgccgacaccatcaccagctccgagtcctgccaccgcaacgcgagcgccgcctgccgcttctccacatggaagcccggcgtgggcgtgcgcctgacgaggcattcggcctgtgcctcggcggcgttgctgagctgcaccggcgcgaatccggcggagtcaagcatggtccgccatggaggcatcctgtcgcctagcaacaggcgctccaccctgggacgcacgacgtactcctccagcctcgccaccgcgtccgccggcgccccggccgcgtccagcgactcgaggaacgccgcgctggagcgcacgacgctcagcgcgtggtgcgacagcggcaggtcgccgcggtggcatccgtggtcgacgcacaccacgacggcagggcggagctgcttcacgacgcggagagtagctgccgacgggaccccggagccgacggagaggtgaacggcgacggcatcgccgggcgcgacggacagccccgtggggggcaacgggtccaaggggtcgaacgcgacggcgttgaactcgaacgag

SEQ ID NO: 11129 - DNA, 67 bp, Zea mays
ggtaaagtcaggtcaggccaactctgtcgaagaaggaacatcgaagaaaggaaggaggtgggcggca

SEQ ID NO: 11130 - DNA, 855 bp, Zea mays
cccttgaagcctggactaagccaaagaaggaaccagtccggccgctcagtcaaaaggaccgaccatgagaatcaaagcactgcccctaagtcaaagtaaacaggaaaagaggatagaaggagttattaccatatagagaggcaaagattcttagaaccagagaccacaaacatcagggtcattgaccccaccactcacccgtgccccccgcatgcaagtgctcgcctccatgtgcactaccgccacccacgccccctttgcagcgcacccaccgccatcgtcgtcggcaataggccccccttcccctcgtcgcacctgctgcctcgtgtcacctgctccatcactaccactccacaccccttcgagcacccccgctcgtctataaaaccccccaccagctccctcaactcccatctcgctcaaagcaaagcacactccagataaatcccctctgccaaatcgcaagcaactccattttccactccctcgcccctaagatcacaatgcttggtgattcttgggttgaagactgttgtacatggttcaacatctttggtttcctccagtgtatgatagtaatactctttgatagaatcctccagtgggaagagcaaagagaaagaaagggtcagtgagaaaaggaaaagaagatagtgaagagaagataagaagaaggttctcccagaatcaaccctgtgtcagtcatctctccgcagcctgctcaagcagcaacaacagaagaaggccccgtaacacccttgttatgaggtacttcaaggagttcaaatccccaagattcaagagttctaccctcattcattttaagtggggtagtgttccagcaaggttcctgct

SEQ ID NO: 11131 - DNA, 1359 bp, Zea mays
tgtatctataatggtaaagacttaaaactagctgtcaattttcctttttagtatataggaccatctatttcccgttttggcttccaaatcttctcaccactctccctaagtgacacacaaacacttgtgtgcaatctttaatagcaataaatacttggaattaatttacctttcccttctcctttcctcctcaccctctcgcctcaccttagcgcatggtgccacaggtggtagtgctacaggcacgacggaccatggaaactcttcatgaaatcgatgaagagccgatccacgacaataacatgaagtaggttatagttagatggtttggggttgagtttttaaaggccgacgagcataaaagaatgtagcggcttactcgatgatagagacgaatgatgaatagtaagttgaggtagtgggaacactagcgaytaaatagtgggggtgacttatgggagggtttatggtggaagcgatctatattagcattgtgcgagatagaaagcaattgatcgtgtattttttttctttgtttaggggggtgcatggggctgtccttatattagtcggacccatctttagcccctattcattctccatcgggaatgtatctgtgcacatggtgtacatgttaaatcatgtacattcacttcggatctaatgtgtcttagtgtcttatctattttataaagatcatatttcgagcaaagtagaaatggaagatagtgttggaaggtgtttcttttttaaaatacatatgacaataggtaccgttagatctagaataggtattgttatatctataatagaagaacaccgtttaatatgtgcatcatatgtaccaaaataccatatataccggatacgttcctttctttttcaaaccatatcttatactacctccgttttcaaatattttttgtctgctagtttatttttaaactaaaacgtgacaaataaaaaagaaaggagaaatatttgtctgaacactcccccatctcccggtcctcgcccacatagaccaacatcgcaagcgttgcaccaaaacccccaggcatgagatgctccaatctgtgctgcccatatataggccactacagagcaacaagggaagtgcaaacaaaaagcctcaaaagggcagacagccaaatgccccaccacagcgtagcccctcctcactgactcgcctgcaaaaaccacttgcaaaccacacaaaccgaaaacgccagctcccctgcctccatttttagcaacttttcccttctgtcttcccatcacagtcacccttcttgcccccacgcagccgagcgtgcctacccctcctcgacccttctctggggccgccgttggacgctc

SEQ ID NO: 11132 - DNA, 1487 bp, Zea mays
atgcataattttggaccgtgtcatgtttaggcggtgtttttgttttgtacttcagagcagcccaaaagaacccatccaaatgtacacctcaagacgagcctcccgtgttggtccagttgcaaacaaactctggcttctattgtggtggcccgtaaacgaagtgcggttggcttgcaacagtgaaaaggaaggctgcaaagcccatggaagggcccaagcccaacaatacatgcagagaccagagagttctctgtatgtgaagacgtcaggtgggcgtaataaagaacatttaaattcgtgggccagtcatgttatcgagaacatctcccatttttctcgctgtgtcgccacgcagagatattgttgggtggagatcttccgttgattttctagctccagcgttgtgttgataagattggagtagcgtgagctctcggccttgcgacgacctgagctctgtctccagccaaccaataccactagatgttagaaacttgggcgagcctcctgctcagtcaccgtggtttcgcctcgatgcatgcatccaattccaatcgccgcaatttgtgtgttttttttgttctgttagtttagtatcgcatgagtacgcttggaaaaatggccgaagcctacctcctccacttgctaaactttggcaaatcatcattagcgctaacccttcggtcttatcacaagagcacccacacttgcttagaagaaatccccacttgggccacttgccaatacagcccttcccacaaactggggggcgggaggaggttttcggtttagcgcaccccgacagtccgacgctggcaaccatctctgcggcatcggctgtggccgcctcgtgagtcacggcgcgctccaagggttccggcgcgtggcggccacgcgctctggcggtctgtccgttcggcggcaacagcgatggccgcagagtagaccgctgtcccggatccccgaaaagctcagaaaccgcggcgtaccagccacgtccgcggcgcgtccccagcccggacgcccgggtctacacggccgtcgctgtctgcctgtctgtcctccgccctcaacagagcgacagcggctggccgcagacgcaactgaatggaaggtggggcggggcacatgcattgcaccacctcttgcggagttccaaccgccgaatagcgacaaggtggcccgtgcccgcggcgacatggtagccttatcccctcacacgctgacatgacacgttcacgatcacgcagctctagcctcccccgcccgccccgcgaattttggagcccccacgccatcagtccaccaccaccacacaggcacacacacacacacactttcctcgcccaaccccagcgctttctcctcctggcttcccctatttaagagcgccccgtcgtcccgagacctccattcccaagcaaacagccaaacacacgcgaaaagaaggagttcgagtacaggttacagagaggcagagagcaaag

SEQ ID NO: 11133 - DNA, 323 bp, Zea mays
cccgtggcacaaataaacccctatcgatggcctccatcaccttcgcgactttggttgacctgaagaccccgtacctcggcatctgctcaaccatggacgtgttcttgttgttagccccgctggaccacaacccgaagccagtgccaacgtcagttgagtcaaggtcgatgaagatggccctggtcagatgcttgtcgaaaccagattcgctgaggcacgggttgaaaacatcacgtacgacaccaactgaagtatcaccttgctgcatttcatcaaacaccgcttgagcatcaatctgggtagatgcatgttgtctgtcggtg

SEQ ID NO: 11134 - DNA, 89 bp, Zea mays
ggtaatgcggggtatccttcctcagttcctcgcttgcaacgaaagacactactccagcagcgcatactcctgaagaactcctaccgagg

SEQ ID NO: 11135 - DNA, 1500 bp, Zea mays
acacagttccagtgggccccactctatcattgatcgtgccgtacgtaactacgtacgagtagcaggagctgctagctagctccaaccagaaaggaatggaattggcccgtttagcttctgattaaagccattcgctggctccagcttttaactgttctcttctctgtgatgcactataggctaaagcggctgcagcttaggcctgtttgagtttctaaacagcttcttagcgtgaatagatagaagattaaataaacaactagttaatacgtaccggcttctactgattctataaagcttttgtctctatggattataactgaagtagtccaaacagtcggctttaattcaaagcgaacagttattgaaatgccataagctaatttatatagaaagtagaaaaatctgacattgttggctttctttagtagagcctagaaaccgataaaatcgcgagactcaaaagattaacaatagttctttttgaaaagttgttttgggcttttaatcatgagaacttaataatagcttcttcataattttactaggaagccaaaaaaatccataaaactagacttttcaattcgtatataagcctagtttggtgcgaaagctaaacaaaaaacatttgtttatttaaacttcttacttttcatactgataaaagcttaaacaaacgaactttagactgtcttcaacatcattctctatattcatcttttatatctattatttacagtttactctgacagatttttttctctctatctcctgcctctctagcgacatcctttatatatcgtcatctatatatctatatgtaaatggctatattagagacatattttacttttaacaatcatacactcaaatatattgtacacatgttagttttgctaaatctattgtttaaagtgttgaaatagataggaaagtgaagtgctaaactgtttatatttagattttagttacatgacgatacattggagacgtcttaggctagatccatacgaagcgaacaacccagacccgacgccacgccctggccacagcccacagcgcagcgcgcccgcgccgaacccgttcggatccgtctcggctccagctcgcgtccccacgggccacggccaccaccgcgcctaacatgaagcccacgcgccgtcactgacatccgggcctcggaacccgggcccgcgggcgagtgacgggatacccgagccaaggcgcaaccgcgcaagtgggtgcgggattggtgtctcacagccacggcacaccaggatccagcctggctcctccaattccacggctccgtcgttctcgttcctcacccgattcttataccaactcgtcccctccttatctccgtcgtcacgcatcgccctcgctcgctccgcattgcccgcatcgcctccaatctcagcagaccaggtcgagtttcgcgcggattttcagtgtgggaggggagtggaggtgtgacgggagcagcagaggaagcgcgcc

SEQ ID NO: 11136 - DNA, 384 bp, Zea mays
tcaacaggaatatgactcacacgggactggacgcaccccttttaatgccgtttgcgcacgtggaagggtacgtgtggcgcacaacggcacatttcacgcaacctaaccgtatttctgttcgagtacatacatgactacaggtacacgacataaacctcgtacgcacgcaccgctaataaatgacgcatgcagccgccgctgccataaatagaataggccattgggataggtagcaggtgcaccgtgcacgggcaccgccccgaggctcgcggcgaaccgaacagcccagcagaggctgcagagcaagcaagacaacaagcccagcgtccccgcgcacgcacgcgagcgcctaggccgacgaggcgaggtggccccgccggaccc

SEQ ID NO: 11137 - DNA, 545 bp, Zea mays
aacaacaacatcagttagtcaaataaaaaaattatacggagagcggagacaatcaataaaaaatcttgagatatttttgatagataatttacgtgaatattgttataagtcgtcgcaatgcacgagtaaccgactagtgtaatcttcaaaatgcacctccacgcatcgacatgtctactcacatatccaatccaagcctcttttggatacgttagaaaattcaacatacaaacatatttatgacgtagaaaagaaaactcgcaaagctaccagacgaaaactaaaatgaaaaaaaaggcaaagcgaagactagtatagagattgatgggtgggggcagtcgggcagaggaaaaaattaaaagagggaggggagggccattcgcctctcctatataacgaccacttcctcccaccgcttcttcccacgcctcccaacctcctctgcttccgagatctctccccacctcccggtccgctagcagatagcgggggccagagagatcgagatccggaggcgctagcgccacccatcagcgtctgcggca

SEQ ID NO: 11138 - DNA, 1337 bp, Zea mays
ctgcagcgagtccagagaagaaaaaaaaaggaaggcgaagagcatgcatggtaaggcgcaagtgccaggaaaaagataggactggccaggccaacgacgagttcagtgaagagtacatgctctgcgccgtgcgagttttgcgttgcgatcttgcctgtcccgttgtccccgaagagtcggacggacggagcagtgaaaacagtgtaaaaaaaatgggtcgacggcggggataaagcaggggatggggtggaaaaagaaaaggggaaagcgagcctgtcattggtgcatcatcatttcacgggccaccatggattgtggtggtaactctcttttacatatctcaagattctggttttcaccccctttatccccgccattgatgaatgaatgttcaatgtttaaatcgccgttgaaactctccaagatttggagattttcggtaaattgactgtaccactaatcgtttggcgcggcagtagatagaaggcctgcatgggatgggatggggggaggcagagccgcagaggcggcagcgcgcgtcgcaccctggcggatccgctgatggagaccggtcaagcgagccatgtacgtgggtgactgggcgcaatcaagacaggcgtcaatgccctcagcccctgcggctgcatctgagacgcaagccttgctgcctgccggcctgttcgctcctcctcggctcctctctcgcgaacgagctcgctcgcgtccgtccaagcacaagcggacaaaggaaaggagggttaaagaggaagggcggccttagacaacagctcttcttcccatcctcgcctcccttcacgttccccgcactcgctggaggagacgagaggggcagagagagagaccaagaccatcgtcgtcccactccaccccctgtttcgtttcgtgatttcgtctgtttcactccattccctcacccacccaccccgcaacccaacaagcgccgcctgccacaacaagcctggaaaaaagagagagagaggggctcagggccgctcgacgacgcgagtgcaaacaaacccaagagaagattctcccatcaacaacaccccgacggcgcacgatccgtctgtctgcagtgcagcccacgcgccgcatccgccgcgttataatcatccccagcagtccaccccggcaccgtttcgctctcgctcactcccggcgtcagcgtctcccttcaccgcagacccacaaccacggcgtgcctgcccaagcccttggccgagcgccatgccgcgcagcgccggcgccgcgagggtctgagcgaagctttcggcctagcgtttccgggttgagccagccagccagccaggcgatcg

SEQ ID NO: 11139 - DNA, 247 bp, Zea mays
ccggagagactttggcaccctgctggtgtgatgtcgtggccgtcggaggagcgctagaacctggcggagggacagctgtcggagctgttgagtcccttgctgacgtcctctgccttccgtaagggggctgagagctgccgtcgtcacagagtatgcggggcgccatcattgcctatctggtggagcgagccagatgggacgccggtcttgttccccatggcccgagtcagctcggggtagggtgatg

SEQ ID NO: 11140 - DNA, 647 bp, Zea mays
gtctaatgtgagggcattttgaagaagaacataaatggtttgaaactgacaaagaaactataccgagtgttttttaggagttattgcaagtagagactacgatcggatttcctcgccattcgacttggctgggcctccggatttggtcggttttatgttggcaactggacgacccagcccgatgtccgcccagtgggcttggtcgaggctgtacattagcaggtaccggaggcgcaggacgggccacgtcgacctgctgcccgctcaccacacagggaggccgggaccgcaccgccactgatatgtcgaccccacagaagattcatcaaaccataacgataccgaaacggaggacccgtccccacgcgccacgagtggctagtggctacggtgccatctcgccttcgcgccacacatcccccactcgcctctcaccgacccagcagaaactatcgctcgtcgccgtcgaccaaagccatgccaccgacatgtgggacagtgctgcaggtcccactcggcagggacgccggcggttcttggagacagcgagagcgaccgaccgcgcgcgcctcctcctcctccttcctcgccaggcacggcacgactcccagtggccaagtacactcacccgctcgcgcgcgtgagcg

SEQ ID NO: 11141 - DNA, 192 bp, Zea mays
tggtaagtgtgataaaatatttgatgaattactcaaaaatggcaacattaaaataaaccacattgttccatctgccgacgagctaaaacgttgtgcaggcataactcattttctcatgccactaatgattgtaatgtgtttcggcgacagattcaatcggccattaacgagggacgattaaaatttcaggaa

SEQ ID NO: 11142 - DNA, 67 bp, Zea mays
gaattaaatccttgcaaccctctacatctaccgttgaacacactaccatttgcacttagatgtagag

SEQ ID NO: 11143 - DNA, 439 bp, Zea mays
ggtatgttctgctgggacttctcagtttgttcttgtgttttatgtgtaaaccaaagaagcacaatgacatcatcatgcaccttcacccattatgaactgaggtatatgtgtccagtttaatcattgtatctagaagcattaaagtcttgcatgctgcggcatacaaaatactatgctgcaaaagaacacatgtacttgcttcaaaatttatctgctctgcgaagtgtaagtgtgccatttcactccatgtatgaatttcgtaaaattaatttcgttctgtagtaatattctgatcacaaaacaatacgaaactagtagctgtaaaaatcatagcaaacaaaacctccttggcatccattttttgctcattatgttacgaagtaagcaatgcatctaaaggaagatccacagtgatgcctacaacagtaactatctttcc

SEQ ID NO: 11144 - DNA, 157 bp, Zea mays
ggtttttgttcacatattactattgggcagccaaagagttctacaacctgcattgcacatcttattattagataactaatcctgtgattactactatactgtgctagccacttcatagtctagcatttttgcaacgataccaacttcacgtgtttac

SEQ ID NO: 11145 - DNA, 1166 bp, Zea mays
ggaagcaatgctcgtcgactttctccgcgcaaacgccgaagtttttgcgtggagtccctcggacatgcccgacataccgagggatgtcgccgagcactcactggatatccgagccggtgcccgacccgtgaagcagcctctgcgctgtttcgacgaagaaaagcgcagatccataggcgaggagatccacaagctgatggctgtagggttcatcaaagaggtattccatcccgaatggttagctaactttgtgcttgtgaaaaaaaggtgggaagtggaggatgtgcgtagactacactggtctaaacaaggcatatctaaaggttccctaccctctgcctcgcatcgatcaaattgtggactccactgctgggtgcgaaaccctgtcattcctcgacgcctattcaggttatcaccaaatcaagatgaaagagtccgaccagctcacgacttctttcatcacaccttttggcatgtactgttatactactatgccatttggcttgaggaatgcaggtgcaacataccaaaggtggttggggctataaataccccaaccaccccaccattcatggcatccaagttttccacttctcaactactacaagagctctaggcattcaattctagacacattcaaagagatcaaatcctctccaattccacacaaaaccctagtgactagagagagtgatttgccgtgttcatttgagctcttgcgcttggattgcttcttttctttctcacttgttcttgtgatcaaaactccattgtaatcaaggcaagaggcaccaattgtgtggtggcccttgcggggaagttttgttcccggctttgatttgagaagagaagctcactcggtccgagggaccgtttgagagagggaagggttgaaagagacccggcctttgtggcctcctcaacggggagtaggtttgagagaaccgaacctcggtaaaacaaatccgtgtgtcacacttcattatttgcttgcgatttgttttgcgccctctctcgcggactcgtttatatttctaacgctaacccgggcttgtagttgtgtttatatttgtaaatttcagtttcgccctattcaccccccctctaggcgactatcaattggtatcggagcccggtgcttcattagagcctaaccgctcgaagtg

SEQ ID NO: 11146 - DNA, 298 bp, Zea mays
ttctatgatagtgtttgactttagattgcctattttgaagggacactttcagcgacagtatttaatttggtgtgttgccagaagacctggctctgaattatctttctatttctttgattatcacagggaactctactaatagtatgctggattagcacgattaaactgaagtatgacaaatttgcatatcatccttgcaggttatttctttggcgcactcatgatttagcaccagccaaattgacctttaactctggtgacataagctgttgctagggtagcaaatcaagagctaaga

SEQ ID NO: 11147 - DNA, 58 bp, Zea mays
tgtacgtgtgcctgttcacctttctttcttcatcctgctgctgctgcatccatcagta

SEQ ID NO: 11148 - DNA, 1500 bp, Zea mays
aggcaatattcaaagctacaatataatatatctgtaaacatacagatggtaatgctcaccttcttctaatgcaactgaattaataataaatgtaacaaagataagcctttctggcgtccaacagtagcattaaatgaatacgagcaagtgacaataagctcacctacgaggccagatcttcaagtcctcttcagtaggtttgattgaggatcaagttaacataagctctactggaggttggcactggaatataatgggagaaaaactattcaataaaatattaatgcacaataattacataaaaacgaataaaaaaatataataggagaaaaactacctaactgattaaaagtgcaatcgaagtattcttaaaacaggtatagattggctttcttgtcagtttttgaggtgtcatggtttgctcagtcatatacgaatatagagcactatatttgaatctagagcctagccgtgggcgtgttcggctggctacaagccgacactgttgcagctgtttggattgctgcagctgcaatccatagagagaaaaatactgtagaagccgcagccgcagccggattgcagccgcagcaagccgcagcgaacaagctagaactggctggaaacgtaccgtgacggccacggagcggcagcaggacgcgctcctgccggcggcgcgggcgcactcggcgtactccggatcgctggctccgatcagcgccgcggccacctgctcctcctcgtcctcgggctcgttctgctgcctgggcaccgccacgctgtctctgctgaaccggatgaggggtgagtgaggaaggatgcatgctgtgtcagtggatgagaacgaggggcctgctggacagacatgcatgcatgcacgcacgccccccgtatgccttttggacagacatcttggaatttggctgctggtagtattattatctctactaatccttaagggtcgacggagggcgtccacaccctcaccatgcccccgccagcgatttttggccgcggcgcgcgtcttccccacccgcgaatcacgcccgcgcgcgtcgcgccgtcgtgtatcccgcccgcgccaggcacccctcccctgacgcgccgtgatgcccgccgcccgcgcaagccacaccgccccccgtccccccggcgcgcgtcttcatcccgcgcgcgtcgcccctttgagcacagtatcccggcggcggaatcttccggaagctgctgcacagctcgccccctgcgccgccgcatgtgtcaggtaaggaccaaggagtatcttgttctccggctctccgagtccgagctcaggaaatgttacggacccgttcggttataccggaataagacaggattcattccagatcatcaaaatctatataaattagagaagtaatccggctaggaattaatccggggctccaatccggaacaaccgaacagggcctacatctttgcagtgtaacctttttgattgaccgattgattcgtgtaggagca

SEQ ID NO: 11149 - DNA, 1060 bp, Zea mays
tcagctctttttttccgccatctttttgcatggccgttttgaatttgtttttttccgcaaacgtgagccgcctctttgctctgctcccaacactgccgctcgctcccccacccaccaccactgggcctttctatttaaaactcgacaaacgtgcaggcccaactgaacccaagcccaaatcatgttcaaatgatagcggtccttttaaggccacaagaggaatttctctctctctctctttaattttcaaataattagagccaactcatcactcgctaatgcgtgcgtgggggggccttttttttcccggacggcgacgcgcgtggggacggagcacgcacgagctgaggtcctgaggacacgccggccatcccctcccctcccatcgatcgacccagaaggcgacgccgggatcgcacgggtcgtcgtcgatggcgccaactgagacgacgacggccgttcgagtgttgttggttgttttgttggtcgtcgagccgtccacatcatcatcgtcgtcgctctcgatcgtacgtacgcacgctgcctggacgatgcaacatccgatcgatgcaggccttagctctcgggcgtttgtttcgcgtcgtgcgtgtacaacttttaaatcagagaataaaaagcttgttggcctagatttgacaggtaggctgttgagcccatgacacggacggtgccactagctaggcttgctcttgtattattgttccccggcccccgtaccgtacgtgccagcaaataagtttcatttctagaaggaagaatagcggggcgtcgtccagcagtgtcactgccacctgcacctgcgaggaagaaagcaagctagcgccactctcctctcactgctctagctatttatacccccgtgccttgcgtctccttcctctagagtcctccaccccaccttccctacctatctatcctacagcggctagtctactcaactctgctctgctcgcgcggcgatcgaggcaccgtcgtcgccaccatcagcggctagcaccgatcgagccaccggccgatcagatcggccggcccaacgacc

SEQ ID NO: 11150 - DNA, 749 bp, Zea mays
cctcgaatgagattgtggtaacttaaaaaagtggaattcactcgggtactcaaaccggtagggtctatagttgtctttctttgttgccccccatcatcatctatcttaactatgcatcaagcttccatcgtcaagaacgctgtgtgacgagaaaaatgatggactgggattgggagagaactttttgtcttttgagtcgtgtgtttgagtgaactttgtgacaggtggggtccgatttcaagagcctcttgatggaataaagccagatggattttccgttatgcaaatgaaaagggggaaaaaggcttttttttttcttttctgttcaaaaggggggaaaaagataaactttctactgacatggaaggtgacacgtacgtactaacgcccggcgccggacaccggccctgtcactccctcagtcgtcagtcctcagccgttagctactttgttcttcccagtgtgtccgtgctctggtgtgtggcctccgtctcacgcctgagctgcaagccctcttggcgccacacagcgcaggatgagccacagaacagaagcgtctcttcctcctcctcttcttcctcctcatctgcaccaccacagaacacagattcgcgagcccaagaccaagagcaagagaagaagagctcagctgctgctgcggtgctgccggtgccgggcggagtttaacatcgcgccgcagctaactcaacgcagttaagcttctcctactcctagcttagccaatagcc

SEQ ID NO: 11151 - DNA, 994 bp, Zea mays
taagcaacctattttcaggaaatagagaaaataacctagctatactcttctctctcacacatggtgaaaccctagatccaaaatgtggctaaaattgagtaagaatgaacaaaaaacttctctctcacacatggtgaaaccctagatccaaaatgtggctaaaattgagaaataaataacaaaaattgacaagagatatagaaactaacttttcttagcaagcttcttccaaaaaaataaagatcaaaacctctccttatatttttgtgaaatctggacctccaaaatcgtcttcaatggaaggtggctgcgagaaacagtactaatcgggaggaagaagggggttttatacaacaaagtttataggcggttggaatatgcaagcaccagtggaaaccgtccatttcaattggtggttgttgtaatgaaaccgtcagtagaaacgagaccatcactggcggatccttatacaaactgctagtggaaatggtcggtttctagtggcggttcacttaaacaaactaacatagaaatggatggtttccactgctaaggtttctttaatcgggccaacaagtttattatcactggcgcgtgataatcgaaaacatccgtagaaattagaccttattgtagactaattagagctcatttgtattagtggtgttttagaattcgcagcttttactaagtatctagatataaatctagaaatattaaacgcatctgcctctaaatactgtataattaaaaaacaaaattgaagaaaccgtcggccaacgcaaggaaacgaagaagagaaaaatgaacaccattatgctttggttcctctgcctccacctgtctcgcccatcactatataaacagtccaaccggctagcctccacttgtctcgctcactagagccaagagctccatccatttcatttcctccactctctaaaaagtagaccagccaggggagagaagtgaggcatcgaaggaagcccccacc

SEQ ID NO: 11152 - DNA, 1080 bp, Zea mays
ctgcggttgatagttgatctgtttcctcgtggtcgtttgctcctccatattggagggaattttcgcatgtaaatctttgtgtctattttatttcgtaacaaaatctatagattctaaaaagctaaaacttattatagtttagaacggaggggcagtggatataggccgagtggtatggcaccgtaactgtaaataacatgcatgcatggagacgacgacgcatgtagattatatatcgtagtggggttccggaacaatatacaaaaaacatatatgcgtgtatttaattattatttgtggcggctggtgcatgtgaactactggaataataatggtgaaattgaggagggtgcactgactgagatacggtagacatgcatagataagcactgcggagccatgctgcctgcctgcaataatgcttgtgtgtatacagcgacacgacacgagacgagagggagggtgaactgaaagagagacccggctagagctataaagcaagtgggggaagagagagagagaggagaaggagaaggagaggtttttatgtatgtgtggtggacatgcgtcctcctgtcgtctcgagagagcggaggccctaatactccaatcaccacgcaccaaactagctagctagcagtcgtcttgcattgtagctagtccattgctctcatcttctcttcttcttcccccagtcctccccccctttcccctcttcggcctctctcgctcagctcactcttcattaagcgagctcacgtcgttcctcccttcttcttcttcttatccgttgttcaattcgttcagctagccggccagagatcgagcatcatctccatcatcgattcatccatctcatctttctcttcttctattctatgtcgtcgtcgtcccagattagatcgaagctgctagcagtctatccagtctctagctagctagctagatcaagcccgcagactatacaatataatacaagctagctacgtgcttattattgctttattagtctagaataatcttgatatatacgatcgaacatatatctcgatctccaccgatacacacccggccctatcc

SEQ ID NO: 11153 - DNA, 752 bp, Zea mays
ggtaggtggctacatacgtgggcatgcaacctgcattgtatgggctacgctttttgcatggcactcaagccaaactgattctatatttatgttctatatcgtatttaaaattttatttatacactcttgtctaatagacatctacacataaccatataagacttgattggatagctaggcatgtatggacaggctagacgcgtcctagccggctggatacggtagttttaagtgtatggagtgatgcaggttaataattttaaaatgagttggtttatatttactcatgtggtcacatacaaataaataaacataagctcaaacaaaatcaaaacaaacaaatataagttcaaacaaaattaacacatacgatgacccgagataaattgatacgggcaaccaatcagatagataaagttgttccgaatatgcacaagcaactaaaatcatgaactaactccgcttctaccaacaataggctcttaccggcgtggttcgacttctacaacaaacatggcatctgtctcaccctgccctctttcatcatttcccgaagcttcgcatccgtccttcggtccttcctcacccgttcgtctgtctcgcctcacccacccacccacagcatcagaacggagggaattagggagcttcggccggatccgcaacatcggggaacggcgggaaccagggagctcccgccrcctagaaccggagctcccaatcgatccactggccgttgagccgacacttca

SEQ ID NO: 11154 - DNA, 1124 bp, Zea mays
accgacggcccggccctaaaccatacaatactacaatgtgctcggttgtaccacaaaggcaatatttgatgcatgtattgtaacgtgaaaaaaagcctcggttatacatgttgtaggttcatctgcggatattgaactatgaatttccgagcataaagcatcaatttccactgccgtcgtttctcccacatttaaattatataaaaaactaaaattatacataaatgaggatttgaattatgactattgattctaaatcgttcctcccacattcaagttataaaaaaactaaaattagacataaatgatgatttgaattatgattattgattctaaatcgacattcatacaaacctagccagcataacgtatatgtttttgtattttatatttaagcataaatgaactttgctagtcagaatgtatgtgcatctaatgaaaccttcaatgttacatcaaatcttaaatctaaaatattcggttcaggacaaagctaatgcgccctactccctctgcccccctgatttagtcgttttggatttgtcgtaagtcaatcactatcaattttgatcgattataccagacttaaagttaatagatttatcataacataaactaccataatatgcaattcttttagtttaaaacaatttaattatatatatattgttgttcaaagttaaaatagtttaaattagattaaactaaagcgactaaattatgtggacggatagagtcgtgggtagaataaataaattatgcaagaatttccaaaagattgttcgaatttgtgtatgttgtcctctctctctccaccgttggatggcaacataccgcctatccacctgcgctcttcccgttccccaactgcaacatcctctatctctctctctctctctctccctctctacctgccccgttcctcaccagtctcttccgccggcgtcgacgagagctgcgctaggtatccctccccctacgggttggcggatcttgctacggctggtcacacgtcctgtcgagatcgccccctccccgatttcgctgctaccgttgttgaattcgatgtggtgattcggtatgcgtggcatgtgcaggtgatctcgactgcttcctcgcccccc

SEQ ID NO: 11155 - DNA, 784 bp, Zea mays
cttttgggtattactatttgtgttgtttcctctttatttgggatgctgcttgagatggaggatcatgtctattcaccgtttttcgatcctagctatccagtcaaaaccttcccacacgcgcgcacacggtgaccgatcgagcctaaagatctaacggtaagtcggtaactactgccttgtatgtccaacactttaccacggaagcgaccatatcgccttgtcggtgtggcgtcgtgcaatttgcaacgacactgcagcagcccaacaggagcctactgcgtgcaattctttgaccagttgcggagtctctttatccatgtcaaggccatccttgagcagggtggaggcacttgcgccatggcccatggctacctcgagctagcacgcatttatctggtctagaagctagctagggctcaggttgtactacctacagactacagaacgtggccggagccacacaaggatacgacagtgtttgcacgtcgcggcctgcagctagctacctgcaactgtgtacgccgcccctcggattctctacgtccatcgtcgtaccaccatgctctagctgattaacagctaaattaagtggcgagtcgtctgcgattatcttattaaggacctcctatatataactatctcttctgcttctgttctcgcacttcgtttctgatagtttgcgtcagctaccagcagatctttgtagaaaaccaaaggaacagaacaggctagcgtggcctaagctgcagctgtcagcgtcgccgtcgccgccgccgccgccgcg

SEQ ID NO: 11156 - DNA, 226 bp, Zea mays
agttgtctgtccctgcgtgtcatgcatgcatcaggcgtgagtgggactgtcacgccggccaagaaagccggaccccgcggccaacggcggggacctggagatcgaggacggcctcaagagccccgcgacggggctggccgccaagttccccgtgtcgggctcgccgtacgtggccccgcgcaagaagggcgccgacgcgccggggctggaggaggccgcgcacccg

SEQ ID NO: 11157 - DNA, 784 bp, Zea mays; identical to SEQ ID NO: 11155

SEQ ID NO: 11158 - DNA, 553 bp, Zea mays
cgtcaaatcccccccatcatcagtcagatgaacttttgatcgaattgaagttgttcttctaattcggccccagcagcgcccatgcatctggttttatttgctttctgttgggtataatatgcaagaccttttgttgctagggcaaggctgcaaccacatgcgtgtactgaactcatgatgtaactcatcctttttgtttgctcacagaatcactactctactgcacttccttttcatccgatccgcaatcttttttttcttttacatgctttagttttctctctttcttgattacaaacatgattactggaactttcttaggctgccttccccttccttggatctgctttagttttcttttttgggctaccgcgcgcggcttatttgagtttatcacttgctgcatatacataatatatatatacatgcatgcgatggcgttcatgttactcaactacagatctgtttctgttcgtgtgtttcagttcagcgcgcagttaagcatagcaggacgaccacgacgatgtatcacccgcagtgcgagctcctgacg

SEQ ID NO: 11159 - DNA, 1500 bp, Zea mays
tattcaataatcattgtttgggaaaaaatttagcattcttttggagttgctcaaagtccaaatgtgcttaaatgggagggtatcacagtcgaataacagttatgagaagaatgtaaatcgacggtagtcagattattagatgagaaggaatgaagtagatatggctatacgcatttcatgtaccaaaacgacgaatccagaaataaagaggtcattaacttcatttcctttcttagttctagctcttgttctgtgcgatctaattggtttcttttcctgacacgttatcagcatcaaccctgccgagaaacgtgtcgaaatggttgtttattcaccttttatcacttgcccacttcgtcacatgaacaagctacgtcgtacgaaggcagctcagccaccggcagtccggcaccatcgaaactgctccgccagtcctctttcaagcgctgtgcacaaaagatcaagcaaggagcgaatacaatatctaatgaagaaatgttggaatttaggaggtgtttggtttaaagaaccaatctcttctagatgagatggtacataagttcattccactaatttagtggaatggactctttctttaaattattgttaaatattagactatgagaaataaaattgtgatggatcaactaattccattctacaaataaatgaaaaggtgagaagatgatagactaactcattctcaaaccaaataaaccaaataccctattagtcatttgaagtgaggaagtaactgttagctgggttgtatgtaagatatcaatttacttgttctctgaggatctgatcagaaacttagctatttttagctgttattgttagctgcttgcaatccaaactgtccttatatgtgatcctaaatgaacgtggtttcattagtgatttttttgtcattgtaaaacaaatatccggcagagagcaaaagatacccatttatccgagtcgtcatctgcagacgttctcaccacttgattggagcctaaaccataagtacacataaccagtggctcatcttcatagtcatagatggcaatgccaaggactagcccgacaaatatttgcaaacccacatcaactccagaagtcaacaagggcaatttaacgtgaacgagaacctgccaggcatgccaaaccagttcttgctcggtgcaggcagacattttcgcaagctgccggtcgcgcacggattgacagcacgggggagttgcggtaactaacatttgccgacccgaagcaccgtttcctcggttagctttgaaggttccaacagcccaaaacggcctcctctccgccgcccgtccacccacccgtcaaccgcgtctccggcgcgcccctatacctcctccgtttccttcccctcccagcacctactccaatgcgaccacacttctcgattcttgcgcgagccgatcttggccatcggcctcgctgacgcacgtcaactagaggagccattcgcaaataaccgggagcgtgtgc

SEQ ID NO: 11160 - DNA, 798 bp, Zea mays
ccctgtgattgtgtaatcagacacgtggatccttaactaatatagaaaacaataagagggctatttcgcaaaactaccactccatttgccttaccttccggtaaagcaatgcaactacaacgagctgacagcaaagcaaagcttgagaggcttttctcaaaaacgcgccgtcgccgtttcttcccctttttctttgagaaaattcgcccgcgagatctttagtttcagaccccgtgtggattagtcgctgtcacgatcgaggcggggcgccaattgcggtggccaccacctccaatccactccccgcggtggcctcgccgagttgttcttgccccgtcctccctccaactccaagatttgtttcgcacccgattcctgagcttccgcggcgcttcttgctgaaaagaaagctccgagttcttcagttctggatcgatagagaggcggttcctttgcgggctctgaggttggaaccttattcttctttcactatacagcgtctcttccttcctggatccagagtcatgttatgatgtggctctgtttggggattagagttgtttctttcgtcctgttgtctgaattttgcttgcagatccagtgtcgaataccgtgtcttgaatcatggccttgtgaattccaatataaacgttcctgcttggcttgctttgttttgacacaagcgttgtactccttgggattttcccctccaggttcagctctcgctcatgatttgtctcatcaacccaccagtcgggctgcaggcttagagctggaaggaataatttgactagagaa

SEQ ID NO: 11161 - DNA, 267 bp, Zea mays
tgtgtgtgctctttaaagccctcgcatcgccatttgcagaattgcccagtgctctaaccagatctgctccgctccgctccgggctgactaaccgagcccgccgtctctgtagctagctggtcgtccgtcgtcgccaccaacaggctaaccaccaaccgcccaaacgtctccaccgcgcgggcggagcgcagctgcccgccccggattaacctccctctcgccctccccacgcctccgagatcgcgagcgagaggacgccacgctgac

SEQ ID NO: 11162 - DNA, 678 bp, Zea mays
gcttgcatgcctgcagattgcctaccttaaggttgtcattttgttatttttctctctctgtagatggccctcaaggataggagacacgctcttattattcaggctgctgttttgatgatattaagtttttttttcccaactacttgtccaaagtggcttggtccacgtgtgggtagtaatggatcacaattcaagtatttctttataattcatttgagtctttaattaatcttagtttacaaataaatagaaatagggtgtgatactaataaaattccatccttaaattttattgtattaaatttagagtccatcatcatccaccctaaaaaggtaatggattgtaaatatgtgcacccatcctaaatgaagagttaaatttgagtgaaaatgttcccccctaagaaacttaaccaatacatttgtttaccacatatatttataagcaaacaatatatgttcctaccctttatccagttgttcccgggtgcacctaggcacctagccaaggttcatgtttacatgagtataaatgtctactcacgtccacccagacccaggcccagccgtgacaaacacaaccataaactgctagcgagcgagctaacttcctccgtcgatccttcccatccctccaccattcttaaatcttcctcccaccagtctgcttacctaagc

SEQ ID NO: 11163 - DNA, 1185 bp, Zea mays
tctttttagagtgttaatggatctatataatatttgatgtatgtgtattatatatgtgtgtagatttattgttatccatttcaatataatggaacggagggagtattttacaagcctctttgcaatataattaaattctaaacctactaatagaagttcttaacatacaatacattgccaatatagaacccaaagcatctagcatatattgagttatatgatgatatgtcaaaaaatgttagaaagaaaaaatgaaaaagggaaaaagaagagtatggaattttatttggtgtttctttagtccaggtactaaaatttagttagaagactaaaatttagtatctactatgtttggttctagagattaaaagtattcaaaacgtattaaatgaattataaaaagactaaaatactatttaatattgtctcgtcattagtgtaattaaaataaagaaaagttaataggtgaaattaatacgatttagtcgcttttagccaacttttgaaagactagagactattagtcattattttagtttatcatttgataatttaaaaactaaatgagactaaaggaaggtaatctctctcaaaccaaactggacgcaattcagcacaaacccaacttccaccagacccctaaccttttcgcagctccaggctccagcgcacagccgccgccgtttcttcatcttcttcgcagagccggcgctccatcttcggctccctcccttacttgcgctcggcacgcaggcggcggcggcggcgctgtggctcgggatctcagtgacggcatcagcggcttcccctcccgcctctcgccagtcgcctccggtcctccgcacaccggccggtgatctctctcctcccgcctccggtggatcgtcaacgacgcccggccccggcggctgcgccgcgcgcgtcctgagggcagcgggagctagcaggcgctgctccaccaaggcggtcgcgccgctttgggagcggtttatgcccccaaagtgaagcgtgctcttagtgccgctctttggaaccctggtaatggtaatctattcctatgcatttgttaccatatataatgccatcttttgtctgtttctattttcatcgtttgagagcatgcgttgatctattttcatcgttctgaaagcatgtgatgatgtatgcgcaggctactgctgttaa

SEQ ID NO: 11164 - DNA, 397 bp, Zea mays
ggatcccttgagtcgacttgcacctaacggatcataaaccctccatcaggggtttgaaacccgttctggactcatgtgtcgcgcatgaccaccatggcacttcatcactactgggcataaaagaatgacaggaaagcggatgaaaaaattaaccaaacgggaatgcctttttagaaacagaggcgctttccacccggtccacggaccacggctctctcattatcgcttcaaagccaagcgaaagccggaagcgcaacctaaatgacccgaccaagtgcacaaccgaacgcgccatgcctagacgcctgcggtttacacccacccattgcggcggtgcggcccgcgccaatggcgagctccaccacgctgcgctaggtctccgcctgcggcgatcgcc

SEQ ID NO: 11165 - DNA, 660 bp, Zea mays
cttgtagagggtttgggcgtattgaagggccaagacgactccgccatgctcacgtctttcagcaacacggactacggcaagccacaaccgatcgaacaggacaaggatattgtatcggttcatacgatcggcgagactggagctgtttcttcggataataccggtagcagcggtgtacctgtacagctagtgcccgtgtcgagagacaccaccaccgtggcgccactatctaggacggaagaaagtacgcacgatctctctacggaagacgaagcagcagcagaagaagaagaggagcagggtctgcagatgtctgagatacctttgacggacagctctccccctaaagatggtcaacagaaacaaccactggctgccatcagtgagcgatcaggagctgactatcagaaaagtgataatgttgaggatggcggcgacggcgtcgaagatgacgacggggatgaatggttggaagaggaagcatgggacccgggaaacacgcaaattccgatagcagatgatgaagacgtgtctttcagtgatctggaggaggaagacgatggtgcggcctgacatcgcctgtaggcttggcttgaccgtactgcttacgtagtctgtgcttcctgttccgttatacgattggtacaattgtcttggttg

SEQ ID NO: 11166 - DNA, 270 bp, Zea mays
tggtgtcaatttctaaaaggatgatgaattggatcctttatgttgagaggcagccgaattgagacgtgtatactgaaatttctcccttgagcatcgatgtacataaaaaatgctttttgtatgatttagtgttacgtcgagatcatggatgcatcacttttctgctgctccttgggtcctcatgtaattgggcatctactgtgtggcaacatttttgtatgactgaatggtttccccacctctttatctctgaagatttccacgtcgtcc

SEQ ID NO: 11167 - DNA, 1500 bp, Zea mays
ttatataactcttcgaggcctacaggttttctagtggattttccatccgaggtcgtttgtaaaatttgaactttgaaagatttaaaatccaaacatagttttgcataacaagatggtttcaaattaaaaagttgtcagctacaaagtttcataacttttcaagacctacaacttttgtttcgatggtttttatatccgaggtcgttcgaattttaaatttattaaattcagacatagttttcattgacaagatgacttcaaatcaaaaagttactaactataaaattatataacttctcaagatctacaaagtttattttgattgtttatgagttatacatgtttatgagttatacaacttgtagctgatttttttcatttgaattcatttactagtttcaaatatgatttgaaaattatctttgcctaacgtcaaaacaaaacactcgatagataagttttttgcctagtgtaaaaaacacttggcgaaacgcttatctgccaagttttttttactcgagcatttttgtttagcattctgtaaatagcttctttgttgagtgtccaaaaaacactcgacaaaccatttgacactgcaaaaagatagattcggccagtgataggtttcgactgggagacaaataaatgacatagcttgacactcccagtagtccatcaatagttcaataatactctaagtcaatcgatcttccccattaccatcgactgtatctttgtatcacacatgaatatcatgaatcacactcatatatcatggttagtccaaacactaaacccttaatcatctcttgataagcactcatctatacaccggcatatatatcaactatgtgtttacataaatggtaaacaaataataaacaaggtcgtttagacgctaatgtcgacgcgtacgttaacaaccgaaagtaatctaaaggtgtgggttgccggaggttaggcactaaaggggctactaaacgaggtcatatatatgtttggttcccacatacatgcatacccatatatatgctttctttcaggagatcaaagaaaccgagttaaccctagtctaatataatgaaggcggcagaagaaacacaaccagctaataactaaagaaaaggtaagcctaaagagtaaagagggataaacaaagaagactgacccggtcctctagctccaccacacgtacgacgcacgtacgtcgcagtatcgtcgcaccatgcatgcaacccccttttccacaacacgagaaagaaaaattctttggcaatcaattagcgtgaaatcgaaccatcaccagcatgtcaaccctacgcagcaacaacgcgcatccagcattatattccagcagcctgccatcatgctatatatataacctgacgctgcctacctgttttctattattctcacgctctgttcttggatcgagcagcagacgcaccttaatttgttcgaggaacgtacgtgcgtacgggacgggcgagccactccgcc

SEQ ID NO: 11168 - DNA, 991 bp, Zea mays
tgaagatgctccggctgagcttctttctccgcttgcgtgctctctccctatatatctagcggtatactatctatgtcgcctcaagatatcgaggtcttcgtcgtgtccttctccaacaacgaacatgtatgtcctcctcttcccttcccctcccgctctacgaaaccttagaagtgggggacgcgcgggatgagagtctctgatttgctgcctatggtatccgtgcgttcataaaaatattatgcgaagagcgaagacaataaataaaaaatcttgaaatatttttggtggataatttacatggatattgttgtgagcgtcgcaatgcacgagtaaccgactagtaaagtcatgatactccccctcattttggatggagactaaacactcacttaaagagtgagagctctatcatttgtcaaactgtacattatatagaaaatgggcaaccacgctacggcccataaggcccgccacgccacggcccatacaagatagagaggacaccactcgttcgccagttactcgcacacacactgacacacatacagcttcaatcatcgccttccagcctcttcggctcttcttgtcatcttcgatccatccgcagttcttcctgcattccccatttgcgcgttcttccatctcccagattgatctccttcccgacttgggctttcccggtgggaaagcagctgtacctaggccggagcccacccgcccttcctgttattcggcaaacgcggagaaagtgggcaggcaataaagtatccgcggcgccggcagaacttcgtgatccgctccgtatggttcgccttcttccagcagcgaggagtggcgcagacttagaggccaagaaccagatcggcgggtccatgaagcctgacgtgaggaaagatgccggctgtggcgtgaccgcattcggcgtctcctgcttcgacatcaagtctttggtcgcctccctcgcgctgctcacgctcgtcatggcgct

SEQ ID NO: 11169 - DNA, 373 bp, Zea mays
tggcgcgctgggggactgggatggggaacacacggtggggaatgggcagtgggacgacgcaagagagtgtggatgacaacgctaaattattaatagagtagtataaatacaactctcggctgattggcaagcaactcaccggctgagtcagcttcaatctcacctgtgacctgtacactcccagatcagacggttcacgtacgacggttggcaacactcacaaccaccgcaccgcacaccgcagcccaagttctcctctgcatctgaaatatcttgccacctgacgcgacagcgacaagatccaagaactcgctcgcgcgcacggacagggccggaacccagggatcgagactgaacagcagtccgagacgcc

SEQ ID NO: 11170 - DNA, 809 bp, Zea mays
atagggggaataaaggcatgcaggagattgctctggcgtgaggcgcttatataggccgagagggggagcagaggcgacgctagggagtgagaatagctcaccggatttatgtcctgtggggcagagaaaacgacatcgacacttggtggaggtaacaaccgtggcggcagtagtgctccactgcaaagtgaattcgagctagtgggcgggcaagtaagcaagcaagcatatggaggcgcgacaaggcgacgctgctatgcggtgtggcgggaggaacaggaaatccctaattggggcagacctatcagcgaaagagagtgggagagacatgggcgggcgatcgctaagcgatctaggccaaaacgcggggtaggtcgagcgcgggagcatgccaaaaggtccaaaaaccgagcagcttcacttgtctcttttcttttataaaaccaaaataatatatataaggtgaaatacaaaattatattaacttaataaaatacatggtttgcaaagaaaactaatttacaactactttatttttataaaaaaggttttccattaaaccaaattttaaaatttgaaaaatcaaccaaataaattctctaacatgaatgcacaaaaactttgcaaatttatatatttaaaaaattatctaatttgtttatagctccaatttcattacttgaaacatacacatttttcttttctatatcgaacctatatttaattatgttgyttttatgttatggattttggatgttacacgtgcctcctccgacctgcgtggtgcctccccctccctgcaaagagaa

SEQ ID NO: 11171 - DNA, 94 bp, Zea mays
gtgatcaaggccttcttataagttcgttgctgtttgaaaattctaactcaattggtactataattcaacaaaacagtttcctggaaaagtggaa

SEQ ID NO: 11172 - DNA, 244 bp, Zea mays
caccaaaggctcgactccactcgtttccagtctactccgaaccgtaagtgaatgaatttctgtctcatacagtttaggtcaaagacgagggaagtcacggaaagagggagaccaactgccgccgatcggtacggacaggagaggggcggtaggcctataaaaacttaccctataatcaaacggcctctcgaatccatcgcctctctgttccctctgccttccctcgtacttcaccctagcggcg

SEQ ID NO: 11173 - DNA, 222 bp, Zea mays
acgggtacgggttcgggttttttgggtaacgggcttcgggctcgggttttatgcccagtcctagtataaactacactagccttgcagaactcagagggaacgaatagagtagtgctgggagtttagtgggtcgaggtagctgaagagcaaacaaacacgctgttcggtgttcgccgctctcccatttcaccgagaaagaagggactaatgagaagagagagc

SEQ ID NO: 11174 - DNA, 1177 bp, Zea mays
attatttgagtacttgctaaatctcagatttaggtagtagaaatatacataactattggagctgctctaagtcattaatatggttggagcatgtttcccatgaatgatcgagttgtgcttgccttgttgcactgggtgcgtatgtagatctcggtttggttgccagggtagctaacatgtggggggtactccagctcctacggtcctacctggtatgcaaattgtcgactacagcaacaatatagtacagtactccgaaagtgagcatgctgaattgcacgagcagttaccatattggacgccacgtaagacgggatttgaacaaacttctgaattctggcttgggggtaaatgcgcaaatggcctgttctgtatactatgttttcaaagaacgggtggggggcaaatacaaaatggatgaggcaaatttagagttacacaacgacagaattttgaatgacccgattgacatgcaacatttggctcacacggaactattggtgatgtcactatttgtgacacgttggtcctgtcactgtttgtgacacccacggttgtcctgtggagcgggtgctctatgaactgccatttgtaattctcaactgtagtcgttggcggggtctgcttcgtgtttcttactttgttctggaggaaaaaaaaagatccctaatcaggagacaaggatccacatgcaataaatcttctcttctgttctgttctggcaccttcccagatcaataggggcgaggggacgaaatcgtttaaaggcgccagcttgtcttctgttccatttgtggtttcatttcctctgcaaacgatttccactttttccgcacgccgtcagctgatccttttcgccgtagtatccccgagcaaaagagaaaacccttttttttgtgcgctgtgctgtttcgccatctctgttcgtcccaccgaggcaccgactcaatccccattcttggcatctggcttcacaaaacaagaccggttcccgttccctagatctctgcgtagaggcggcggcgaggcacctgaatccggcaaaaaagggttcgcggtttgccttggttgggaggagcgcaggagcccggcgtcaaaacccaatcttggcgcccgggctgccgtgcgccatcgtcttctccctgtggtgtttagggagaggagaaggccggtggag

SEQ ID NO: 11175 - DNA, 317 bp, Zea mays
agcttgataatgcaagcttttgttttgacagatgccttgcttcacaatttttggttcacaagggaggtgtagggtatgtatatgttcagctaatattgctccggtcagtgagtgcattaaatttccgcaattcatggcgggcttggtctgttttatgtttgttaaaacctgggctggaagaatagaaatctgtaaacatatctgtacaactatgtctatgtgcttatgtggcattgctgttaccttggatgatggatgttacaacattgttcagttgaaatgacaaaaggtataaagagtagtgcaagcaggcctta

SEQ ID NO: 11176 - DNA, 1106 bp, Zea mays
ttgccgtaccttacataatattttgaacgtggagctggggcgaaccttgttggctatttttgttgcttacgttttcatctgccatccatgaggcactgaggcggtcatgcatttttgccgaaaattttccaccagaaaattgtttggaaaatggtacactccgtacaaatatcagctgtaactgcttgttgccggttttagtgtggtaatgtgctataaatcgtacacaatacaatttatggatccaacccgattaaaatcggacactgtttctattcaattttgaattataattaattaagaatttaaacaaactgtgaagaaatatttaaatcattattcattatcatccttaaccttgacctcgctttatagtgctgtcagtttgaggcaagctctcctgcttctgagaaagaaaaaaagcaggataggaagcaggataggagcccgtaagctgttgaccgtgagagacggagcctgcttgcgacatcacccttcaggtcgtctggccttgaccgagtctgagagagagagagcgccttgcaacttgtacgctccttttacaatacggcccatgaggccgcgagcgggaaatcagcattaggcccaaacaaggagcattttcgcgcgaacggaaggtgcgccagaccgcatggaagaagaatagacacggtgcatctgtttatagtcccacatcgccagcatagatgcggagggggcgcgaggcgcgctacaaaggaaagcgagagtgcctagctgcaactcatacctttctccgccttttggctaagatcaagtgtagtatctgttcttatcagtagactgtccctgctttcatgtcatacatcttaggacctggcaatctattttgacctgtattgctcttcttgtttataggcacatgctgtttcagcgattttgaattttagtgagaattgtacacaagaaatcggcgaagcatcatggctcctgacgaagcaggggctgcgaccagcgcgctggacgttgctgggaggcggctgctgtctagaggcagcgacagagctcatgatcgtcgagatctttgatactagattggtaggagctgtgtttcctatgctgacaat

SEQ ID NO: 11177 - DNA, 458 bp, Zea mays
ttgaaatattgtttaaatatgaggaattgttggagaccaagctattttttacttccaataactatttagcaacttagagaaaaattttctatagaactgttgggattgatttgagaacgacattgtggtatttgtatataaaaaatgatactagtggatgtctgatgacctaccactagaacatggtcatggaggtccctacgaggctacgaccctgtccctgcccttgaaagaagagagcaaggccgtaggatcggaattcccttccggacaagacacctaccaccacccaccacccagcgcaaggccaggcggcccaggccaccactccttaccttttcccccctcttttgttccttcattcaagaatcccttcttccgccttcttcgtcgggccatcctcaccgacgagaagagatctcctcttcggcacgaggagggcagcagggaagggagag

SEQ ID NO: 11178 - DNA, 1500 bp, Zea mays
tcggctgtgcccatatttaacgtaccactcgtttatgccctcgctctctccactatttttttggtactttacgtatcccggtatctatccacgacgacactattgattggtagtttttttccctctcatataaattatccattaatcacttgtatctactcatgttttattcatgaaactagcattgtctacctaactcagtgaaagtaacattgtctgctcatttgtatttattcgtgctttattcaatgacgatggattgatgatggtgatgagatgaaactagcattgtcttgtgcttttcgttttaaaaagttggcattcatctgttttcccatcagatgcctatatataatttcacaagcttcctctgaacacaatgatggattcctatctaaccaggggcggacccagcacctaggcacctcaggcggtggcctgggctgcctcgcaggttctgatagatagaagcaagtataatgcgtagaaacaagcgagcaacgtagcatgtacacggcgaaagtataggcacaaaggatcacattgtaatctcgcctaggctgtctctaaatcctgggtccgccactgtatctaaccccgtataattcactgctggcagccttttaaaagtgcacccaaaaagaaaaaaaggtgtgggacaagaaaaggcacttcattagggcctaaaaggcactaaaacggaaaaaacgtacaagtacgtatcaagcctgttggacaagcaagtaagcaaccggctccacgcgtcccgttccgttcgatagccacacgcaagctttccagtcccctcgccggcgcgccccctcccgcgggccgcggctacaagaacggaagctgcgtgcttcgcttcacttcactccacttcatccagggaaataaaaaagcagggtggtttggaatccacatccgtagggcgagcggcacggcagcggaggggagcccacggcaaacggcatcccgcatccctatcttcctccctccctctctcgctcgcgtcgcgtggttgtctgcctggctggttgccctctcctccagagacctctcctgtctccacccctttggcctttgctcgtcgtggcgctctcgtacgcgcccaacgaggggagttaccgcccggtttcgcttcgtacggacggttgatacttgatagcgagttaatactctaagacttaaaggaggcgcggcgggcgtgggggcgagcgagcttgcttccgggggttggttcttgcgggaagctactagaaggaggggggacgaggaggagtgtggagtgtgtcttgctttgcctcgcctgtcctggtttgttagcctcccgctcgctcgaggccaagccgacggacaaatcttggtttgggacgcgccgccgcggtaggattcgggtgcccctattccctgtttctttccgaggattccgcgaggttcgctgccatggagccagcaggcgtggcgcattgaggcgtgcgtgcagggccggagagggac

SEQ ID NO: 11179 - DNA, 47 bp, Zea mays
ggctcgcggtcgccgccgtcctgctcttcctcggcgccacgggcctc

SEQ ID NO: 11180 - DNA, 1500 bp, Zea mays
gttaggtttcgcgtttgcgggttatcggattaaaatgtcatcccgctctgatagtttgcttttttggagctctgtagtttgcttttttgatggtcggcgcgttgctgcgtggcatctgttgggcccattgacgccacaacttcacatgccatggagaacaatgacactcaagtacttcgagcccatgggctatggcccatgaccacagagaaaggtcaaaccacagagaaaagtttgaccgagtatggtggctagcatgagcggacatgtaatcgccagtccccctctcgtattttgtcaaggaagaagatatatatacttaatagttaatactttcacaatataatactaaatataatactacatctgttctcaaatatttatcatctaatggttaatttttatactaaaacacaataaataaaaaagaacggagttattatattactttcttttcctatgaggtaatatctttttatatattgcctgcgaaaatgattttttgatcaagcatcttcgtcatctccaactttgttgccggttcgccggcggtcagagccccagcggccggctagtgcttggtagtccacgtccctgaggcgcagcagcaggtacaaaacaatccccgagatgaaccccagcgcggcgctcgagcccgtgagcgagactccggcgcagataagcatgacgaaggactcctccttagtacccatgtcgcgcgacgccatggcaagctcgatcccggagaagagcagcatgacgcccagtatcccgatcgggaactggccgaggatcgtcacgaacgagtttccgaacacaagccccagcgccagcttgccgatggccaggaacaccacggacgcgccgctccggccgccgaaccggtactgccccgccaatccgcccgcgccgtggcagcacggcatggcgccgaaccagcagccgacgaagttcatgaggccgacgctcaccgacacccgcgccggggagagctcggcccgttcggggaacagatccgacgagagcttgcacaccgcgatcaccgagttgagcacggacagcgggagctgcggcacggcaccttcccagaacccgatcttgaaatcgtcccaggtgatcccgacgagccgtagaggcgacggcccgaagcgaaggccctgcagaatcgatgggtcgcgcacgaagcagagcaccagcccgagcgcgaacacgatgagcgccgccgggacgcggctgcaggagcggcggcgacgggccatgccgtcgctggagacgtcctcgtcgtcgccggagccggtggcgaggatgatgaagagcagcgcggcgagagcgaggaccaggccgtcgaggccgaggagcgggcgcgccacggcggtggaggcagaggaggagcgcgagaagtcctggacgtagcggacgtacttgacggcggtgaaggcgaaggagagcccctgcgagagctggacgccgcgcacgacggggagcgggaggaggcggtag

SEQ ID NO: 11181 - DNA, 1061 bp, Zea mays
aaccactagaggacaccggcctgctgtcatgtcacgtcggtacagcgtacgcgtacgcgcttgtccgtcagcccgtgtgagccaggtacggaccgctcgaccccggacgagggcattcgttgtcagggtgcgatcaaaaatcacatgccacgcacgtacggtagctattactaatttacggagttggcactcattcattcgagttggttctccacaccaggcgttgtgcagttgaggtatagtatagccttatctctctctttttttatattagaataaaacggtggttaaggtatctcttggattggtcggcagtctgaggttgagcgaatttgcacctgctttattatttggtcggtcgggaatcagttatctatgagctgtttctttagagcatggcacatgtacatccacatcctgaggcagcagcaagatagagttgagtcagtgtgagcactgagcactattaaccacccaaaacacacatcttatcatatattttcgactggcagtcaagatagagttgagctgttcctcgcgacaagtcttttaccaccagcagaaagtcgctgtcctccttggactgttcacgaatcggccttttttcccctactagtcccgttgcccactttcaagggaccagcaacatttcactccctgtctgtccgtcggtatgttacttcctactggcccattgacgttcccggccaggcccaaccagcgaccctcgcccgctcgatccaacggcaacggtacagtcactgcaggaacctccaatggcgagccatgcgtgcaggcagcacgcatacgcgccctcgtcacctgtgagttgtgacgcaacctgtccctacctaccggacccaccaccaccaccttcctcttccctcggctcttcgcgcctcgcctcgcctcgcctatatataacagtctcgcgccaatcccctcattcatcagacggactcacagctcgcagcacctgcaccacttgacaaccagccagctagctaaccaaccggcggagccaagaacaagcaagagacaacttgccccgtccaggcagc

SEQ ID NO: 11182 - DNA, 1430 bp, Zea mays
ataacaaggacataggcccaacaaaagaaagaagaggaaaacaacctatggaaaattctccttacaaagaagctacttcatagtaagagccctttcactttaggctcgaccttgatgataaccatgacaaatcctctctgaaataatgtttccaaacatgaagagtagaccattgtaaaaaaaacagtgctatttcggagctcccaaatggccaagcaggtagttataaccagttctctgaagatacggcttccaaagctatttctggcttccataatcatatcaagggattgaagattttaatttccagacaatgtggacggaggcccaggacagctgactgaacattcaagaacagctggtctctccacacctggagctccagagaacacaattatagtcatccaggcgtttattctttcctctaagcaagctcctggtgtataatctatctctggttagaagctacaagagcctatgttcccaaaaaacacaagaattccaaagccacttgaagagacatgatgccagcaaagagcatgttagctgtgtgcaactgcatgtgtgtgtagtttcttggaactgaaagtgccataaccccatatttttcccacttgtcttctgaggagggatcctgttccctgtcatgaaatagggcttgaacctcagctagatgtttcagagtttaaagaggagggaggcaaatggaagtttcttttcaggacttgttcggttagatgtagattggaggagattaaatcactagctagtcaaaaatgaatagaaaagggatttaatccatccatcaatcctctccgatccgtatgcaaccgaacatggccttataggagggctgtccaagatagtttcttactaagcagcaatttgtgtttcccggtaaaggagaacttaggaaaacttgtttgcaggtggctggagttccaaagcactttccaggataggaaggacataaccttgcctaatgagcagcaggcccagaagcctgtaggaatcagagaggtttaagatgccactgaaactgggctcttggcatggggtggagcaatgttggctcatcaacatgccctcccatattcatcaacgtgacagtcatcatcatcaacactgagcccagaaagtgaagccaattcttctatctcccctttatattctacgagtaaacgaaacaaacacaaacatcatccaaggttacattgatctcttcatgcactttggagttcatagcaaccagacaacagttgctgcaaccgaccaccacagacgcccatctttttttccctttccctttttttttgctaggaacgcattctttttttgaagttttttttttacgaactaggaactaagtaatacaactatacaccctttaactaccacacgccattgtacatgtgtcaaggaacacaaaa

SEQ ID NO: 11183 - DNA, 1500 bp, Zea mays
cgcgaccattttccatctaaattcagtggtttctttcttcaccggatccagtccacgacccaatcgtttcccggaacytcatcaagcccagcctgcacatagagttggttgctgaaaaacaccagattttccgtggatttagtagcgcagtcgcgcagatatgtattatctatttctacctattatacatatacacgtcaggttggtcagtaccgtgacactgtggatggattttttttaatatgtgtatgcttattattgcgtcgagagaccaaaccgacgacgcaatttgaattcaaatcacatacttgttctgtcctacccccaaggaaaaaaaaatagcaggtaaggggaattatctggttaattaagctcgctgcaaactgtagcatccatgcatgtttcgtccctgtacgtacgcacacttctgccacgcgccgtccatgcactgtgtacatcgatcgagtgaaaggccatgctgccgtcaacctttaatttgtgggacaatattcatcaagtgctataacgtcgtcttgtacgtattattatgggattggagaaggagcgagtaatagtattgattagtattattgtcttgccaccttgcatgtacttactcctcaagtactatcggtatcgcgccgaaccagcgcagttcaacacaactgtagctagtaggaaggttcgctgcctcgtttctcgcgctgcaggctgctaatgccgcgcgcatatgcacatttgacacaccacctaattaagattcaaccgcaccacaacatagctagggtgggcaactactttatatatactattattgttgttttagaagagaaatctgtcttgttttttcttctcatgtatgcaatgtctttcttatatatattgttatttccgtctagggactcacgcccccaaccatgtactgtagtaactgtttaagtggaaagataattaatcgatgcaacatagcaacactagctcggtatatagttcatcaagtccgtgttttttttcatctatcacgtctcatctgaaaaaaaaacatgactgcttcagctatatatgtttgtcagatgatgagtactgataaaaaaaaatgcttggatgttcatgttctatagcctgcgcagcgccgcaggcagccagcgctcccttgcctctgagagtctgagtcgactgaccgtctctgagagacacgcgccgccgcacgacaggccaagtgtgaagcaccgcatgcgcgaatatatcagtcttacgtggtgcgagatctctcgaccaactgctctccttgacttggagacatccacagacgaagcaacaacgacgggtgaataaattacaacacttcctcctctcgtaacagagctcttaaatgttgccatgcacgaaacatccgtccctataaatataggggaccgtaccgtacccctggaccgcacatacctcctgcacccccgacatccatcgatcgatcgatcgagctgtagcaacaaggaggag

SEQ ID NO: 11184 - DNA, 286 bp, Zea mays
agagctgcaatccgctggctgctgatctacatctagtcaattcccatgggaggaattgcattggcattggactgtaccgtatctaataggtcacctatatcatttgtgaagatcaggattatccggtctataataactaaacatacaaataaaatgtccaccgaggtttctgttgattctttatgtcattgttgaccccatggctgctgctcaactgctgatgcgcggtctctataatttgtgaaagaagatagtgattaacttacataatgcaatagttaagtac

SEQ ID NO: 11185 - DNA, 1031 bp, Zea mays
tctgtttatacaagcacagatcacgaggaaagcaactatcataatcaattttttgaaacgataactatcataatttatatcgcttggtaattgatcaactttaaagcctaatagttttcacaagggatgtacgtactacgtattcgaattcacgtctaaaagggttgggatcttactaaattccaaatttgagtctgattattcaatatctcgtctgtattcgatctatatctatatccgtaatctcgaaattggatatttaaaacatcgatatctgtttagatcttctccaacacaagccgataatatccatattatctgattcacgagtgaaagtatgaaatcaaatatgggagagtaatattcgtgtagattcgatcgacaccctggttccctagttcttaccggtgctcgaggcctcgagcgcacaggccagccacatggcgtcatccagggtcgccggttgccgcagctccacgtcggtgagcagcggatcgcggagaccggcggtaaagaaggccacctgcagcggctccgtcacgccgtcgcatctgtccagcagcctcaggaactcgtcccggtactccgcgacggagccagtgtgccgcagccggaggagctcgcggagcgcgtacccgctcgtcggggcgccgaagcggcgacgcaccgactcggcgagctgcggccaggtagggacgccgcggttgtgcttgagcaaggagtaccagatctgcgccgcgccggtcatgtggaaggccgcgaggcacaccttgtcgtcgtcctcggtccgctgcaggctgaagaacagctcgaagcggtggagccatatggcggggtcgtccgtgccgtcgtactccggtaaacgcagctcgagtactccggggaacgcggcctgcttcccagcctcgacggcatcttggaggcgccgttgatcgagcttgacggtgcagagctcgcgctcgaccgtcgtcatcttggtctcgagcgatgtcagcttgtcgacgacgtcggtgagcagcttctggacgtcg

SEQ ID NO: 11186 - DNA, 1477 bp, Zea mays
acccctgcgccgcgcgcctcgcaggccaaggtgagcagagcggcgattccactctggagccacggcaggggacgacgactttttggtccagggcgcctggagccacggcaggggcagcgtcgtgcgcctccacgacgaccaccagcggctcgtcccgagggccacgacaggagcagctgcgccgcacgcctcgcaggccaaggtgagcagagcggcgattccactctggagccacggcaggggacggcgaccgcgtgacccatggcgcctggagccacggcaggggcagcgccgtgcgcctccacgacgaccaccagcggcggcgatgtctaccgggctccgggcgaggagcagccgcgtggccgagggcgtttggagccacggcaggggcagcgccgcgcgcctccacggcgaccaccagcggcggcggtgtctatcgggctccgggcgaggagcatccgcgtggccgagggcgtctggagccacggcaggggcagcgccgcgtgcctccctttttgcgatggattctgttgttcgattggggattttgggatgtggcgtgtggggcccaactgcaggtgacggcaaacggtaactgctgacggtgagaggtttagtgatgcgttgctccgaatacaagggtagaactgaggaattttcattgctaaggtgaaatctgaggttgtgtgccatgcaggggtgcggcatgtaattctccctatattataataagtgagaaaatattttttgcatatacgatctgaacagttcgcagcaataaatgtagcagcaacacatgatatatatgtcgtctgtagttaaagctggaagtcataaaatcttatcaccagtcgccactgatgattgagtgattgagtcaactgttagtagctaaactagggggactagttttctgcctacctatgtgctgaagaataaaacggtggtatggtatgggtatggccatccacacgtgtgaccttagtgacgtacggtatggactgcaggacaaatttaatggccgacctgacttgcattggattacatgcgaatattggtctgagaagtggctctctttaatgaaaactatgggcactttgttaacgcgacttggatctgtatgtgatcagcttgtgtatatactatatggtaggccgttgctgataactcaccttcctggcttcctagcttgatctgagccattgaaggatgctgaatttttttgtaataaataacttgaaaattagactatatctcttagatatgaaacatatatatgatctggtatctttgactatatcattagagattcattgtttgatttcacaccaaaacaagctattaaattaattgaaaccaggacaaagagattcaccaacaggagtataaataccgggccttgtgatttgccattcttcccatccagaaaagccagggtccactgctcctctcgtactcaacaaccctcacacccccc

SEQ ID NO: 11187 - DNA, 228 bp, Zea mays
ctcttctctatcaggtgaggattgttgtcagtgtgaacttgcttttgctcacgagcattcaaggactgacagtgcatgttgcatctatgccacgatgttggagattttaatcgatataataactgctaactaatactctctttgtctctgtcccaatttataattcgtttgacctttttacatcaagtttgattggctcgtattattgcatcggccgtatgcatactc

SEQ ID NO: 11188 - DNA, 459 bp, Zea mays
ggtatatacaatggccactcggtcatgtgcttcgagctaggctgtacctgtacgtgctgctatgatttgatgcgtccgcatgtgcttcgcggtgcaacttgcgttgttcctaaatcatgcagcattycgcttcgttgacttccacagcatttcgcttcgttgacttccacaataggctgtacctgtacgtgctgctattattcatctgggactggcatatagtacgttcagattcttcatgttttggcctgatcaggtgtatttttcaccggatctcagtacccgtttggcctgatcaggctatggcgatatgcagacgatgttcaactttactaatctctctctctttttttctgtccaaactgtattattgcatccgtttgtgaatgcacgaattcatttgcaaggaggaacaaaactgtgatcaaagaacaaagaatcaaagagaacgaccgacct

SEQ ID NO: 11189 - DNA, 1500 bp, Zea mays
ggctattgtataattacatatatcatatttattaacattatagttgtagttatatatgtattgactccctaaagaaaaatcctggctagccctatgagcaacagtgtgcacgcatatatatatatatatatatatatatatatatatatatagtttatatattaagagccctgggcttccattaatgcagggagtccccgccaggtctagttgtgccgggcgcgggtcgacgtggcaggtggtccgagtaccgcgcacatgcaccgattgaaggtgggtcgtacgtgcgcaccctctattaccatttatgcatccgtttcattcaaattacgtatgcataaacacgtaaatgacacggtgagtgcgtatgctccgcgcgggttttccggcctcgtggtcacgacccgcgttgtagttggccgcgtttatacttgcatattatgactccaaccgtttcataaattgacacgtcgatgcggcttggtcggtgtggtgtagtatttgggatttatgattgtatacttcgatgttaacaactacatatcattttgggatttattatattacgcaatttggcgtgggtcttgattaattattttttgtaaactgtttacgatattttgcacagctatttatgcttcttatgatcacgcagttaccaaaccttcaccctgactgtgcgctgactagtggacccacagtccctcgccgctcccccgcgggccgaccgagctaatatggtcaacgaatcacacacaacagacccctttcaattaattcagctcgggtccacccaaaccctaaaataatcagttcctccccgtcgccgtcattcgctcctgcgatcgccatcgacgaccgcccccacctcttccaccgccgtaatctccgcggttcatcgattcaccgccgtcgttctccttccctggttcgtttcccctctcattctttcaagttccccccattcttttacatagttcagtcgctaatgtccatcaggttcgccccgccccttctacatcccttcaattgattcgaaattaattgaatcacctcattatatgtagtatccgataatgccttccaattttttcaattgcatatttgttacattctgttcatttttatataggtactgagtgttgtttataaacataatatattttttttacaatagcaatcaatagattagtgatgttattgtactgtgttattattgttgtttctgatagttatactacatatacttttatgaattacattgcataatttatttatgcacactatgtactgttttatttaaatgtcagttttcacatatctgttgttatgcattccttcttctcatttacgttgtctacatctgttgttatgcacaatacacacactatacataccccatcagtttcataatgttattttttattccattattatgtatggtatagtattatttcctgatgttctttttcatttacttagtttgttctaccccataaa

SEQ ID NO: 11190 - DNA, 1213 bp, Zea mays
caatggcattccaggagctaagtttggaagaaactatgtaaaaatgagcaaatggacttagacagggcaaaaagataaagacatatgcttagagtatttggatagactaagaatatgtttgtttaagggtgcttttggttcagttttttgaatataagttgaactaaaggggtttagcttttttatatctatgttaaaaaacgtagcttttctgtagcacaaatttgaaagtagcctggaatctgcttttgctactttaccaagttcgctatattaataaatatatgtgtaaaatagaaagtaaaataggattaaaaataatttaatgttataataaatgaaataaaaatatttaaaatggaattgtaaaattgttttatttttaaaaaatcaggaacataaatatgaaaacaatttttgattagatatgctgattaagagatatagttaaacaagatgcatatgaacaatatacaatttgtttatatttggcaactcatagcaatttaaaccaacatctttttcataggagacaactcgtagcagctattcttatcacacagctgaaccaaatgcacactaaattatataagtgcttaagggtataagtaaatgaagacaaagagaaaatagcctaaatttggttaaatattgtttctggacacactgaaccgaacctgcttcggttgtgcattagatcgtaatttaatatgtagaaaacttcgaacaacttatacaccagaataaacttttagtgctaatttgggaattctatttttctaaaaaatttgtattttaagaaaaaatgaactatttttttaaggaaatgaaaatcctatgagaaaataaaatttctaaactagcctgtagagaaaatgttttcggacatagaggactttgacactagactatggccctcaaccaattcgcccacgaccctccaaccaataggtacgcgccatgtcacgtaaacccaaacacgtcatctctcaccgcaacgtcccccactggtggggtccaacccactcgcctgtcccacgcggcagagacctggccacgcctcacgcgcttccggccttccgctacatgtcgtctcttttcgtttctcactttctctcttcgttcccaatttgaaggctgcccaacccttgcgtcggtagacggcggccgcggcgaggatagagggttccctgaggaggcagtgatggagacc

SEQ ID NO: 11191 - DNA, 1500 bp, Zea mays
tactgtggtccaaggcttatcatgacaaaaggaaataaatcttgtaatcgaagtatatttgttgtttcaacaagaattaaatatgtgtgcgtgcatgcgtgcgttggtcttgtaccagtttgatatacctgcagctatattcatcagtgtattggtgcatctataaattgtcttattcaggtacttaattaacttatattacatgacttacaggaaaagcttagcttcgtccttcatatattgtggaaatgttgacatcgtactttctaattggaattaattgcaagttttatggtgacatatcaatcgggcatggcaccatcataagtaggaaatcagttcttgtatgcatatatactcttgtagttccaaaataagtaaatttgtcagcttaaaatagtggcatgagataattggctatattaagccaccacagcggaaatttcactagatcgtctgtctaaataagctcttcagacgaactgaaataccagtcgacaccaatttacgtgagtgttggccaaggaagcttttttctgaccagctttttcaaaaatctagctgtgggaagaatctggctgtgtagagaatctgagtattattaagattacgtgcggaggaagataaagttgttcatggaactcaggatctataaagtaagggattactactattgcgacgactcaaccgattatatgttatgttgattttgaatgttttttacccaaacgaattttatagaagctgactgaaaagctcagtgtttggcagtccgcagtagcttttggtggccagaagctgcgaaaagccgaaacaaacagaggctatatagtgccaccaaacacgaaaacctggcatccgtaatttctttattccttctagtctagacaaagcataagggcaatactagtagtctacttttccaagagccaatggatactccgatcccatcgctcctggacaaattaattttaagcgctgttttaggttaaatttctaaaagtttgactggccttaataaaagagcattatgtcgtaaattactgtcactaaatacaccataaactatatttttctaataaacttatttgctgtcataatttctaaatgttttttacaaacctgattaaatatagaaaatgatctgaagacagctctagaaattgacggaggaagcgtgtggtgtggcatgcagcacgaggtgaaccaaaaaaaaaagatgttacaaggatgatgccgggtgcgcgtagctaggcacgaccctcctcagcggcctgtctgtcgtgagcacgcttcgcttagcagcatatgccagtaaatattcggaaaaccgccacggccgacctcgccttctgcctcaacgatccgcatctccgatccgcatctccgcttagtatatacatggggattggtagcgagcgattgattacactgggtgaccatcatcatcagtaactaataattactttagattagaaagcaagaatcgagtcgatcgag

SEQ ID NO: 11192 - DNA, 196 bp, Zea mays
gactggtacaaccgtacaggctgctgggccgtgtgaaaagccgggagtagagaagccctcgttcgactaacgtctacttctgtgatttcccccggcggcgttgggcgctggtttaggagacgaaaaggcggcgcgcggcggaaaaccctagcttagctcctctccggcgtcaagtgctctccggtttgagggcgcg

SEQ ID NO: 11193 - DNA, 635 bp, Zea mays
tgtcagccgatcagtgcagaggaaacgtgttgcacgggagtggacgacgagagcaagtgctgctgctgctgcctctctgtcggccagttccttcgcgctttccgttccgttcccctaatcattcaccgacgtgatggggagggggagggcccagcccagcccagatgcctgcctggctcaacggcccagacgtcactacgtgactcatgacatcatcccactctttaccgtccgtccggacacacgaaccgaatccatccatccatggccgacactgccaggtgggctatctcccgtcgcttccagccattgccgtcccctctctctctccataagccagccactccgctcgctgcctcgctctaccgaccaccgtgcgcgcgcggcttccactcgcgccggcctgcctgcctgcctgcggccgcaggcggcttccgttgccgccagggcaccgcccgtgacaccctgatctcccctcacctactcctggattcgatcccatccagcccgtcccgtccctctcccacccttttcagatctgcctgcgagcccccgccacgcacccccatgcccatgcccatgaccccccgacgcgaggccactactgccaatggctccctgccgtgaccgagccc

SEQ ID NO: 11194 - DNA, 1186 bp, Zea mays
cagcaccgtgcgctcgtcctcctccctggcagtcagcacgctcatcgtcctgcgtggcactcgaggcacacgagcatagcagtgggctggtggtttcgacagatagaggatctatatgaaatctccaaatatagcgaatgcatgacaaacgctatattttagcggcctcggtagcggatgctgctggacaccttccgaacgagaggaaacgttaaatataaaggacatgaagtctaagggagaatatacaatgttatttaatatagaggctcttgagttgtttaaatgagtattgggaaaaaaaccgtctctccgtgaaaaaacgtctatgacttgtaacctaagtaacaacagacacatcacttcccattttacgaattcgtcgtctattctatcaatccgatgttgtaaatacgcatttacttctgtatttattaatatactatatttataaatatttcgttgtataataatctcttaactgtttcttttgtttagagaactgttttgatgtatcttcattatacatgccctaatttatatctataccgtgcaaacacctgtattagttgccctgggtacatttttaaaatttttcgtaattttagtcgcagtttatatgctttgcttatgtaaaaaaaagttagaatcactctcgagagacagagagagtataaactaacgcctaccataaatataatttatacctatactgtgcaaacacctgtattagttgccctgggtacaattttttaaatttttagtaattttagtcgcagtttatatgctttgcttccgtacaaaaaaaagttagaatcactctctcgagagacagagagagtataaactaacgcctaccataaatacaaaataaagaaagacaaaaaaagaaaatccctattcctcctcagcataccccttcttccttcgtccccattgatccccttcccccctccactcgtctccaaaatcgccagcgagagccatgccgcctcctcccctgccctcgccgagcctgaccgactgaccccacctcgccactgttctttcccttccacctgggccccacagcgcccccttaccgtcgccaccaaatccccaaatcccggaggcacgaggagggaattcgtcgcctgaccgatcggccgatccactgccgtcggcaccccaatccttcgctgccgcc

SEQ ID NO: 11195 - DNA, 1463 bp, Zea mays
tcaaagggggcatcttatggactcaaaactcatttgcgtgtatgcttaatggaacttttttgtgctagtttacaaaaatatcatgcacaaagcaatgcatctcgtttcattttttttctattaacactgccttgtataagagttttggggcgtgtttggatgaacaccaatgccaatggctgccaagcaaaaaaattgtccattgaccaacagaactaatgctgtttggatggataccgtatattggcctgccccagctcacaaggccaaagcgcagttcaatttgcatccgatgcgtggccaatttggcagccaagatttggccagcaaagcctttggacagggcacagtcacgcagcaatcaaacacgcccttgttttcctcaacatgcaaatatgatttggaacttgcaataaggcacattcactcaaaaaggcatacctcggaacacatggaacacatttgactaaaaacagaaaagtgtatgctggcatggtgatgacaatatacttaaccagaagccaaaaaaatcaactaaagacatacctggaagtgagaactgttaaggcatcgtccaatctgcttgaacagtggcaccatgcaccgctggaactctgcaggctgtgttgcctcgagcacttctttcaagctcccccagaaacaacacctctttctggcagtttgtgactggccagtatttgagcagacccctaatcacagtatctgctaatttgtagtccttctcaacgaactgaacaatacaataggacagctgctgatggtagatcgcaacagatttgggcttatgcagggggatgagagcacgggcaaggaatagcttgtgctcctccttcattggcaaggcaaagccattaatgatgcttccaaggatctcaaggagctcccctatgccattgtggcgctgcgtttcaaagatgaaccggtagaacacattgttgatggccttgcgaatgaatggtcggtgtaccatgaacttgccatagatgcggtggagcacggtcttgaggtactcgcgctcacgcggatcctcggagtcaaagaggtcgaggagacggaggacgaaggcgtggtccacataccgcttggcgaccttggtgtcggtgtcgggcgaaacaacgtatcggagaaggagctcatagacgagctggaggtgtggccaggaggggtcgaggtatggctcctcctcctcgtcgggcgcggcgccggggtcgatcgcggcggcggattcgtgcagcgcgggtggcagcgggcggaagatgttggcagagatggcggcgacgagcgcctcctggacgtggtccgggaggcgcgtgggtgcgttggcgcccgcagcctgagctggagcctgcacgtaatcgacgagctcgaggagagcctggcgtttggcctccttctcccgcgggtgcttgagcgagtccgaaaggtcaaagagcgcggcgacg

SEQ ID NO: 11196 - DNA, 439 bp, Zea mays
ggattaatggtgaaccgaacaaaccctaatgaaagttaaaaatactttcaaactttccagactagtttagaaactcaaatatactttagaattggaggggatcgggagagaaatgaactaatttgctctcgatcgtagaggagagattcgagttctcagaatagccactagcgtgtaactgaattccctcacgtgctttactcacctctctctctcattcactcccctcgcatcttgcctagtctaggctataaaaggacttggaaattgccatccgtctcccactagctggtcatcttctctagatctcctcctcctcctctctatctctctctccccaaccaacaacctgtcgattaagctagctctcagctcatcccggcctcacaaccaaccagttcctgttttagacggttaacaatctacaacaacagttagc

SEQ ID NO: 11197 - DNA, 58 bp, Zea mays
caagtttgactcaagaaagaagaagttcttctccagtaaaagaaagcccatctccaaa

SEQ ID NO: 11198 - DNA, 218 bp, Zea mays
ggaagacagactgagtctgagagagagagagagaagagagagagagagagcacacgcaagacgagcgtcgccttctccgaatcccctccttgccaaacacgagctgcctaaccaaatccgtccacgctgtctcgtcccctcggcatcgcagtctcctacccaaatcgtcctcgtttcctcctccccgaactgacccgctgttgccgacggctagtagg

SEQ ID NO: 11199 - DNA, 513 bp, Zea mays
ctggtcccttctcagtatgccgtctctgatcaagacttgctgctggaaatacctctcaacgcacgacacccagaggcagaacttctctgtcaaccatctcagctgatgagctctataaccagcagctccacctctatgggtggggttgctgaaggagaagggtacctgaagcaaccatagtcttaggtcacatcagcaagcagcttaggaacagccagtagttgcagtttactttaacctcctggatcgtgtcgcctctctgtgccgatcaccaatgggccttaagtgtccttatttacataacaatgtgcttcgtatgccaacttggcgaattgtcggttcagctaatatttgtagcatgcttttggatcggctttctgctggttttctggtacatatggcgcatggagaaagcattaacttatctctgtatggaaaaaaaatatcaccatattgtaggaaaatgaaaaaagaggataatggagagttgtttatgtgatattgttgtttgct

SEQ ID NO: 11200 - DNA, 316 bp, Zea mays
ccaccaaatcagccctaaaatggaaaaatattatgttataggtgctatttttgtgtatacatgatattgcatagtttcaacacattaaggttccacaccaccatcatggtgtcgacggtgaatgctgcgatgctaaagagatccatagcgtgttcgacagtactgtgccgtgtctgccgtccatgttcgatcggacggtgcgaaccgtgtgctccgccacggcagttgctgtaactaactacggcggtcagcgaaaagcgaacattggtaccactaccagttgcagtagggttttagcttaaccgtccaatccccc

SEQ ID NO: 11201 - DNA, 280 bp, Zea mays
acatgctaaattggcctggcccggcagcttatcaacaaaccagcccaactgaactaggcaccatcaggctatgcttgaccaagttccaggcctaatccacatgatgcttgtgccgttgcgcgtactgatcgcaatcgaagaagggccgcgtcgtaaaagctcccacgcaagtacacaacacagtacttcagaaacaggacgcgggctcgacgacacaccgatcaggcgcgccgaagcagcgtccgcagccgacggtcatctcccggcgccggtcgcggcc

SEQ ID NO: 11202 - DNA, 179 bp, Zea mays
ggtaaaaaaaaaaacctcctccgcagtccggagtccggacctagctcatctcgtctgtgttgtcgcgcaacgaatctgactgttctcttgtcacctggtccaggggctactacaagtgcagcactgtgcggggatgcccggcgaggaagcacgtggagcgggccaccgacgacccggcc

SEQ ID NO: 11203 - DNA, 1500 bp, Zea mays
gctgaacgcagaaccgaatcgaagacgatatccgttttgaccttctgaagccccagccgtgtcgacgcgcacagtcgcgaaaaagctaaacatgacacaggaacgataaacaaatccgaatcggacgatgaccgatcgagctggcgtacaatgcgggatatcgcatcaccgctgacagcgcaaaaaaaaaataaagcgaaagcctgtcaacttgtcgacaagtatcgagcgcgcacgcggaagcagaggagatgcgttatcaccgcctgcggttttatgatgataggaaatgacagggcaagccgcgagcgggcgatcaggtccgccggcgacaggaccaaccccacgactcggatcggcgctcccagctgtcaatctgggcgagcgatcggcggggcggattttcgcgcgcggtcgcggatatgactcggcgccgcgtcggacacgacgctgactcggagccgcggcggccgggcgccagccaaagtgggggtaaagcaaaagaaaaggagaactcaaagaaaagaaccacctgcgtgcctcatgccctcatctcgtgctgcgtgcgttgccagtgaccgaacgtgtgtgacggtgtcttccatacacgcggaagcaaaaaaaaagaaccttctccgtggtcatccagaacgtagtggggtggggccggcatgccgcaatggacccttctatactatacctaccctgtttccacctcatccccggcgtcaattgaggtcctgcaacgttgtacgtacgtgtacaactaacttatgagtggcaacgttgattttttctttaagcgcgaacagttaggttggttttgtcccaaaaatattaaggtacatacatccgagtatccgacgaggcgacgactatatcagagccggccttaattagaggcccgtcccgaactgcatgcatacacatgcacgtaacagggttcggtcggtggatatgaatatatacggaccacggcctgcatgcatgcatgcgcgtgtgcgtggatgccactcatggatggcacatgaacacagagtagcagcgggccccttgcacatgctggaggagtgccattacccattaggtagccgtccaactgcaccttggaaatcttcttttatcctccactcctcatggcctcatgggggatgatgactgttccattcaaaagcggcttcggcatcggatagacacccagctttttgatggctgtgaacgtcaaaaaaaaaaatactactacatgtgtatactattgacaggttccccagcttataaaggacaccctcatcttcccatttggagcacggagctcgagcagccagcgacgacaacccacgcgcacaccaaccaacaagccacaccggcccacaggccacagctcaccagctaggctagcaaccacctcgatcgcagaggcagaggccgccggaagctcagccgtgaattcggcaggaaggaaaggaaaaagtcttgggtggtttcaacaagagatagaag

SEQ ID NO: 11204 - DNA, 380 bp, Zea mays
ctcggtacccctgttgggtttatttactccttgtatgaccattagtaaaagggaaaactgacgtttctgcttacctgtttcaggattttccttagtcctggagtaacccggctgtcatttgccttgtgtcgaaaataagtatgctataaagcgttctgtcttgatgggaactgttgggctgtaattgtaaataagttttgacttgcttcatcttgctgtgcaaagtagtaattaataggcacgatcaaagctgggcacagttatcttttccccccatacaaaagtgtgtcctaggactaggaggagagatggatcgaacacgactagagctgtacatagtatactgtttgctctgtatataatcatcacttcctatttga

SEQ ID NO: 11205 - DNA, 301 bp, Zea mays
gtgcgaatcgaggtgcattttactataaaatgctcacctacagctacaagccaacgaacaccgattcgtttccccttggcacctggcgccctgtcgccttcgaaaaacagccgccgccgtcgcccgtcccggatccgacggcccccgctccttcgtctagtatttatactagtgccttgccggcgctgctcctgttgcctctcgcatttgcccacgcccgcagcgcctcgcctcggctgctctacctctatcccgcgacccgcgagatcggaatcgcggcgccccgccgccctcctccaaa

SEQ ID NO: 11206 - DNA, 235 bp, Zea mays
ggtatggcatttagttccacgtcctaaccaaaatgttgtaggaaccaagtgggtcttctgcaacaaataagacgagcatggtgtggtgacaaggaacaaagcccgacttgtggccaagggatatttacaagtcgaaggtttggatttcggtgaaacctatgcacccgtagctaggcttgaatcaattcgcattttacttgcctatgctacttactatggcttcaagctttatcaa

SEQ ID NO: 11207 - DNA, 293 bp, Zea mays
gaatcgccttttttccgtatagaaggcaacaccttttcggcaccaagcatttcctttgcttcttttccaattagaggtcaatgccgtaacgaaagaaggaaagctcgtttgcatccttttttgcgggccatcgcggtgttgataaggaaaaggcgattgccccaccagtcctgtttggatttcctccgttgttttgatttttttgtacgcgcattggttcctccacgcttgctcgctctattgtagtcatttccttccaatttagcggactcaatttctcctgatcgtcaggc

SEQ ID NO: 11208 - DNA, 1500 bp, Zea mays
tggtgaagtctcaaggtttcaaccgaagttgtcgaggggacgcggctttrgccgagtgagcgaaatcttgccatgttttactggacctgaagtttgtgacggtttgagtagagttgtttttaattgcctttttggcccttacacattacatagcgggaatggtagctgaaatgcgtcggctgctggttcgcgcacggcgacttgttcgtcgtggtgggtgccaaacgtgccggccggcgatcgcagtaaaagcgagtgataagagagccgagcgtcggttgctccgtccgctgatttggcagcttgatgcctgcacggggactctgagccgcattcgccactggtacggtgttgcactactcgtctgagccagccggcaggcggcctcctctccccaaaccgtgtgtctccagctacatcaaccaataaataaaatcggcgcgtgttgcacgtacaacaataacaagatgccgtatggcacctctgagctctatcttgcgttgtcaactctttataattacattggatatttgacggttgttaggcgcaacttgcttaacctctataactattagcgtaaaactacttacaatttagcgtaaaccactgttgtcgacgttatagtggattagcgggcaaaggatccactgtttcggacgtaagaaacgtgcatgatttggggtagttgccgtttatctcacttcgcacgggccattcattttttcacgtaaaactggtacaaaagaaaaattaagttgtgtataactctatatctattagcgtacaactgcgtacaacttagcgtaaaccactgtcgacgttatagcggattagtgggcaaaggatccactatttgacagcataaacattttcttttgcatataaaaactaacaatcaaattataggtagaattgattcagtaccgagcatgggataataaggcttgtccttatccattaaccaatccatttgaggccataatttgctgcggttccgaaggcatcctctgaccccctccagtcagtagtcttcactctccagtcaaccatgagataaagattaacccctccggtacttcgttttttacgcagtgtaatccaccaagccagcctaaagattaacctaaccatgagataaagattaagccctccggtactccactactccgtagtctccagtccatccgccaagccagcctaatccacacgccacgccaccccaccggggttaaccagcggcggcccccactgggccccacagccgaccgagtgtccgagtccgacctcgacccgccggatccgtccgttagattcaacgctgcaaacatcaactccccgcggaaataaataggcaccccgcctccccgttctcgtcctctgcctccgcctgccttgccgccgcccaagtctcgtccgtcgtcgtcgctccgctgccagtcagccgcatctccagcctccagcaggcagagcacccccgctctcgtctccggagccttccgg

SEQ ID NO: 11209 - DNA, 420 bp, Zea mays
gatgagaaagaagaaggaagaagaatagagaaaaaaaatgagccctcactctattgaagaaggcggaggttagagaaggaagaagagagaaaaataaacccctactagcttgtttttgtcttcaccactggtcacaagaaaattagtctccactacctgttacatccctcctatggtcattttttgccattcgaaagattgatacaggcagcgttaccagctcaataaaattgtgacgtgtacgcgcgaaggttcatataaggtacatatgcactatttgtgactatgagtatattgtattattatggaacgggttacttgtatcatgcgatacataaactttttatcccaacgaacaaaccggaatagctattgaaataggtatcctagcgcttcacagggtacaacggttgtgtgaga

SEQ ID NO: 11210 - DNA, 1500 bp, Zea mays
gtcgtcgcggtctaggtaactttcttcaataacataccgactaaaaaaggggctcagacggcacagctgaaacctgaaagcgacggccagacagacgaccagatgggtcgaaagatgcttcaggatagcattggccacttgcattttttgacggcaatagttcttccgcgagctgctggacgcaggatgcgcacgcatgggagggaggtagggagctagccgatggtggatacgggataccagtctggcagtctactgtctatcacataatcacaaagcacctgtagtttgtgaaaagatcagtggcctttctgcaaaaggcggcgcttcctgctttatattttgccttcccccctcccgttctcccgtctcgcactctcgctctcgcatcaccaacaacttgcccgcaaattccttccacagcgggtcacctcgcttcaccccgttaatctccccggcgaagaaggtaaccaccaccattctccccgtaactttgcattacaaattcctaaccactccagtccgccactagtattccgtgcccaggcgattcctcgtgcccccctgcgttagtttagttaccccttctcgttctgatctgggggtgttttttctattggacgacctcctcccgcagtcccgtttgtggggcaaatcatcgagtttccaggccagaacgatttgttttcgttactggtagggtttctgattagtgcgagaggctaagaatcccagtcctctgttcgctgaatcgagtttgacattatgatatgtgcgtagccattggtacctcacatcgctgcctcatgctttcttttgcgtttgcactttgctgtgatcgggtgagttatcagactacagtgtctcgttgattccagtatttgggccgacaactgggttccagttggatgtaccaaatgtgcgcgttcgctgcacctcacactctggtttctgggagccatagatctaggctatcggtaaagacgcaaattgtcaaaccgtgcagcctcttgcgtttgcacactgggtgctgattctgtaaacagtcccaagtttgttagccctcacgtgttctttctgtttctgagcaaatcggtacaggttacctttctaccattagagtctttttttttggctgcagttggacatctttgagctaaatttccttcagatctgggtccaatacccaagttagtttcctgggtagagaaaagccagggcccaacgtttacttctgttcgattcagctattaattttaaatctagaactagcaactgccttacttttcagttttacattattatgctctgaaaactgtgagcccaaagatgtagaatgcaatcattttagttatgtattgaaacacagaactttgcattgttattgttttcttacaaggctacaagttgtgttatttgttcaatcaactttattttgattgaacattgaaccaatttcttttttttttggtatgtagcgcagtacttggcacaccagca

SEQ ID NO: 11211 - DNA, 203 bp, Zea mays; identical to SEQ ID NO: 1029

SEQ ID NO: 11212 - DNA, 191 bp, Zea mays
atggagttgtgccgagttaagactcttcggcaagcaaaagacgacgacaggctttcacaaagaagtttttttccgtcatacatgtagggtctcacacggattcagcataggattttccaatagtatgctgaagcttggcgacaggttttgttagtgttttgtgttgtgtttggaaaccgcagaggtatgct

SEQ ID NO: 11213 - DNA, 1109 bp, Zea mays
ttatgcacgaaagattttgcattggtgtagcctgatcagcttcaaacactcaaatctgatgtagggcttgttcgttttaactctaatccacrtggattggttggttttgagttggtttaaatccataacaaatcataattcatattaattcatttcaatacacttcgatccacatraaattgaaataactgaacaagacgtagtgagatagcatccctttctgcactaccaggttctaactaggatttatattttaggtaaacaaacaaactctgttgcatggacagtagtcgggcaaccaaagcccctaaccaaacacacttttaagtttargggtcgtttgacagagctttcatagcttcgctcctaacgagaatcactcctgccgagctaaacaataaaaatctgaattgcttcatggtgggagtggagtgaatctaatctctaatttgtactagaaagtaggagtcaaaaaaacatgcttcccatcactcccaatctgctcttcactctttaacctctcatgaatcacttcacagcctatttgccaaatatttttcgtcaaatagattcacttccggtagagaatcaccctattaaagaatcaactctcagagctagacaatcatgagctttagggctcatttggtagaactgcactctatgattttatagctctgagagctgattctctaatagagtgattctgagtgcttctttattggaagtgaatctatttgacgaaaatcatttggtaaataggcagtgaagtgatttctgatgggtcagagagtagggagtaggctgagagtggtgggaaacagattttttggctcccactttttagtacaaaatagagattagattcactccatttacgccatggagcagttcagatttttattatttagctcgacggaactgtgaactgtgaaatcactcttgctcggctggagctggcgtcgaacgcgactacacgagctgggytcgctcgaagtcgactcgttgacagccgtcacccctgctgtcatttcgtcgagcatctcgccagcatcgcgaccgccgggcgccggcttcctccgcatcgcgtcggttgattcccagcgagg

SEQ ID NO: 11214 - DNA, 1317 bp, Zea mays
ttcgcttttgcttcctgtagcatgttagattgatctgtaggagtaattattaaattaatgatgacggtgagtgtaatttttcttgccaatcgatgtcatatagctaaatggcaacatgcacattacatataatcagttgttgcatcattcaatcattgcacactgggctcttcaaaataattttagaacatagtcgcttgaataatgtgtgagtctatctctaattttgtcattctgcaagtctaaatttgtgagtctataagactgaaatgcataaaagatgatgttgaagaatttttatgtttagcttactgaacctgatcctgatgttgtttgtcaactgatgtctcaaattagttgtaagaataattgaacaagagcagctaacgtgattcattagtatttttcaattgtttgccagatgaataacgaagcacttttaggtaccaatcttagctaggaaggcacttcattgttcactcattctgtaggtcttttaccgaaagaaataaatatgtatgttgaatttgtacttatcttgtatacattatgtttttgacatactaaatttggcatatttcaagggaactgtgttgttgtattcatatactatttctagtgtgtggtgtattcgtatactccatttatcctaatgcatgagcgtaggtgtcctacaaccaggttgtgggaaaatactaacaggactgatgcaaatatggactactacatgctctgggcttttttagctggtccacttttcattttagttttctatttggggaactgctggagtaaaatcttagcctgccgctaataagtttttgtttgccgctaataatcagttttgggggaaaattttttagtatccttttggagatgctcttataatcttttaatgataaaatgtctcctttttatctctctctttccgccacccgtaaacctcctatccgccgttgctaatccttccacactcctcccccgcaaccacgggatctctcactgtcccaccccactccctcctccatttggcagtggcacatctatataggcacccggaatccccactcccccacgacgccgtccccgtccccgtcccgacgaattggaataggagaagcaaaaggtaagatcttcccacgcctctcgatccacgatttcggttgatttttgtggcgccggccgcgggggatctccttttcaatgccgctcctgttttctttggttactaggagattctctcatacctgtagctagtgcttgccgctctgcatcctaaccccacggaactgccgttcgtttcccacgaatcagatg

SEQ ID NO: 11215 - DNA, 1500 bp, Zea mays
aacatcctcagcaggtatctattttaatggtaatgttgctggccattggaaatggaattgtcaatttcataacttggtgacagcctacctataaataagcacatcactgacatggtgagcttataccaaaatgattactctagctagttcaggtttatatattgttttcttcttgatgggatctactaactacagctgatgtcaaacaattaaacgtggaaaacagaataaaaacacatgtagacctagttccgaggaagtggaatcgaagatactctaatttcttattcttgcttatatatataattaatataatggaccacaataacttcaacaccctaaagatgcgcccgatgttgggcagagtatttagggcctttgttcatacgaaaatagttaacaatgcctatagagagttgttacatgttctgaattatatctcagtagtgaaaataaaactaggtcggcctcattgtgccaacatgtgatatatatcaacttttagaacggtctttaagtcgaactatttaagtttgaaagtttatggaccaacatctatgacatcaaagcatatacactataaaatatttttttggagtatttaatggtactctagttttgttttataaatatgtgtctccatttctatagatttagtaaaactttttaactttggggaaatttagaagttgattgattatgttgggtgttgtataagcttaacattttttttcttgctaacgctaaataagaatatgtatgtataatagtgtttttaggacatgagatgatcaaaaattaaaacgaacagtaagaccaaggtttgggaaaaacaaaacaaacaaacacatatgagatcagttaataaacattcagaagattccatctacacagtttagccgcatgataaactataactggaaagtcaacacagctcaggctagcttccaaatggtgcaagaacacctactcatcttgcagtacaatctctcgtcaacaccgacgccctctctctctctatcaggcgcacactgtcaagcggcacaggcacagaaaacctagaaggcaccttttccaagagcaccccagccccattcttgtcaccccggcctagcttgttcatgtccactgcaagtgcaaggtagggtatgatccgtccaaggaacaccaatttctgagcaaaaacatctactccatctagtcaagacaaatataaaagctactgtgtgcgtcgatctagatagaattaattttatcacctcaatctgaatccatttccattttcaggcacgaagcatccagcgtcaaaaccatcaagttactagaaccctccactcctacccttattacgattctcatgctgttttcagcgaacggcctgaccatgatgagctagggaagaagatcaagagggagtagtcaccggcggagcgcatggcggcggcggcacggaggagctgcagctcgccggcgggggctggtgctgttgcaggggccgcg

SEQ ID NO: 11216 - DNA, 1335 bp, Zea mays
gccttgctggggcgagaggccgcgattcttggcacagagacgcggcgcgacagacggggcagggtatgggcgcgtccggggatgggcagaaccgtgcgtcatcctgttgtggacgcctacactacgttcttaagtagtagtagagatatacattaattcctacattaattcctatgtttttttcctctgtttctgtgttcccatagtcctgcattagtgcattctaaatgggtcttactggttggtcagaacacgatcgaagcagaaacagccgcaccggattagccatagcctaccagttgttgatggtagacccacgcggccatcgggccatgctgaccgtggcagggcacatgatttcgtcgtgcctgcatatgctccttgctccctcttctagtcttcttcattgaattcttcatttccaatttccaatttagaggttgtttgaacgtactagaactaatagttagtgattaaaattagctgaaaacatccaaacaacctagctaataatttaactattaactatttttaataagataatatttaaatgtactagaataaatagttagtggctaaaattagttgaaacatcccaacactctagctaattgtttaactattaactatttttagtaaattagttaatagttagatagttattggttagctagctaattgtgttgccggcgtgcatccatcgtttgcgttgaatagcgatgcaaaagctcaatcttcaaagaaatagggaagaaaatcctgcagagatgtgacccatcgtttgcgtaagcaatgactcgccagcctaatccgaacatggatagcacgcttgatgtctgaccgtggagtggagcactgcagtagctgacctttaagaatggtcccagtggggggcgggtcttcccgtccagcacaaccaagcggttcgcgccggcgaccggcgggaggccaaaacaaggccggcaggccccgtcgccagcggatcctacggtcccatcccaatcgtaaatcgcgcgccgtcccgatcatcctgactcttctgtctctgcctcgtgcgctgtccgtgcccggtttttattgcgcttctattctggtctccaagccggtgacggtgaaccgatcaccacacaccaagccaaccccgcttctattccgcgtggacatatcgacaagacagccagcggcgagaagtcgacgccggcagtctggtgcaacacagcgatccagtaggtaggtcaaaccgaggcggcgacgaagtacgaacagagggcaggacgcagtcagcgcggcgcgcccaggccccgaggccgagcgatctggtgacggcacggcagc

SEQ ID NO: 11217 - DNA, 565 bp, Zea mays
caccactccgattcaacgtcgccccttccccttcctatacctcttgctggttcttagctaggcgacggggacacctagctgtttttgggcacctggacgtctaggcatcgcctttaaaacattgcaaataaccgcactatcaaaatatatgtccatgtgaactatagtttgtaatggagggaatagtttcgaataatactccaagtcttctgtcataaatataagtctttgaaggagtttctatttcagctagatggtagatatgttaagagatagatgctgttggagttggacttcctagtcatgttatactgccttgcgttgttggttagaagttcgaacattttcggtaattcattatccttctttgatcgctaacataaatctatggtgcttgaacatttgtgggattttcttcaattgtgttgatcatggtagagtagctcctgatgtaggtttttatgtaacttgttacctatatgatgtttcttccaccttgtttgggctgtccattcagtgctaaccattgcttgttgcctttgccttctaggagatacccaagaca

SEQ ID NO: 11218 - DNA, 1500 bp, Zea mays
ctgtcttcgctatcttcctttgagctggtgaatccacaggtttggttggacatgtgatactgatgtgctagctagctactagtttatccacacaacaaacacggcggcagctgctttttaggtcgacagattttacgtgcagatgaaaaccacttgccacgcaagtaaaatctcagtgttgctagctagatttgatagatccgtttatttcactccgccgactccagccgtcactggaaaaagttaaccggccggttgcagatggggttcatgccaataattcggaggttgataggtatggacactactacctagccagctatagtaatagcagcagagacattttgatccatatatttttccagctaaaattgtactccctcctccactcacgaggtcacgaataagcaaaagagacattttgtttagacgtctcagcacgatatctccaaattacaattttgaccgagtatgtagcatcttttttactaaataaacatagtaaaagtactgtctttgtgtagatctactaactccgagttaaaatatacttgcatctttgcaaaataatatccatatagcataacaaaaaaacataacttgttcgtcggctagtagcatatgatctgagctcagattactttgctctaactacggccaaatttgcttgtttccgcttatagcaaacgtggttataatcggcataccgggcccaattggaccatacctgattgatctactattcgtcaaatccaactgtttttttttgcataaaagaatccaactaattcaaaaatgcttgcttgataaattataggcatatcattcgtctaataagctaagataagaaaataagcattttcatgaacaaagcctctcttttcatggctttgtcgtgggcttgtcgccatccaacattcgaacgaggctgtaagagcccaaaggaaggatgtgacaaaaacaatcagagatgggctggtggtagttgtgtggggacattgttgtttaaatgaaccaatttaaaataagccaaggattgcgataaaataaaatgttgtatgcgttggattggaagtgcccacattgtcttttccatgacctatctagagtaactgctagcagaaactaggatgcttaatttagcttccgacttctatctagactcactaaagaaagtaaaaatacaagcagatttgtccataaatttacagataaattttataatgaaatcttatacggattcgcgaacaaagtcttctctccgtagtagtataaacaagacgcttatgctacatgcctacatgttcgaattccagtccaaaggtatgggcctcgactatttttgccaatcaggcccatgttgttctcgtgggcttaattaagcaataggcctagctgcgcccgcaaaacttagcaatccgtacattccgctcatattcctcaccggtgaccttcctcacctgcgtcagacagagaaagccgagattagcggcggcggcg

SEQ ID NO: 11219 - DNA, 66 bp, Zea mays
ctgacccgtttcaagcccggcgcttcaagcgccgggctttttcattttttcaggcggtgcaagcga

SEQ ID NO: 11220 - DNA, 225 bp, Zea mays
ctgctaaccaatcggcaggttatcctaagcatcaattcctacaccttcaacaacctatgttttcctttttaggagcagtgcaatctcaatccgctgttgcagcagcatatactacagcaagggacccaacatcatatggttagatcctgatgctcaaaatatccagtccgtgctcaacccaaatgctattcagcagcagtctccaacaactccagcagatgcagc

SEQ ID NO: 11221 - DNA, 510 bp, Zea mays
ctgctaaccaatcggcaggttatcctaagcatcaattcctacaccttcaacaacctatgttttcctttttaggagcagtgcaatctcaatccgctgttgcagcagcatatactacagcaagggacccaacatcatatggttagatcctgatgctcaaaatatccagtccgtgctcaacccaaatgctattcagcagcagtctccaacaactccagcagatgcagcatgctcataatgaccagaagcagaagattcaaccagatcagccgtatcaagttcctagcagtgcggttctctcgagtccaacatcattaccaagccatttgcgggaaaaatttggcttttctgatcctaatgtcaactcttccagcttcatcagctctagcagcaacgagaatatgctggaatcaaacttccttcagggaagctcaaaatctgtggatttgtctagattcaaccaacttgtagttagcgagcatcagcatcaacaggccatggaagcaaaagttt

SEQ ID NO: 11222 - DNA, 1144 bp, Zea mays
aaaaaacctaagtataaatggatatttgggccacgacccgggccatgacccaggtggcccgagacccaaatccgcccctgtatgtaagtgataatccgaattgctagaacaaatttaatattttgaaatagatatgtataaaatttgatgttgatatttttatgttatcaagcacattattataaataagaatattttttttgcataaattgttgtatgcattatttgctccatacaacaaaaaattttaaaaaccaaatttgtatccgaattcataccgaattttaaatctatcatttaagaaattatataataattttgtgaattttcttttatgratttttacatgtttaatgcttaaaaacaagaatataatattgcatattacgatcaaagtaaaagacacaaaatcggtatctaaatagttatcgttttcatcctgtccgcagccaccgtggcctcgtcacgggagcctaggccctagaggcagggcgttggcgaggtcgagcgagtccgcgaggcgggcggccgtggtggcgttgacgaggggggagtcggagtcggagtcggagtcggagtccagtttgttatgcaacaccgtcgcgacgcacaagactccgatctcacggaagaaatttccaccccgtttttttgggaatccatactgaacctcggatccatgatcaagggatgaaaattatccatgatgacgtcatagcatggttgtgttgcgcagatatctccggccgtttggaaggagaaggcctattaaaggcccaactatacacaggccgcctatataaaaggagagaactaaccctaaactcccaaccttcgcctctcctcccgttgtcagccgccgtgcctgttctctctgcctttctaaaagtgcggcgactggttgggctgccgccgactgccggggccttcgccgacctcttcgccggcgaagaggtcccatcaggtattgccaaaatgagttcccaaactctaatctcaaactatttggctgtttgatcgatgcctgttagcttctaagttttttgcaaaaaaatatcgggtgtacatgcctttgctagatcccaccctaactgttggtgtggtgcaggagaaggagtagatcgtcgacccagaaccctcgctg

SEQ ID NO: 11223 - DNA, 1312 bp, Zea mays
gcccaccccgagacgcatcaccattcatcagaaccgccaacttactccgtaacacgagagccaactatacccggactgtcgctgctcgctagcattggcatttcggcagggacactaggatcaaagaaaagaggacaccactctgcaaaatcagaaacctttgaacggcgcaaccaatctaacccagcccaaaccagaaacagaaaccatgcatatgctaagactgggtaagcaggacgggcagcgatagaagaacgtaccctgagagcggggccgccgccggggcttgccgggctccctgtagatcggccgcctctccgccatggacggacgctgcggacctctcctctcctccggtcctcccacggcccaacccctaggcggaacacgagagaaaaggcgcccagactccctcccctccactccagcgcacccgcggacgcaactcacagagcgacccaaaaggcgcaccgcgcagactgccgagcaccagaaaacggcgcgcccggttaaagtcggagggaagtgggaacggggaacgcaacgagtcaggcgagcggcgaaaggtccgcgggagagaggggtggaggcggtttgccggtttttggtggcgtcgttggtttcactcgcggccagcacgttttttggcgctaggattttctccatgtgtttattcaattattccgtccgtctctgtttgaggcgacgagatcgtctgcggctacttgagaaagtaactgcagtcttgctcacaccgccacacggctacaggggttgtgttttccctttttcggagcggccactacagcctacaggggtacagtgtgattctgtacactcatgaaatgtgtgagttcgtgggcccagattagccgccaaactctcggcttaattaggcccgttagtgtaaggaccagttacacgggcaagtgcgaaatggtgtcgttcgtgcacacagcatttcatgtgcgaactcgtcaaccgttaaatgtcacgaaatttgtggtaaggatatgtagttatacaaacaacaaaaaaatccagaaaaacctctgcaacaagagcatttaaaaactatatatattgataatatatgcagtattgcattgtatagtaacgtgacgttggttgatgctttaagatgcactcatttgtgcaaataatgtcaccaacaatcgccgacccaacctttcgataaaccctactggttactagatgcgagtaataatctcccaaatcctaatagttcgtgcacaataatgcagatcgacgtcgatacgagaccattaaaaacttttttttacaaaaaaaa

SEQ ID NO: 11224 - DNA, 299 bp, Zea mays
tttctggctgcgggggtggctgtgggcgagagagagagagaggcaaatgtttgtattggagttggaggccagctagctggtaatcccgcacgacattcccttctatacgtaggcagccagttgaggagcatctggtcctggatttcggtgaggtgatcttgcgtgccttcatgatggatggaggccgagcagaggatgataagagcgcacaaattccatgctgcgtaagattggaatgtcccccagcacgttcaacatagctgtcacctgtgtagctgtgtttatctaggccatttgtg

SEQ ID NO: 11225 - DNA, 564 bp, Zea mays
caagaaagagttggaaattggtcccaaaagtcatgcatgtgaatagactattgactctcgcaatttagttttttattatatatgtttttgcttcatttgaggctatggttcttaagccccgtttagtttggggtgactaaactttagttctttagtcaccaagagataactaaaacggacaaaaatatgatttttaccttatttgtcctctccactttctttttacagcaaacattaactaattaatagagataatacaatcattattttacagtaattaatgacttttagtctgatttagtcactggaacaaaacggggtactttagcgactaaactaaagtttagtttagtgactaaaggaaccaaacagggctatatattcccttgctctcctcggagttctcaagtgaagcatagaatactcatcttgtgtttcagaaacataaactaaactactgctcaatcatacatgcaccaccccaatcatacagactacagagtgagtttcagaaacatcaatactcatcttgtgttttcttagttcttacccgagaactcccaa

SEQ ID NO: 11226 - DNA, 552 bp, Zea mays
tctgttaaacattcaaagtgattattttagtgaaattagctagataataaatagctagctaagtagctaactagtagctaattactaaaaataattaatagctgaattagatatgatgtttgaatatatttagctaattttaccctctagcgtattcacccctaaaatagtttgcctcctcgtacacctaatacgcgcgcccaagattcatcgcagatccgatggatccggttgctcccccgaggccccgattatcgtcatccgttgatttctcacccgaggtcccgaacagataaactcaactcgactgccgccgccgcaggcacacgggatcctgactgaggtaggttgttgccatttttgttccctcacccagtccgtctcaccacttcaaaaaccctctcctctctcatccgccttcctggcgattgcggcgacgaggtgacgatagagctgcccccgcaaggaaaacggacaagagaggcggaggctgatagggagaggagacggaggaccaagagcggcgtcgatctaaaagcgttggcggcggcc

SEQ ID NO: 11227 - DNA, 642 bp, Zea mays
ctgtagttttttcccattaacaacccaaccaaattgacctcaagccgcaatcaagttggctctgaggctctgcgtcattcgggtagggatgataatagatcttgatccaaatgctcattcacaatttgataggaccctaaattacttctagtttaaaaatgaacataaatagatctaaatgctccttcacaatttgataggactctatattacttctagtttaaaaataaacataaatagagtccggccctaatcagattttatctttaacttttatagtctaaggatttttagtccctacattttattctattttagtctatagattactaaatatagaaactaaaataaacatccctacatttagtttcaatatttggtaattttggaactaaaattgaataaaatgaagggactaaatattagtccttagaaactaaacaccccctaagatgcagagtccactgtcacccctacatttagggtccagtttaaaccgaaaccacactgctaatcggccattagtttagacaaagcgcaagaccaaccagtaaccactccgtggcctcccgggaaaggggcttaactcgagtcgctaatccttttccttgtatctccccgtctccatcctcgctcgccgcc

SEQ ID NO: 11228 - DNA, 165 bp, Zea mays
caacaaaaatcccttttttaaattgcatttccgcttaaaccctcatatctgtcctacataagcccctataaataccctccatgacagtcctaaaacaacaacgcaagcaagctatcaaagcttctcaattaaccactcttgcttacctgcaagcagctcagtcag

SEQ ID NO: 11229 - DNA, 1131 bp, Zea mays
aaagttatttttctttcttccatatttacacaatatagagaataataaataaataattttagtgcaggcaatagaataattagaatttgatttgatgtttgaaatctggaaattaaaaaccataatttgaatttagtttgagtttttgatttggaaataggaaagaaaggggaaataagaaaaagagaagggatataaaacaaaaatataaataatatatatataaataaatatattcagaattaatatccctaacttcacaaaaataagttgaaatgatgagccatagaggtttgaatttaagtttgaattcaaatttaacttggaaatgaagaaaagaaatagaaaatgaatggggaggcaagtcagaggaagaggtggcgtgacgctcagggagaatgtgagtcagaggaggaggccgtgtggcgctcggggtcagggtgggagtcgagtgcgagaggaatcacattcctcgttttagggtaggaaagttttacaggctactgattcaagcctgagaaatagatggaaagttagtttccaattctgtatcttgccaaactcgtgagtccaagaattaaattccaattcagtccaattccactctaacaaacgggccctgagttttttcttctatttgctctatttatgagatactcattttttgttatgtaattatttgtctatttgctataatcaaagttcagtgaatctacgtttgactttagaaacatcaggtgtttggtttatagggaataatttatagtccctctattttattatattttagtatttaaatatggagttttcgtatttagcaacttataaactaaaataaaataaaataaaggaactaaagattagtcactacaaaccaaacacttctacaatataatcttgacttgaatatactttgcctccttccacgaagaaaaattaaaagagaaaggcaggaaaagttcgtgcaacggagtcaaagctccgattcattgcttgtcactcctctgtgactctgtctggtgaccagggggtggtcgtyktgtttactcgtctccctcgttgccagatctcaacctccgccttccctcccatgccctcaaacctacctcctaactagcatccgccgctccg

SEQ ID NO: 11230 - DNA, 1500 bp, Zea mays
tggttcaaagaccaaaaaatgcatttaattgtctctataccactgcatcgatatacgtatgcatagagagagcacgccttatattatgggacaagaataaaaagtggttacgccttatatcttgggacggagggagtatattttattatagtctcttaaaagattctccctctatatacaattaggcctcctttggtcaggctctagtttctctttgagcttaggttccttgcttcttgggaggagtcaaagctgttttgcaattcgtttggtaaaacagtttctcttgtgtttgttttaaatggtgtgtgtaaaatgtaggaggagccggtagaagccacatttttggtgttctggctcccaacacgaaaatagctctggcttttggaaggctcttgatgagaagtcagtttttatatgaccgtttgatagagcttcacgatgagccagaacgagagccgtccaaagaaccatgccaaaggagccctttatattatttttgttgagtgtcttaatgatctcaatygaaaaggtcaaatttataaaggtatctctagcagccttatctatagatgtacagaaagcacgaagcacgatttttagcccagtacgagcacggtccgacccgcttttatacgagcccgggccgggccggcacgaataagcgggtcaggtccagacagtaaactaagcacgatgggctagcccggcatgacccgtttacctctaagcccatcaagcccactttttgcactaaaccgtactaaccggaccgtttaatccgtttttggaccgcttttttcatgcttaccgggccgggctcggacaggggacgagcccgtgggcttagacggccgacccgattttctaaccgtgcctatcgggctgggcccaaaacatgtcgggcttcattagacccgggccgcgggcggtccgtttagcatctttagccttatatatcataccttctatttcaaacttgatccagtaaacagtgcagtttacaatgttttataagctatatgtagtgagtattgtctaatattagagatctcattctagttgagccttgtcatgctattttcgttagcgcgacaaaaacgtactgtaaagacaacgtgagtcacatggcaaggataaaaattttaaggcacaaatagtagcgtgattttgttgtaccgaaaaagcgtttgtccggccgaaaagttagaaataaaaataaaataataggtatggttattttggattaaagattttaaaaaatggtagctctgaggccatcacgtgtggtcttgcatggtctcactctcacctgcgcgagccggccccgagtccaggtgcagcgccggacctcctccgccactgatgagtgacgtgacgcctataaatggcggcacggcagtccgcagagcagagtccatcactcttgttgctccaatataattatcttcctcttcgtcgctcgcacgtccgatccgtcctcacgtaacacgccgatag

SEQ ID NO: 11231 - DNA, 663 bp, Zea mays
tagaaaaataatttaaacaaatactacgtacataattataaatatatatgtaattcctaggtgaggtcttatcataccatacttgtataacctgacataacctcacgcgcctataagtcatgcgacacggcatggtataatcccacctttatcttcacgagtatccaacctgcacagtttgttagtataaaaaaacggcggagttcagattatgagatttatattcctcaacatgtgttttccaatcctgcatttccaaatggcattctccaattgtacttcatgcatgttgcaacttaattgcattattgtatctcccggcatattatttggcaggtactgaagtatgcagagatcaataattattagttatttagttcagtctctcgtctatttctcatcgaccagcaactggtcacgttctccccaacccaaataattcgtccggtaggattcttttttttcccgtcttcctcccacgtacgttctcgcgctcccaagtcccaaccgagtcactataaataccccactcgtggcaacacctggaactcaccaaacaacccctcggtctaagctcgcctctgcctcacagccgccttccgatcgagctaccagtgcgtagctcaaaactcaaaacgagaagcaagaactcagtagcaatat

SEQ ID NO: 11232 - DNA, 1500 bp, Zea mays; identical to SEQ ID NO: 6554

SEQ ID NO: 11233 - DNA, 542 bp, Zea mays
gattttataaagaactagttagagtcagccaaactctcttaaactccctaaaatttgagagctaaggtacaaatctttttttattgctctgaaacaactaaaagtcaactcatgaagtttgaaaaatatttatccatcactattaccggttataaagacaatctagagttgctccacctataactttataacaaatctggtatgccaaacaccctctaataaattcattactcctccacggcaacttcaatctcccgctgcaatatccaccgcaacagagaagaggagtcgacacggtttgtggttttgtgccgtcacattaatgctattcgtgggcccagatgcagacctgacagcctgtgccactgctcaaccgctcggcgttctatgaataaacgaccacgcgcttctctccgctcttccctccccattattactggaacaaaaagaaaaaaaacacgagaaaaatcaaatcaggagacggggattccagagagccccgttcgggtagggaagggaaggagaggcgaagcggaggcgag

SEQ ID NO: 11234 - DNA, 1500 bp, Zea mays
ggattgatgcaagatagagaaggcaaaacaaattaatgatgtaacattgtactctgtttttactatggaagtaaaatagttagggctagtttcagaactctattttccaaaaataaaaaataaactaatttacgttagggctagtttcagaactctattttccaaaaataaaaaataaactaatttacgttagggctagtttgataaaaaatcatttggaaaaataaggtttttaaactaaccttgcattggaaaacctttcggcgaaatatggctgtaggactagaaaagccttaaaatggtggagagtatggcacagcggatgagctcatttggtcggtccacacaaatacagacacaaaactggcaccgtttttaaagagtatagcttctgcatgcaccatccatcccacaaaaacagggtagcctcacagcactgcactctgcggattgcagaggcaggaagcatctccggccgtgaacgatgagctgaaaaagggaagctgggggaaggaagacagagagaatcgtttcccttgaaatcagtttgcttgttttttgcttgtccattagcctggccctttcaccaaccccgtctgcatgaaccgacttggtgactaatagtttttttttgctcgctcatgtagctagctaggagctctactgcaccaccggccatatcgcaccgtagtgtgtgtctctactttggcattggcaattatatatagcgtaaaaaaagcggcatgtgcctgcctgactctacatccccggcctccatggttggttgctcccatgatctgatctgatctgatcatccatgttcgtgaaccagctagaggcgagcgtgtgagaacgacggcccagtagcggtgtttcaggttgcaaactaaaagtctgagcacacaggacaggacaggaagcaggagagcggtgtgtactgtaccgcacaggctatcatgtactggtacactcgtactggatcacgtacctactaatgttacgtacgtacgagcatgaaagcaagtaggggtactctttaattctgaagcctactagtacgtagatgccttttgtacagcttgctgctttggtttggtttcagttcagtgacgcgaaaagtggaacgcaggacgttcagtgtggttaaagagactccagctagctcgagtgcagccagccaggctgtgaatcatgtgggcgtttatttgggcccagggcctctctgttggagcccataactgggcgtgcgcgagcccatgataaagcaagcggacgttccacacagcagcctgcctgcctgcttgacactagagtagtagagcctccctcgtgggctcctggcccaaagcctgcggtactgagtatacgacttcacgacaataatcccctccgcgcaccaaaccgttcgccgtttccccatctggccatctctttccccacccccacccacacgcactccagtcaccgccggcgccaagccgatctccgaccaccgcagcc

SEQ ID NO: 11235 - DNA, 1131 bp, Zea mays
ctgcggatttaattaacctttccattcagcgacataaacgaaatattctggacaacaaaaaaaataaatcagtgacaaagacaaaaagtattaaaaaagccttgatgattttataaatatacttaatattaaaaagtataatttcgaatacattagattattggagttttagagtccaaaatataaatatacttaataaacaaaaagattataattagagtccaaaatataaatatactaggtataaataaacagtgacttgatgattttataaagtactccatacttccatagggtgggttacttatgtgcatggtacttgcgtcacggagtttgaataaacaaaaacaaaaacaaaaaatatctagatgaataaataaatcagtcataaaaacaaaaaaactagataaaaaataaatctggacggacaaattagcgacataaacgaaaaatatggacaacaaaaaaaacaaattagtgacaaagacaaaaaaatattgaacgtccaccatggggcttgaacccacaacctcaaggttaaagaccttgcactctaccaactaaactagacatgttttgttgttacacatccgagctcggcgccatagattttggcgccgagctcggtaccacgttggtgccacgtcgttcaggttgtgctagcgtagcaygtacctcagcgtcataggttatggcgccgagcaaagggtctaaaaataacattaaatttttttaaggtctaaacgtgattttttttttgagaaagtgacaaaatacaaaaaattcgggcacggtggcacggcgccccatccgaccccacgataacattcaacaacatccctactcacatccccgccgtccgttccagatccaacgtcagtaaatatcagcgctcaccctgttaccccgtcacccaatcacggcgtccccgtgcttgctgcctgctgccgcgacagccaccgacgctggctgtctagcagtggctctgctcatgcgcacctacccggctatcccctcacctgagtcgcctcgcgcaattggtgcggactgcggagcaatccccgaatcctccattgattaggcccaagcttcctcctcgggtggcggcggcggcggttgcagctgctggag

SEQ ID NO: 11236 - DNA, 1500 bp, Zea mays
gctccataggctcctctcgatgtgcaacggtgtctggtccacctcgtcagcccttggtgctgcgacctcctccggggacaactctaagggctgtgacagcctactctggtagcacgacctcacgcgctgccatgctggcaatgtctccatcagtgtcgcctaggccaacttggtgtttgaggaccttctttataacagtgtaatacacatttgtatataagttattatggtattatatgttctcgttgcatcgcacgggcacccacctagtatataaatgaagaactagcgggagcagatagtttcacagctcggaggagtttgtaagctctagtatttgccaaaagaactcagagcaccagagctaaccgaaaggttatttctacttgtatatgaggtgtcagccgtatagactatacaagttagtggaaaatgattagggcgaagccaaaggtgttagttagtttcagtaatgaagtggctcctagtcctatagacaagcatccgtaatcatatgtaggctttcattttttttttgctgatttttgccgtcataaactatcaaacacgtcatccgtaattaatatgaacgcggaattggccgaatcgttgtgataggagaaatacgtctcacttcctagattttaaatcctatagacccattcatttttctttacacataactccaacaatgatcagattctcaaagaaaaagttaaatcaaataggcccacatctactctaacactctagctcgaacaatttactatagacgatcccatgctccatacctccaatctcataccgaaaatatgcagacttcttctctagacaaaagacacatcttagaaagtggaaagtggttaccaaaagcagagcaagattttatactgatatggtaaaacacagggtgggaaaaagtactctatctacaactggtagattagaaaggaaaagacggaagaaaagcgcagcaaccagaaaagaacacgaacagaaaaaacttcagaccatgcatgcacagtacaacaaccgaggtgacggtacactaagggggtgtttggttgctcctgctaaagtttagctcgggtcacatcaagcgtttgacttttaaataggagtatgaaatatagacccaaccaacttgactagattcgtctcgtcttttaatcttcagctgacaaattagttttataatccgactacatttaataaccggaacggaggttcaaacattcgatgggacagaggctaaattttagcggggtgtaaccaaacaccccctaagtacagttaagtaggcaagcagcctggcgaaggagactcacacgaggtgggctaatgccgcaacagctaagtcccaacctacgccattaacgtcctctatataagcaagcagcgaacctctgcaaacatggtcatcagcgaagcacaaagcgcagatcgtcgatctagcgagctcggagtcggagcacgcctagacaccagcagaaagaagca

SEQ ID NO: 11237 - DNA, 471 bp, Zea mays
aatatcagcgagaaccctcgttttcttttttgtttagcagggggcacaagagcaagctgcaagcagattacagggccacgaagctcgcccctgctctgctctctatcttattagtccttcaattgggctttcctctgctgcggggttctgttctcgtctgggtttcagacgccagatttggagcagaacacaccggtccttggtttccttgccggctgcaatgttatggcgcttcgggggtatgtagagcctgaattctgtgatgacgggggagttagcggcgtggggagattttttctgtgctttgtcttttcttagctgagaaatctggtgctatttggtgctcgccgacgccgagccggagggcgtcatcgttgctgtgtcctctgtagctggatttgtggtcattggtagagagaagcgttcttcctcggggaatccgtgggaagaagcggtctccggtgcaatccc

SEQ ID NO: 11238 - DNA, 208 bp, Zea mays
atagagatgaataggtttacaatttccacatgtagaaggtaaagatagctgtgacctgtgctcttgatgatttttttttcctaatcatctgtttgactaggttttatcttgtagatggcagctttgtgtaatatagttttctcctgaatctctcactagtcactaatgtatctgctgataagaagtgcaggtgtaaattaacagttta

SEQ ID NO: 11239 - DNA, 801 bp, Zea mays
gacccaaatggtgcagtgaagggaattagagatgaccacaggtcgacaactatacctgcctgctttcttagcacagtacattgatctcctttaccgtgtttgaaaaattaggacctgttctctagtttatagagttagatttgtctttctatgcatactaggaaaatcttgtgccagttgatcctgcattatataagcggtatttgctaatctggacccatttatgatgccttgcagcgtgagctaacgaagaagcaaatagagaaattgaaaaaccaaaaggagacacttgagtccctgtgtcgatcactacaggcagaaaggaaacaaggccgctccgccagtattccagacgccccttctagccaagaagacatgccagcgacaagtcaagaatcttagcatatgtgcttgccaatattccgttggtgtccgttacagcttgccgggacttctgaagcctgagaaatgaatatgttactgatatcttgttttgcttgagtttgcggaagttctggtcccatttaacacatactcagctgtcaacctactcaggcctttggggattgtaactataacctagagttgcattcctctacaagtaactcggtattgttactaaccatataagctatccgttgttccttgttttttgttcgagacaaaggctgttgctggtaaatgttaccaatcatataagctctcagtcgttccttttcttgattttgtttgagacaaaggctgttgcattgtgggtgtgttggttcctctgatcttttgttcccgttttgtccctaatta

SEQ ID NO: 11240 - DNA, 846 bp, Zea mays
aaggaacgacgtgatagacaatacatcaaagaagatggatttgagacctctaagagcggagttgggtcgtgctgggctgtgggcccgtgtaagtagttgggttgggtctagttaggcccatgttattcatattaaaacattgcgccaaaaaagcacaatacatttcacgttgttcggatgggcaagagtttgtagctaatggttacagttacaggactacatgagtgagaagtctacgatgatttcatcaataatctcatctcgaaaaatttgttaactcagttttcgaaggtgctcgtcttgagaattacctagctaatctaagaagaagaaaaaaaacattgttcgggtccaacaggctcactgctttaccaaatcaccaatgtgatcaacgttacatgctctttttcttattcttcttcttcttaaaaaaagtaaaagaaaaaagaaaattaaaataagatctagtggcggtgcagccaacccgcggtcaagagagtaatcatgctgccacgggatgggcgcggcgcgatcgctcgatcggaagcgtgacatgcgtgcgagctagctaggctaaaactaaacgctcctctgaaatccgaaaggcgaggcaggatgagtacgctctgctctgtcatggcccgcgtccagcaaaccccgacgtgtttggtgagttgccatggccatggccatggtcatggcgtgtataaatggcgcgcccggcgatcggctccggcacccgcactcgccgagccaagcaatacacagtagtgagcaatagtaggcagcgcagcaggatacatagcagttagcaccacagcgagcagctgcccgtacgcacgcttg

SEQ ID NO: 11241 - DNA, 1500 bp, Zea mays
cacacaaactgaagatttataccatttactgccaccaaggacttattatctcaccgtttcaacaagtttggtgtagtgctgaaggtactcattgtcactaatgccgcaacggaccagccaacaggttcattttaattttaaaatctttagtgcttattatagctgagctaagatttgtatcatgctattcattttacccctttttggaatataacttgtttattgagacattcataaggcttcaatgaaaacatctgtatatctgcaggttataggtgcttaacattagataattgctcaatggctaaaaatgtgaatacaataattcagggcattttataccattctacactaagcttgtgagtgtttcgaattttcaatgaacattatatttataataattggtcatattacataagcccctccatctggttgctctttgctgatgtaatctgtgcatggtaagtttgaattcttgaattgatgtttttagttgaattatggtcgaatgtcactgcacttgatgcagcaaaaacatagggtcatgtgtacatgttttatatgtacatatgggttttggagaagttccgtctcgctgtcattaccctcccaaaaaaaactaaactgtcgagctaggtgctgcaaaacacgtatgtttatcctgatatgttcgtaccctcacctgaaataaattcttactgttctcagtcttgtatgctatttgtttggagcctaacatctctatctccatgaccacagatgggagacggagtagttgctgggctgttgattggggactgcagtgaccggctgaccgcctccgtgtccatgcctctagaatatgggactactatgatcttaaagatgagacaaggctgctgcatagtgacctggtgttgcttgaagagtacgttgtgtagcgtttttactcataatacagtgatcaagtaattacatagagcacaatgtttacaccctctgtagaatataatgcaaaggttgcaacagctatgaatatagttagacggactgcagctattacataaataggactagcaaatcccagataagttgtttcgaaacattattttccatagggcgccgtctgttctagtatactaatttattatcatcttatttcttacaagttaataatcagtactaatattctaatatataatagaatataattgtttcttataacttggtctgacttgtgatgctcgaagaggagacttatccatatatctagcacctgcgcgcagtgagtacacgtctctccagacgatcctggggcccggcgtcactattgcattcaaagtgtagtggtgtagactggtagctccatgtacctactacgaccacgaccaggaggcacgccaactacatactactagcatcttgtgaacagacagaggtaggagtaggaaccggcgcagcgagactataggcatggacgtggaagcgagccatgagtctccgcccttgcgcagcaagacg

SEQ ID NO: 11242 - DNA, 947 bp, Zea mays
ccattgtaatcaaagcaagaggcaccaattgtgtggtggcccttgcggggaagttttgttcccggttttgatttgagaagagaagctcactcagtcggaaggaccgtttgagagagggaaaggtttgaaagagacccggtctttgtgaccacctcaatggggagtaggtttgcgagaaccgaacytcggtaaaacaaatccttgtgtcacactccttatttgcttaagatttgttttgcaccctctctcgcggactcggttttatttctaacgctaacccggcttgtagttgtgtttatatttgtaaatttcagtttcgccctattcaccccccctctaggcgactatcagtaatcattgtacttagtcatacgtcgataactagtgtttccgtatgaaatggtacaacgcctcgccgctaggtgtttaattcgctatcgtgtacgtagcactatttaggtttgtaatattcctgtctatatgcattcatgtgcataatgcatttcattcaggtacgtgaattaaccacgtgatgcgaaagacgtcccaagtcgaccacaagatgctggaaagcgtaagcttctccaaaaggtgatgctgatggacgaacctgcctgatcaagtgctagaacaaggatgatcgtcaaacggatgtcgtctaacaacactaacctagtgttacccaggcaagccccggtgcatgcaaccccttccttgtgtttttaaattatttttacacactttaagtctagtgaaatgtgcattaggtttataggagttgcttggaaaccctttgatgcattggctaccttgaaatccattccttttatagatacttctggtgaagtatcaaaatatgatttacaaaaaaatgcttagccctgcttataagcagatagagtttgtcctttgcacttatgcctagctcaggtttatcctgaggaagg

SEQ ID NO: 11243 - DNA, 1500 bp, Zea mays
ctagtgtactctaatagaccaacatayttagctcaagtatgtcggtaacccacatagtgttctgacatatttaagcaatgcaagtaagtatgttggggccgtcaagtacttaagtctagggcacccaacatacttacttgcattaagtatgtcggttttaacacaccgacgtacttaaaaccctggcacgtggtagctaccatgggctacctcggctaaccacatgcttcgaataaaattctttacatccgggatgcaaacacactcatttgcagccctcacaaccactagtacggtggcatggggcggaacatcggcgacagtttgaacaaggcgcgcgacgggggtttgaatgagaattcaaagtcggtcgccgcaccagccaacctaaactctagaaattaagaacgtcaactaacttagtcgacgtacttaatataagtatgtagatctcgcgctaaattcttaatattaaacacgtccgttggactaaagtgacgaacttaaaccatttaagaacgtcggtctcgacgtacttaataaagccgacattttctctattttcctgtagcgagggtgcttgaaatatatatattcttcattattgaaggcatatatagtttcattggctgtggtctctggacaattttaccacgggatttgcgttttctataacgtccattcctatatattggtagcgaaagaaacaaaaatcgttagcctttctagaagctattgcactgctatgcattaagaacttgtgttcgctaccaatttaacccctccacacttccacagtgttcttcattataccgtcactgctaccagcttgactgcataattactggagcgcgcgcctaccgacagtttcgtcagtttttggttctgcctcgtcgcctacctctgttggtcagttcattactctggctatatatttctcctggctaaaaacttcgttggccatcacatttaccaagcaactcaagctaaactgcacttcgccgtgtaagacaacgagaaggaacgcaagtagaataataataataataaacagactaacagctcaactytgtctctgcaagctcaccgcacattattttttttgtattaatgtccgctcgacaaatgttcgccgtgcagtcaccgtcgtcgtctggagctggaggcggcgttttccaccggaatatattcggccaccaattgttcgctcagacacatatccacgaaaacgaggaccgcccctttgcgccacactacttcggccgagggaaaaagaagcgcgtttaggtaccaccaccagatccttgttgctggattctttctttgctactagctaggtgtcccttctcctatcagacagactataagggcaggcccgccctcaccgttccgccgccgcctcgaactggaggagcgagcatgtatcccgcaccgaaacacacacgcaaacggcaccaccaccaccaccaccgtccggcgaggtagggaggcagcggcgcc

SEQ ID NO: 11244 - DNA, 409 bp, Zea mays
atcaaagaagaaagtctgtctgggccgtgctttgctttgctctgctcgggtcagttaattaactaccatgcagtagctaaggaaggggctccattgcttgccgtctcctaccacgaatggtcccggattagtacacgtattcggtacccgtttcaagtaccctgtccgttttcatccctaatatgaagatcaaagaagaaagtctgtctgggccgtgctttgctttgctctgctcgggtcagttaattaactaccatgcggtagctaaggaaggggctccattgcttgccgtctcctgccacgaatggtctggtcgctgtcttcttctgaggacctaacccaagacggtaggtaagtgccagcttaaagtctatctaaaggcggaccaccactgtccacctgggcggcg

SEQ ID NO: 11245 - DNA, 276 bp, Zea mays
ccagcaaaagagaagccctcccctcttccccctcttaggaacaggaggtactctgtttcttagttttttttttttttttgggggtggggggtgggggctctcctagtttagggctctgggataggttgttgtacagaaggtatcatctgctgccaatccctttttgttttgtacgcagatcaatctgctgttctatgtgatgatccatgccgtagcttttactgtagcgtaatttcaactgggagcaaatatttaccagggcctgagttgttaaaa

SEQ ID NO: 11246 - DNA, 1117 bp, Zea mays
ctttacaacaatgataatggggagtgagggtgagaatgaaaacccaaatcaagagcacaagaacttgcaacactcaaatgcacaaggcgataagtttcccaaactcaaatcgatcgaatgcggcgtagaaatggattttgaagcctatagaggttgcacctgatgtgtagtaagttggggtgagtcttgtgtcttcgatgtgctgattggggatatttatagttctcaacaaccaacatagccattggagcaaaaggtacaatttatgctctgtcggtggtgcaccagacctcctacagtgacgaactgacgatccagtgcgtcaccgaaccgtgacagtgtggtcatgcaggttaccattgattctattagtcgatcgttggcttctgtgccgtgacgactggtctaggctggaatcatccgtcaatggtgaggccacgttggtgttcaacccgctgggaggctcgatgctccactgcctcgacgcgttccaacaattagaccatggttgattacaaataaataaatatattttttttaaataaaacgttgacgcgtcacggtgaaaactagctctatataatagagacgtactgactatatagcaaatcctttgctataaatattaataatattagttcatattgtaaaatatagatatttattccatgtatcaatatatcaataatacataatggtaggccgacacacgaaaaactcgacaaagcgttaagttttctagttaacatttgaatccctaaatatacatcgcgctttgttttcgcgctattcggactgcgaagaacgaacacgaagtagtatgaacgaaaggagttgagaaagcccagcaggatggtttattttcgtaacataagaaaggagagaatgggcccaaaggcctaaggaacgaagcccgatccgcttatgggatatcgtggccctgcaatcagtgaccgtccagcagatgcgcggacagctgtcggatcagaaaccctagcccgggaggctctcacctattattagaatccacctcgcaccccgcgagcggtgacttccctagggtttagtcgcgccgccgccgccgccgaaacagcacatcgctctctcgatctcagcc

SEQ ID NO: 11247 - DNA, 1179 bp, Zea mays
ccctttgccagttcgaggaccgctgatgtatttaccccttctattctacgttaaaaaaccaaacaactttagggcctgtttggttggactatgacaatgaaaaagctgttgtgaaatgtgagccataaaaaaataatataaaaatcgtttagtgaaatccagtaaaagttattttatatatttgtaaagttcttttatccgagaaccactaaaagcaggtccaaagacgctttcaattttacaccacgagaaagccatcttttaaaaagttgccagttggactaggtcatttggtttagcttttggcttttgaggaataaaagccacattaaaaagtcaaaccaaacacactgtcattctcttagagctcaacttgtgacaatttcacgataatatccactctgttgaaaccacatcttgtttctctaagaagtaatatttttaaattacatcaactagataaaaaataataagtataatgtatactaagtttagttagattaatcttggcatacatttcataatgtttttatttaaagatgagagtattaatactattttctttagagctcactaaacttaaataaatttaacccatacaagaattgttttttaagtggggagggaatatgccatccaaattccacgagggcactgcattttttttaaaaaaagaaaaccatttgttctgaaagaaaaaaaagaggaccaaacaggaggccatcctggtcatttccgttctctgtccaaaagccagcgcaggcccggacaaaagcaaacaaaaactaataaagcggggctggcgggcgcgcgcgcgcgcagccagaggcacacctcccaagccacgtcaccgatccgcgtgctcccccgtccagcaccgcccgatcccgccggcccgagagatccacgccgtccgggcccgcgtccccatctgatcccatcccttctcactctcctcgcgcacacatacactgtcttgctagacacacccgaaaaacaaagggaaaaaatagtaaagaaacggagcgaggctcctcctcgtttcctatctatcctgatccaaatccgccctactcgcttcatatatcctcctgcgaggaaaacaattcattccgcgccgcatctgggaaggtctcgtcttgctcgcctccgtccgtcgccgcaccctgcgtcgtcgcc

SEQ ID NO: 11248 - DNA, 1176 bp, Zea mays
agctttgacctgaattgcgcccatcagtctctgcagcttgtgttgatggtggttaccagccgtgtttaggagtgttgggggtacccctaattacggtacccgacagatcctgacacgtacatggttcgcattcggtttgctttctaaaaccgggtgtgacacataaccagattgagaatcaaacccacactctatgatttttactcgtggtcacgcatgtaaaatgttgatgttgccatccctatacaacaccacgaggaaacaaagcggcatagaaatttaaagcgtcttagtaatttttatggacatgctattaccaaaagataatgtaagctgacttggatagctcttatgcatgcgttttatcccttccatagaactttgtttgttttatttccatgaaaaggttaacttgtaatgttatttgtattgtatatcttgatcttcttctatatttaaatttgtagtagatctctactattataatatgagaataattgtgtgtcctcccctcacgcaggcgaacgctacctctccccttcactctatttaaaaaaaatgcacgccaaatttgttgtctaccattgtactgtgaaactgcttgtgtcacaagaagcttttaaatatatactaataatttaaaagcaaaaaaatataatcatgctttattaaatatttatttaaatataatttatatgatatatataaatcgcagcaacatacaaccaaactaactattatcttttatgtatcttcggtcaaatctagatcgctatagatgtggtggtgtttagcacttgagagcgacaaaaattatagcaacgcactgttttttttaaatatatgtgcaagcaaagaaacccgttgagcggccccagtcgtcattgagtccagcaagagcagatcaacccgaccgctttctccacccccattgcccatttgcccccaaggccccaagcccccaacacggcaacaccgcaccacgaccacggactaccgtctcctctcctttcctctcctgcaactgcaagcgaccacccctccacccccatccacccacccgcccgccgacgcttggatcccctcccttgtttgccgtgtccccgcccaaaccccgtagccgccgccacagcaatcgctgccgccgccgctggaggccgggccgtgggggctgaa

SEQ ID NO: 11249 - DNA, 512 bp, Zea mays
tttgacgcaccttgttttttattggaaacagtgtaacaataaaatggccagcctgctggtagtagtttggggaagaaataaaattgacgcatacctatctctatatatccaggccaatgtcatgcgtgtgcacagatactttccttttgacacttgcgctgacacctacttactgacgacgaaaaggaacgcgacagataatctgaaaagtcacacgtaacattgagagggcaccaatacacgctataaatttcaactatgccggccgtaccaaccatgcatatatatgctatatattatgcctgtgtgattctaatcgctttcatccctttatgatgtatatatatcacttcctgtatatacatcagctagcgccctaggccctataaatacggcaatgcacggctcgagctcacacacaacaaacaagagagagctagctagctagctcgctcgatctgcttaattaagcctctctaagtcatcttgattattatattaacagtgtaaca

SEQ ID NO: 11250 - DNA, 1500 bp, Zea mays
gaagccaagtctacttctaagcaaagtctacttctataatatgacgatgttttctttgtacaacatattctgctgatgagcatgaggataaaagaaacatgatgaacattttttatttttttgaaagaaggaattcaacttcttgcgctctctacgtgaatctatttgcatggtaagttttttatcgaattgtctttcgacaagattttgaaagttgtggaagacttgaaacatgctagatttgttttaaacaagtttatcaaagtgtatttactaaaatcattaataaaattgatttaatacttatttcaaccaataaattgagaggcatgtcacatagagtgaaaaagtttaagaggacaaggtgataatccctccgtccaatttataattcgtttgacttttttttaccaagtttggttggctcatattattcaatttttgtgtgaaaacaaatcaaagacatacttaaagtatattatatgttaaatgatgtcacaataaaaaaaatatggacttttttgaataagatatgtcaaaattgagctaaaaaaggcgaacgaattattagttgaaacacagataatatcatatttttatcttggtatagaagctgatgatgacttttttttacaccggtgtccggtggtagaactaaaagaacacggtatattagagcaaatgaaggatgatatgaatgagtgtgctaggaatcgattgcgggctgcaagagcacgtccaattgcacaatctgaggtcatgtttagtacccatagagctaatggttaatcaactattacattattagttgcgttgagctagctaatgatatgtatagtgaagagacattaaaacggttctccaaacaaaagagacaactaaaaagactctattatataataatagagtgtctataaatatagtctattaataaatagagaagtgaccgtgtctataaatatagtctattaataaatagagaagcgaagtcgtcttgttactaattaggttatgagtcagatacgtctctttacagagaaacgacttcacgatttttttttgcaaatatactttagacatctgaagagcatttatattaaacaccactctacatgttctagtaaactaatttgttagatgtgaccatatgagatagctacgatattagctaagtatgtttataatacatcaactaatttttaatcgtgaagtattagttttagaggtttcccaacagcgaggcagttaccgatcgattaatgctgtggctgtgctgtgtccttggcaaacatttaccagtcagccgttcagtttgctttacctgcctttcgaacgaactctcaattctttcctcccctgaggtggttgcattgcaacatggagatagatgtgcatcagagcgccgccgctgctggtgttggagtatactagtagtatatataaccacactccccgccccatctcgatctccacagccacagcacccggcagccggcagcc

SEQ ID NO: 11251 - DNA, 1500 bp, Zea mays
cttcttcttcgaggtgatttttaactaaacatctaagaatgcgtggagacgatgttgctcctgctgaaatagtactaccagcttctgtcgtagcaatctgtgatgagacacccccagccctccagtcaccacttcttcagtccttgtattaggaaccacttcatcagtatgttactgtcatatagctcgaagctctttaggaaccacttcatcagtagttgcccgtgaactatctcgtgtacatgcaacctatagagcataatggaattaaatagttgtgacctcaccacataagaatctaactaggtatatgctcgtgtgttgctatgataaaatacattaatatacaaaaaatattgtgttttataatattaactccgtagcaacgcacgagcatatacatataacacacacacatgtacataagttatcgtgttattatacggttccgttgcaacgcacgggcactcacctagtatagtatgagggaagcacattcgtgtgttgcagaatgcagactaccagctgtccagccctccctcattcaagacgtgtggggtttgctcctccgatcgagtggcacgcacccgttttttcaggcctaattatggtgcagtgcagtgcagccgctctcctgcctgtcctccccgtggttcgttccctcgccggaccaccgtggggccggtagccgctgcctgcttgctactagatccgatccagcctcgcatcgcatgcccatgccgccatgcggatggataataactgtacagtgcctctttgatagggtctggcggccaggaactagcgacccgaccaatcgtttatgctcttgcactgtccgtctacaccgtgtcccgatcgattccactgcctgtgcgtacgagtagggctgggccagtagggatctttctcgccaatcagcccgcatatatggacccagtcagtaattggctcgcaagtcacaacagatctcgatcggtctgttgtaccaatctacgtactagcaacatgtacacgcacgtaccgaagcgggcgtaaaacgttgtcacgatacaaactttcggcggcaagagcatgcggcgcgctgagcgcagcgcagcgcagtcgtccggtcgtcccatcgcggccgttttcggcgtacgtacggcggtacgggctacggagcactgactgactcgtcggccgtccaactgtgtagtccgccgataccgcctgggccaatagcggaatagcccaaggcgcgagacggcggcgtcacacatcggcgcagttggttgggtcgagctcccaaccaactcgctcccgcgccagccaagccagccacgacccacgagccaccaccattacccgcccgcccgccacaggccacatcgtttccggccctgctcggctatatatccgcgagcatctgcatatcgccatatccccgccccgggcaccgcgagctagctagctactgacacccggcgccggcgccgagtacaatacaaggaaagcagc

SEQ ID NO: 11252 - DNA, 239 bp, Zea mays
ggtaatgtttgtttaaccatagtattttagccataggtcatgtgtttttgtcagtctttgcaagtcctctcaattttgaacttctcccatgtagaaatggtcatttgttaaatctgagcagaaaagatcggaaatccaagggcttatggaattggtattgcaaagatcttcatgtgattcggatccttataaggaaagataatttatatacatgaggaagccacctattgattcttttg

SEQ ID NO: 11253 - DNA, 1376 bp, Zea mays
ctgaagatatatgatttcacttgtttcacattttttattttcatttatcattattagtctattttctcttttccagattttattcgctatataatcatttggatgtaaatatattatgatcgcgatgactcttgttcatcacttattttatagctatgaattgctttagactttgttatgattttttttcattattactttagcaataccttaattttgattcgtcttccgccactgattatctgaagagacgtgacgtgatttcaatttacaaagactgaactaatttcaatcaatcgtatacgtcgtttagctcatcgctattggaaatcggctatacttctgaaccttcttagcaatcatcgctattggaaatcatgcccgtgatggtattatgggcctacttgggccgggctcccgaaccctaaaaacctcccgcaactgtagcaatcatgaaacgtttccctaaaacacgggggcgcacgggggtgtcacgatctcccccgggagaagcggatcttgcggagctctcatgtccgccgggagggcgacctgtcagtgattggacagtgcagctgcacctcgtcccggcagcatgctgcccgcgtccgcgtcttttctgctgcccacattccccaacgccgcgcccgtaccgtgtaccggtggtggtcgccctcccctcctcgtcctcccagcttgtcctcttctttccaccagcttgcttttggtcgctccaacgccgccgctacgtgctaaaccatgggggaaagggaagggtgagaggctagtgctgagccgcgcctgctagcgggactagtttactgctgctgagggaacaccctgttgtggagcaggtgagtgagctccttttagtcggggtcaggtgaactcacaggcaaaacggccgcccattggattggcgcctgtccgcctcttcccctttcgttgtgcctattcgttggcgtgcactacccgtctggtcatttcgtcctccgttgggcttgtgctgctgcctgctagtggttctcgatttctcctgggaaaaggtttgtttttatcttatgttggttgggtttgggaatcataggctgcgcctttctggtccgggttctgatttttgctatctcagttttcaggtagaacacgcgtacatttggcaaatcggcaggtgttatcttgtgatatcgtctgcaaagatgagattgtgatggatcctatccaagattgcttcggtccctggaggatttaggagtcctagaatccaaatgcagaaaccagtctcctgacagaaaaaaggacagttgcgcacgtggtgttcgtcaaaaagccgcaccgcactgagggagtcgcagcttgcgaccatcagaatcgtcaca

SEQ ID NO: 11254 - DNA, 241 bp, Zea mays
gatgctccggcctcttgtcggtttcggtacagcctttttagtccctgttcgtcgtcaggtgcacagtatacaccgtcatattctgtcaaatagatgcaatgcaacgactgcgcgccgtgcttgtgttgcaagcgtggataatgcatatatattgtagcattgacatgatgtgcgttattgcattacgtaagggagttggataaataagtgtgatttgtttgtcaattattcagtgttgaga

SEQ ID NO: 11255 - DNA, 120 bp, Zea mays
tgtaagttctgcttcctcagaaactctctcaaatgaaaatgaactgtaaaagcaaaaaaaaatgttttgaactaacttttactcccgtccggtcttgcaacccagctcaccaacccgtac

SEQ ID NO: 11256 - DNA, 246 bp, Zea mays
ggtaaacaaacaggccctaaaaactccctcctcccctccagctttattacgcaccttcacataacactgcaaaagcactcctctcttcgtcctccccctccctcctccatcccattccataccattccgccaaagaagaaccacagacgctcgctcccaactcccaagccaagccggatcccaaaatcggcacagcgcacccactccgctcagtcccttcgttcacccccatccatccagccagcc

SEQ ID NO: 11257 - DNA, 364 bp, Zea mays
aagcttcgctgctggcgtcgacaatggaggcgcggcaggcggcgatcgtggatggatgcggtctcagcgtctggaggatcggtcggagctaaagcagggacggtggctgctgacagctgagtgggtgacgatgatcaagaattcaagactgcggttttagctgttggtgatggcagtccgtcgctcagacgaacaaacaacagggaggaatggaacggatcaggaggagtttattgcaggaaatgctacaggctagcgagagattttttagcatgcaggaacgacgcaggatcagtaaagtagtgtagcaaactgttttagcctgaactctgaatgcctgctttcactggattgcatttgcata

SEQ ID NO: 11258 - DNA, 1500 bp, Zea mays
agctgcaagcacagtggtcaaccctttgtacttgctgtgcgtccgacgatgccaatggctgccgccaagcaagaaggcagaaaagaaggatgctgccatggaggagggagaaaaggggactgaatcactgaactgagtttcaatctggtaatgtcgactaggtacccgcgatgaggatgatagcaggaagcagcccccatcttttacagcttggaacttcatgagcagctatcggatggctctgagcagttggcgtcttggcgagatgggttccgtaccagtggggttaaaaaaaacaaaaatgaagcaagtatgatgtagcacggcagtgacggcacggcacggatgaaaagcgaacgtgggagagcagtagcaccaacaggataacttggacagcaaactgccacatcacaggtgttgttcacacctcagccttcgccatcatcgtcatggatcacaatacaaagatacccgtaccatcacaaatcttgaaggacaaaagcgttacctgttcatgttctaaaccacgtgtattttcattagtaatcagcaatccacctagcaggtggtataaatagctgtgtaaaatactgttttataatgtggattacaatgtttgtagagttaagtttaaaacataacttagatgtttgtagagtgaagtttaaaacataacttaggagaggtggtgggatagcaagtctgctggatatagtgtaagactaacgggttgtttggtttgctacctaagacgccacaacgtgtctaacttttctatctaaccttagttcttcaattcgagcgactagggttagacagattatgacgccttaggtaggaaaccaaacaggctttaagactaggatgtggatttggcaagttgcacccaaatcaaagttaaccaagatgccatgtgaaaggatgaactccagcaattctcaaaaaaaaaaaaacggtgttgcatccaacagaatatatatatatatatatatatacttgtgaaaaagatggtgcaaataaaaaggggggcaccgggatactctgatgcactactagagaactagaagtccctgaaatatgggccccgtacgacgacatggcctgcgtgccagcgacttcgaattccaataatgcttgtccaaacaaccaaatcagggacgaagaaatgtrtgacattataaataaagaaatagagtagcgtttgctcaaatcgacatgccgggtataatcttaatccttccctctcgcacaaacacaaacaagctaaaaaaggagaatgaatggtcacggaccaccgacatcaacaagaggacgaacagcacagcaccaaatgaaaaggggaagcctgaaattgttgttctaacaaaactcggtggcctaagcgccaccagcaacaacgaatcgccgaatcatggcggcggggagattaccaccggagcataggcagccaggcggatcgcgggtccgtcgcttcagcggtgcgccgtgacgagcgtctcg

SEQ ID NO: 11259 - DNA, 120 bp, Zea mays
ggtacccctgcaaaaccgcgggccgcatcccgcccgcgccgcccaccggcggccacagccgcctacataaaccactaatcgaccactcgccgaaccaaaccacccacccacccaaaccca

SEQ ID NO: 11260 - DNA, 1500 bp, Zea mays
cgcacgtggcccacacgtgagtccgccggaaaagccgaggcgtcgctcacatgcccgctgctggggtcgagccgtagcggacgcgtcggagactctccggtccactgatggcatggctcatggctggacctggacgtcgcaccaaccgtcccacctcctctcctaccattaccaataaaataagcgtaccccacgacagcgccccagcaccgcacatgggatccattccagcctcaagccggcttgtgggtccaaatctggataaacccacctgtcagtggagttagcatgtgccgctcaccggcccagcgtttgccagccgcgcggccgaaaacgcccaggggccagggcagctcgagctcggggacagcctagacgggtcacgctgcctgctttccccgtgggcccctcccccgacggaaaaggcgatatttgcgaggggcagttcgggcacttcgccgccgcacggtgggaaatttgaaaaccacgcaaggtggagagagatcttgaccgagcgccgcgaggagagctcggagcgggagggtacgggccgtcggatgctcgcagctgccaccgccgcctacggctattttaaccccgcgctcctgccgacgccgcactcgcccccggcctcctcccgcctcccagatctcgctcgctcggcgccagttgcctcgcagtttggatcatctcatacctcgtaagtcgtaaggatttctgaactacgctcataaccgagttttcaatctgtgttgcggtgtagcattatttctgatctgttagctcggtttttttttctgttgccaaattctgggttgttcccgcgatgtaaccggaaatgcgattggatccgctgatttgccacctaggaatgtcctggcccatgcttgtctctctctctctctcttttgacgaaggttattcgattggttttgtgattctgcgtagctgagtgggatccctagtgtttgattttgggggaattcaagtcgtcctttaattgcgaaatgtaactgttaaccttagagacagagagctttgtggatttattatcataacttagtgcagttttgaagtataagtttcagtactgaaactagatctggaagaacatacgtcaccgtttgaacggttgggctcatggaattatttgtaatcatggggagatatgtttgaagtctgctataatattgatgcatttagtacctatcagtaggcgattcagtggttgatgtgtgtgcaagatggttttgaaagcccagatcttgtcatggttcgctatgtgatccgagtacgagttcagtgacgttttagatctgaaactgcagtgacaatgtgcgctcgctctctggtttcgttgcaaatggctagaaatacttgaggagggtgacaacaagcaaatgtttttcctttccttcggcgcagcattttaagttactgtgtgcttgttgcagtatctgtaactaattcctatgcgattctcttgtttgtagggcgaag

SEQ ID NO: 11261 - DNA, 1500 bp, Zea mays
gaatgcagcacaacagagcgaggcaggacagcatcgcaatccattcactgaacctggagccgtaaaaaggtggatatcaatcaatcaacccatatacaaagagagagcgggtagggtaaatttgacccacgcgtcttaaaaaaatatattattatcatttattttaattttagtttagtttatcatataattttctttagcaacaaactaaatttttctatatttttataaatattttaaataagacaaaccgagtaaattaaataccaaaaaagtcaaatgacattctttgggagacggagtgagtagtatgtacgagtattgacataaataggtcagataatatatttttttttctcattcactaataaaacaaaggagtgcgatcaggctgctttatttgtattattatcggttctgtgctgtctattgggcacacgacatgtatattatacatagcacacaaaagagctgccaacgttttccaatcaaatgtcagcgaaaaatgtcgtgcgattatacttcacatacaacctctatacaatcaaactatcgaaaaaagcataattgttttttaaaaggtgtactatattatttactcaattaatatatcgaataaaactatcttatttaccttatattaagagatataaaaaaataaaattctatctaaaatggaagatttaaaaacagtagaattttcttttatatcttttaacctaggataaattagaaaacaattattatttttttgaatcatccgtaatttggaatggaggggaataagtcaaagctgatgacacgctgagccgaccgcactaaatcaacgccaccgccgcctgtatccgaacccagatgcgttcacacatccctcccactgcctggtggtcccagcgccacatcatccctgttcatcgtcgtgtcggcattcgccattggctaactccctacaccattcccacggtcaaggctgggctgggcgacttatctctgccgactgggtcccggcccctgggcccgaacgtgacgtcaccgccgtgacgtagcgcgcctggtcacggtcacggccccggctcgcttgattacttcacacagttgacagtctccgtctccgtccgccactaccctgcgctgcgctgcgcttgaaaggcgcacgttcttctctctcggaaactgccaagaacgggggagggatatataagataaaaaaagattaaaaaaaaggaacgcgcgaaatttctcgataagggaaaggggaacacgcttctgccattgcttggctccccccacccgaatcttttctgcttgttgaatctgaaatttgtgctgggttgagcagcgtccgtccttgcgcttagcgaattcgcggtgtttacgctccgatgcctcacgtaaggctatctctcaggcttcccaaaagctcgggtaggttgaatcgtggagagttccacagcgtcctagccgccgccgtggcctgacctcgccataaccttccattcc

SEQ ID NO: 11262 - DNA, 1500 bp, Zea mays
agccggatctggctgccgtctccgcggaggcccgctcggtgtcgagctcctacattgtataaactttgtgctaaattcctaatagtaatctactgtggggtcaggattgtttgttgttgggccagcaattgactcatgttattaatgttatagtatgtaaaattctttagtaaatcacaatctgaatcgaacttaactgaccctggcaatatctaatgcttgcttcgtcactgataaaaatatttgcaatcttcataaattaaaatagataactatgctatatgtattatattgttacaagagagcaacctggactgggtgatgacagagctggccagcatccgtacatcccgaagaaggttgaatgttgtcatcttcaccataagcctgagcagtagtttcaagaatagagctaaagatgttctctagagattcatgttgttcaatctggccatggaatacaaaaatgtgagataactcaataattacagtacaagacctaacaaaaaattatacatgaagagttaaagaagaatacaatatttttttaaaagcaccctacataactcagatgtaataagcagttaagataacttgcctttcccagatctagccgccactctgctcttccctcagcgtggctgttttgcacttttgcggccgtcagtgcgggagtggacaaagctaaagacttgggggctggttcaaacagggatcgacatgtgtctagtaaattaagcagttatctttctatttggaagaaccgcttattagttgagcacttttttttcttctagacagttgtagatgtgatgtggagcagtgcacaaactgctccatatctgaacaccgcatgataattgtatatttgcagtgtacaaagagtcaaattgcatattttatcttcagtttgtggtaggtgccttgaatcgtgagagtttacaccttgtgattcccatggctgcctcaatgcgacatgtatctacccttgtctatgatcaaagcaacttactgaacatgagtaattgtcttctctttatgtcatatctagtttatatctagcttatatgagtaattgccttctcttttgttcttcaatggatatcaaaaggctgttgaacagtgagtttatggtgcgatgtgcttattcatttggtttcaaagagttccaagtgcatcacttttttttagttgccctcatgttatgagattctaatctctatccattcaggttggcatgtactttttgacttgcgtgccatatttttggctttctctatgatgtccaaacttgcattggtgtaccatcagcttcgttcaagaagtactaatagttgatacctgaggctctgagttgtacgtgaaatgtctgttcttggagttaggatatgctcggatgacaaatgaatggccttgcctttacactcttgtccttgatgcattactggaccgctggtagcatacatgacagacgtccgtcttattgtgcgcagataagac

SEQ ID NO: 11263 - DNA, 1212 bp, Zea mays
ggaggcaatgaggaggagggagcaagggaaacgttgttggctcgtgcgtcgaagggataagaggagggggttagagtttgctaggagaaggagggcgaccgaacgagggagtgccagggcagattttatgcaatggcggggaggcaggcatcgtcgccgcgtcgaaggcgttaaggagggagtgagggagctcgccgccttagagggggagaggaggggtaagggattgttagaagcagaagggcgaagggtagcgtgggaccgccacgaggggcaggtttcatacgacagtggggtgtggacttcacagaccgaccaatttagttgtattgtacgatcaacatatcgtgtttactgtataacccaaacacaacacgtaaatcgatcgagtcagcacaaacctattttctaacataatgtgtcatgttgcggcccgtcaatccttatcggttccagaccacttggttggcacggtccatctagacatctatatttccctacaacacaagttaatgtgccatctataaacaggcacgcaagcgatgattaaaagcaataatccaatgtggcatgtagttagtgaagaaagaggttgtagccgtgtcgtggctcgtggtccgatgctaagaagaccgtgaaacaaccggtgtacgacgacggcaacaaaggatgcctatcgtgtacttgtgcagcagcagctccataaaaactacaataaagactattatatgaattaaaaactatatagacatcgtaaatagataacttattatataatttgtctttttgtgttgtctgtattactgtatgtgtttttaatatatgtatgtgggctgtacatgccctaatccaccatctcactcctgattccgacgccaaccccctgccctgccgccgtctctctctaacccgcttctccacctccctcacatcggctactctccgcgcgcctaccgttccgcgccgcatcggtgagtacctccgtcgcgcttacaggctaatctcaccctcacgtcctccgctcctccctttcccgtgctcggatttgggggtccagcggttccttgtccaccatgtttctcccatcatcgatgcggttttcggttctggaaaaaaaatgtaattgaattgaaagaactggtgttccgacccttggattgcaggattgggtggtcggggcctagtcgaggtttcgcgggacagcgtcggtcc

SEQ ID NO: 11264 - DNA, 1500 bp, Zea mays
acaaaggatgcctatcgtgtacttgtgcagcagcagctccataaaaactacaataaagactattatatgaattaaaaactatatagacatcgtaaatagataacttattatataatttgtctttttgtgttgtctgtattactgtatgtgtttttaatatatgtatgtgggctgtacatgccctaatccaccatctcactcctgattccgacgccaaccccctgccctgccgccgtctctctctaacccgcttctccacctccctcacatcggctactctccgcgcgcctaccgttccgcgccgcatcggtgagtacctccgtcgcgcttacaggctaatctcaccctcacgtcctccgctcctccctttcccgtgctcggatttgggggtccagcggttccttgtccaccatgtttctcccatcatcgatgcggttttcggttctggaaaaaaaatgtaattgaattgaaagaactggtgttccgacccttggattgcaggattgggtggtcggggcctagtcgaggtttcgcgggacagcgtcggtccatggcggagcttgtgggaccgcgcgtctacagttgctgcacttgccggaaccacgtttgccttcacgacgacgtcatctccaaggcctttcaggtccgaactccccgcaattacctctccttcactaccgggcgagttgtttcttaggaggttctgcaattaccaggacacctctgttctctacgaaaccgaragtccttccgtaggtcatacactcaaaagaatacttatatctgtcttttttatttgtattagctaggtctagtaaatcaaacaccgcattgctarctaacctttagctggccaatacatttggttcttttagtcactagactaaagtttagtcactaaagcacaccgtttggttctagtgactaaatcagactaaagagcattaattgttgtgaataatgactgtattatccctattaattagtggatgtttgctgcaagaagaaagtgtagaagataaataaggtaacaatcctactttagttccatttagtcactccttggtgactaaagaactaaagtttagtcaccacacctttaatcaccatgtttacttctttaaagactaaaagtgactaaactttagtcactaaactttagtcaccctgaactaaacgggaccagaggctgtgtcgaaccagaaatcccatctgcgatcgacgacgattgaaaagaggataaaaaaatctcgagctgctctacattctcaccttagtagtagtaggacgtatctagagccatttctacaagagatagagattaataaaaataaaataggagcggagagagaggggcaggaaataaacgaggatctcaaccacacgcaacacaagaagctgacgaagggctaatcccccggaacccgttaacgctgtgggagtgtgagcccacccggccacccgtttcggctaatcccccgctcgccttctcccatcgcc

SEQ ID NO: 11265 - DNA, 737 bp, Zea mays
tatccataccaaccgagtgttgatgctcctctttctattactaacctccaacgaccaacgcgccaccttctagcactgataaagccccttccatcgatgcttgtcctccacaacccttcacagtttcacttattaaattatcatcacccatctcaaatttaacatataagattgctctgtatacaaaagaacaccttccaccactttcaccctgttcgaagggtgttctttgcaaaatatacaaaacaactaaaaaaatggtagatctaatatggatagtgatgatttaatatgagcacaaaatatgtttctattttctaccatggaacatacccgatgcacataggaatctggtgcatataatgcatatattaaatcccattatatattcctccctgcaacattttgatggtgggctgaagtatgtgtgttatgtacactaaactcttatatacactagatatgtttctcccttcaactctttggttgcggcctgcgggctatgagctggagtatgtacatcatgtacactaaactctcgtatacattagatatgtgtatatgtttctcttagactccatgtttgtcgcgctatataagtaggcaagcttttcttaacctcgacatcaacatcctcctccacccgaaccaatcttgtagcatttccttccgctgcgaacacccaaacggcagctttctactaggggaagagaaacgttttcttgtctcaacgatcg

SEQ ID NO: 11266 - DNA, 711 bp, Zea mays
ggttttcagtaagactcgtgtatataatcgtgtaaaatactaattttacattaaagattcaattgtttattaagtagagtataaaataggatatcatgatacaacagtgaagtggatttgaaataggccttttcgatcaataaccaatgacacgcattgggctcaaatcgagtccatcaaagtgacccacacagcccatatacctttcgttaacgtccttccggtacaaatcccagccgttaagctgtactctccaaaatctgtccgtcaaaatagaatcccagtgcacaaaaaaacccacgcaacgttcaggggcatttccgtaactacaacctacaaaaccctagacgcgctgcaggcggccgtcccggttgctgccgttcccggcctaaacggaggcggccgtataaaggcattctcctcgcgccccacccggcggttatcttcaccaccatatcgacatcgacgccagcgagccaaggacagaacagccggcgcccggccctaaaactgccgtgcaggtaacctgccgcccccgcttcacgactagcaaccgcgcccccccggctccgctccattatatttctcgccttggacttgcgctcgcgctacagcagttgccgcgctgcgctctcgcgtcttgccggatctgagtgggctcgcttgcattgtgctgtgctgtgtgtgcagcgagagagaagcgagggaaag

SEQ ID NO: 11267 - DNA, 1205 bp, Zea mays
ggtaataattttagtaatccgctcagaatctgcccaatctcagaatctgcccatattttttttatctaacttgctctgagccttagacaacccaaaatcggtctggtcaattgttgagtgatttctgcatttattaggaggttgtcacagtctgatttgtagctcacgttgactatattagaagaggaaaaaccagaaaagtctaaggcattccagacaccaaaaacacttgtgcttctgtgttctcacattagttacatcattgcaaggtgaaaatcaccagtactagtgtaatttgaactaataaagaacttaaatagcatatgccaatcctcattttaatcttaacttgttcacatcattcttcttactatgtaactgatgtgagaacattgaatcaaaaagctaaaaattcatgtggtgagattctcagtgttccagttactttgctgtcaataatcatgacaaaatatcagagaacaagacaataaacttaaaaccatagtcacaaaatttctgggtcgatggggtcaaggaacatggtatgctgcttgtgccaggtttttacatggctgggtcaaaaattaacctaggtaccggagtcgagtgtcgatgaattcgatcccatttcctgtgactatgcctaaaactgatggtaaacaattatttgttgaagagcaaaacaaagatgtgtttaccactcttatgactatgaatgcaacatcatataaaaggtattctttcagcacatacttgcatgtgatcaagccacaaagtaagaccaacaagtgcagcccyagcagacagcttccrgatgtcagaagaatgtggcatgtcatgtagatttcttggaaaaatatttagtgtcattgatgggagccatctcttgctatcagatttgagttctaaaacatcaccagaatgtggcatgtcatgtagatttcttggaaaaatatttagygtcattgatgggagccatccttagcagtaattagtttagtacttcgtttttacaaaaaaaaatcattgcttgagccaaagttgatatgtgtaacttgaaaaaacaatgcctacaccagttatgcaattttatatatgcacatgaaatacatttatttttttgtagaatraaattgtacactacttgaaacatcagcagtttgctcacacaaactagctgccctgatgaaacatgtccaaacttg

SEQ ID NO: 11268 - DNA, 205 bp, Zea mays
ggtatggatccggcataatttcatagatctgcaggttcttagtgatttccatgcatcctgacgtctcctccctcccctacctcctctcacctcgcgctcgttgcctcgactagttcggttcttgggagagccagtctgctgctgcttgcggtgactggcaccagcgcgcaaggcttcctagagaccatctacctgcgccgttccg

SEQ ID NO: 11269 - DNA, 1500 bp, Zea mays
aaacatgtgtgtttaacttagagataagaaaatgaattcgattttcaaaaacaaaccaagtggtggcgaataacgatccaaatatgtcaaatcttgtcaaagactatttttgttctgaattgctttgatgttgcacttccatttgttgctttttgatgtgttggcataaatcaccaaaaagggggagattgaaagggaaatgtgcccttgggccatttctagtatattttgatgattaagtacccaacacatattgagtgagtaattatatgccaaatgatggatgaagtgcaaatcaacaagaaggtgtagttctagacttagtacattggtttttgtgtactaatatatttgtctaagtgctagaatcagataaaagaaaagaagagaagaacttggctcgaagcagccaagactctgctcagtctggcacaccggactgtccggtggtgcaccggacagtgttcggttcgccaggctagactccggcgaactgaccactctcgggaaactgtggcggcgtacggctataattcacaggactgtccggtggtgcaccggactgtccggtgagccaacggccgccagagcaacggtcggccgcacaatccgcgcgcgacgcgtggcccacgccaatggtcggctgggggcaccggactgtccggtgtgcaccgaacagtgtccgatgcgccaaccagcccgaagatccaacggtcggctgcgccaggaatagaaggagatccgcaccgaacatgaacagtggatgtccggtggtgcaccgaactgtctggtgcgccacccgacagaaggcaagaattgccttccaggaatgcttccaacggctcctagctgccttggggctataaaagggacccctaggcacatggaggagataccctaagcatactttgagcattctaaatcttccacactctgtctccgcgcacttgattgactttcttagtgatttgagctccgttctagtggtgaacttgttgcgattcattcgagctcaagtcttggctgtgtgtgtgcgtattgctgcggatttgtgtgtgtgcttccctcccttactctagtgctttcactttgatctttgttgtaagggcgagagactccaagttgtggagattcctcgcaaacgggaaagagtataagaaagtgaacaaccgtggtattcaagttgatcgttggatcacttgagaggggttgagtgcaaccctcgtccattgggacgccacaacgtggagtaggcaagtgttatatttggtcgaaccacaggataaattaccgtgtctcttgtgcttgttttctttgtgaccattgtgtttcacaagagctcggtccttagccacttgattccattgtgctaacacttaaccaagtttttgtggctataagttttaagttttacaggatcacctattcaacccccctctaggtgctctcaattggtatcagagctgttctcttcatgaaagggactaatcgccagaagag

SEQ ID NO: 11270 - DNA, 358 bp, Zea mays
gctggcgttctaattaacgcgattaattaactcgtctcatcggcgactgacgcagagcccaaacgacacgcgcaccgtacctcctgcgcgctaaactatcgttattgcggccacatgcctgagattcacattccccgtttgctttgaccatcccaccacgcgccttgccccaccaggccaccacgctatatttagctcccttcaccctgttcctctccccatcgacagcctccgccgcacgttcacacacacagcaagcagaatccagctagctcagctctcactcgctcgctcactccagtgtccagtctcccttcacttcaggacgtcctcgattcgccgccgtctgtcaaccgag

SEQ ID NO: 11271 - DNA, 51 bp, Zea mays
agtaggtgaaagcactgaaacctcacgtgcgggaattatgggatatcctcc

SEQ ID NO: 11272 - DNA, 857 bp, Zea mays
agggcattgtgagtctattggggtgcaccgaaggtgcacctaatggatgtagcccccaagctttgagtggattttagaaataatccattcaaaggtcttcatatcatgctttagaaatcaatattttgtcttcatgggactataaatctattgggtgtagctcccgagatttgagtggattttagaaataatccattcaaaggtcttcatcttatgctttggaaatcaacattttgtgaaataaccagacaatgccatatgtccatgccttgttaggtctgaaatcaatttgatcggtgacagattggacgtctagctagttgaggcagatggccctcaactggacatcaccctgccttgtgcttcaatgcttctgttgattggacttgcgcttcagtaaccacatttggacttcctcctgtctcagtcgatatcctccttttgtcatggtacattcattgcgtatattttgtggatatcactttttcagaaaatctttgaaaattctgggcaacacacccaatgggtgtgcccaaggggtgtcttagtgcgcaaagtgtttatcgcgttgtcctggagtagtaacttgatgtgacagagaggtgtaaacatttgcctgagcagttgactcaggtccaaccagtgtcatgctacacgaaatggcgctagttgcctgacttcttttcaagcggcttgaattgcttattgaattcttgcgactgttcggcgagtagggtaggaagtggacgatcaccccgggcttctttaaatagcccgcttgccttggctgttttattcacttattctttgatcacttgctttcttcttcttcttcacccctccctttccaaccgacc

SEQ ID NO: 11273 - DNA, 1500 bp, Zea mays
agaacacaagcaagaacaggaagaacgcaatcaaaactgcattgatcacgaggtggggtctcacaaaccgatgaacggcgatactgttcgatgacagatatgatctaagcaaaacccaaaccctaatgtggtggtggatgctggtaaaatagaggttaggagcgtgcacaacccctggtcgcacccctaatgggctccaacacgatacacggcccaacagcccaacaaacggtgtcgcagcaccaaaacagaatctgaacgctgacttgtttcgacgattcctgttgactcctgattatttttaaggtgggactagttggatcggaaagcttatctccttagctttctatctatataaagcccaacctaatcagagttcggatgcatcctagacgttcgttttagtgcgtactagtcctgaactccaaggtggaggcgaagttgagtcggacttgactttttattgttgtgaacatcctatcttcttctccttaatatcttggcctttctcaagtcttcgttggtcatctccaaggtttctaatttttaaaatatacatggtaacaaacgtaagctataaaatataaacctgtagaattaactgtcgtgcatgtgctcgtgttatcgattctcacattgtttgtatggtagtgatgttctcgtcagaacgcaaaactgtatttgactatatatatcccgctgatttaaaaaaaaccgtcacggcttgctttgcacagctgatctgataaatgattgcacggtcaaccatccattttgccagcaactaaggttgcacatggatccagcgcaataatactcttacgcccattcaggtaggatcgctagtggatatggtgtgatcctttctaacttccaaacaccaaaatatcaaatgcaacgagggtagaaccaatatatagtcaacaaggcacgtaagtacgtacagagacaagatcacttaaaaactaacagcacgtatataggcttgttggggaggagaggtttagttgccactgattggagtaccctaataattactcactcaaaccacgcgctagctgctggtgagtggttccttttgtcaccttaattagcttactcactaggatgctcgatcaatcagcaaacacagccacgaagcgtagtgtggggtgcacgttctggcgcgccatttgttcaatagtggcccttttgtttttagctagtgaagtcaatgcatgcatggatatgacaagcaacgtgtgcctaacctaccagtaacagctcaattatttagagcttgcattgtctgcatgcgagccaatcaggccgcttgcccctcggcaacgttgggcagtgtatctataaatacccctcgctccgcaacaagcttcccagaacacaacaccacctccaatccaaccattctagcgctgcgcagcagctggctagctatttgtgatatctctgatctagttgattgatccttggagtagggtaggaggagccgaggaggacgac

SEQ ID NO: 11274 - DNA, 1299 bp, Zea mays
agggggtctatctattgccttgctgcttcccatcaaacctgttttcgtttcaaattttaccttgacaccgaatcttgctttgcctcaaccaaaaaaataaacagaagttgtacagacggatctgaatggaaggatgaaagatctgtagacatcagtcagccagttagcaagtttagccatagcctgttagcatgaccacttgaccaccagcttgatacatcttggggcctacttggctacttcatcttcttcctcttgggccttcgatgctagtttccttccaaccgcgtgcctaccattctgtagttttgcgacctaaaagctgtttgattcgtcacaaaatcaagattttttttattacacgagttaggatgatcgagttcaaagtggtatcatgaactttctgatcagagtaggcctgcatctgtatgtgggatgcaaatttcacgtgcacggccccagaactagccattctgaccagttcttgtcctaatctggacgcgatgtgtgctgctgtggaacgctctctgtccaccagaacgtcaacagctcggaccgcgcgcgctcatttctccacggctgccgtcggcgggaatgagacagaacttgaccagggccagggccttcggcttctccgcgtactccagtctgcccatcgcagtcgcaggcacacaccttccttctagaaatcacctgcactgcacagtggtgggagcaagcggcttcgtttttcaaaagctgaatcaaccttccggaaccccactcaccgaaacttattttatttctgtctgccgtagcattcatattgcatcgtttcttttttgggctatttaaactcatactgcatcgttgaacaaacaaacgaccttccttctagaaatcacctgcacaaagacaatagtagtagtaataaagagaaaaaaaggcatagacagctgacgacaaatacagtaagtagttctttgttttgacgccaagtgactagccaagctctggagtcgccgcgggatagggagggcagagtgcgtgtctggtcaggtagcgctggtaggctgccaacgtcaagtgactgcaggcagccgccccacatcatatctggcatcgtgtgtcgttgcgttgcacatcgtacgtggcagccacccaaccttcgaccgtaccgcacggctacctgcacagctgcacttgccactgccaaagcgaggcttaaaacattgcctccaaaaaaaatataaaaaaaacggagccagcccaaaccgcgcgccagaaatccccgagagctgaacagagctcagagctgcc

SEQ ID NO: 11275 - DNA, 658 bp, Zea mays
ggtgagtgtagtacatacgtttcatgttcaaacatacattacggttacataatacaaatttgatattttgttctcttatgtctttatgtgttggatagattcttcgaaggaactttgtgattgatctgttaagttatgagaacaattcgtgctgatatattatccctgcaaacatacaacaacgacttatcgatatttctaaaaaggattagattagcgtatgattgtcgacattataaattctaaattgactctttagaaataatttatgtgatattaataatatttatcatatgaattttgtatattatagaaatatttatcgtcccgtttcaatatttcgtacagtttttttactttcgtggtaactaataaaaaatgacgaatggacttggcggacagccgcattctagtatagtgcagacgtgcccggctgcatcaccgatctctctccctccctcgctcgtcgcttccgcaggggcagccgcagcaccgcagctacctacctacccacacacgcgattcacgcaagcacacgcagccgctccttccgtcctcaaaccacaggcggaccctgacgagacgtacaagaacctccaccaggccattgagcccttgaccgtgtacgcaaacgaacacgaagcctagctcctcccca

SEQ ID NO: 11276 - DNA, 158 bp, Zea mays
gttgactgatccagacgtcacgttcttccgtcctagtttcactgaactgaagggacttctggtatccttctgtagtttgctgccgtagttagccttctataaacgttctacaagctgttgtagcaataatacttctttccttccgggtataaaccgag

SEQ ID NO: 11277 - DNA, 283 bp, Zea mays
gaaggtaaaccgaatgcgaaccatgtacgtgccaggatcagcaattcacgtacacagcagttacataacatggacatcatcacacagtgctcaaatagtattaaaaagggaaataatagtcgattacatcatatgtctgagacatccatatagtctttacaataatcaaagtgcggaaaagaaacgtagataaacgcggccttcacaggcagccgactgggggttgccactaaaccacgcctagaactcgtcgtagtcttggaactcctgtaagtctccttcc

SEQ ID NO: 11278 - DNA, 240 bp, Zea mays
gtatgctgcatctaaatgaaattagaattgcatgggacatgcactccaatcctgtgtttttccctattcttagtttttggagtcctgtattcagtcattgggttttgttatatgctaactaagcctccaattttcaaaaccaaagcagttcacaaaatcatggtaaatttttttaaaacaacaaaaatacttccacacagggcctaaaatataatcatagttgggtaattttttgcattg

SEQ ID NO: 11279 - DNA, 458 bp, Zea mays
ttggccagactgagataacgaaccaagtactagtggatatgttaagagtttatgcccttaagcatggaggaagttgggacaagagtctaccatatgcagaattctcctacaataatagttatcaggccagtctgaagatgtccccatttgaagctttatattgcagaaagtgcagaactcctctgtattgggatcagactagtgaaaggaagttctttgggcctaaaattattcaagaggtagaagaacaagttcgtatgatccgagagaacatgaggataacacagactcggtagaagagctatgctgataaccgaagaagaccactagaattcgaagagggtgaccacgtgtacttaaaggtgtcaccaattcgtggaataaggagatttaaagttaaaggcaagctatcccctcactttattggaccctttagaatctttaggcgagttggagag

SEQ ID NO: 11280 - DNA, 112 bp, Zea mays
ctctcctccctcgacctgcgcttcactacagcccactggcaggggaaggggagcgtcgaccaattcgtcccgccctcgccgcgccgctggcctcgctcgcgtgccctccccg

SEQ ID NO: 11281 - DNA, 1500 bp, Zea mays
ccattccagttcctaaaattttgtaattttattctctagcacttagtgtctctgttttatcatgacaacagtaataaaattaatctcacacgtaatcctatttaaaacacataaaacctttgaaaattcataacttaaaatctataactccaaaaattatgattcctgttcctaggattttattttaatgtgtagattattactgtgtattttgtttacatgtttggtgtgatgttaattttctctatatactgtgcttgtttgtattgtggcgagtagaagagcccgtgactgaggatcctggtgagcaacagatagaagtagctgagcaggagctcattgaaggcaagttgtgcccttgaccactttttacccaataatgttctctaattatcattcactcatgcataggttaattttgatgggacccaataggtcaccctagattgtttatctcactaccttgtttacccctgaatcacctgggtagtttgctattgctttacctggttttgggataatcatttattacctctatattccaattctttttgttattctatttatgttcatgttgagatcattaatgttaattggaacatagagcttaacttgagaaccacgtgccaccacaagggtttaatgggacgcccttggttgactaattaggaaagctagtggaagactaccttacccgaaaggggcaagggcagtaggggagtggtcagtgtagggaggtccttggttgattttgttgcgatggcagtcagtcaagaaccctgcattggaacttcctataaactgtagcgggttttcggaagctagtggaactttgtaaaggcctcgtagtgttgccctgccgcgcttcctaggtagaggtgtatgggattcgcgaccccttggcagatgggtagcatgacttgtgggtaaagggtacaacctctgcagagtgtaaaactggtatactagccgagctcacggtcatgagcagctcaggactctctgatgtttaaattatggaacttaaattcaatttggtcatttgcattgcatgggattattattaattttgttctattacttttattatggtttggtatttacttacacttagtaattgctaataaaagtttgaccaactacttaaaagcaatgctcagccttaacccttgtcattgatttagccttacacatcacatgaactcacacctttgtgagtttgtgtccactggttccccacaacttgttgagctatgatcatgtgtgagctcacccttgctgtctcacacccccccacaggagaagatcaggtggttcaggaggagccgcctaacactgaggagttcgatctgatctaggtggcgtttcccagtcgacattggcgccgacgatccttagttcgttttatgtttacacttttattttgtaataagtcttccgctatgtaataaatactctgatgttttatgacatttgtctctatacactctgttattatat

SEQ ID NO: 11282 - DNA, 191 bp, Zea mays
gttggagctgagaaagtgaggagcctactagagccgagctccgagttcaaaccaggctcgttcgagttcggctcgttgacagcccagcggctcagccctatcccagttccgtccgtccgttctgacctcggctcgtcgggcagcggcgcccggcgcaccacacaggctttctccaactctccgccctcgcc

SEQ ID NO: 11283 - DNA, 296 bp, Zea mays
aaggaaagttgaaggacatacaccaatcctcaactgaagccccaatcactactactactactggaggcgttggaaatgcaccttactagttaaatgctcctatattctaagttttctatatatatcatataaatatcatataagtaagctttattttaataaaacctaaaatatatgtgttattgttggttagatagatgctaatgtgaagccaacgatcaaagttcaaacccccactttatacacaataaattgtgctttatatagtagagatattgtaaccgagcttggctgat

SEQ ID NO: 11284 - DNA, 437 bp, Zea mays
caatatttatataatgaagtttaaaatagagatacgacagatgagcttataaagaaggaagccaactaagcaagaagccagcctagtcatacagaaatgaaaaggaaataagaaagagaaactggcccagtagcgcacgtgcggagaaacttgctaggggaaaaatattggcccagtaagtagcgctactgggcacccataaacccgtcatccaaatccatggctgctcagtgcagaccagcccagatctccctttggcgcccgagatcacgcacacggcattattgccggacacacaaccgggagtcgggaccactcgccccggccggatgccggagctcagacgactacgtgtataaactccggctacacgtcccggcacggcggcaccacaggctgataagcggcagtgggaaaataccgcaccgcacgcacca

SEQ ID NO: 11285 - DNA, 595 bp, Zea mays
tgattgggttagtttgttcagtttactaaaagcggaatcaaggtaactaaaagggtctctgttcattcaagtgtagggtgttcatctgcttttagttcttcaaaacaaagcggaatcaaggtaactaaaagggtctgttaatctaactgaaattgtgctacgtggtatgactatttttgttttaagttcctatcttttattagaaaactaaatatcttctttttttagttccaacaaatttttgccgactaacaaccatgcagatagcactcctaactataactataattccacctgatcaacaatgtgcccagtcctagcattatgtactgctcataatttgtcacttggtctgtgtttttttgaatgcttactagaccaaggtacttgatgtagtggctcatgaggtttgatcttgagcctggataagcagaccaggttcatcagctcagatttatttttttaagatttaattttttagttgttataatttatggaatctaagtaactagcaaactaattactaaccagtataggaaaatgttgcttgctatcacattggagccagcaattgtattaacactttgggtaggat

SEQ ID NO: 11286 - DNA, 238 bp, Zea mays
agttgcacttgcacagatacctgttcctccgagtctcgctcctgttcggatgtttcatccccgtctcacacccgagcttttctctaccttcctcttcatcctcctctccgcggcgagatccgccgtcctctcgctggagtggacaggatcagaagagagaagaagaggggggaaaacaatgtgacatactccccgagtagaacatataacctttttctcatcttattaattcgtatgt

SEQ ID NO: 11287 - DNA, 315 bp, Zea mays
gaaggtaaaccgaatgcgaaccatgtacgtgccaggatcagcaattcacgtacacagcagttacataacatggacatcatcacacagtgctcaaatagtattaaaaagggaaataatagtcgattacatcatatgtctgagacatccatatagtctttacaataatcaaagtgcggaaaagaaacgtagataaacgcggccttcacaggcagccgactgggggttgccactaaaccacgcctagaactcgtcgtagtcttggaactcctgtaagtctccttccatggctgcatcttctcctgagcagtggttgca

SEQ ID NO: 11288 - DNA, 246 bp, Zea mays
tgcccccgtgcacgtaaccctgttgtcaccactgttcacccttgttggtttacttgcagcagagagcaagttccaacaccttcttgaaatgctctcaacggctcctagctgccttggggctataaaagggacccctaggcgcatggaggagtacaccaagcattccttgagcattgttgatcactcacacttcattcttgcgcacttgttcgacatttttagtacaaggactaatcgcccgaagag

SEQ ID NO: 11289 - DNA, 782 bp, Zea mays
atgtcgacatgtggtcgttgcctggcgcaaatggcttttgccctgaccagtaggctggctgagctgacaagatggccactccactctggcacaaaaccattctcgtcccgcttttctacgctatcctgctgctgcatctcccaaccacccaagatgcgcgcgtcgttatggtgagcaagagagagacggtgatgaggagcctttcaagtttcaactgtgtgtgcgttcccgatcggaggtatggtggagttatggacaccttctaccttcccatgaatgaatgctcggccacgcctagctccgtgcatcgttggaagcatcacccgagttactactgctgctgccgccaagaaatttcaccacggctcatatggtcaacatttcgaatcggggatcaccgtaacagtgcggcaacccatgaagttctgctgaagtgagtttacatgtactgataaatgaagaaaacgaattcggcttggtgtgccgttcccttcctgctaaggttgtcatcagtctacgtaaaatgcccacaccagacccaaaatccacagcacgatcttcaacttatgagcagtttgttgttgaaattacacatccagacacttacttaggaacagcagggggggtgaccgggtgaggacggacgagatgtcgagatctatacggcgcgaatcgacagacgggacgcaaggcagtgggggcggccatgctgcagcttcggctttcagttcgccgctgctgttgcctccgtcgacgacgatggcggcggcgtcggggatggt

SEQ ID NO: 11290 - DNA, 1500 bp, Zea mays
agccagtttctagaaatcaggtatagaaatcagtttttttttttaaaaccgaggtagatccaaacagaaacaggcccttagccatccctgcttggtccaaaaattttttaaaaaaagagaaaaagaaatcaaaccgagcgcgtcgaggtcaatgcagggcgggacggagaaggagcagggaacaagagtacaagacgagcaacaggacaatccaaccaaccctttccattcccaatcttcccgtctccaagtctccggtctcgaatccctcccttccagaacaagacacctgacgccgccgcccccccgccggccgcacccgtccataccataccataccatacctccggccgctcgtctcctatctcgtcaccttcgcccggcgctcagatctccgccgcgcctctgcctgatccccccacccccattggagggagacacatcccgcgtgggcgcacgaggtacgtacgctcgcgcctcttccgtcctctcgcgcgaccgcggcgtctagggtcgccgattcgcgttctgctctgctctgctctgctcctcgactctcgtcagcagtcgtcccgcagggcgcttcgacggacccatgcgcatgtatgtgtagctaacccagcagctgaaggctctggattggcgctgctgcatcataggtagcgggggaatcgggacagtaataactgggatatgggtatctggaaccgtgggggttttgtgtggttctagatgcaatggagaagtgctctaaatacttgcttcgcgcacatgtactggttgaatcggactgcctcctttcctggttccatccatatccatcgatgctggctgtggctgcgctcatgtcaggctcggcttgttcactggtccccacagtcgtggctaactttatttactaatgtggctcgcacagtctagtgcaccgatccttatgactgctgcgacgtctaaacaatcatgctaagctcccaacatgacattgagccgtatgttactgctatacctgtcagctcccagctgaagcatcactgcaacacctgagacatcagtatattttaacaccagagtaacacaaatccgaccgctcgaacctaatggctacgctatgaagtgtgctggcttcattataccgacttaaggttgaaatatcaagctaagcaaaagcacccatgctctgattaacatatacatgacttatcatctccatattctgagactgatattatccctgatgagtgatgacccaaccaaactttaggtttcagctagctagccatacttaaaatcattgtgatagattatgtgcatgagggcattttattctaattggcttgatttttatgtggtattgatttatttttaacatgtagtttatcagttttaacctttcagcacatcctacttattggtacacgacttacctaccacatattatcttgcaggacctggtttttttatcaaatgcttgacaaaatgcttgcttggtgatgtctggct

SEQ ID NO: 11291 - DNA, 299 bp, Zea mays
ctgcagggcgccatggcgtcgctctccatctccgcgctaggcgcggcgacggcgagcagcagcagcttctggggcaaccggctcgccacctactccgcgccgcagcctggggtctgttcctgcttcccaattccgttccgttctgctgatggtttggtagataataagtagctgttctggtgaaagattttactctggagtttctggatagcgttgcaaagcgcggtcggatggaattgttctagggacattcgagcttgcattacggttttggagctagtctgtatggattggatgca

SEQ ID NO: 11292 - DNA, 1500 bp, Zea mays
atttgaagtcattacgaattcacataatatcaaattatatatttctaataaaatagaaacatgctacaacaacaatgttagggtgcatttggttggagagccaattgtcactactggacaaagttggaacactcggcaaagaagcttatttgccgagtgtcaacgacgaacgctcagcatagttaacggtcatcatctataaacgccgtcttctttactgagcatcttgtttcgctgagagcttcacgctcgggaaaacaacctttgccgagcgttgttatatgacgagtgttttgcacttggcaaaggttgtctgtgccgagtgtcgtagttcgccgagagtggcacccgacaagtgtagaatggagcggctccattccaatttctgaaaatggaaccatttcattttatgtttggcaagtagaacaaagccgctctattttttgtttggttgaagagtagaatataacgaagccgttccattcattgtttggttggagagccatacaagtgtgaaggggagaagagaaaggagagcgctcacatctgtaagagcgctcatatttgatcgttttggtggagcaggagcattccaaatatttgccatatatagactccagaaccgctctactccccttccgttagaaatcaaacatctagaaaacaggaatgaagaaagagaatgagagaaaaaaaggctcctcattagtagctagccgagagtggactgcacacggactctaaagctctctgtgtaagaaagatgtggatcaagtattaaatgtatatattgtcatatgagtatgtttttaattgtctatatataatatgacaatattataaagtctgctatcggctatactagtattaatcttgctctaagcgaccggtggcgttccaagcagcaagaacttgtttgtaaaaataaaaaagaaaagtatgaacaggtccctgccgctccctcatgtatggcagatacccatatccataatatataaaaatcaggatatataattatttttttatttaaaggccctgtttggcacagctggtgcttgttgaaaaagcagcttatctgagaagctggtgaaaagcagtttctgcttgttggttgcttttagtgtattctgagaagcagctgaactgataagctgctgcagaagctgcctgtttggcagaacttctgcttaaatttgtgaagaagctgaaaataagctgtgccaaacagggccaaaatataaaaacaaaaagataccaactaacctaaataatctgtcgaaaagcaagcaaatactgtttgcgggccagcgttgggcatggcccacctgccattgttagaggcgttagcccacaggcggacccgaatccagaattcctgtcactgctcgaaatcgatccgatctccgctcgcgctgaagcctgatctccaccgggttcgcagcaggggcgcaggacctcgatcacgaggaggcaggggagcagcatccacaaccacaagcc

SEQ ID NO: 11293 - DNA, 1425 bp, Zea mays
tccctcaagcgaggaatctccatattttggagtctctcacgccttacacaactgttctccaataaacacaagagtaaaagggggaagtttctacaaatattccaaaagtaaatttaagatgtaagattaatagttttattttataacaattagaatcggatagtatccactccatggtaaaataaatgttaataatacatttatttcatattaatacatctgtcttttttagcttttgagtttctgtctatgtgcaaatagatgattatttttctgtttatgctcaaatagttgatgataaatctaaacacataaataaaacgaatacattaattattgtatgaattaatttgaaagttaaaacgaattttatttgaattggacgttttgtcgtatattcacaaagaaatatgtgcagtcgcgggctgcgagggcggggtctggtcacggagccggtcaaggtgcagtcaagcagcgacgaggggaggcaggcggtcagagactcagagcgcgcagaagaagctggcgaatcagggcggctagttggacttgacgacttgtcacgtcccgtgcgtgccgaacttgccgtgcgcagcaacctacctaccccggcccaccgttgcggtcccgtgcatgcgcagccgggttccgctcccgcggtcaccggcgccggccccggccccgccttccgtttcagtgctcttcggctttcacgcaccggggcgcgcgcggttgcatttgcgtgcgccgctggtacccgaccgtgcccggtgagtcggtgaccgcggtgaagacttccgaggctctcgtggtagcacgacatatgtttcagcgacccgactaggcctgtgcgtggcgcgacgcgttccgatgcatggtccaagcctgcctgtttcaagcatttgttacagtgaacgagttatcaaccagatgttttgctgaccggataaggaatttttgttatttttttacaaatgttaaattaaaacaagaaacaaaatattcatgttttttcggtttgttactacgctaaattaaatcaagaaacaaaagctcgtcaaattaggaagcaaaaaaaaaatcaaatactaggcggcaatctaaggtaggaagccaaatccggcctttcttcctctcggaaaatacttaaaaggcccttgttccttgtacccgctgaagataagacccactaaaaacacgacccacatgtcagtggaatttcaaaacgctgccagttccatccccattccgaccctgccgccgcacccaccccaaccccaacccaacgggccgggtcccttcagattctcgacagtccgcgttaaataggccgccccgctcgccttccactcctcgttcccacacccctcaccgcgtccgcctcccctaccatctagggtttctagggttttcgaggaggaggaa

SEQ ID NO: 11294 - DNA, 786 bp, Zea mays
ggtgcttttgtctgatactaagtctgaacacgcattattgcaggagatattttagaaagcctactgcactgtcactgtaggccactgctgatagatcagatattcagataccaatcacactatcctcgatttttcatatgcacgcagaagacgaaattggttgagtggttacaaaaaaaccaaacactttccagcatatgcatgcaagggacgaaattagttaccagttaccaacactttcagcatatgcacgcaagggacgagattgattacccattaccaaaccaacagtttccagttcagcggtaggaacaggccgtcacggcgtcatccgccaaaggacaatccatttgctcacacaggcacaaacgctgagcgcctgagcctgctctcgcggtctagtaagtccccttgttgatccctcctgcaaagaactcgaaaactgctgttttgttagtgctatttctcctctcctcagtttgatgggtctgtgtcgatttgttgaaacgatgcgtgatgtttaacttccatttgagttcatcttcatcaccatgtggtcatgtggagctcataagctgttttgatttgttgcttagtaccgatatttcgtattttatatatcgtttgatcttacatattccctcagttcgcctcagtgcagtttatgaattgccttcatccattgctcgtgttgtttttgcccttcttactaacagatatatatcaactattagacaatctttatttttctgaccttctgaatttcccccaaatttgggcagggag

SEQ ID NO: 11295 - DNA, 1500 bp, Zea mays
tgaggacgattatgtgcggatcagtcgacaagttctgagacgaaaccttattctgagaagagggtttaatttcagccagcgtcgtcgttgtggccagtttgccttggttcttcgatcggcgtgcagatccgcgcgcggagagtcaaatatgtgctctgaagtttcaccgcagaattcagacatccaagtttctagctgatttacgtttgtgcgtgtctccagtgttcagtgctaccttttctttttgatggcatggtctaaaactactagctcgtactgaaatggcacgagcacgagacattctagctggccttgagacgatgcatgctcctgttaatgcttgaaataagttactctttgttttacatgcatacactaccgaaaacagcttctttgccgagtgtctgaagcactcggcaaagcctggaaaatactcggcgatggctttgccgagtgtgacactcggccaaagaatgcttacatcccgtttggttccctagaattggtccaaattgaattaaattccatatctcggcctgtttggatccccttagaattgaattggccatttcagcccatttctcgtccctaaaaatttggccttgtctcatttcagaccatcacccatcggaaagcgtcagaaagtggctagggttagccgtcccgctccgctcgcggcatcgctcgccgctcacgccgctccctgctcgcggcatcgctcgctgctcacgccgccccgctccctgctcgtcgctaacgccgacccgctctctgctcgcggcatcgctctgctccaatccgccgctccactccaagtcacacggaggcagccatcgcagcctcgcccgactccgcttcccctgttctttgggtgagttctctgctgatccatcctccccttgaaaatcttcgccgtcgcatctgaatgttcaatccgtatttgttcccccgtccggctagtccttgtaatcaattcgtattcgtattcggttagttctctactgatcctcttccctccgaatcttctgccgcgcgattaattccgagcaaggatggggagtaatcgtttcatctcggtagctggaacgaactggatcgtttcgcgcctttgtagcgctggtgtatgcgatgccggatgcccgctacgctatcaaagaacgcccctaaaactctctgaatccgcgagtcattctatcgctgaggtcttgttgcttcgccaagctttgatttttttagacaagagggggaaaatatctccgcttttattaaaagcaccgcccttattttcatttttcttcttaatcttccttgatttctctgtgttcaactatacggcaatccccacatgttctttgttattcttcaccatcagtctctagagaacattgttacgttgctctgaactcttatgacgggaaggtattagcagatcagaggtagtctgaactctgaactgccgatgaactgggaactgactgcgagggctgtttggccacaggc

SEQ ID NO: 11296 - DNA, 1500 bp, Zea mays
gatgaaacgattactccccatccttgctcggaattaatcgcgcggcagaagattcggagggaagaggatcagtagagaactaaccgaatacgaatacgaattgattacaaggactagccggacgggggaacaaatacggattgaacattcagatgcgacggcgaagattttcaaggggaggatggatcagcagagaactcacccaaagaacaggggaagcggagtcgggcgaggctgcgatggctgcctccgtgtgacttggagtggagcggcggattggagcagagcgatgccgcgagcagagagcgggtcggcgttagcgacgagcagggagcggggcggcgtgagcagcgagcgatgccgcgagcagggagcggcgtgagcggcgagcgatgccgcgagcggagcgggacggctaaccctagccactttctgacgctttccgatgggtgatggtctgaaatgagacaaggccaaatttttagggacgagaaatgggctgaaatggccaattcaattctaaggggatccaaacaggccgagatatggaatttaattcaatttggaccaattctagggaaccaaacgggatgtaagcattctttggccgagtgtcacactcggcaaagccatcgccgagtattttccaggctttgccgagtgcttcagacactcggcaaagaagctgttttcggtagtgtatgcatgtaaaacaaagagtaacttatttcaagcattaacaggagcatgcatcgtctcaaggccagctagaatgtctcgtgctcgtgccatttcagtacgagctagtagttttagaccatgccatcaaaaagaaaaggtagcactgaacactggagacacgcacaaacgtaaatcagctagaaacttggatgtctgaattctgcggtgaaacttcagagcacatatttgactctccgcgcgcggatctgcacgccgatcgaagaaccaaggcaaactggccacaacgacgacgctggctgaaattaaaccctcttctcagaataaggtttcgtctcagaacttgtcgactgatccgcacataatcgtcctcaagtattcaacttgctgaagaatcaactactactacgtctgtcagaagccacacagtgcatggggcggctcacagattggtgctccatgcataagatccctcgaaccaattagtcaactctcatgatctctctcgctttaattgaaatcatgataaacttttttatatacacccacttactcaccaactagctagatggcgattctctcaaatttttcttagatcttaagagaataatcaaagtagctatgctatagctatcccagtcccaggtcccagctaggttagctagatcttgtttgcgctacacaggaccctaatctctacttcctcctcctctcgatctgaagctatatatataagttattagcatcacttggatcaaacgaaagcgtcctcacacactacccactcagcaactcacagcc

SEQ ID NO: 11297 - DNA, 134 bp, Zea mays
ggttcgcccacgcgttcaacgagacgagctggcatttcttcgagctgcgcgacgacgtcgacttgtccgccaccattgctgtaggagggagctaagttcattgatcagatgtaatatggtaactggatatcttc

SEQ ID NO: 11298 - DNA, 268 bp, Zea mays
gctccattaaaccaaccctcccaccatcaccaaagatatatactattactacatagttaacaaactttatctgccttctgtcctgctaatctatatatcccctctccactactgctaccttctctcgcgcgtctctgctcaaagaataatgtcagcgtagcctagctagctcatagggattcctctttcatccctcctgagatcgacgatctcaccaattaagaacacacacgcacacagcagctacgtacgtacctagctagctagc

SEQ ID NO: 11299 - DNA, 93 bp, Zea mays
ggtcaagtctagggaattattatgttctagcctttcatggtagttgagctgattttttggggtgggctgagttacccatttttttaattggtc

SEQ ID NO: 11300 - DNA, 772 bp, Zea mays
accaaacgctagccattttttttagttaaatctatctatcctagacacaaatacgtaaagagcgatacactatcgatcagtcttgtttagattgttaaactaatgtctcaattacttatcaaatactctatccattctaaaatagtatttgttttatctctcgatttttatgtttatatttaactacatgatgatgaatccactaaagaagcaaaacgaattctattttgatatagatttgatatagagatagtattatttactgtacacatgatggttctagcgacggagagaagatttttaaaattgaaatatttttgtgaacaatttaaagtcaacaataactcaagagaggttaaatggcttgacgatcctatgagtcgaaaagaaattgttgaatgagattgatctcaataatataatcgatgattttgtatcccaaaatgttagaagatatttttaatgatatcagataacaagtaagtgtttttggctatattttatatttttcatcttataaacttcaaaacagtgcatgataatttttatacgtcaattatttgatactatatgtataattatatatatttgtgtgtggatgaggcctccatatcggatttcgtactgggctcccaaaaagttaggaacggccctgggctcaacctaactatcaatttgttagctgactaactattaactctaggattctaaacatggcttaaattgcaaatatccctttatttcactgatcatctaagctgttcctctctag

SEQ ID NO: 11301 - DNA, 84 bp, Zea mays
gaagaaggcatcaagaggggcaaaagcaaagcagcgggagcggcggccaccgaagcaggccgagcgaacaagagcacgacggcg

SEQ ID NO: 11302 - DNA, 1500 bp, Zea mays
gtagctagtattataagttaaataaatcttagcctacttatacttactactctgattctttttaaaattttcttgttcttttttctcatcttttactgctttactctaattactcctaccttttcactcataaagaaaaaaaatagattttacaccttaaaatcctacagctaagttattctcctaaaaaatagaagtcccaattctagacataatagtaggtaaaaaactattttatatagaaatttataggctcaaatgtttgctcttataggaaatgcttgatttacattttggttgagtacacctgaccgcgaggtagttgggctgggtgtgcatgccggaaaggagatgagagtgggcccaggggtaaagaataggcccgagagctctcccttctttcttttctatttctattttctgtttgctgttcttttttcaaattcagattcaataaagtttgaatttccaattctattagaatgctcaatcaaagaaaatatcagcatgcaatgaaaattcatatatatatatatatatatatattagttgttttataaagttaggaatatataattcatgaatgaataattcaatcaaacaaataaattggaagtctttctattatttcctttgcgaatttcaaataaaattttagtttcaaaattcaacttcagtttcgaaagtcaaatataatttctgaaaatcggcataagctaaattatttttttaatagtcagaaatgtggcatgtacgtcgtgtgtcataccaattatttgtcttgtttgctacggcttgctgcgactttaatgtggttgcggatgtggctcttacagtattttatctctacggattgcaggtgcagccacagctgctgaacatgctagcttttacgattaggtggtgataaaagaacatgtgtggttgctacacgtgagagtagttgtgatccaaataaataattacacagtaacatggtatagaacaccattgacagaacacctacttaaaaaccatgtttatttgaaagttcattgtaaaacctgtctttgaaagtaccgattcacggtaatgagatccaaacaaccacataggcataggcttaggttcggtgtgaacgtccaggagaagtcgaccgtcgtatcgtacaaacaattagtattataagctaaacaaacggcgcggccgtacgcggaatttctggccatatcygaagcatataacttccttatctttatagatcctgtacgcggccagcggcggaaatctctccgagagccctcgcgaattgaagctgctgggcacggctatctagctgtatcgctcgtcgagtcaactccccgcgcgcgtcgtctcgttcgagttctctcgcatctcgatcgggtgcgctacacgtagacgtagcgtccgctgatacataaaccgcacggcggaagctgctcggtgctctccctactagttccaaaaggaagcaaggaagatagcatcatcgatcgtgtc

SEQ ID NO: 11303 - DNA, 527 bp, Zea mays
tggagagcgttgatggcggggagcagatggggaggaaggaggatggggatctatgacgcgacaaccttccttgacgggcgcgtccgcgttgatggcggatgggcagaaccgtgcaccaaaagattgtggacgtctacagtagcgtcttaagtagtagtagagatttatacggtaagttcgcacttatttgcaggcgagccggcaccaaaacggctcatctcggttccaacttccaacttccacggataggatgagccacggaaaaatgaacttacaaaaagaatcccgtgttgggctgacctggaccttattgtcctaacgggaaatagatgaaatgggccctgcgatttggcgggagcctagtccaaagttgaacgtgagctcgagatagaacatggcccagctcagccccgagccgaccctgtcttctccgttcagcctccgccctccgctctgcctctgcgtcttccaccctttgccatttgcttgcaatgtctaatacctgagtgagagagcttcctcagtcc

SEQ ID NO: 11304 - DNA, 515 bp, Zea mays
gctctctcactcaggtattagacattgcaagcaaatggcaaagggtggaagacgcagaggcagagcggagggcggaggctgaacggagaagacagggtcggctcggggctgagctgggccatgttctatctcgagctcacgttcaactttggactaggctcccgccaaatcgcagggcccatttcatctatttcccgttaggacaataaggtccaggtcagcccaacacgggattctttttgtaagttcatttttccgtggctcatcctatccgtggaagttggaagttggaaccgagatgagccgttttggtgccggctcgcctgcaaataagtgcgaacttaccgtataaatctctactactacttaagacgctactgtagacgtccacaatcttttggtgcacggttctgcccatccgccatcaacgcggacgcgcccgtcaaggaaggttgtcgcgtcatagatccccatcctccttcctccccatctgctccccgccatcaacgctctcc

SEQ ID NO: 11305 - DNA, 398 bp, Zea mays
cgttgtgaactctcttctaatcgtttattttattagtcgtgttgtaccaggacatattgaatgaagtaaataataaaattagttaggtaaatcaaaaaatattatacggaaaacggagacaattaataaaaatataaatttttttggtatataatttacatgtatattattgtaagccgtcgtaacggacgagcaacactctgacttcaccacggcggaagcgacggcattggcccgaccgctcgcgccgcgtgcacactctcctcgcgtttcccgccattaactctgcaacctattctcttcctcgcgaaaccgcttccttcgattcattccccctctcccctctccaagacccaaaaccctaacccctacgacccccgtgaccgccgccgccgtcg

SEQ ID NO: 11306 - DNA, 188 bp, Zea mays
tgtaaaagaaaaagggcccataacgaagagatccgtgtggccaaggtcttcctctcctatatattgactcgccgccacacagatagggttttctctccacgcagcgcgctcctcgatccccaacaggcaacagcccagccgctgtcgccctcgttccgtagtacggcgccgccagatcgtcagtcacc

SEQ ID NO: 11307 - DNA, 1037 bp, Zea mays
gtgtcgtttcagtttactagagctgggtgccaatgttggtcaatcgttctcaaatgctatgaatcaggaacaaggcaacacaatcattaaggattaaggatcttcatcttccgaagcaatatctccatatggggataatacccatcagacaaaggtcatgaaggacaagccttcatcattcatgagaataagagtacatagagacaatgaatgtaatccattggctcatttacatatgtatttcataatatacacatgaacatttacaaaatttagattatattgataccttcggctagttcgaaggtgcagacgcgagagcgattacaatccagcgtgaacattatgggggtactgttcacctatttataggcacgggacacaacccagataaaagtacatttataactttaacaattgttcataattgtaacataaatcactaggaactagctagtctttttctcctcgacttgggctaagctgaagctgtcgtccttgggtggtagcttcgataatcgtcgttgttgcttctagacaagatcttcgtcttgaggaccttcggcagagagagagtcctcaaaatcacttttctgatgatgtctttgtcttgaggacctttggcagggaagaagaccccaacaactataaactttgattaactggtacaacccaacaagccctaattcgtttgcaaccgaggccaataatatctagatgatgacgcatttgggcggtttcattctgaaagcaaattttatctttgctgccggtagttgctgccttgcttcttccttgcgatcgactcggagaaaaggagacaacgaactattgtaaccaccaggaaacgatcagccgcagttgactccaagtcaagtagctgggctacctatctcgtctcgtctatataaactggcagcgattggcacttgaatctcaaacagtacgtgctgtctagagtacaagtgagtagttaagcaagtgcctgtaaaccaagcttgcttgcgacttgcgagacaacacacaacacaacagcc

SEQ ID NO: 11308 - DNA, 340 bp, Zea mays
ggtgagtcaccctgcccggcccggccctacctacgagctacatgtactacgtgaacaagcaataatgccgattggttttctttctgaagaatcgcaatgtcgagctgaatggcgatgattgacttcatccgctgctcttaccttttgacatatgatgatttatcttttggttttgctaagagcgagctggcaacggcttcgttcgatttttaattattcattactaggcaggctataaataccacattgtgaatccgtttattgttgctttaatacttaaatactggttacaaatgacgaattaagtgacgatttatctgcgctgtgaacgaattattca

SEQ ID NO: 11309 - DNA, 158 bp, Zea mays
gtgcgactctgaggatcctcctgaagccctgaccttattcaagtagtcagttcctgtttgctgttgttctgtatgcgtaacgacttttccaccagaaatacgtggagcatgcaaattctattgaagatctttctccacatgtaccactatataaagtc

SEQ ID NO: 11310 - DNA, 543 bp, Zea mays
cgggagggatcaggatctattcttcgatctagagtgtttcgatattaagaccatgtgcccctgttgagacagctccaactctaggaaattttgtggagttgatggagcaggtcattaggtgctctagaaaatcgtggagctagggctgtaagcctttagaagacatttaaataagtcactctatttattatttatattaaaattatttataaaaactttttaaatcgatattataaactatagctctccactagagctgaaactggagccaacccaaacactccctaattagactaagcctcacggtgcgtgagatcccaaaaacacgagactggttttaaatgaacccactttaatgaggtgtttggtttgatgaatcactctatccaaaataaagtggtgcatcatgggtccatttctcaaatttggtgggatgactccattccacatattagtactaaacaactaactatgacgaatgaggtgatgatggattaactcactccattccacaaaccaaacaaaaaagtgaagagtgagaag

SEQ ID NO: 11311 - DNA, 137 bp, Zea mays
cgttttcttcatttagtgaaaaatcgggaatggatagatagaaatcagggagaattatgctaacttttgagttcctttactgtgatccaattatcgctgattaattttgtctctgtatatgcaatccaccagcaagt

SEQ ID NO: 11312 - DNA, 255 bp, Zea mays
gtgagaagcgtgaagggattgcgaaccctcatcatcctcgtgtcttggacaatttggtgtgagagaaactcgcgaatctttgagcacaaagagaagaccgtgacacagactatagcgatgattaaggagcaaatccgcctgtggattctaggaggagcaaaacacttagcaaggctggtgtaggttttggggaaggggaggggttggttttgggacatttgtgtcaccatacttaatgtctccttccctagtgtg

SEQ ID NO: 11313 - DNA, 950 bp, Zea mays
caggcacagtaaaacgtacgtcctgtactctaaaattttagaggagattctcgttatatccagtggtgttctctaaatttaaattagaagacagtgctacatcctttgtatataaagtttctctttacttttgtctatccatttaatattttaaataacacatttagtaaaactaaactatatataatatacttgagagtataacatataacaaatacatacgtacaaaattaaaaataaaatatatctctaatttatgtatttacgtatagagaacgagatataacaagatataacaaatatatacgtataaaaattaaaaataaaatatatctttaatttatgtatttacgtatagaggaagagatatataggatgttgaaaaggatgtagatatagaagagagattttttttagaggagaacgcgaagaactaatatagagatgaatatgaattatggagatgggaatgtatcctgtgtttatggagctcttgtgctcatatgagcattttaaatctgatgcattcattttttattcaggggtgagtgtagtagtgacacatagaagagacatgccgggcgcggcacaacaaaggtggtcaaaagtgattgtatgagcacataagctccgtgaccacgggatacgttacaggtggagacagtcgtcccgcagtcaacagtcaccacctgaactgaacctgatgcggaggcggtggtgcggcggcccccggttttggcattgggcaggcacggacggagacaaatccgcggcacggacggagagacggctgcaccgccccacacccacccttttccgcgcccgcgaagaaaacgaaggcagtggaacccgaagcggaggggccagaaagcgacccgaccgtctctccgctccctccctcccccacaccacccacctgtgatctcccgcgcgggagatccgcccgcccc

SEQ ID NO: 11314 - DNA, 682 bp, Zea mays
atgcatgttaatgtgtgtcggtagcccaactttttatgaggagtctagagtcaaataattagatgaagatcaccatgtatcatacacaagtaattaaatggagatcatcatacatatggaactcccttgtctaatttacaattggatgttggtgaaagctgaaattacgtagaggtgtcctagtaatggaatttcaaagtttggtaaaaaactaggagtcaacatagtaaatgaaaatatttatgttgaaatatattatatacatggacacagtgatccaaccgctatgtagtgtggtttgaactacacaactaaagtagctaaaagaatgcaagatagggttgcgcaaaccggcttggtggcactttgttggtctccatgatccaagatatactttctgggtactgcgaaacaccttctcctacaatcaacatgagagatcgagggcaagtgggtcgttcaaagatgtgttaatgttgatattggtgccactcgatcgaccgatggtggcgatgatgaaagtgttgacaccttttgtcttcagaagcaaccccattggacaagaaaatcattgattctaaagatctcaacgacgtttaccctgaytacaacataaggctgactataaatgatttgttgatcgacgagcagaagaaatttaaagactatatgaagaagcttg

SEQ ID NO: 11315 - DNA, 1500 bp, Zea mays
aaaaaaacgtttaactatcacattataaaatttatatccatgtgttcaaaattttacactccaaagttaggaacatcgtactggcatattgtaaaagttctgctagctttttataaactttgtacagcccaaactttgtactaaaacattttaaactttgtacttttaggtccaaaacttaataaccctatattaaaatgccaactctataaatcacggatttaaaaatagataaagctgattagtgatgtagatgtgcgcgtagaaacgggtggtactctcctagatcaaattctagggttcgtttggatgtgagaatagttttcgtagaaacattttcaaacggtcaaagataatactagctctatctaaaaaggttgtactagaaaattacaattatcagcagggtagttttgagtgtgcaatagtgattacttttttgtactgaatctttgttgcaacaagttaaaatagtttacatttacgaaaatgtaccgagaaaaataatcaaaaaaataaactacatttttattatattttttataaaaagtattttgttgatgatacaaaatctattttgatagttaatcgatttcataaaaaaagattccgcttcagaacctcaaatgtttttataaagaaactaaaactgatttgtaccagcatctgaatcggggactgacataattgataacgcgccaacacggacacacatgtttattagctgcgacctccgttcacaaatatatgatactgttgactttttaaaaaactttgactactcgtcttattcaaaatatttattcaaaaatataaaattttaggtgaaacactaactctcttaaacgataaaacaaatcacaaaaatgataatttattgtttttttaataagacaagtggtcaaagttttttaaaaaatcaacagtgtcatatatttatgaaacagagggagcaatatttaataaatgtaattgattgtcataaattaaaattcgttttagattttaatagatcatacactaattaatatatgtatttttgtatatatctagattattaataattatttaaatataaatataaaaatcagaagctaaaacgaatactaattagcaagcaataaatatttgggctaaactgtaggtagaagagaagtgtcggagtcctctacacctccaacagatcaactgtgtccatagcagattagcagtacgatcttttacgtttttgccacggcatccgcagggagcaccgccacccacagcccacagccacagaccagaccacagagcaaagttggccgaagatccaaactcaagctctgtttgacccttcgccgctcacgtggatttggaaatcgtaatagctaggatcagatcatttcaacttcccgactctcgcatcccggattgttccgccgcccgcacacgtctctcctcttccgttgctctcctgcctccagctctccacggtctctgacccgcacaactgaacccgcg

SEQ ID NO: 11316 - DNA, 290 bp, Zea mays
ggtacttaccttagtgaattaaattttacaattttaagattttactctcagcagatttggaatacctacatttttattgctggttgtgagcaaaaaaaaaaatttccccacctgagttcacttattgagttatgtgggagtttcatttcagttagtagtagggtagatttggcagactcggttcctacctagcgagtgccaccgtcttgtacgcatcgcttrttccaaataatcatgtttctacctccagcttctacaggtgcagcttcgaccaagtgaacggagggcag

SEQ ID NO: 11317 - DNA, 804 bp, Zea mays
tcagaagtgacattggacattggatttgcacactaccaggtctgcccgttgcactgtgatccaagttgtacctgtcatattgaggggaagagctgtgctagtgtgaaactttctccttccaggatatcctcctcaacgacctctctttaaatcccagcatttggaatctactccaaactagagtaggaaggaagcatagggatgatcaaatgtacaacatacattttgcatgctctgtaggaatttagcttccctatgcattttttgtgtacattaagactgtaattcttttgttgtgccagttttgattcaattgcagtgacatgccatcatggaccagtatgtagacagattttggtttcgagaaaaaggatgtaccaggaataaaatgtcaaggaatggaactcctttgcaattgcctcattctgatagtgacaggtgccattggaacaaaactgaccactaaccagtaacttgaagtgatgaaattacacatgtttaagaaatttttgataaagcagcgtctcagtagaaaggaagaaggttcctgcaatgcatgtaaggttggtaattcatgcctttctaagctgtgaacttttgtaggacgggagtggtttaatccagtggaatgcagaagctgtgaggctcctatgctgtggtggaatctgcgcatgaccaagccaactctccacctgcccaaccgagtcaccaaaaaggggtgacacactagccatactgggtacttcaatgtgcacaatataaactagctgggatcaaatacaggagcacctcgagtctgagaga

SEQ ID NO: 11318 - DNA, 1429 bp, Zea mays
ctgcagttgactttgctgctctttttctctttcaggctctagttttcatatatctggacctttttcccacctactgtatagctgaaagtaacatcagcttttgttgtgagcttgctttctctattgggatgacggttagtgccttgctagctttataatctatagttgggagggggtgtggatcaatgttaatgaaagaatgggtagagatcttcctctgttctccgaggaggagtaatacggctacaacctacaaagaaactgatgagtggaagttcatgctggttatgtgattactagatatatgcatgcgtgttgcacctagaccgaaattttgttcacatcaatggaaaccgcgtcttctctgtgccctctactgacgggtgggtcaccacggtcagcgaccatggcggtgctaccaaggctgacgggtggggtcaccacttaccttactcaaattaaatagactattatttagatcatttctcattcctctcctactgcgagctcgtcacctttagcctccctttctccctattggctaccactaacgtcaacgccttctatggtgtcgtcgatgtcgaccttttatctcttctctctttgggatcctaatgttaacccgtgctatatgataatactttgtatccataaggtattgttcggttattcatatccatttagattggatgaggttgaaaaaattatgaaagattttgatttatttaggatttaaacccaaccaattcacatgaattgagagcaaaatgaataagccataaaccatatttgtttcgttggaattaaattctattctaataatcataatttagacacaaattaattaagttaatatatttgtatgttatcctaactaatttgagcgatatctatacactacatttatagcatagagaagcaagtagaagagggtgatataagttgtacaatagaaaagtagtatgtaaatatatagaatcaatttttatctctcgtcctataaatctataaatttaagatagatttttttaagttataaaatatcacattcttaaatatagtctacttcattagttacattctaattattcaaaatgaagggaactaatctgaaactatcagatctgccggcagaggagggccacgctcatccggtcatcccgtcatcggactcggtcggacacagggtcccggactcggttggacacagggtccagcactccagcagccagccgtccaggcaccaggctcatccagtgttcgagtcctcgtcgacttcgctttcccgattcctaaccccgcaggccgcaggctcgcatcgccaagcatcttccgcgtctcttcggagacatctagtaaaagcatcttccgctactccgccctccgcctcccccgtctgcttcgcaatccgatccggcgaccggcggcc

SEQ ID NO: 11319 - DNA, 946 bp, Zea mays
acacccgaggggagcagtaaatagtaactattatccacctctccctccactctcctaaagtgtctatacataatggcgtagataagaaacatatgcgtcaagggctagtttgacaactctattttctaagaaaaaataaattaatttcacttgagaaaataggaatgccatgggttgccaaactagcctaagggcctgtttgggagagctttacttcaaaaactccagttttggttttccggctttaccataaaacagcttcaacaaattgttaaggtgggttccagtagcgtttgatttgtatatgaactccatgttctatagtataattaatttgtgtgaatttacttgattacccttgataattagtggactgtcgcgagagagaatgtaagttatatgttgcgtaattagtggtatggtggataatttccgtatagcttaatgagaagatataaaaatagtatttttaaaacactctctaagtagcttcatgaatttcacgaaattagcctctagtttcgattttctttaaagatagagctcgtagagctgaatctatttgtgtggaagaagttgaaacgaagttaaaattaaattattgaagttaagttattccaaacaaaagtgtagatttttttttcgcttgttgcacctccagcgtttcgcttcacccgaaaaaattccccaaggatgaagtgacggacaggggaagtagagctcaaatctcaggcaaacgacagggtcactcacaagtcacaactcacaaatactcttctcatttcctctcggttctgctcagctgcaacccagcgcgtagatcttattcttggacgagaactctcctcaagctctccgatttctgttctcgcgccgcttagcaattcaaccccgaaattcttttgcggcgcagtcttcacctgaatcttgggtcgtagccaagaag

SEQ ID NO: 11320 - DNA, 1413 bp, Zea mays
cctcttttatcattctctgactcaagttttctgggatgatctatagaagattcagagcaatgagcttaaagcaatggatgacttttttccaaatggttccatcgctcattgccaacatggtggacaatagggtgcttctcaaggataaactactgagacgagggcatgaagccaagaacaccattcatacctatgatagtttcctactaggggctgcttttatcctcaaggtaactttgctccagtgctatgcttgttccattctgcttttgctgtaccgggactaaatatttacggatgtattctggtgtctgacagtcctatgttctctgagttctgactcgagtctttgtgttttgatgctttgtgtgaggtattggaacaagaaaaaccggtctgatgaactcaattggtttgcttccacaagaacaagattctagggagagccagaaaacaaggtcaacaaaaaagacgcaagcgcaaattggtctgctttcgccaacctgaaactttggcgtacggttggaacagaacatcgtaaggtactagtacttcaaccttgtctctcattctctatggcaaggttctttgttcagaactacaaaaactccattggttctacttccaaatataggcattttttgtatttaaaaggcgaaagaatagttgtattgtcgaatgccgctataccgttctgtacttccacaacagctcaagcggtagaatccaggaaagcagtctaatatttatcggggacactgtcacgcactcatgtgtcagttttctattgagttggggatttatatcgtgtatgcattcggaacctgtaaaatctgttgaatatatatccatgaacctgaattggaaccaagtctcgatgggatgatttgaattttgactggtctctcaaaacatgatagcttagctccgtgacactggactcaaaatcattaaatcttacatcctccgttccaacatatatttcgttttttattatagtttgtatgtatacatttattatcatacatttaaatatggacatggaccaaaaaaaatactagaaaaagctactccacctattttaaaataatagtcgttttagctctttatttttattatgtctatatttaaatagatgaaaatgaacgtacatacatatataaaacacatatatataaacttgttaattaactaaaactaattttaatttagaacgagaagaagtaccaaaataccagttaatttgacatcggctcgcaacatccccccgttcacccaccacggccacgcagcgccgcacgaatctcggcgcggtccgcgcctgcatcttctccctcgttatccgctgggtcactcgctcgtcgctcccaagtcccaccaagctgtcccccgaccactccgccgcccgctcca

SEQ ID NO: 11321 - DNA, 115 bp, Zea mays
tgtgacgcggtccctggcctggagtggaaccgcaacaagtgaagccatgatcccgccgtttcgtttttgccccctgctatttttttttaggaatcagtgatccttttttgtttag

SEQ ID NO: 11322 - DNA, 466 bp, Zea mays
ataagctcatgctttgtcaaatgtgtttttatgatatcatgaaaaaattgatatggtgagattgcatatagtttcagtgggatttggactcagacagtctaattttctttataggtaacatgtattcagtagttctcatcttttgtgagtgtgttagtcttatttcaattggcaaacctgacatagttccaaaaaaaccttactgttagtgatgaattattgaaatgttattttcttcttttgggattgctacacttgagtaagtaatgtttgcaaaaaaaaacttgtctatgaagacttgctgcatgtgttgacaattgaatcaacattttgcttatcatggggatgtttcgctgtgatttagttcttgtacatattccaccttctgcgaagaaaagtccggcagtctgtgattgttatctatattccattttactttggtctcgcaggttaaagtccgacatca

SEQ ID NO: 11323 - DNA, 1115 bp, Zea mays
caagctcgcatgacatgaagtctaaaaaatttactgtctccacctccattctccctttttttcttcgggcgtttcttctattcttatttactctcggcaagcgacttgtataagtctgttgaggacgccctaaaacatggatttgatagactatcatttagtagtaggcggcgatgacaatgtgtaccttttgcgagctggcaccatacgtacgtagcgagcgcgggctagctagtgagaggtcgacatcgtagagttgttttttagcttttttgatgaaataaacgtgtttgtatttatcatggctttgaatgataccggtgagtggaccgccgaaatcgatggctacccgatccagcaccgtatatacgatatctggttgatgatgattaaatgagtcagctggcgaactgactttgccgatcgataatctggaaatcattgttattatacactgttaaaccaaacgagatttttgcgaatccatacaatcacgcattacctagctagcaagttgaaaacactagtaccccttacggtcgatatagttatcggccgtcaaatatatacagctagtaacggtcctttgccgaacgttgtatttcaccgagagcttaacactcggtaaaacctcctttaccgagcgccagcgtatgatgagtgttttacgctcggtagagaaggtctatacagagtgtttttgtttgtcgagagtgtggtactcgctaaagcatattttgctgagtgttggttgtcctcggcaaagagactgatttcggacactactgctcaccacatgcatatatatgcatatatggaaacacacaatatttagctcaactctgcagtctagctacacacaatagagcgcagccgcggcgtgatatggttctatgatggttctttgctgttggctagatatatatgctgctagctactaggtgcgtcatccccttgctatgcgcgggttaagtatatatacacagtatataaaaagtatataaagtcttgctgctggcttgagctccttggatacacctatctgcttctgctagctttctttacagagacgacaggatagctagagccgagggagagatcagggtcgacgatag

SEQ ID NO: 11324 - DNA, 744 bp, Zea mays
attttagttctcctaataaggtgttgctgggagatggaccattcaaggatttttgtcgttctctttgtggttctctttgttgtgctaggtactttggaatgaaacaaatgtgtgctgttatattcaagatcatgaactattagtgtgctgctatttaaaacaaaaattcagaagttgttagtgtgcatatcttctgttattaagctgtggtcaggatgtttgagttgtggtcattagcttggaacctgacgctaggatacatagaaaaaaattcagagcttacgctggagctcgccgcgtgcggcgtgctggagcccaggcgcggtccagaaccaagagaacgagcgagaggagaacagagagaatgaagtgttttgagcgacgggagacagagaacgagcgactgcagtttagtttaggggtaaaacagttcaatcagttgatacatttgtcaaataaccccctaaatgatattttatctataagtcaatgttttagaatgacgtaataacgaagcgtgttctcataatatcattggagcgaatccttagtttgatagaattccaattttctaagcacatcaacgcgacattccccttctccttcccacgttttccttcaagcacgcccgtcctaccccgcttccgtgtccgtgatcgcccgtcgacttttgcgctgccgtagcgggttgaagcggagatccatcgcctggcctgccgcggagtcagtcccaccccacctgag

SEQ ID NO: 11325 - DNA, 1500 bp, Zea mays
gcaagtggggcggcacgggacgggcagtcgggcacacggagccgcggaggcagagcaaagcgacgacggattttttaagggcgaattcgccctttgttgtgtagcagtgtagacgatcgagctagaggaaaataaaatgcagaagtggttgggcatatatgttcggccactctgcagccgtagctgatgtagctgtttagactaatatagttgtaacctatagagacaaaatattatagaagtcgtagctggattaaagtcgcagtttaccacaatgaacaagttgtattcatcttgcttgtaatcaagaaccctagtagtagcatcaaacaacatttaattcaacataatgttttacacaaccatatacgcactgatgagcatggtcttagagctagaactagagatgtatagaaagcttgtggcccaaatgctagcccgaaagcctgtttgtggtccgttacgagcccgacctgatctgctttatatgggattggaccaacccgtcacgaataggcggtcacggtatggacagagaagtgagcccattaggctacccagcccgctagacctgttttttgtgcttattcgtgcttatcaacctggtaaacccgttaatcagctcgtattttctgtgttgattgggttggcccagcccatttaaacccgtagtgagttgaatccagagaaatgagcccgtagtcctagaaggctcggcccggtttcctaaccgcatgcgcggcctgggcttcaccagcccgtgtttgaactcaggccaaccgggcataacgactttgtttctaacaagaatataattctaggtagaatcagatttcaggccttgatatgatatcaattggcttggttatcatcatcgtcacaaaccagaaacctcagagcaaatcgacgagaaaaattgtttcggcagctagctagggcaggggaccagtttggtagctactgccaatcatcatgagttgactccaacgaattccggcatgcatgcatgcatccacgccacgcgtacgagtacagcagcagcatgcatggcttgctgtgaaacacaaacacacagcgcaaagacaagagagaggtagcaagtggcaacgacgtgtgtaaagcaagagatttcatgggactactagactagaatataggcccgtttgcattcggtggcctctatgctgcagcagagctgctggttggccaggccgccagtatatatgcaccggcaggcggcagggctgaagagagagagatcgaggagcgcaagggagaggagatatatagtgcaaggaggagcctcgccaacctcgaagctagtccaaactagtgggaggttgtgtgcagtgatcgatcgaggaagacgagaagcttttcgctgctagctaccgcccgcccggtgtctgtcgatctgtgacgaccgccaagccgaagccaaaaaggcagcagcagtcgtcaagttcatcgatctcggcatcgacgaccgcccggccgtcc

SEQ ID NO: 11326 - DNA, 260 bp, Zea mays
ccctagaaatttaatgatgattgcttgctaggattgaagaattgaacatttctcttgctagtcttagattagaaaatgaaaatttgattgctaagactaaagattttaatattactatttccgaccttagaagtaagaatgaaatattggatgctaaggttgtagaactaaaatcttgcaaaccctctacatctaccgttgagcacacttctatttgtgttagatgtagagatgttgatattaatgctattcatgatcat

SEQ ID NO: 11327 - DNA, 110 bp, Zea mays
ggtatgaagatttccatcacggaaattttgcttttgatgatgcttctcccttgtcaacagaactgcaggctgttccttggccatagtcttacaagccgcctcagctcccc

SEQ ID NO: 11328 - DNA, 158 bp, Zea mays
ctattttcccttctgaaatattggtgttgtattgttgcaaagatgatctaagagttccatgctgacaatacctctcacgaacctgtgtgcaggacaacaccaatttgatgctttctgaaactagacaatacaacctgatggtaaaatgatacagagtt

SEQ ID NO: 11329 - DNA, 216 bp, Zea mays
gtcagtgtagtggcatcagatctggaattctcagaaatggttatcttatctcatgatttctttaagcacttggtttttttagaagatagtggattgaacattgtttcttgaaatttagttgtttttttccgtatacttctccaaacaggcctgcttgactacattatgtgcatattgtgattctcagcagaggaagtcaaagattttggagtcaat

SEQ ID NO: 11330 - DNA, 82 bp, Zea mays
tggtggccccttcgtcccttggacgaggctaaggctagctagagctggagactcgagagctgcggatgagcggagagaatgg

SEQ ID NO: 11331 - DNA, 925 bp, Zea mays
cgcttcaactggacttgtgtatatacagcatacatcggaagatccgcggctaatttctcaggtctcaatcaagcgataggagcgtggtttcgcgtcgagtgctcactcatctcaagcgtcaccgtcgaccgtggagcaccaaatcaacccgtgagacggggcagattagattcttcccatccaaggggcggtcgcaatgatgacagatgataaaggcgaggttcgcgtcgtcagtattaacgataaaaaaaacaccggcgcatcagaatgtccaaagtaaaactactactccttttttcattatttatcttcctaagactgccccggttggaccgaaccaaaccaaaccaccacctcgtatcgtctgtgcccaccgtgctagaataatagtatcgcactgcacgatgactatttccttttactttaagttacaaaaccattggatttcttacattacaaattaatttagttctaaataaaaataaatcatttttgatttatgatttattcgattagagatggtgtaattaatttagttctaaataaaaataaatcatttttgatttaggatttattcgattagagatggatgaaatgagatagaagtggattaaatcttcttctatttaaaatagaaggagatttaacctcctcatatcccaccctgttcgaaggagcccaagcccaaggggcgcacgcgcacgtgggttgagacgagtgatcactggccacatccggacccaaaaatatcacggggtcgggggaggataaacatgagccgaacccaaccgggagaagcagagggagagcagtcaccaaaccaaaaccgctctcgagtctccatccattctctccgctcatccgcagctctcgagtctccagctctagctagccttagcctcgtccaagggacgaaggggccacc

SEQ ID NO: 11332 - DNA, 777 bp, Zea mays
tgtcaataaatatattttttaagttatatatcttttctattatccacctatcttagatttgtttgattcatgactcaattttaaaatcttgttttagaatagtcatattaaggaccgtcagaatcggtttctgccagtcaaattttttgtctctggcaatcaaaagttttgcttctcatgttacttatatgagaattgtttttgcgaaaatcgtataaatcaacataaacacataatccgccgagtcatcgctgcgggagaaatccactgctttctgactttttaaccgtgtaaatatcttcatcttactccgcatgcaagccctgctatgtttatattctttgtgatagctagattatctagaaattcatattgttagaaaaagctgtcccgcgtaggcttaaaatactagggcatcgtttcatttataaaaatcacaagcatttaaaaaaaaatccagaaaaaggacgaacgatgccatccaagtcaccatgtggcccaccaccaaaccactgtccacgagtgtgctcatctcgtggcctcagcttcatttataaaaatcacaagcatttttaaaaaagaaatacagaaaaagaacgaacgatgccatccaagtcaccatgtggcccaccaccaaaccactgtccacgagaccacgagtgtcctcacactgccaccagtaccgccaccaaccttgtccttgtgcgttccttgtagccatctccgactccgcgcctccgctgcctcccgaaagcattgccagttcctccgcacaac

SEQ ID NO: 11333 - DNA, 1384 bp, Zea mays
tcggacagcaaggatgggagcaaatcaatccataaatcagctttaatttcgatcatatccaaagtggctttcacctaaagtacaatcgaccactacacccaataaagaggcgccaaatgcatgtggttgattgcatctccatctatctatactatactatacgtctgtgtgttcttctctctagctcgtcgatgatccatcgattgtccagtatcgatcaattgcctttattctaacttcacacgaaagtaaaaatcattgcgcacttgagcaaactaacttctactacttgacaaagccatatctaaaaaaggactcactaaaatttaggtctccgaatttaactttccatttacacatatgttttatattaaatttatagttttatttccttgcaatttcagtaaacacaatctataaacttgtaagacatacgttcaacaaaatttaattatgttgacaactaacaatttacaattatttctatagtcggaggaaaacaaacatttgatatgttatgaaataaatataaataatagattaaaaataataatttacttatactagttgttggtacaagctaggatgttatctggaatcgtattaattaaggccggcaccctagaaatatagatgcttatgtgaaacagattaagtctatcatgagtatgtatcagtaagaccacactggtaataatcaacattaaacagaatagattaagcctatcgtcgcaatatatccataaatctaattaaagaacatctggagatgcaagctaaggttgtcttcattggtaatggtactggtagcaatcaactgtacttaacttattgcagctgaaaaggttagcatgcatataaggggttcgaattaagaaataccaccctctccacaaaccagtccttttagcccccaaaatgtgtgtcacacaaggtgcctttccgccaccactttacaatttgataaagcaaaaggagagaaaaatcaaagactatgggggaaaaaaagaaacatccatgcagtagcctgctagtgaaataaagcaagggctcgaaagtttattcagaaatgaataaaggagtgaagcgaaaggaacctgcaggccagggaatacaaaacaaaacaaaagctcagattcctctcctctccaaacaggtcctatcccttttgcttctcccttgctgttgttttctccctctagagactagagaccccatctctagaaagagaaagcaggacaagcaaagctaccggccagacagcagctagctatagctctaaagattgccctgacctgatcagatgatatgagctttttgcaagatggtggctatagcagctagagtagtatttctgttgtgatgtgctcaagccaagcatgat

SEQ ID NO: 11334 - DNA, 914 bp, Zea mays
gattacttatgcatcatgtgcttttgttgtaggatttgtaaattacgaagaatgtcgagacattggttgaaacttgttgcagcagataccgaagaagtgtgaatatgtttgtgctcaagaatgctctacgtacatagttgctcgttaagtagtccaaagatagggaagcaaaccatttttatgctgtgctatagagactagaaataaaatagttgaggtcttggtgagtagaggctttggaatcttagatgatgagtcgcataaaaaataactagatctttcatgcgtattataagctattagtatgccgtttgaactatttatattgaaacttatggtttaatgttcatrtactagtatctgtataccgaactgcagaatatttttatggtactttgttaaattggtaaatgtatgtattttatcgaattttgcgtgtgggattgtttattactatacgtacacactacagtagtgctacacaggcccacaggccaagattgggtccattacgctactccgccccttttcatgtttttttttgggggggggggggggtgtcgaaaggacgaaaacccgcgttggtagctgttcacatgaagcaaagcatagcttcgaaaagctctcatggcagcaagaacacacagcagaacctaacgccacgccacgcaggcaggacggcacgtacagagagcgagcataaagcgcggcagaaacatatacctgttcgcagcgttcacgttccctgacattgacgggaagaacccgtacggtcgctagctttctacgcgcttataacggccctgaaccacctggatcgatcgacgcaagccaacgctcgatcgcaaacgcacacgctactctctttttttttttgttgttggtggtgaggggctggctctggctggatctgg

SEQ ID NO: 11335 - DNA, 269 bp, Zea mays
gccttttgctgttgtggctgcatggatctgttcatgcgcgtattgttctatctcatgggtgatgcctgctatatgtttgtattcctcagtggaggatgggagcctgatagattcagctagtgcctagttgttgctgcaaaggcttgaacattagagtagcttctcgtagactttgtaggccgcaatagtttaagttatttgatttgtacatagtagattctcgcggactttatagtagaattaacattagtatttgttatagtttcata

SEQ ID NO: 11336 - DNA, 639 bp, Zea mays
cgtaagttttcgtcttgcctctttattttttcttacaacatgaagtttacgccaacagaataggtagaatgcatgtttaatgatgatacctttgctaatgttatcactagggaatagttgatagcgtgtagggcatgtctaatgtgtctgcagcaggcagcataatattcgaccttaattatttttttattaatgttttttaatcatgaccaagtggctcctcctgtgacatccaactcaatgggtcctatctgtccattggcattttcaataatatctcacttctttttgcttgcatgtgaggcccagcaagacaagatgccttaggaaataaaatgctactytaattcagtgtttgggaaagtagtaaaggaggaaatttcagatctcaaatggcatccatattgaatttgaaaattaatgactaagcacaatgcaaaaaggagatataatagggtctaaaaggatatgtattaggtgttagaggcacaagtgttagggttagatatttcactagttattttaaaattttattgttacctaatgtttttaagttgtggtatgatgctgcttgctctttgaggccctgactcttgcctaattattttgttgcaccagattcctgtatttttcatacgt

SEQ ID NO: 11337 - DNA, 694 bp, Zea mays
ccccacttgacagtttaacagattaacaattctcggctgctcttcaacattagacccccaagactagaatttcagacttacgattgaattggatatttaccattacaaagaaaggagttcatatatttaccatcagactcagatgatccataatttacagacacagtgataattataataaggagacaacattttaagtggcaaaatactaattattctcttatcttgtctagctaactactcaaatcaatgtaagagaaatttcgaatttattatccattgatcatcagtctcctagaataaaaatggtatcattcctccggtgcgggcttcattcggcatcagacccaagaatggaatgttgttgctgggctggctacagtacagtacaggtgcaggcttcattcctccagtggcggcggacaacgccgaacagacagaagaatactgtagagaagatcgtcgcacccaccggaggacgagacgggccctaggcacaccacgcaatcagccgccccgcgcccccgcccgcggttggcgatgttgccgtgacgtcttccagggaggagaagccaacatcacaaactccacgacgaataactggcagtagaagccgagaaggtaggcccgctcgttccaacatcacaaactccacacggctctcctgtctccgctgcccgctccacctccctcc

SEQ ID NO: 11338 - DNA, 406 bp, Zea mays
ggatttttagagttgaatgagtgtggatagccttatataaaaccccaaaagtagtggaaacgatctaaaatcttccacgacgtgaccagcacgtggagtcatggacgggacgatacccccgcccctcaaaaacaaaaggtctcgtgggaatcagcgtcatggacagaagatgcttctgccccgtttcttctgccccgttcgcacgttcaagggccacgcacctctccgaaaaatcaaagcacagcctcctgtagctagccctagcttgagtctctcccggtctcccctcacctcacgctggttgcctatataaacgaagatcagatctcgcaccggcgtagcatcacacggggaacacacaaaacatactcctgccgaagcgctgagaagtagctagacaagaata

SEQ ID NO: 11339 - DNA, 623 bp, Zea mays
ggtatatttcttcagttctcggtttctcgctcttatttgctaaattttcttgttctttgcctctcagaaaccacttggaggtgggagcagcggtggtccaggacaagcgtcaaagcagcgaccatcaccgtcgccagctccatcaacaaccccgccacaaccaccgccaccgaagatgtcgaagtcgccgtctttcattcaagaggaaatcgaggttgccgaggtgctgttcggactcaccaggcagttctcgtgccctcccaaacaagaggtcaaccacaagctcgatcccagagatgtgccagagtccaagtgtgggaactcttcgtcggccccctcttctggcgcccgaccctctgattccacctccctttccgctataggtgtgtagctcttttcattggtggctttgccttcgttttgctccctattttgccaattttgtaattttggtttttagggtctaatctgctcccctgctgtatcttgcagcgccaaagaggaagaaaccacggctggcgaagtacgatgaagatagccgtccggcgagcccaacgaagccagagttggtggagccgtcctcaaagccggagccacctcctgtggctagatcagaagcaaag

SEQ ID NO: 11340 - DNA, 698 bp, Zea mays
tgaatgaataggctaatggtgccttcttccccggcccgtcccccacccacctcctaccaccggtggacgattagatttttcccggctacccgaaaccgacacgtgtcagtggcggcccatgcttgagccgtaaggaagaggcagagggagagattttattgagcgtcagtgtgggcccggtaaggatccgacggtggcgggccgcgctacggtggcgccctcgtcgccggcgctgtcggatgcgggatcggcgggtgagaggatctggaccgtccgatgcgggcgtgcgcagcgacaaaaagaagatgaggtgaggcgggccgcgggcgcctagaaagggaacccgacggggagggaaacggccagacgacgctcagaccaaagagcgagaagggggcaagcggcacgctgccggaaaagagaggctggcgtggtgaagggcagggcggagccttgcaccgcagagaagccagaggagcgttagtagtagaagagcagagagggagagggaggaagagccacgcgacgagagccgaggagccatccaccgcccgcctaatccttggccgcgctgctagattcgccagaattaccgaggcgctgctccccggatctacggggcggcgtcggtgctcatcggaatccagagaggtggcggttgtttgccggggatcggcgccgcatgtctcagatctgag

SEQ ID NO: 11341 - DNA, 350 bp, Zea mays
agctagctgatcgatccaccgctctttcgtgcgctctcccattcggccggtatgatgccagccagattgagcttgagcatgctcatatattttatgtatcattccgtgcgcgtatgcatgcatgtgcatggcgcagtgtagccatgcagctccatgctgctgatccgtctactctacctacctgctgctgagtgtaccgcattgcttgtctttatctgtgtttcgattcgatttagcattggtgttgtcgaatctatttgcttgtaggagtgagcaagtgtttgctgtactgtcaactgagtatatatgtccctttgagatctactagctagggactgggagatacatat

SEQ ID NO: 11342 - DNA, 1413 bp, Zea mays
ctaagtcggttggtgtctggagggatgggaccaaacagaaaggagcaagaactttggggcgcaaggactgcgctacgatcttgagatatggtccatatggatgtcatgataacgatgcatgtacagaaaccttgtccgtgcctattcagtaatgtcgttgatgagtatcttccatcaatcacatgtaaaatttctaatgttatcttgtattagtagcaggggattgcttgttgagtggaataccaccagttgttcagcaacagatagtaaactccatgtgcatttggaagtcacttttgtgatttgtgtccaaccattggttcctgatagacagtttaccaaaaacagggttctttctgtctttcaccgaactgttggtctggaatttggagccacaaattcaatcgcggcaatatatatttaggcccagttcggttgcctgggaaggcttccaggccaggaaacagtggaccactcaatccagcccaagatttgatctagatggtaagggatcgggattcctaccgggctatggaggaaggggaactttaaaccgggccgtttttgtttttatttcgggttgaaacgaaaatctcagggctggattccaaactggataatttttccagccggtaagaggcatagagcggccggatgaggccgaaatggacgagaccttatgtgttgacgccaaacaggttacatgggtagtgtatcactggtcttgcattgtttgttttcaaacgagcaagcaagcaagccagagtgtgtaagcagggtttaaatgtaagcgtgtaagtaagcgccttctggtctcatgatccaactgtgaatgtaatcgtactttgatagggttatttatgaagttgcatgagatgatggtgtaagggttcaaatgctaaatacgatataatacggttggatcatatgatctaactgactagaagacttgattgcacgattgcacctaaggtctgcttgcagtctacacctctacacgaagcataagagacagtagtgttatgagaaattgatgtattaacttgttgagggtcaaaatgttcctttaggtatcctttagcgttcttgtgatcaaaaagagatatatgaattgtaatgatacttctaaactttgaaattcgtaatgattcccagacactgttaggttaacaggccgtgtaacattttgggccaggacatataataaaactcagtagattgaagggtaacaaagaagggaaacagaaccattctcccccgcatacctctgcctgcgccctgcgagtcttccctcgcttccattcctcattctgttctccgagagatctcgttctccgatgatcgccggttcttcgccgccggtcatcacatcccacctcggcagttcccagttcccaccaccagatcgccacg

SEQ ID NO: 11343 - DNA, 118 bp, Zea mays
acaccattccatcggctatgagtagcgagtaagcgacaagtgtttcatgtagtaccaccaacattaatccacggctgttgttgactcttattctaatgaatcataagccatgcattag

SEQ ID NO: 11344 - DNA, 386 bp, Zea mays
tcgccaggccgcccgcatcgacatataccagcaacccaagcaactccccacgttctctgtccttccaagacccaggctttcagttccagccccacctcgcctagcttctccccctccccttcccaaaccctacaccccgggccttcgccgtccccgactcaccgccgggcgccggccacccccatagcgcagcgccggcgccgaactgaactcttccgtgcggtcggccgcgcgtacggccacccccctcggcgccgcccgccgcctttgatgtctcccacctgcgacctcggcttcctctggccccggtcgcagaagagcccccaagaggtctcccgagcggccgcttccggagcccagcgattggcctccccacggcagccgaa

SEQ ID NO: 11345 - DNA, 455 bp, Zea mays
tcgtgagagtgaaatgtcactagaaggaaataaataggcagataaaacatgcaaaggaataagatttagggggtgtttggtttgagtaatcacttcatccaagataatgtggtgcatcataagtctattcttcaaatttggtgggatgaccttatttctcgtattagcactaactatataactatgaggaatgaggtggtgatgaatcaacttattatattccacaaatcaaacaaaaaaaataaggagtgagaaaatgatggacttgctcattcctcaaaccaaacaccctataactccaccgcctcgcccatccggccgtcccaggcttccccagctcaggagtcaggtcctcacgccgcgcacgggccagagacgacgagagcgcgcccatccggacccggacagagctcgcctgcgcctgcgcctccaccgatcggcaagcgggaggggag

SEQ ID NO: 11346 - DNA, 1500 bp, Zea mays
gcgaggagaggccagagctatcgcgcggcgaggacgatcccgtaaggcgcctcggccaaacaccagggttcgaaggtcggctccgtgcgcgcgcctcgccgctgatggcaccgtcagggtgtgtcggargcgggagatggcgctcgggtccgattggtgggaaggggatgcggaattagttgagggagcactgggattccccagccgaattctgtgcaccgctgcaacgactctgctagaatcacgggaggaagacgactgattctgctccctcaccgatgagaggaacacgaccactccttatacccgagcggaaccccggccaggtcgtggcgtcctggattcacacggtctgcaacagattctccacggtcacagctgaattcgtgcgaaggttgttgagaattgggacacagccgccgcggtatacaacagaaaggagaagaatctggcgaacgggacccattcaagtatataaaaatatatactttgcattcatcctgatattttagatgttgcatttaaactagaacttgaaactctgatttgaatttaaatttgaagtaggaatctaaaacagaaaaaaaacaaaagagaaaaaacctacatcggtcgatttgggcgccttttggcccattcctctttttccttgtgcgcgtgctggcccaatcctagtcacgcgcaaactcccctggcccaattcctcatcgcgctgccaccacgggaccagcgcgccagacccatgacccgcctggtcgcctggacaccgccggactcttaccctctctgtatatttgttatggtcctttatttagttaaaagctctaggtatattatgtacatatattatttcattttaagagactattacttgtgagtgtgcgataaaatttcaagctaactcagaaatgaatatccaccatttcacttatttagaggaaggtaatatataatctttaccaagaatcgttttataaaataaacaattttaaagcttgttatatagtttacaaaggtactaatgaacagatggaatgcctctagcttaaattttagtttcaagattcgaatctatgttttgagctacccagttttttatattactaaagctgcccttacacatgccatggctcgtcatctcttctagaactggtccagaagaatagtttttgaagaagatgaacaactgtttggaggaacgaaatgattgtcacctgtaaaagtaagttaatgaaaaaaacagtaggggttcaagttgggcctccacccagatgacagcctcggatcggacccaaatccgacccatcaccacgacctctgaagcccgagcgcggcaccaccgtccgatcctggatccaacagccgaaacccagcctccagaaaccctagtgccgccatcctatataacgctccccgcctcccgcgcgctccgatttgacccatctcccaacccctacactcccggcggcggcgcaggagcagcagcaccagcacccgagg

SEQ ID NO: 11347 - DNA, 254 bp, Zea mays
ccggccgttgcgcgtgctggagtcgttcgaggaacgggcgtttcacctttgagtttgattttcgcggcgagtccgggtgaagttttgaatagatctcacccgggcctttatatacccagaagaggggccggcggtgttctttaccctgccatttgtgctcgccttctgctttggtttccgcaacctaagagaatagccagggaaaagaaaatcgcgcacctcatcccttccgcctccaccacctttgttcggcg

SEQ ID NO: 11348 - DNA, 1383 bp, Zea mays
tataatgatataggttgtctacttatctcttagcaaagtgcccgtacattgctatgattttcaattatatttgaatataaaatatgtgtgctctgatggctagatgaatgtgaatatgagtttaaagttaacaaccatggtttaagtctccaatttatgcataattcttattatttttactatttaaatatgagggacggggcaatggaaaccgtgtaactagaaaaaacggtgatttaatacaatagagaccacacaatatatactaaacacccattttacctaacaacaaatgtgctttcccctattttagctaaaatctaagaggactaagttgaatgtgaaccaaattactcttgatttttcatcttttttacattcacgtcacatatttacctaagggctgtttgtttgagattataatatgtctagattatataatccaacaaattttgaataaatgttagtttaaaatttgttggattatattatgatattatctggtcagattataattttaaacaaacaccctttaactctatatattaatgtaatgaaaacatgacgtatctagcggacatctaatattcctattgtacccaaattgaaaaatctcaaaaaatagatttcttatatgttataaaatagattttaatatccgatgcacctggcacaatatgtattccactctaaatcttagtaaaaaaatataattatctatattcgaaatctaagtatccgtattcgaaatttgtaatatgttcgtatttttttcatctagtttcatcttcagtaaaatacatctggtccttaaacttgttgctctgcgttattctgttccacaaacttttaaaattgtgtcggtacgtttcttaatctctaggatctcagttaagtccaaacggctcgtggttaatatatgaaccccacatatcaacatgtgcatcggtgaaagagaaccgaaaaaatgagagaaaggagatacagatgctcatacgggtctatatgttaatcacgacctgtttagatctaactaagaccaaacaacgattaataactgaactaacacattttaaaagtttggatctaacaagtttaataactcaaaatgtattatactctttcatcctttctatttttccacacacacagatgcccctccccggtggcagggtaaaacagtacttgtcycgccccacgtcgcagcgccgtgtccctctcgccttcttccccaccccaccctaccctggcacccacgcgctcttcagatcagatcggcaaggccaatcccgagcagtggtgcgaaacctcgagcgctcgcgccggtgaccataacaaagaggaagccgcggtagcactggtagcggcagcagtaagggggag

SEQ ID NO: 11349 - DNA, 164 bp, Zea mays
cgtaggcaaaacaagataaacatcaaccccaaccccaacgactccaactccaagtcaaagagagcagcaagagcacgtgccggccgccgatcaaatccaccgagcaatcgcgcgcggccgccgaggtgccaaggcggcggcggtcggtcggtctgcgatatacg

SEQ ID NO: 11350 - DNA, 1234 bp, Zea mays
ttatttaatagaaggtagaacatgttcttaactgcttatttaaacaaaaaatattattagtatttaataattgtatttatttttatagtaatatagtagacgtatatattttttaaaaaatagtatgcgtattattttcttgacttacgagtctaatgagctgatctgagatactaacaaaccgagctaagctaacttttttataactagacgagggcacgaggcaaacgagccgagccatctaggtgatgtttggttcgcgaaatgtaacgtaaatggtaatggtaacgattcacattcgaataccggtgataacaaatttaaataaggcggtatctattgtagtgtggtatcgattactgttaaagttaaacaaacatgatttaatgttatcagttagtcattccgttaccaatattccgttaccaatatatgaaccaaacaacatctaagttcgtttgaaagtaaagcagtgacgaacggacgcctgacggacaagggcagatcgtttgaaagccaagaagcgacgaacgcaacgtgagggyggactagctccatcgaatgcgggccttcattgcctgagccgaaccttccatcaatactagtggcrgagaagccattatagtttagtatgacattagtcatatcttactttttaaaattcttatatcttccactataatcacaaagcaagacacagtgtagtgtatgtgttgtcttgattctagtaactggtcttaagtttgattcaagattcttgcagatttcgtttttttttttcagccgtactataatttttgtttgccctccgctactgatcagtaccaactcctcgacctcccagcgagtcaaacacgcggttcgttcttactggtttcccgggagagaggccttttttttttgtatgtgtgtgtgtctgcgctgctgctgcgtcttcaagagttcaagtcgtcttcttggacgccattctcttctctccggctctcccggattccttctccctcatgcatttcttggccccggccagcgggcagtgatatcgctccctcgtccgtctgatactttgtcgtccattgtttttttttcaatcccaagtgttcatcagctccagttcccaacctgagcagcagcaatcagaagagaaggcgagaaaggaaaccgggttgtttcggttccattttgattcgactggaggagatatacgcacacccaaatcgaatacatagtagggggg

SEQ ID NO: 11351 - DNA, 510 bp, Zea mays
ggccatatcaagagtaagtagttgttgccgacacttgctcactaacaaacagcttcaggtgataatccttgatccaccagggttaccaagcctattcaaacatctcatccaccaaaattatttgcaataatacaggttgcttacagcaaaaagggaaaccatgtcttcaagcaataatttgtgcaaaagcaaaagtatctaacctagtgaattgaactgaaaaaacaacaaacatgtaattaaacacagtcaaaattggtgacatgaagaaagtaagcaacacacatccaacgaaattaagtatttaattcagagaagcataaaatcagtgttcataagaaacagaatttctctagtgtaggtcaaacataaactgcaaggtatgatttcatatcacttgggaaatgtaataaatgctcccaatggaacatcaacatgatcatgttaaactgcatcaagtacatgttatctgttattttagtgaaaatctgaacagcacacagaagaaac

SEQ ID NO: 11352 - DNA, 995 bp, Zea mays
ctgcaggggatcccgatccactagtagtatgccctgtttgtttcttcgatgtactcattgctgacgattatattcattggaatttctaaccgaagatttccaaccgtagcccgttcctgggtgctgttggtcagttaggctaacgcatctgcacacgcacaaaacaccaatgcgttacaacaaatcctaaaaaaaatagcagtgtgcatatatttgtagaacaaatcaggtcgaaagagtttgtagccaaacagagaagatacacgagtcggttggcctggaacggtcctgtacatccagatatatttggccgggattgaaaccgaaaataaccagaggcaaccggtaatagttgttcggatatgtctaactcagaatgaaacaagaatgaaaacatatcatttcagtcgtttttaccccctcagtgactcagattggatccacatctaaaacctcctagaatcaaaccaaaggaggccttctcacgttctggcggcgaaccaccatgattcactcgatccggacatggaagaaaaacatacctgttttcgagttggaacaaacgaacttaacgttataactttgttcggttacatcgaaggggagtgaagaggcccagagggggatcggaatcggagtgcaaggggacaacccaacccgtgcccgactgccgttggccgttgccataccataggctatagcggctagcccatgacccttgtaaaaaaatacttcctagtaatagcaaaacaaatatcaggggcgaaaaagcgaaaaaacaattaattttccgagggaaaaccgcccggatcgctttaaatagcgccctcgcctcacagccctcccccattcctctccgccccctcccaccccaccccaccccacccgcaagcgaggcagcctaggacgcagcagcgcacccccgatcctcgcctgtcgcctccatctccattcgcaggcctgagaccctcgcccgcaccgcgctgccgccagcc

SEQ ID NO: 11353 - DNA, 163 bp, Zea mays
gctgatgttgccgaggaccatgtccctagggctcgggcagtctccgtcgacgccctcgtcgtccatgagtttcccgaagtagaagagaccattgacgacgagcacctcatctggctctatctcgaggtcctcggcaaaaatcatctcccacttggtggcgacg

SEQ ID NO: 11354 - DNA, 1140 bp, Zea mays
ctgcattgtaaaaatgagttcgcaaaggaattacatctggtcacgcttagagctaaaggaagattcgattcgacaatacctgaatggcttcagcattggcaatagatcccgtcaattttacccttttgtaattttgtaatttactttcctgtatgcttctaactctgtcgttttaaaattttaataaaatttcagtaggggcttgcccctcctgtcctatcaaaaaaacctgagaggcctgtgattttggatgtcttcaggttcagatcgctgtgtcgcctactcgcctcgtctagcagtcccaggcccaggactgcaaagcaaacaggcccccatatgtatatcatttggggtacatacaatagtgtttttagttgtatcttcgagtgtgtctaaatggtgaatgtaaaaaaacccaagatatatatcttgacgaagacacagtgtcttaactttatgttcaagataggaggctagctgattgatcactttaatttatttaatgctctaattggtacaataaatatgataagacacatattttagacatgtccactgtattatattgtgttttagttatgtcttatacttggagtaccgttcaacagtgtcagggttgtacatgcccttatacgattttcagccagccgagttgtttttgatattgtcctagagaagctggattagtttttttttctaaccagcttttctaagaattttggtgtggttccagccagccgagttgtttttgacattgtcctagagaagctggattaactttttttctaaccaacttttctaagaatttggcggtggagataatcttattatcgttgggattccatgcacagaaagatgaaggtatatatagggttcatgatttaaagtgacggatttctaccattacaacgactcgataaattatatctttattttgattttggatgatttttaacaaatcgatttttattgaagtcaaagctaaatttttttcctcggctgtagcgtagaaagcggagtgtaataacgaagaagtcgcagtcgcagcgccagcttcccggagccttccttcttcttccattccatgatttcccaccctaggcggcggcgtagtgctccctccatctgctagactttttg

SEQ ID NO: 11355 - DNA, 641 bp, Zea mays
tgattggagaggagatgaaatagagggaatgtatttaaatatgaatggaaaatacaaataagtgatttggaaggggaaatggttggagataatctaagatagtgaccccttatataacgtagacttttctacagtactctcctattcttttttatttgccatattttagttttaaaatgaactagaggatgacaaataatcaagaatggagtagtattattttgacaatttgtcacctatccacaagattttttgttttcaacgcgataacagtaataacactcacctagtactaataaacaaactaacaaaagtgaatgtagcgagcctcaaacttgttatgcatccttgagacctatgctggtatatatgtgcacatcacacgatatatatgcgcgcgggtacagcaccggagcgttccacacacacacacaagcaacaaccaacagtagacggagtttctgcaagagaagccatctcggtcacgtcggacgtgtgggtgtccctgcaattctcatgaggacagcaacgtacaacaactggcagctagcttgtagaggacgactatgcatgcatacgttcggggtcgagatcgagctgaccaatgatccaatagccgccgccttgtggttgtgtcatat

SEQ ID NO: 11356 - DNA, 133 bp, Zea mays
ttatcaaactggatttgagaagttgtgattaaatgctccccaaacttgttatggtaggttttttggtgagcttaacacggtgttaaactgtggagtgtggaccaccgtgcttatgtcttgctgatctgaagtc

SEQ ID NO: 11357 - DNA, 582 bp, Zea mays
caaaatgaatgaaaaaaagaaacatggcctctaacttttatataaaaatacttctaatattgggaaatgatgttcgaataaggacgtatttagggatgcaagttcaaagtaatttggatcaggccaacctcaaaaagttaatcaaatgaactagaaagatatttctgtagtttgaggagagtggaaaatggtctaaactgaaatttaaccgtaactagttagctgacaaaaaaacaatcattgaataccgacttccatcaatagacgtatcccacatatttcctagctctaaagtgtaaacaggggggtccatgtttcggagagtcctttgcaatagtttcatctgccacaccagtacaccacaatttgatgaatgttgttcaaaaagaaaattaagccccgtaaaaccaatccaatcgggtggcagtttttaaggaaaccagggaccgcagcagcaagccgccccagccgacgaggcgaggagcgtgcaattccgtagctgcaacgaactccctcgaccgtatcgcccgctgctcctctatccctttcctgctgctgctactaccttaagctatcactatc

SEQ ID NO: 11358 - DNA, 957 bp, Zea mays
cagtaaatgaggttatgagaagtttctaaggacaactgtggtagttgtctaaaaatctatcggcgcaaactcttgaaatataatgtgtgtttgtgaatataggtatgtatttgtcattttctctattttataaagcattacttttcacagtttccaccttcatcacgccccctacatttaaatagtagaaaatctaaaattatatacaattaaggattcaaaccatgattgttggctctaagcccgtattcacatccacctaaccaacaaaatatacatacatttgtgttttatatttcatactcaaacataaatagaaatcatagcaacgtacatacactttgctagtgtttttaaataaactgaaaaaactttaggtcatgtttgttttcttttagaattatataatacaacttatggattatgtaaacacctaatgacctaattatagattattataatctagatatctagattatataagcaatctaataatttatgatgtttatttatcttttaacttatttaagttggattatataatttagaggttaaatacttcgtttacaatggaccgaattatctaccaagtagagagaaaaattcaaaagagagagaaaagcaacctatggttcaccgctccccctatttgacagctcgcgagtcgagtcagccggccgacgacagggagcctcgcttccggcgccgcggcggcgatcacccaattttccacccccactgccttctcctatctccccacactaccgctctgtttcctccaccatccgcttgcgtccacgcgctctctcgttaagccatcgcttgcgtcaacggccgcgccctctagtcgttcgacgaaacgccaccgagccactgacgcgtccgctgcacgcgtagtcgcgcttccatcttgctccgccgccccgcagctcctagccggagggaggccaccgatcc

SEQ ID NO: 11359 - DNA, 549 bp, Zea mays
agtatgtttgaaggcaggagatctttcctttgaaccagaatgccctctttgaaactaaaatatctgttgggaaccaaaattgtcccttaaatgatcttaatattaatttaataaacttcagtggaactttgatacttattattgacttatcttctttcttggtcttggcacttgcttttgtgtttatatagaagaaaaaaaaatctgttctgatgagtacagaaaaatgtgttttcagatttttttttttgcttaaactgcttaacttcttaacttgaaacaacaacttattttttcaacaattctaactgttaagtgaattcaacacagttggtttcaagatgacaagtaagaaaagtaacagatctacagtcacaccacacactgctctgcatatggaatgggacaggatttcttgccctatttgtatggagcaaccccacaatgctgttttacttatatgcagttcatacaagaatggctgcagatgttacatttgtaacacaagccatcgtcactctaattgccttgatcggttcagaaaaatga

SEQ ID NO: 11360 - DNA, 1459 bp, Zea mays
ttatagatgtaatctagaggcagttggctctggtaccatatgagattaggtggaagcgttgaacctccgtagaggtcgctgtgcgtgttaatataggatgggaatagcccccaccgtggcttacaggatgcatccgtgaaacaaccatgccaagattaaagcagagatctaggattacaacaaaatatcctgcaactaatctactaacagcacacgacttctacgggataagaactgaatacacatatcatctaacagtaggtacaaaatgttttccaaaagttgtattgtaattgcagtaattttgcatgagtatgtgtagaacttgaactccccttctgaaagagctgcgtcaacttgggattctttggcattatataagctatcaaaattgataaataattataatgacaaaaaagcttcaattttttgtatgataatatcctctgttactgtataaagcttaaacttctgcggattgttccatccaaaaaagaaataattagaaaaaggcaagctatgctgtgaaccctcctcctcttctgaaagagctgcgtcaacttgggattcttcggcactatataagctatcaaaattgataaataattataatgacaaaaaagcttcaatttttttgtatgataatatcctttgttactgtataaagcttaaacttttgcggattgttctatccataaaagaaataattagaaaaaggcaagctacactctattagcattaactttttattacgcttaagttgtgactatatagagtattactactccctccgtttatagatatatgataccgttgatttttttaaaaaaaagaactttaaccactcgtcttattttaaaaaataatgagttattatttgttttttggtttgttttatcatttaaagtagtctgtgcttaacttaaaattttacattttttgaataagtattttgaataagattagttgtcaaagtttttaaaaaagtttaatgatgcatatgtttatgaatggaggtagtatattattagacaacaccatgattggctcacgaccgagccatccagaattgtggcggatttggggactggcggtctatgttttagttttttcttttttctaatttcatgaagtcaattaaattaaacttaaatgtattagcgctacgatggacacatcacacacgacgtggcaaggcctgcatcgttgggtctttgggtccaccacgtgtggcatgggatgggtgggttgttgtttgcctctttagctcttggctcttgtaaaaatcagatcccaccctcaccgccgccaccgggatagccactgttgtcgcactgctcagttatccctggtggtgtgccggtgactgagtttgcaattccaccctcagcatcttcgctagcggtgargctgccatcgttgctcgcttgtcgacgctcttcaaggaaacacgtggtac

SEQ ID NO: 11361 - DNA, 1156 bp, Zea mays
gccatgtgggccacgtgaattccgccgacgtaccgctggtattattccaacacgctagataggacaaaccgctagcatttagacacgctaaatgaaatgtggaatactagtcccgttcgaggggggaaaatgtccttggaggctggctgcgcaccacggtacgtgtacgtacgtggtggtgcgttgatgccggtggcaagtgtacgagcaaagggctgcgcctgcgcgctcatcacgtacgtacgtcgggaacgaacgaccgattagagcgccacccgagaatactacacacgtgtcgaaagacggctaccagagcaagcaaaaccgaacttgcgtggccacctagctttgtgctggatacctactgcatgatcgtgtgggtgtgtttgagcagatgcagtacatcagctttgatcgttttatctgccgcgtttcatcgtacgtacgtatctttctgtcacacacagacagtcggcaccgagatccaccgccatatccgcctgaccgccttcaacaagcagcttcagctacctgaccgacttgttttttataagataagattctctcaagaatagtctgttttgtccctgcatgacaaacaattagtcgatcagagaagagaaataaaagaaactgacaggaatatatattgactttttttctccatttttagctggttcgttacatgtgtccaccaggcagggcgaagaaggatgaagagggatcgggtgagatcattctaacttgacacatgtttggtttggaggtccagagtcagggtcaaaaaatattcttcaaaaataatgtatgaggccatcccttaaaaaataagggacgggatcaacccatccgtagttgacaccgaaccaaacacacatacattaccgtgtattcctcgcagcgggttcatgcgtctcgtcaaaatattatatggagcccgtaatattctccctcttccaatctccttttattcaaaagaaaagaaaagatctccccctcacgcctatataagcacgccggcacagctcaacgcctcaacccctccaacgcagtttgcagtctcgcgcgcgcatccaaactccagagtcctcttctgcctcgcgacccctccacttcagcaccacacacacacaccgcccgccagctaccacgaacc

SEQ ID NO: 11362 - DNA, 1500 bp, Zea mays
cgctcttctttctctgtactgtttttttttttggtgctacgaccgccgagcaccggagcactgggagatgaacacgcaccgctctgcttctctcccagcgaattgcttacttgcactctggtgctgctgtgtctgcctgcctgcctgccattcagaagtcagaactcgtgttctctagtagaacagcaagtgtgcgtgacgttacagtgctactgttgccgcatatactagctgctgctggtggtggtggtggtgcgtgagaagggtgaattcacgatgagcacctctgctagtagcgtgcgtgcgtcactcaggtgcgtgtgtgcaaaactcttacgaggcccgcctaacccgtccctgttcagttcctcccaatagtctttctctgctcggcagtcggcagtcggcaggcgctatctcggttgcagaaaggcaaacgctcttggtccacaggttgcgctgctccacatgaaaaccttatccgttcatttttctgctagtcggcccttacagaaccgactttctgaattactcccccctaaatatatatacacacacacacttttgtcatgcacaagctaagtcagtcagtcatctctctcacctggtgtggtggtggtagctggcgttccaaaaactgttgcctgctgctcttcaccgtacgtgtgtattttttctggtcagtattcgtggcgtgcgccgggcagatacatgtaaagatgacgacgagtgtttctctgtctgtcacggctagcttttaccatgaacatggcatggcatggcatggcatgcccacacgtcaaggacatctccccagtttgagtttgactagctagctagctagtcttcctgtttcttcacgctcgctctcttcctcaagaacatgtgccgcgcgcacgcacgtttcttccgaataaccgtgagaaaacatgcacatgtaagctggtggcgtgttacatgcatatatattagtatcatatcattagtagcgcagtgcgcagcaccaccgctttcttgttgctaacaatcatatcatcatcatgtcattatgatgccaactctcgtatatatagcactaattgtgatatatagaaggaagcaaagcgagtgccttttcttttcggctgtttggcggccacgatgcttgctaagcatttttaatccgctctgaagatagagaggcggtgtgccggtgtgtcgttcctgtttttttttattttttatcagcgactgaagatagaaaggttggaacacaggcatgttaatataaccaaggtgtatctagtgaaagtaaatcagatccatgcatgattgcactggtactattcttgttaatttaaacccaaatgcccgacggccattctatatctaactgtctgtgtgtgtggcaaacgacctccagagcttgtgttgtttaaagttttgattttcttggtgctgttgcgcagctgcagctgggctgctagcttgagctgagcttgccgttgggcgcgcgcgtgc

SEQ ID NO: 11363 - DNA, 145 bp, Zea mays
ctggtacattagatgagtatagaaagcttgtcgttccataattgaggattattttagtacaggagatgtggaattggcagcttctgagctgaagtgtcttggatctgatcagtttcatcattactttgtgaagaagcttatatct

SEQ ID NO: 11364 - DNA, 1500 bp, Zea mays
cttcagcggcgctagctcagctgagacctgagagtgagccgtgaggtgaggtgctgggccgaccggctgagtagtctgactgtacccgccgctaccatttaccacgctgtaccgtagcagagcaggcctcacgcggcgctgtcccgaccccgtcgaggcaaaaagccctggccgttccctcctcgccccgtgccgccgccgcctccgtgcgcgcccaggcttcctcctggtgagaaatcgtcatgtcctccgttgttcctcgcgcattcttcgctttaatcccgaccgacgggttctgttcacttcccctccgtcccgcattccttgccgcgcgtctcggcgtttgcttgccccccgccgccgctggcctggatctcgcgggcttctttcgcaatgccgcagcagcactggtttgttgggggtcgagttctgctataagttctgatccgcgttcttgcgaggagctaaaacgacaaggaaaggaacgcacccatcgttgcatgcgtctatgcggtagcaggaagtcaggaactgaaccattgctggttgggagatatgggcccaaagatcttgcgatcttcactgattgtgtttattcgaggttctgagaggggttcttcgctgtcctttgagtagttttttctttctttctttggtttgttgtgccatgtcatatatttctacgagaggttaacggtggtgattggtacttgcagctgtgcaaatctcttctgtttttaagtgcaggctactggtgggggtgtagggctgaggccagggtaggttttgactttttgattgttttcttcacacttggtgctgtttgtttgtttttttccttgggagccccaagttcgttagaaaaggagagagtgtgtggattatctgcactgttttacctttcatttcggtgagaaaaaaaaacgaggcatttccttttactatcctgatatgtgctcttattgaatgactctgggacctcaagatttcatacttcgtttatatggcctatgggccagtcctagtgtatactcctagtagaaataattgctccaatactgccaagatagattttaatttaacttctttttaaaatccttttcctcctctattatgcttttatatatccgcctcaagttctggcctggatttaatacttattggagatccacgacatgcatcattttctgtttgagctcaaaagccatgcaattgattcactttagcaccgttttctcagacttgatgatgtgtccagctacatcttgccctgatctctcatctgagctgaagccccttgttggctgtgcaaggggaggagaatcagggcaagtacggaaaacatgtgttcttatggttcttgtgcctgatcttatgcagtgacttcgctacaatgggtcatgccgtaatcaaaagaaggactacattttcatgccaacattgaagataccgccttccattattgctgggtaagttggaacagaggagtgcgtattcaag

SEQ ID NO: 11365 - DNA, 194 bp, Zea mays
taacaactgtttgagtgggcttgggcttggttggacaaaagctcaccccatctcataaaacccacgtcccacagcacaaacacgacacgacacaactccgagggccgaggtcagcaacgcaaagcagcacgttcccgtcccgacgcgcttcccgcctgagtccgccgcggacatcgatccccagttccgtcccc

SEQ ID NO: 11366 - DNA, 800 bp, Zea mays
cgagcaagccacgctgaagatgggaacgggccgagcagcccggctcagctcgacgcggctcagtggaggtgcgaggcgagccatgcttaactcggttcggtaacgactcacgagccggctccagtcagctcgcgagcctcacactaaatcatgtttagagtataaattatattttttattatatataagataaaaaattatgtataatatatttttagactacaatataagtgtatcacgaatcaagttcaagaaattcaataaaataggttcggtttggttcggctcgcagttctggcgagccacaaaaataggttcggttcgggctcgttttggctcgcgagccggctagccgagtctcaccgagtcggagccaaatttccaccatactccctaatatatgtcaacaaggtgttgatgatggtagttaatgtatggtgaagtgatatgggaaatgattggagagatgaaggtatagggagaagaattttacgaggagagataataaaatagagtatacaataaaataattatacggggagttaaatagggtagattgttagagatgtcttagaaccaaactactcctacggtcctacctggctaccttcacgcagctcttactccgatcctccatcctcatctaaacaaatacttctcatcttactttttttcgtcttcttccctataaataactggccttcccaaatcgcccacaactctcacacaacagagaccacccacctgcgctgcgcctcggttttacggcccttccctcaccgccccgcgcgagcgaagcc

SEQ ID NO: 11367 - DNA, 1051 bp, Zea mays
ggtaagaaaaacttggtttcaacgaaatcctctgctgcttcgtggttggttagccatagttcatggaggcgtagaattactttggatggattaaaatatggtttgctttcggtaacttccatgatgtacggcttgtttgccccgagccgacgctgctgatcatatgtcgtctcgtgtatcctaatttaattagtatttagtactagctgcgcttccgctgactatgtttggggagagttccagtgctttgctcaatgaaatttatttgttattgtacctgacttgcctgaaacgcagtgttatctagagaatttttcaaaattcacggcgaatcggtagtggtccctttcagcattgctttcattaatcaagacagctgtgttgctgatttagaacatttttccccaatattctcaagtgtttttttattgttgcgttcctctgaatacaagcctaccaccaccagcgtgtacgcatcaccgcttttggcttggagcatctccatgtgttgcctttatttcttttttttttgtgattttcccttattttggctccatgctatgttttctttcgctgtttctgcaaattaggtaaatcatgcaattactttgagtcgttcagttaatagtaccttttattacaactcccgtcatgttctactgtttgtatcctgtacttcgtagatgtttgctagatttctttttatgggcagtttcattggtttcagaggaaacaagcaattcttgctggcactatgttttcttttctccagtttgtgatgtttcttttgattgtgcatttgtgctgacagttatactgaacttggtaactttatcatatttttgcactctaaaatccatcaatcattccgttgtttcagcaccttgagctgttcagcttccttctgtgtttggcagcctaatcaattatggggagatatctatgtggtaatggctgtgtcaaacagcatacacgatttttttagaaatgtaaccgatttatctttatgagtttgtgagaaaagctgcaagatattcctgtaacttcagca

SEQ ID NO: 11368 - DNA, 615 bp, Zea mays
cgctggctccgggtggaactggaatcgaaggcgcgcgccatggatcagcaagaggaagtggcgcgaccaactgggatttgggaagagcacacgcggactcgcgacttgatccatcttggcatccgatcagtaaagacgacaggcatatctgtaccatggattacggaacaagaacgctatgcttttgctctacgacgtcgaagcgagggcaccgcaccgacggacgatcaattttgtgcattaacgccaacttgtcaccggagatacggtatacagttgtttctcatgtatgaaacggtgatgatatttttgtatccatgacagcgagtcagccacagacgctctcgtaaaacttttccgaaaaatatcctctctttttttcatcagaccagagtcaccagacatacaagaagtttatcggggagaagaaaatttctcaatcatcaggagggagaagggcaaaaataaaactttaaaaaactacaggaaagtgcacgcagtatattttaaacagctcccctccccctgctctcccagccccaggaggacagtcccgttccagtcagagcgcagccagttcccccggcccctcccccctcccgctcgccggcggcg

SEQ ID NO: 11369 - DNA, 208 bp, Zea mays
aagacaacttatgtggtgtcttatagttatatggtgcgggtaacggataggaattgcgtcaggagcctcgtcgtccggagccacaggcctggagacgtcctggataaggtgaccagccgctgcgataggggcgcgtgtgaaccccgtcgcgccacacggatggtataagagtaaagacaaccttttcgccgaaccccccctcggaagg

SEQ ID NO: 11370 - DNA, 203 bp, Zea mays
tgtaagtaaatgaggaagaccatcttgaccatgggcgagttcaatttcattttcttgtatggtgctgtgatgcaaaatacggtatcgtgtatttcattttccccccacgtccatctgttgccaggtttattctggagccgaagtcagttctgttcaatgagcaggagcaaaagcttaatgacagtgagagtgcgatagcttca

SEQ ID NO: 11371 - DNA, 1500 bp, Zea mays
gaatattagagtatccaaacatagttaagaggtgtggtttatctgctcggatatgttgattatcctttcctttgacgatgcccgtatatctcatgtgagcaaagttttgtgattgactacgcgcatgcagaacagagacgtcgagtgtatgtgaatgcagaggacaaaaatcatattttacatttttggatccacaaaaaaataatactctatccgtcatgaataaaatttattttattatttcagttgatttatataataattaatgtatttgttttatatatacttctaaatttattctaattaatttaaatatagatataaaattaagagctaaaacaatcaatatttgaaaaagatgaactacgaaaacatgttaataagcagtaaggtactatttagagcattttgcaaaccgcgacaacaagagactaaaaaaaagcaaatttgccgtctgcaaaacccctcccacagccgtcgccccccgccagcccgcctgcgagagaagtccgcttcatccgttcgccgcctcaaggacggtaaggctagccgaatgcttgatcttattccttgtctgtttcactgtagtagctgcagggttttgagggtgggatcgagaccgtgatttatccaggcgccgcagttttgctagggttttgcctccatagccgagcgcccgagccttgccgcgccccgattccatggtcgggggagggaattcctagcccatatcccgaccgtatgattggcgctaccatcttcgcggaaggaagaggtggggcggggttgggcgtagagaagccaatcggcgcggattggagtatattaatgaatgagcgcaggttgttgaacattgaaactcgccaggttttgcggagtttgccgcctgggatttttctatcgagatctacaaatcggtgcctaggatttatgttttttgaccctaatcttagtatcttacacgcggggtatggataaactgtcttacaaagtgttctaatgtttggtcttagccgtgtacagtacaaaagactgatactcgccagcagattgtgtgtgctgactcatgtgtcttacatgctttttcctaggccacctactgtactttgacaagcatgtgttcttgtagaaaatgtcttgcagtcatttcacagtaattatgttggcagaaattctgaatgccatttcttgagaatttttaggcattacaaatcttatggtatcacatccataatgaccaaaatgattgtctcaggctgaatgtgtaatattataacctactcacaagtcacaaatcacattgccaaccaaaactccaatgcatatattccagtagagatcctctccaagtacttgttcatcattctgtaatctttgatatgttgtttttggtgatagtgactagaagccgtgtggaatttatttgcttcactctttgctagatgattgtactgaattgcattgaatgatctgaaatttctgaatcctcactttgcagag

SEQ ID NO: 11372 - DNA, 1275 bp, Zea mays
taaacattaaataacttcttagtgattataaaagtgatgtagtgcttttgctgagctttccaaaaagtcttagatcactctttttggtggtctgaagcttaagttatgaatgtttcaaatatgaagactgaatctgtccagttctggacagcaaagtcttatagtgatgtctatccttagttaaatattgaatcaccttgagatgtttataaatgatatgtagacaattttattacctttccagaaagtctaggatcaccttgtttggatgtctgaatctgtagttgtgaatttttgaagttgcaagtctgaatctgtccaaatctggacagagctgctgtgtttgcataattcgaccttgctaagtgtttaatcaggttgtgatgacaataccaaagttgtagagcactttttaagctttccagaaagtcctagtttgctaattttggattaatatttgaaaagttatgattaaaacaagtaactcctgtgttgctgtcccaaaattctgcaagtgcccatttgatgattgagttcacccttttggctaaaaatgcttgattagcacttaattaatatagactttccatgactaagcttaataatgcatgtgtgtcatgttttgtatgtttcttctctagttgattgtgatataggagtctatcgacattgatgcattggtcctctattaaacttgtgttgggatgatttttgtgtgcttaatagatctaatgaaaagccgtagctaattaactaaatgctcatacttgtgatgtcctgtttgtgttggttaattataggtagtaatcgtcgtccttccagtggtattgatgtggtgcgctcgatgaagtgtagataactaaagctaacatgtagttatctacggtgtcttccactttaatgtttagttcgccactgtgtctttgtatatcttgtgttatttttgtgctactttcattatattcatacatatgcatcttgcacctcatataggaccgagagatgatgatcgagctagtgatgtggtgccaaccacaagatgcagtcggtggacgacccaaggaaggatggaattaaccagtggatgctcgccgagcgagtaccctcccccagcaaacactatctaagtgttaaattaaaggcaagccccggttttatgcataaccgtttatatatactattttactgcacttaatgtttgtaggcttgtactgtgcacttaagtgtaggagttgactgaaaccttagttgcatgaactcaggattccttttgag

SEQ ID NO: 11373 - DNA, 620 bp, Zea mays
gcagcccatatatgaagaaaaaacaaaagaaaaagagcccaacacgtaacaagcaacatctcgcattgattttgaagcgtgagaatctggtctgcttattctgttcgctgtgtttctttcgtccactcagctttccgcagccgccgttttacgttagccaattctgctgtcagcttgccgctgtccgctcgtcctttgagctttggtaggtactaacttgaatactagatgcatgcttctttgattcaccaccatttatcatcagaatgtcataatattgtaggtccaaattatcgtctctagtagaacaacgccggtaaattatgtcaatcatgcaacaaccgccgtgcttactatttttttttactttaagtatatataatcttaggaaatactgttgtcctaccatgaatagcgctctggtgactagctaaacatgctattagaatataataaataatatatcgatctactatatctatatgtgtgcaatctgttttatatatattttagattacatatatttaaactatacttatattgtattctgtgctggtttgtcaggttgtgtctccyaaatatcttgcctttttgttgcattggactcttctgtggttaga

SEQ ID NO: 11374 - DNA, 1177 bp, Zea mays
atgtctaattaacatgtagcagcagtcagcagagttaaaagtacgagctagttagcatgtatgtatatgaaccaatgctgtatatctagtacagtacgtctctgtatatgtatgtatgtacgcggctggcttattgccttgaaaaataatcggatatttgcatattggttatacatggacgtgtgtaccactcactaatcatgcgtgcttctttcaggcatccttcctttagaacaaaagccatgtgctttttcctgtgtttccttaactaatttcgtatagtgaaattcatgcgttcaaagggcactcatgctttagctttgggtgatcagcacgcaaagagagggcacatctcatggtccgacgacgacgcacaacgccaaagcattccggcgcgcgtccaggaacagagagacgcatgtactagtagtctagtacccgtaccgcagggcattgaccacagaggaaaataaaaaggtagaagcaggcaggcaacaccgacgacgcaccaccgacggccacgaaagcaaagcaaagcaaagtcgtcgtcgtcgtccgatccaccgtaccgacgaccgaccatcgccgtcgctggcgctagtgcacgctgcctgtgtcttacgtgtgtgaacgaacaagcatgcagctatagcattaatttcgcagcttgcggcgcgatggccgtccgtcgtggcctcacctggagccaccatgcgtttgcggccgcgaggtggacgacgtcgccacgggattctgaatactacctgatgacgagacgtacgaggttagatagtagtaatagcagtctcttgctggtagcaggcaggatcaggaccagcgtacagtgggccccatagaacagtcacagtcacacacgtaggggggcctgtatggctgtatctattgctgtcagtcacttttgcggagagggagagacgcgcacgccagcagcgtcacaaaaagcgagcgcgcgccaccgcttccgctcccccgagaatatccatatccattatcacagtgtctcctactatttctttttactcactgtggtggactcgtctctatatattgcaagggtaatgacacttgtctgactcccctcacatacagatacagtacagttcacacactctcctgtctcctatccatccagccaccgaagctagccaagaccaag

SEQ ID NO: 11375 - DNA, 667 bp, Zea mays
tgcctctatatataggtgtcaactctcgcacaggcacgacggtcggggagatatatcgccggacggccggccgactggagggcggctcgtcgagctctggctctggttgcttgtgcctgtccacgggaaacggagcaggcggcggtcggcatttatagcgtcgtgctcgtgccgtgtctcacgagttcacgagaaatcagcagtgctgccggccttattattagcgcagctagcgggcagaggtggacggcggacggcgcgcgcccgtgcgcagggccgacgacgacggttggcgttggcgattcggcaccagctaacgctaccgctaccgctagcgttgcgtgaaagtcaacgcgcgcgcgagcgtcacgtgcattggtgatggaccgatggatcgaggagcggccagcgtagcgtgcacgcgggcgccggcctagctagctcaaaagtgatcgagtgtggtgtgggtcattacacattaggccatgttcggtgagcttgttcccggtccggatcatggccagatccccgtggatcgctcctatatggattgaaacccggtcacaagaaaatatgtgttcgattaattcacgtgtgggctgcatcccggacgaaccctgcctttcctcgtcaccctcgccaggtaaccacgcccgacctctactgg

SEQ ID NO: 11376 - DNA, 167 bp, Zea mays
cctctccttccccggcaccgtgctctgttgtgctgtttggttccgtcgcgtcgcgtcccgtgctcagatcagatctctcctctcccccgaccccgagtggagtgcctccctccccccctcccgctccagactagcggagagagatctcggcaccgccgttcgtcgcc

SEQ ID NO: 11377 - DNA, 974 bp, Zea mays
cactccaatccctctcgatccccatgtatgaaacgaataaagtctaaagcgatagattgtttatggagaataaaaaaacttctcatttgtaactacaaatggaagttttaaggcctataaaaaatttagagtgttttagggaatccactccaatccctctcgatccccatgtatgaaacgaataaagtctaaagcgatagattgtttatggagaataaaaaaacttctcatttgtaactacaaatggaagttttaaggcctataaaaaatttagagtgttttagggaaactgttgttggtgacacgtttttgtgttttttctaaaaaaaacttgatccaggaaagactgataagaagccgttggagatattttatgttaaaaaaagttgtacagcagtgcatgatctatcccgtgaaggcgtgaagcagaaccaaaattctgctcatacttgctacgaagtcaaccatggtgcaggttggtggagatgcgagaatgttgtaaaccgggacatgttttctaccacatctcattcacggcgcaacaattttggttttcttgcgggatgaataggggagagtttaatatggcaattgcaatcgcagtgatgtcaacaattttggttttctttacgtggatgattaggtgatgggaaacagcaagattcggacaaagcacacacggcccaagacggcgacttccagcccatttaacaacacgcacgatggatcatcagcgcacgcctctctgccgagcactcggcgcataacagcaccaccgcgccgcgccgccgccaccccctttcccgttcgttcccaggacgagtcgcagcagccggccagccgcacagagtggtggagcctaggaacagaggaggcgccgagccatctccgcagcctgctaccggggaacgggcgggaacggactctaacttagagagagcgcgggcgagagaggtcaaccgcagccggaggcg

SEQ ID NO: 11378 - DNA, 1322 bp, Zea mays
aatgcagctttccttcggaaattggaggtgggcgcacgttggaatttctgccagaggagccggtggccagtcaactgccagttggacgacgacggttgaccagcttctctagggctggcggcggtagcttcgtttctgtgctggcggtcgattaaaaaaaaagaccgtacggtgatcatcacagatgcacccatactgtattattctgtttcagcgtcctatacaaagtatacattgggtctgaattctgattagcctgtgctgatgcttgcaatgacattggttcttctgtgtacagactacggacagagtcccggtcagtaacgtgtgtgtacttgttcttcctctgtgttgacattcttgctcgatggtggaacctgtcgcagttggcggaggtgaagccgcgtagctcacttaggtctgccaaacacttcacttcttagattgtttctgtggaaatcgcttctgatgaatgcaaaatcaattaagtcgtccggttttgatgggaggaatcctacgcttcttaaactctaaattgcacatatttctttatttttctccgcatacaaatttgatgttgaatgcaaaatttatcaagtcgtcgtgtcttgatgagaggaacccgacgtttcttaaatcctaaattgcacagatttctttatctttttccacatgcaacattgttgacatctagattctcgttacagctagatctttaaaaaaaactgtaaaaaaaaccaagcccttagtcatacgcgcacgcctcgtagttttttttggatgatgatctgatcagggaaaaagaaacaggaattggggagcaaaaattccaggatctacaggtggttggcataaacgaaataacgatctgaaaacagtaacggtttcccttctgacgatctgacccacaaaaatgcagattaagcagacccacataaacgaaataatgcgactctcggcagggagtcgcgcacattctgccaacctgcctggtagggtgagccggcgccgcctctgcatctcccgtctctctcctcccttcccttcctctttctctctcatccccctccctgcccatatttagccgttgtagcttccgccctctctctctccctctccaggctcttagaacacgaaacgtgaaggagacataggaggaggaggaggaggaggaggaggatcaatctgccccgttcttggctgcgaggcgatctttgtgccacccaccagcgcgcgaggggcttcattcacctgatcctcgcttcttcttctttcgtcccactggttcgcgttgattgcatttggaggagggggcagtcaag

SEQ ID NO: 11379 - DNA, 833 bp, Zea mays
cctggcttttacttggggtaaaccggaccaaatttattgtaaattgaaccggccggacgggaacggcaaccgaattcggttgtttttatttttacccccaaaaagcggccaaaccggtgggttaattgggggatccgccaccccaaataaacacgcccggggccggtgacggtgtaccaaactaccagtacggcccatttggtgtggggccacgccgttcttttaactgttgcctagcctgaatatgtatatgcctgtgggccatggacgccgaacctgcgccgggcacgttgcatgcatgtgccttgccgacaacggcgtctggtacgtcgcgctcgcgcggaacggcagcggcatggcatctgactctgacgcccagggcgggcggttgtcttgtcggggagacggaaacgggggggatgaggacggaagggcaccaggacgcttggagtggaggtggtgtgcacaccgcggcatcagctggtcatacatacataccgtcgatggccgtgagggaacgcactgggcggtgggtgacactggcactatccgtcgatccgagccgacacgtacgacggcaacctgcgaagcgacttgccacgtcgtcggccggcacccccacgccacgacgtcagaccggaccgcgcctatatatatattgggcagagcacgtacgcaagaggcaagacggatcgagactacgacgccgatcctagctagctctcccgtttctgctcgcaagtcacacacagctccggtagatccgcccctcgcctctgggctccaggaagagattagcttcagacggcagggatcgatactagcaagcaagc

SEQ ID NO: 11380 - DNA, 537 bp, Zea mays
tgtttttggatttcaaattttataccgggtcagaaaatttgaatttcggtaaaaccagtcggttttttaggctctgtttggaagtaacctaatttttaataaatcagtttctatctttttagctaggagaggtcagtgtcttggttttaaaaaaccgagaatctaatttctatatactaagttgtaaactgttatgctaacttaatttgtataaactagttttttaaaaacggagtgatttcaaacaggattttttggttggtgtggagaaaattaaaccaaaactgtttggctagtagtctagtactctcacgtgtcaccgacacccagccaaaacaaaaaataaaccaagctcagtagtactgcctcacattcacactgacactgtcacacacttccgtcttcacactcactctttacacgaccacgctagcacgccctctccgtctctccccttccggttccggttccagtggctgcatccgctgcgccaccccccgtctgctcacccaagtcccaatcccgcagcccggcggc

SEQ ID NO: 11381 - DNA, 131 bp, Zea mays
atctataattcaattctcaatatctatgaatattgtttggtttgaattcattaatagttctgcacttttcatgccttaggttgctgatttgtccggagagcttatgaggctcgcaattggccgtatatctg

SEQ ID NO: 11382 - DNA, 825 bp, Zea mays
tattctagtgcattcaaccatggcctaagaaggaataaaattatgaaatagatttctttcccgtttattcacctctagaactaggttgatgtcacttggtgagatcaatgggaacatttcctgtgcaatcatatactttgtgcatccgaacaatcttcacctttgattgtccatcctatggtgtcttcaaataatataaggaggggtatttacaccgaggggggtatttgcacggagacacaaaacaaggggttatttgtaaaacattatcaccacatgatttacaaaatgatatggattgcttgaatatgcccccgagtttaattggcgcaaatttgttgtggggattattactaaaccttgtggcaatgcatattaccaaaaaatgaagctttatggaatgatgtatatgggacctgtatgcacagtaatagttcacctgatgcataatatgttctttttgcatcctggatggggtttgatgtggcctaactgtgaatggagttgttcaacttgttattcatccttcttggttggagacaatagcatgttcattacccccgaaaaggagacatttcttcagatgctatttttttcctgtttattttttttgacaacactgacacatttctatgtgcataggtgacactattccttttcttcacttggtgtataatctctctttgctccgatcaagcttttcaaacataataagcaaatagtctctgcacgtgattgccaaaattagtcaagacgggtgctctttgctgcgtggccgctaggccacatgggacaaagtctgaccctgctagcagagatcgttct

SEQ ID NO: 11383 - DNA, 961 bp, Zea mays
acgggccggtcgcctgtgagctgtgcagccggcgtcgccgccggaggaggggctctgttttgaagcagctcgctcgagagcgcgcggcaaggccgatagaggctatgttgcgactagtagcaaggcgcatgtgctgcgtcgtcgccggccaccgaagatggtgggcgggggcgctctggccgcttttactttcagcggggacgcttaattagttagatggtcagggaaattaatcaatggatggctgtggtgatgaggagcagaaattagcagcggctcgtcacccgcgccgtgtaccacgtagtaactattgcagctagctttgctcgcttcaatcaatggaatgtggctgttcatcgttgcaacatctcctctgtctcaactcaattgaatgtgccaatgtgttgtactcagctaagaagccagttcctgcatcgtctgattcatgaatcatctcatgctttatgaggtggtgcacgacgatctccgtttggatgttaatattggagtgcatagaactgaattgggtttagatgaagtttccggttacaataccagtgggctctgcaggggcgcatggcctattctcgcgtcagggggcgccggcccgaggccacgcttcatgggcctggctgggcagttagcctcgtgcccataacaaataaccgcacgtccacgccgtgtcatgtccgagtccgtccggtcgctttcggaccgtaatctgctcgtgttggctttatccgtattcaagtctagtccagggctccaggccttgtgcccctatatatacttgttccaacggcgtcaccgcgttcatcgtctctgcttgcgctgccaagtgccaacgaagaaagaaccatccatcgatctatctgctgcggatcatcggcgatcgctagcagccgcgcgagacacccgccctcctgaccgtacgtagcaagcagcagcggcggcggcggcg

SEQ ID NO: 11384 - DNA, 1500 bp, Zea mays
tgattttaattgaggattacatataatggctcgtcgcttttaatttgtgtattagtgaatccctggttggcaatctactcctgtagttaagtttcaactttcaagatcagatgccacgcaaagtcagtactttgaaatttacctatagcttggttatcggagccttagatctctaattgggactagtaaagtaatatatcggcagtacgagttaatctgaagcatcataaaataatttatagatttgcagggaatagaagaagggaatagagacatcgggatttggaaagatggaacatgaggcttaattcccttgttccccttgactccctagtgcaaataaacctatattctatgttaactacactacaaattttcagatacactattttttatatcctacattacacattgggtaaatttgtcgtaggtgtagtaaaccagagataaatttcggatgaaatattactaaaccccctatattacacattggataaatcagctatatcctttattattaaattttagattcggtataaaccgtttgcagtgacttagttaacctggaatgtaaatcactgcgtaaattgtataaaccagttgcgctagggaatcagaggcacaatggtcgcttctaataactttcgattccatctacttttagaaaatattgtattaataacgataatgtctaagagcaaattgccacaaccgaggagcgtcaactagaaatctagaattcactagcaaataccaaaatttatagatgccatatccaaatttacgaagaaactaggccaaggaaacagcagctgcaggcagatgaagtgataagctcgccatgtttcacaatagcaaacttgcaaaatcacacaataatgacagtgctatagatagagacgcctgattgcttgttctgaggccagttttggggcaggtcccctgttcaaggacagcacaacctttttttttcgttcggtccttccagaaccagccaaaacacacatacgtgcatatacccatatacacgcatggacacccccttaggtccttattgtgagtgagcctatattagtatatagtcaatgctcccatcaatcaatcaaaaactagtatacagctcaaacctatctgccaaagactagtatacattttatacacacatagggtttgtctttgaagagaatcttggacttgatatctctaccccactccatataaggcagcaatacatcccttttcccttgtactatcactttcctcgtgtttttcttgcctgtctccatactcatcgatcggttgctttttgtcgtcagttcttttgaggagctgagctacaatcaggcaagggatatttccgaggtttggtctgttactctttatacaggagcagtaaagtatataaggatgtagcagtttgaagcatctaatcttgtttcccatttgctccatgtacatatggtgtgcttctttgatcttagctaggttttacagggagga

SEQ ID NO: 11385 - DNA, 524 bp, Zea mays
gtgtgttgataatgtgttgaataactatgttatcacagattaccagatccgcttccttctctcccgtcagcagattaggcacgagaagttgtataagaaccgtctcccttctcataaacacgtcagagaaaacatacgagacacatgatatagagttggacctctgacctctttatcatatgtattctatataaggggtacatgttctatatatatagatacgtgataccctcaaaggcatattgggtatttggccatataacactttgttagtttctgaacactaacaactatacattagtttatgagatcaaataggccgtaacgatggacgccagcccatgggccaacgatcctccgtgggccgacttcctaaccgcacgaacctccgagacggagcgtgacgcccgcctcggcgcctccgccctccgtcggcggcgcacggggagcatagaaggtgtcgtactcgtacctctcgcacacgcccccatcgccacgcgtgcaacgaagctggctccgtcgcc

SEQ ID NO: 11386 - DNA, 877 bp, Zea mays
ttaaactcatagtgcattggttgagcatgtcatgccattagtgttttttgcttcagtttctgttgctcctatctggtagccacttgttgcaacatatatctgactttgagtggattacttgcacacaagtgctattgggtggatcggctaaccggtccagatacatagcttgtggactatcgatctccacaacaagcttagtccacaagttctttgtcttatggcttattaacgagtaaacaagttatactgtgcaatacttatatatatatatatacaaactccaatggggaaccttgctttaatttctgttacacacatataaatttacagacttgaaaaatagattaaggaactattgggcgcactactattaatgtccatttcatcaatctgattgtcactaggtggttatgatacttgaaacagattgtgctttctatttttttattaaataagagactgcactatctgatatttaagttaaatctcatcattatgttgtgttttttggcacttgtattagtgggcacggcaagcagtagcagccagatgctgtgtagtgttctgtttcaaattgatcttgacatctttgtgttctaaattatgtccatgaaactggccaccgtgaatccaggtggacttaaatagcctgcctaacgtcctccctaaagatgtgaggacacacatacatgatcgctcgcttcatgttactacatttggtttcaggtatggatcgaggggccctagctcacattttgttcctgtttgtgatcaggtacatcagtcttgtggtccgccacatttctcgctggagacctcaggcgctccgttgtcgtacctcagccagcctcaccatggaagccctcttggctgc

SEQ ID NO: 11387 - DNA, 845 bp, Zea mays
ggcatgtcgtcactctacagtgggcaagaacttcaaatgcaaagaaacgcctctgcaatttttcttgaataattttataagctagcaactgaataattttcttgaagatttcagttgcatggcatgccgtcactctgcagtttataagctagcaactgaataattttataagctagcaactgagtaaatgcacggcatgccgtcactctgcagtttataagctagcaactgaatacttttcttgaagatttcagttgctcggtccttgaagagtaaagacaaaatcaaataattactacatagcagtaatttacctgaattaagttatgaggtattcaggaaagtgttaaacatgtaatctatcttcaaaaagagaagaaatgctaccatgtagaacatggaccctactctcagggtgtgtttgaaatgtaggaaagaggaatacaggaactgcattttcagaattggactgctcggttctgtctgctcggttttcagaaacatacaggaactgcattttcagaaacttgctacttcagaaattactgaccagggactaactgaagctaactgaactaggactagggaataactgaagataactgaactgaagctaactgaactaggactaggcaaaaaaggtagcatctctatatcaccaaggcaccgccgatcacagaccaaatccctccccccctctggtccatcccacacgtagagcagtcggtatttcttcgatccgtgcttgcgcttttttttctttgtaaagatttcgtttccctcccttttaactgttgtcgagaagtttcgacaagagtggtgtgagtgttgaagagctcctcaac

SEQ ID NO: 11388 - DNA, 921 bp, Zea mays
tcgtattttagggggtgtttggtttccacgtcctaaacttaaatttactcactaaattaccaaacgaggtgactaaaatagttctttaaaataaccaaacacccaaatctgattaaactaatatttagtactcatatttgatattcaaacatttaatacgatattttagtcaggaaacaaacactagggttagatctagatacttattcggatgtttaatttttgtattatttctttagttgtgaacaaataacatatagaatttgctatgtaaatttacactcttgtttttagcattaggtctattaatattcatagaaagtaaaccttaaattccttctataccattttaaataattgatataaaattcagatacaaattcgaatgttttttcgttttttgttgtacggagaaaattttattttgtatttcataatatttcttaataatatggttaaaaactagcttaaattctatgtatatgttaaaatattaaatcaatttcaaatattttagaaacatttgtaagactgtctagaagattattcatccccatatctatatttaaactatactttgagaacaatataatctatagtacgagtgttttagataactatatagtctgttagagtagttctattcgctgcaactagattaaagttattcagactgctacagctataattagaacaaaataacgtagaaaaattagaagttggtggattaaagccgtagccaacaggttaatctgctgaacacggtttaacaaacaccctacccaaaggggcggaaaccaagccgccctgaccgccagacccaagccaacaagcaagagcattactactgctgcttccgaccgaaacctttcttggaacgcaagaaggatctccaccccgaccgacctatcctaatcggcg

SEQ ID NO: 11389 - DNA, 1500 bp, Zea mays
ggtgtgctttatgcaatttgacaatttccagtatttgcataatgaggactctagggaaaagcctcgtagtgagaccctagccattcaccccggaagtgaatatgggtctagctaacccgggctagaagggaatcgtgactcatgggtaaagatgtgccacctctgcagagtgtaaaactgatatatcagccgtgctcacggttaagagcatcttggactcctcacatgataattgaactttgaaagggaaatgtgcccttgggccatttctaaatattttggtgattgagtgccaacacaagtgcttttgtgttgatctatgcaatgtggtggacaaagtgcaaatcacgtcaaaaggtatgtttctagacttaatacattattttatggactaatgtgttgtgtctaagtgctggaaacaggaaaaaacgaattggacatgagatggctttgttcagccaaagtctgctcagtctgggagcaccggactgtccggtggtgcaccggacagtgtccggtgcgccaggactggctcgagcgaactggccgctctcgggaattcaccgacgacatacgactataattcaccggactgtccggtgagccaacggtcggccgggccaacggtcggccgcgcgatctgcgcgggacacgtggccgaaccaacggctagaagggggcaccggactgtccggtgcgccaacagctctctggctgccaacggtcggctgcgccatttaargaaggaaatcgggcaccggatagtgtccggtgtgcaccggactgtccggtgcgccacgcgacagaaggcaagaattgccttcccagattgctctcaacggctcctagctgccttggggctataaaagggacccctaggcgcatggaggaggacaccaagcatcctttgagcactattgatcactcacacatcattcttgcgcacttgttcgacattccagtgatttgagctccgttctagtgtgctagccatttgagcttaagtctgggttctgtttgtgcgtatttgctgtgatctttgtgtcttgtgtgagttgctaatccctcccttactccgtgcttctttgtgaacttcaagtgtaagggcgagaggctccaagttgtggagattcctcgcaaacgggattaagaaaagcaaagcaaaacaccgtggtattcaagtgggtctttggaccgcttgagaggggttgattgcaaccctcgtccgttgggacgccacaacgtggagtaggcaagcgttggtcttggccgaaccacgggataaaccactgtgccatctctgtgattgatctcttgtggttattgtgttttgttgagactcctctctagccacttggcaattattgtgctaacacttaaccaagtttttgtggcttaagtttcaagttttacaggatcacctattcaccccccccctctaggtgctctcaattggtatcaaagacgttctcttcacaaagggactaatcgcccgaagag

SEQ ID NO: 11390 - DNA, 1500 bp, Zea mays
cagtttgccttatttagttcgcgagtaagaacataaaaaacaatataataataataataataataataataataataataataataataataataataataataataataataataataataaatttctagttaatttcaaactaatttaacaatataaatactaattatgcttatagtttcatatatcacatcaatgaaacaccaaattaacaaaacctatcgcttatcaatttacaattcacagacatgttcattaatttaatccatatttatattcgtataaaccaatttaatacatagatatagtttatcaattattaatttaattcatacgtcatagacaccacacatacatataatatgtttattaattattacatgattgatatatatagtttcgtttttaaatgtggtggcttgattaattcgtgagctgactcgttaataaattaagatgactcattaataaaccgaaataaaatattaatttaatttttaaaaaaattgaaacgagtcgatccaaaacgagcgagggagtaaagtgaacgaaacggcgagtcgacgaacgcggttgcaggctgccacccgcaatagactagcggacccgatccgttgacagccagccccctgttgcccccgcttttccttcttcgctgggcgcctgggccctcccctccccctcatttctccctgcccttgcctcttctcccctgtcgccggcgagagctcgggcggagacgccgcagcacccgcaggagagcttttctccccgggaaacaaggagacctccggagggctcttccttccacgaggttagatcagaggaaagccactccctttcccttctccatccatctcctgttttttgttttttccatttattatctattcattttttagcattcctgtgaaaaagttctgggtgcgtaatggatttgtcgaggtcttatctgctttggtcggaggaggttttcttccgtcgtttcaatttctcgaagagaagatcgagttgtcgtgggagaaatcatctccttcttgctactactgataaagaagagtgccttttcatttggtccccgcggtttaggtttttgttcctgtgtaatactcctactagttgctcggtgtgaattctgacgagcgtttataataaataaataactttgaattccatccgttttcagggctgcggctgttggattgtgctgaaagatctcagtttttatctccaaggaaggattactcatcgcgaatccggatctgtcggtggtggaaactggaaagttgccacttttatgaggcgaggctgtgaggaacccgtgtccctcccgtggatgtggtgagccctgattggcgcaccaggcgagaaggggcaggagcccagtaggtggtgacagagcagggtgagagggagaaccggagaagagaggtagccggtatacaagacaagcaggcaactataggaaggacgaaggaaaaggagaggagggagctctcc

SEQ ID NO: 11391 - DNA, 675 bp, Zea mays
tctgcaagaagtgactgtacctcgctgagtcactcactgtaggtaccgggaagaaggtggtttttatctgatcacactttgttgtttgcctgcgacaagtgatctcatccacacaaaaaaatttgctccaaggtgcctgccaaacgcagcaattatagattattctaataaggctaattaacagcccttaggagtgaccaaatgcatcagatcgattcgtaaggctaattaacagccctttggacgctcgcgctcctcctcaaccatcaaacgatggcttctcatgcacgcccttcccatctaataagattcatgtttacatgagagagtgagtataaaatgtgtctctcttgtctaaagcttcatgtagtttaaactctagataaaagtgggcagagcattattagggtggaatatatggttattaatctcatcccctgcgccggtacacgtgagagccatctgccacataacccctccaacccaacctaatgatccaggggcattcccgtccatggagactgtatatatactgctcacgtccacccagacccagccgtgacacaaacacaaccataaactgctagcgagcgagctaactttctccgtcggtccttcccttcccatccctctaccattcttaaatcttgctcccaccagtctgcttacctaagc

SEQ ID NO: 11392 - DNA, 1500 bp, Zea mays
agtagttatattggctcaattccaagcaacctttacacttacattatgcaaactagttcaattatgcacttctatatttgctttggtttgtgttggcatcaatcaccaaaaagggggagattgaaagggaattaggcttacacctagttcctaaataattttggtggttgaattgcccaacacaaatctttggactaactagtttgctctagtgtataagttatacaggtgcaaaaggttcacatctagccaataaaaagaccaagtgttgggttcaacaaaagagcaaaggagcaaccgaaggctcctctggtctggcgcaccggactgtccggtgtgccaccggacagtgtccggtgcaccaccggacagtgtccggtgcaccagaggactccaactccaactcgtcaccttcgggaaaatccagagccggctcgctataattcaccggactgtccggtgtacaccggacagtgtccggtgctccaacgggacgcggctctggaactcgccagcctcgggatttcacgaaggctgctccgctataattcaccggacatgtccggtgtgcaccggactgtccggtgcatcctcggagcaacggctacttcgcgccaacggctacctgcaacgcattaaatgcgcgcgcagcgcgcgcagaaggcaggcgcgcccataccggcgcaccggacactgaacagttcatgtccggtgcgccaccggacatcgaggcgggcccagaagtcagaactccaacggtcagattccaacggcactggtgacgtggctggggcaccggacatgtccggtgtgcaccggactgtccggtgcgccatcgaacagacagcctccaccaacggtcatgtttggtggttggggctataaataccccaacaaccccccattcattgcatccaagttttccacttctcaaccacttacaagagctaggcattcaattctagacacactcaaagagatcaaatcctctccaattccacacaaggctttagtgattagcgagagagatttgccgtgttcttttgagctcttgcgcttggattgcttcttttctttctcacttgttcttgtgatcaaaactccattgtaatcaaggcaagaggcaccaattgtgtggtggcccttgcggggaagttttgttcccggctttgatttgagaagagaagctcactcggtccgagggaccgtttgagagagggaagggttgaaagagacccggcctttgtggcctcctcaacggggagtaggtttgcgagaaccgaacctcggtaaaacaaatccgcgtgtctcacttcattattcgcttgcgatttgttttgcaccctctctcgcggactcgattatatttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 11393 - DNA, 199 bp, Zea mays
ataactgtcagagagagtgggagtgtgaggttagggtcttcagaaattctgtgtatcatcctgctagtcaccatcgctgatcggtgtaattaattaacgaaatatatagtggtgtgtgtgaatgctagtgtgctgccagatcctggtacgtagtgctttggacgattagtgtaatgctggagctggagatatatttgtc

SEQ ID NO: 11394 - DNA, 1500 bp, Zea mays
cgttggcctctcttgtttgtttgctttttgtttaaagaagaaaaaaggaacggagaacaatgggggcatagcgattatgggggaacgtgcacaggacttcagtagaaacgcttttagttttagccaggcccagcgcacgattaccgaactttacccacccgaccgacacagcaatgacgacgaaaaaggtaatgcagcgtcgggccaccgatccgtttggctttggcggcagtaggcgagacggcggactccagttgccagttggcagcgacaaaagcgagatgcgtgtgcagtggaagtagtggggttggaacggacgagacaacggaggatgacatgacatctgataccgtagccagacccgccttggtccccagatatcggcatatcgccttagcggcctaggagtatcagggggtgtttgattacacccggctaaaatttagcatatgtcccatcgaatgtttgaacctccgttccgggtattaaatgtagtcggattataaaactaatttgtcagccgaagattaaaagacgagacgaatctagttcagttagttggatctatatttcatactcctatttaaaagtcaaacgcttgatgtgacccgagctaaactttagcaggagcaaccaaatacagcctgagtagggtccaaaaggagacaagaacactgaacacctaacagtcagttaaatcactcgagtactctgaaagccatggttggtatgtccatcacgtaaactcccggtggcgtaggcaattcgagacggttatcaaaaggctagactttttttttccagagtctgatgagtgagatgatgtgtagcatgaacagtgatgaaggaacgcacgcccgcacgcgtgaacgagaagcgaggagagcgtgcgcacgagcatccatgtgtccataaaggagaagggagaggagtaggagcagtagacgaatgatggtgccatactgccatcgccgccagctcaagccctcccttcaatccaactccacctccacaaaaatcctatccattctccaccaaacgcccccacgacgagagctcatcatcccctgctaaaaatttgcgtcttttatttctaaagattccttaccggagttttctttaataaaaaaatcccccttctgttgtccatttctcgacgcgccaattgtttttttctttctttctgatttggattcgtggatttggaccacgcgcaccaccacaaccaatcctcctccccccttcgagtccccgtcctgccccaacaatcccaatctccggaagaaggggaagcaagcatcagaaatcctaaatagggggggcgcaccaagaactccactgagaatccccaatcatttctcggtgcatttggccccgctccaccatcaccgaaatctccaagaaaactcatcccgaatccgcccccgcccccaaatcggccctacaccgcaccagatcacagctcataattccagtgagaattcggaaaggaggggagca

SEQ ID NO: 11395 - DNA, 1388 bp, Zea mays
cccccccccccccccgaccatggcaatcgctcaggtcctaggatggatgagcacgatgcacactagtggtttggtgggctggtggctagtacgcgcctacgcggatctcttgacccgcgatcgtacaaaaaaaacagcagatctagaagcttttgaccacctgattttctgcattttaatatatataaagagtacacacaaaacaaatcgtctgcggcaggtggttcatggtggtacgggtcaaactccttgtgcggcaggggttggtttcagtttcacgcggaaaatctcttctgctgactgttcatatacctcccgttcagtactcagcacgtactagtgtagtaccccgtcccaaactaaccctcgtcttatttttgacgagtcaacagactttaagctgggctaaaattctagaaaacagtattgatatgtgtatctctaaatagggtttactataaaacatatagtatgatgtaggtaatctaataatgtttagttggtattataaatattagcgtttttttttcttcttctagctgtctgtttggtcagactgtaagattagttaacttgtcgggatgtgagatgcgtatctcttaccatgacgcagaatcgtagcttttctttggtcagccttacacacatcatcctgcccaccttacgcttcgtgccgtttccgtcagcaggacttcggcggcagtttaaaccgtgcctgtgtttgtcgcggtgtgctgctgtggtcctgtttattattgcccggttcagaatgcaaactttagtggaggatttggggattacacaactactactagcattttctgattaggctagctagttatttgctcttgcgtggctttcagaattagcatggatgaaaatatctgctgtacgctaccctcagtcagtgaagagaacctttttgagatgagatactctctctctttttctgatcgattagcactaccagagatgatgtttaaacgagctgctatttaccaactgtagaaatttctcagcttgctttctgatgaattaattcccaactgtagatatccttattattgagttcgtgcaccagatttaatttctgtaagcgacaaggctgtgcagttggttctcatatttcactgtcaaactgcagtaccaattcccttacttactggtacattgctttgtaggttgtgttctctctctcacatgcttaatctactgttgcaggttctgtttggtcttcataaagtagagcactagctagaagacatattcacacgcatcagctatcaaattgcaagcttagaattgacctcaaagttgggacatgcttgtcttaccacaagcaactgatagcttggagttgtagtccggactgtctgcgctggaccagt

SEQ ID NO: 11396 - DNA, 400 bp, Zea mays
cctgtgggcatatgcatggagccttccgatcccgcggagctgtcatggttactgcatgcaagtcccactacaagaatatggtcaatatatatatgtcagctaaaaacctctgtaaataaggcccaaatcatcataattagttattaatatcgttttttttcttattaacatcaggtttgtatataccgctactaataaaacatcgtaaataaccttaattaagtcaattggccattaagtcgaccgccgcggtagccgacgtgaaaaaagtcagccggtcatgaaccgttgtaacctatttgtttacccccagattatataatctggattaaataatcctaagaggcaaacaaacagtctagcttatttgcccagattatataatctaaccccttggatt

SEQ ID NO: 11397 - DNA, 1143 bp, Zea mays
tggccgctctggctgtccacggccggtcagccgcgagcgagagctgggctgagctgccgtgcgcgtgctaacctggactgggcagcaggcatcagacgcatctcgcggcatctcggcatgtggaagctgtgaagaggagaagacgcggagaggagatgctgcaacagaagccgaaccgaacgaaaggaaggagagagagagagagagagagaaaaaaaaaggacggctccgcccaagggtcggaagggagggagttgccgcgccgcggcccggttcgatcctttgcgcgagatcgagcttctccggttggtgttggggctggcgacatctgggatccgtcgtctctcctcgtgttccttgagcaggtgacgatttactctttgttgcgtgtgcatgggtgggggtcgatctgcctggttgtttaagggcgtaatcgcactgttctgtgattagtttaggaccaccgaggtcgcagcttacttttgcggtggactaggattcgggatgctttgtgatttagccttcagcgggtggtaggaccgtaggaggattcccgtggtaatcgctggtgagattttgctctggtttcggattttggggttagcttctgctgaagtgcttgttcgagcaaactaatatccaagcatttagcggtgctgcgtggtacgcgtacgccccccattttagactatacttgagctccaattgcccaactgatattagttttgcagtattgttttgcagattcctgagatacctaccaacccctgatctccaattgcccaattgatccccatttgagttattactagttgttgattccaattccattacatgtttgccctaactagatattcccttttccgtgcagttttccacttgcctggcaaaagaacatttgacttggaagagcaaacactggaagctttgtggtttgtcctaagtgatcctatcaagttctcataggctgcatactggtacagcattttctccttgtgttttgggccacagaagaggggggagccaaggatttttctatctcgtaagccgcggccttggtgctcatagttaccctagtctgtaagctggagattgtaaaaagccatatctgttcctctatcactgtatatagagatctacata

SEQ ID NO: 11398 - DNA, 512 bp, Zea mays
ataaattagcacagtttagtctctgatgtgtgtagcttcgtcacagctcgattatccgatgccgtaaatattgtgacgagccttgtgaaattgacttcgaactaataaatctgtaaagccagcgtgtggtgttgttactggagagaaaagtattaccgccagtcgccagaaagaaagagagaaaaagaggccggcctcgtggcgccttcgcgtatatgtataaaaagaacgcagcgcaaccggcctctctcgccgtcgttttcttggcgttattagtcctgccggccggcctggaggggaggatcgatcagcaaggccaatagccaatagccaggagccagtcgccagccagccagccagccgcataaatccatccatctcctccatcttgctctccctctccctgcaggccggcagccgctggaggcacagacgacaaggcatcggccccggatcgagcccgacccctcttctcgtctcgtctcgtctctgcgctgggaacgccggctgcc

SEQ ID NO: 11399 - DNA, 876 bp, Zea mays
aggaaacatgggaaaaaatccggcatcaaattgcaaaaaaaaatcactgtcgtacctagtggcaacggatgaggtgtgaacaccatacaaactaactaacaatagtcaaaaaaattcttaaaaaattatagatgtacttttttgcccactctaccactctataaaattttaaattcaaattcatcagatattaaaagattcgaaaaagagaaaaatttgagataattttcactttttatcaaaggattttatttttttatcttttaacaaataatttgaacttgaaattttacacaatggtagaataggtaatgaaatacatctgtgatttatttgagatttttttttgtaatttttgttaattggtttacagtataaaaattgatttgcatatcatacgttgctttacctaatatcaaatatccactgaatgcatgacatgtggtgcgtccaatgtccatgtcacggccctgtgaaaaggacaaaacggcaagtctatctactagccaggcctgtcagtgctacacgtccgggtgccattttgcagaccgtcctaacaagcccgccgaacacgttgaccccttccactaatcacctagatgccaacaattacgtgacgtccaaatgcggattagttaatcactaaccaacgtgctaatcgcccggtctgtgtcgcggctcagctccgtcctgtctccttccgcgcacagcacaccctggggccgggggccatataagcccccccaccgggccacccggtgctccccggagctgaattcggaaccccagcgcaagcggcgccgccagttcagcaagcaagccacatcagtccctacttggctcgtggcgctgagccacgcgtgcctgtgccgatcg

SEQ ID NO: 11400 - DNA, 84 bp, Zea mays
aacttttaagccgatccaaatgggtaaggccccgtttttcaatctcacgagataaactttaacttcctgctaaactttagctat

SEQ ID NO: 11401 - DNA, 902 bp, Zea mays
gaagtccagcgcaataattgagcaggcaggcggcaggcccctcctaatcactgccctaaacacatgtgtgccgggccgaggtcacaatcgatgcacggaggaggatgccgccgtagctgcggagattgataatataaagcgggcggagaccgccggcccctctggcctcgctgctcctccccccttcctccccccacatgcgctgcccccgcccggccctgccctgccctgctgcgcccaaggtgattggttgtttggttgcttgctttgtgcctttgtttcacgctttccccccttcctttgctcccatcgaccgatccaatagctgagattcagcttgtggatccatctgttcatctatttactggtacggtatcgccagattaggagcttctgtgcctgctacctgtggatccatctgtgtggtaaaagatcatcgaggttgtttttttcttcttcttcatggtacacgattggttgtgcgttttgttaggtttgtttcttcttgttcaccgtgtttggtgcaatatctgggacggcctaaaatctgaaattgttccatccgttcctgttgctttgtccatgttcttttcctgattgaattgcgtgttggttccctggtgcttgaccttgctccagcgtagatgatagatactctttcagagcgcgtccctgtctttttttaatttacgagctttcaaagacgtctgatctgtccatcgcacaagagcacacgaatggttcaatctgccgtgctaaatgattgctgcgttaagtaggacggtggattgtagcgtcatcactctgatcttcccatctcgatttgtttgtagcagctgaatctccgcacagacaattagagtagctgcattggcggggaaagcgcaagaagctcagcagaa

SEQ ID NO: 11402 - DNA, 1500 bp, Zea mays
agtgtattcgttatgagcatctgttttgtaccgcaactcaaagaatttagattgtcgcctttgttaggctgtgtccagcagtccgctgacgtgaatgtgcaaaacaggatgatgaagaacgatgcgagcatacaaacaagatgctcacttccagcatgtggacacacaaacaaagaagagggggagaggatccgtgaatttgggttacgaggagaggcagcgtcttggaaatgtgaacaatttgcttgtgggcacttgtyttacgcatttgcgaccgtttacacactccgatacatatatatagctgcaattcatttttttctagatgaaattcggtcaaaatttatccaacaatcgaggtttcttaaccgaggatcgtctaccagttctattgggcactctgaatcttttacataaaaaacaagtatgcaaaactattttataaattggagactccatcatatttatgtggcaaaacggtatgcatatccaaactctcgactggtatataccacggacagccccactctttccacttcccttcttgtcttttgtgtgggtctactgtcacaatgttcacacctttattcttgtgctagtatcttgcgtactttgtggcagccattgacaaaggtaaactgacatcaagagatgcaaatgcacccgctgaaaatgaaaaaaaaacaaatgtgattcgaactaaaattccgtcataattcatgcaccttcgacgacataagcccatccacccacaagacaagttagatactagcaggaggcggcagcccaagaactcgatctctgaaccatccacccacatgcgggcccgggggaaggcagatggcccaagaactcgatctctgaaccatcaactgccgagtattctgtctccgatgcattaatctgcagtcgccatcagtataacggttacaggccaaattgcaacatccaggatcagtgtaagccagcaatgccgtggcgtcaaatccaaatcgaattgcttaacctctcccaagaacggccaaagcctatttctgtgacactggcaacgagtgtagcaacagtcacactggcaagcaagcaagcagcaccagcgtttactcaaagtcgcaaaccaacgaaatgccatggcgaagctattgtggaagctggcgtacgtcgagcgccagcgctacgcccagcgtcggctcatcgtgtggcaagtctggacattgtgtaatttggaggattgcagaaaaataaataacttgtggagtttggacaaatccagccggtccttatcagttagttcaggctatacaaagacgacaatgcacacgtcgccaccaatcttgttttacttggctttgtccactgcacttctgctgcggtatatatatatatataagccgctctgctagcagaagcaaaacatgcatcgggaacccttacacaggtagataccacaaccctgtgcagagttcttgcattctcgtcaaggtgacaggaacgacataggaa

SEQ ID NO: 11403 - DNA, 1279 bp, Zea mays
cggtgccctgcggtggttctttctcggagtcggacgaaggggatagccggacatggagagggcatgtatctgtttttataggtgtacatttgggccgggccagataggccggcccgaagcacagcccaggcacggcacggcccgaaataatttagtgccgggccggcacgacccgttatattgggccgggtttgggccgaggtcacggcccatgggcgggcacgggcacggcccgtttaaggcaggcacgaaatggcccatatagaggcacgaaaaggcccatatatttattaaaaccacacttcattccacactttcatatacttgataaagaacacaaagctagagataatgctagttagatgttttttgtagctttgaattagagtgtgtgatgtaattttgcttttgttatgaacattagacaataaactgaacttacgaactttgtatagagctggttatactctttttccttctaacaaaatgatttataaacgagatagtcattacatagctctggtaactttaattaatacaaatattaattttgattttgttcaaatttatttgtcttatcttttatttgttttattattttttttgaatttagagctataatgtgaattttgggccaaaaactgaatttcgggccaaaaattgaatttcgggccctaatgtgaatttcgggccaaaaaatgaatttcgggcttttataatttcgggccacccaaaatgagcccggcacgtttaatcaattacgggccgggccgtgggccgagggctaggcacatgggccggcccggcacggcccgaaattcaaacgggccaggccgacccaaaattcaaacaatacggaccttttgaggcttgggccgggccgggccgggcggtccgaatgtacacctataccttgaggtttcaccgaagtgatatgttactggaactcctagttattaattaatattccggcttaggaggagaataaaaaacgcacgccacgtaagtcacccgctctcaacgcatttccgtcttctcctccgacgagttgccccaatccgcccagacctccaacatcgcaacggagcccaccctgcctgcctcgccgcgatccctccgcgctgctcgaggctcctgtcctgaaccaatcgagaacgccgacttccggggacgggatcatctaaagccgcctccttcccgttgaatccgccgagattcggcgtgaggcgaggttaccgacttcccttgcgcgtagggccggcaggagcgcccgctggcc

SEQ ID NO: 11404 - DNA, 401 bp, Zea mays
ggtgagcagaaaagaaattctacactcactgtgtcacaactttgaattttgggaaataattcatttttccaaaaatatgaatctcaggacctctacattccaacttaatgtaggcatgatatgaaatctacttaaaattgcatgtttgtgaagaaaaaaactatgcacgtttcaatttacctaccctagctcagctactccctctgttccagattataagtcgctttggttcttttagtacatagatccttttttgtatctagatatatgtcatatttagacacatggaaaaaattatgtaacaaaaaaatcaaagcgacttataatttggaaaagagagaatataaagcaagtgtgtaagatattgagacacgaacaccaatgcttatatattctcactt

SEQ ID NO: 11405 - DNA, 1500 bp, Zea mays
aactagtgccagttcatctattccaagttttagccctttttgcctagagttgagttacttctgactttgaaactgaattattgatcttatgaacttatgaatcaaagatttggcaaactagttagtctgtatggttgtgatggtaatcaagtaccaaaatcaattataggaaatggtttaaggccatttccctttcaggtagtttgtcccattgaagaacagaggtttgctaacacctcgttccatatcgcatccgaggatccaaacctattaaggtggagagatccttaaccggctccgataccaattaaaggaccgtgaggcgacaggaggaagggtgaatgggagccattaaaattttcttaatgaagagcttgtggctttctggaatgcaatccaaacctctagggacaccaaaacgctccaaaaaggaacaactcaataaagtgtcgattggctgctccaaccaagttcttgagaagagtataagcttgaaggaacaaaagaacttgatttggaacctaaacttttagaggagactccaaaggaaaaccttcaaggacgagcgacagtgctagggcaaagtacgaatattatctttccatacttgaattcaattcgtctaaaagggatgaaatccgatccgtattcaaatccgaatatttcgtatccaatttatagtcgtattcgtatactcaaattaaatatttaatatgtcgatatccattcgataatatccatcccatctgaatccgtagaaaaaaaaatgaaaacaggtatgatacaatatcagcatgtatccgacccaattacacccatacccaaaagtttctaaccaacacgtttcatggttagctaaataaaaattgatttaatttaaatcactttccagtcatttttagggtggacaaaatactcatggctcgtcagctcggtcggctcgactaattttcattttatcacgagctgagctagcatctcagcttgatttgttaacgagccacctccttaactcgaacaagtatttatcagcaaaacaaaacctttatttgtattggatgaactaataagtgattaactatattaatttggtgttgaattgatgtggaaattgaatttgtaagtattattactcttttctaatatttaattggtctaaagttaattagcaattaattatattgttgtatacatatttgtatatttttttgtttawgactcgcgatataaacgatccatctcaaactcacaaataagcaaagcggagccgatttttcagtttggtatcttaacgatcgagatttttcaatgtctctcgtctgaaatggactggactgaaacaaaaaacattcggggacgcgcctgcttgcttctttccccaaaccccaaaccgcaggtaggaagcaaaccgcacgccccgctccagaacggatcctcatctctcacgttgtcaccacagtctgaatccagaatccaactagtagctccataaaagcggca

SEQ ID NO: 11406 - DNA, 169 bp, Zea mays
gtgatttttcatcatgtcttgcaggtctttgatgtaatgttactgtagtgtatatattaaggtgttctttcmatgcaaagactgggataatggcagcgcagtgatacatgtatagttttctcttaaatttggaagacttataaggaatatcttttcccttttaaactgg

SEQ ID NO: 11407 - DNA, 1395 bp, Zea mays
aggcgcttctttgggctagtcgtccaacccaagatcatccctgaaataaaagaccatgatttcgtattcaagaaactgctgccctctggatgggatttcgaaagagcgttcaggattatcgaggcagagctgggcttctgctatgatttcttcttcacaaagtactgctacaccttcgtaatgactaatcagctaccggtgccggtcatccagtctttggttttagcaaagatcgttctaatcataaccgttggggtgtttgccgtcaggaattcactggtacttgagacgccaaatccgatcattgaagtacgcatctcaagagctaactacatcatcactctactgcttctgggtattgccctcatagtggagctggtgcatgtggcattttatctgtcatcggactgggcccaggtatcactagccaccatgcacgtcaagaaacaatggtatgaaatcagcccatccatctttggaacagtcatcgctttccttagaagggtcacgttttctggacagctgatgagaaacaggatgaagcagcactcattgatgagaaacaggatagaacagaaagatccagtggaggtttctgatgcagtgaagagagctgttgctagatcgctcatatcaacgtatggcggcaaggaggacgacgccgtagaaacatcgcaatggcaggaccagatgccgttccgtacgtattcttgggcactcaagggcctctctcagctggaagtcattctaatttggcacgtcgcaactgaacactgtgatatttcctctggccgtgctcctactaatcggagtcggactactcctcgagatgatgaccgaggcgttgcagttcatttgtctagatactgtgcgtacttgattggatctgtcccagaactgcttccgtaccatgaagccgatatagcagagttggcacacaaggtgatgggagaacccacggaacaagacgacgacgctcggaatatcttccataaaggcatcgagctcggtaagcagctggagaggatggcggatggggatcgctggaaggcgctgcaagatttctgggccaagacaaccatccatgccgctaagtcgcactacaccaccaagcaacacatgcaacaccttgaaagtggcggggagttcctcacgcacatctgggctctgcttgctcatgcaggcattctctaccttaattctgtgaaaaatgaggatcaggaggaacaagctaatctaggctctgggccttcagctgttgcatgatagattcaagtcaatggcggagctatatatctttgtcggttttcccccacaagtttatgttccagatgctgttgttccatttcgttttcagtctttctagtgtctgtcaaaataagctctgctatctgc

SEQ ID NO: 11408 - DNA, 127 bp, Zea mays
ggttggagaagagcgaaggttgtgggagatggctaaggggtttattttcctagcagctaatcttcctcacggctaatttctgttcaagggttgtttttctgttttgaggggtttaaacctcagtgtc

SEQ ID NO: 11409 - DNA, 1174 bp, Zea mays
ctgggcttctttctccgcttgcgtgctctcttcctatatatctagcgatatactatctatgtcgcctccagatgctcaggtctttgtcgtgtccttctctgacaacgaacaggtatgcacgcctattccctttccctcatgctctacgaaaccttggaagtgggggaggcgaggaatgagggtatctaatttgctgtctatggtaaccgtgtgtttataaaaaatattatacgaaaagtggagacaaccaataaaaaatcatgagatatttttggtggataatttacgtgggtattgttgtgagccgtcgcaacgcacgggtaaccgactagtacccctaatgttagactgcaatcagccatagatggtatgaacatgatttggtgttaacacgttagtactctaatcgtttttagattatatatgctgccttcttttgttggtcatatataacggatagcagtttttatttcgtcgcctgaatcccggatgaaaggaagtaatcaaactaataataatacaagcccaaaccttgcctgccacgcacgcacacaggatccacatgcggtgaatagcagccacgtatgccgccgtataatattctttagacgacactggacgccaatacgccatcgtataatccgcgcacgaagcatattatctcttatctctccattccactcagccgcccacccgaaccaacaccagaatcgcgcacgaaaccagtccacatctcagccgagacgacctaaccagcgccggccggcaggcaaggtcctggcctgccaatgccatcgacaggcacaatgaagcgtgtgcggtttgggctcttgtggatgcatgctagagctactacaccacctggcaagctagctagccagcctttgggatttgtatggctatctggcattgcccgccccttgcacatgttccaacagccttcgtccatcttctccatttggcggccccttccgtctcctccctagcttgcactatataacaacaagctaccatgcaacatctcttctctcacatcacatctgaaacagaaacagctagaagacatattcaacagattcagagaaagcacatatatatagatatatatagagagagagaggcaaaaaaagagcgagagagagctgccgattaattaccaacccggccagcttcc

SEQ ID NO: 11410 - DNA, 1000 bp, Zea mays
tggccggcgaccgatggcgtcagatcggccgcgacggcggcatctgcatcgggcgcgcgcgggaggcggagaccaggcgctggagacggaggggaaagtgctgggaaggttgcggagaagcgtgcgccttaacgtgagtgcgtggacgtttagggcggtgcgtgcaggtgcagccgtggactggggaaggggatgcccgctggctcgccgcagcttggggcttttggttggtggccaagttggactgggcgcgtagaaaaacttgccccgcgaggccgccagccagtgaaataacctttcctttttcttttccctccccgttcgctttcgtcctccgtttacccggctggcttggtgaccgctgcttggggttggaggagggacacgataggcctgacggcacgatgaccggaagagtgacgttgctgaggatatggtgaccgtgatacctgttcagagcagcttgccctgaccaaacagcaagcaaacagccgccgacggctctcgttcgtgtacaggcagtcgctcgccctgtgtggctgcgctgttttcgaatttcgaccttcgcgagcaccggaagccaacgctccccccactaccactacacactacacagaagccgcactgcgcatcaactcaacgacgtccgtccgattgggtcaggtggtccacaggctttgagtagttcgcaacgagaaagcctcgtcagacggcctacttccagcccgctttcgctttcgcgtgttcgttgggccaagaaaatatgttttttccggccaaaacgtctgcctcttttcgttcgttccttgtaacccatcctggcggggcgacgcccgtgcggcacggcacgcaggcgcgtagcagccagtcaaccgaccgaagctcccgctcttccctgcgaccgccgccgttcgtggtggtaggctggtgggcggtggcccatctctcctaccgctgagtaccaagccatagtccaccgcccaacgccggtggcgacctc

SEQ ID NO: 11411 - DNA, 432 bp, Zea mays
tgttcacggacctcgtcacggcctgcatcccgcgcagcaccgtggacgtggaacgcctgggcccggagctgcagcgcatgcgcgcgggcctcatccgccgctgcgccgacgccgaggcccagctggaggcgcactactagaacctgctggcggccttggaggacaacccgctgggaccacctgccgctcttcccctacttcggcaactacctgctgctgggcgagctggagcacggcctgctggcgcgccacgtcccgggcccgccgcccgcccgcgtcgccttcgtggggtccggcccgctcccgctcagctccctcgtgctcgccgcgcgccacctccccgccgccgccttcgacaactacgacatctgcgcggaggccaacggccgggcgcgccgcctcgtgcgcgccgacgccgcgctcgccgcgcgc

SEQ ID NO: 11412 - DNA, 1500 bp, Zea mays
gatttgggagatctgcttcaggggaaaccttgttttttaatgcaattattttttgctctctcacaagtatagacaaccgcaggcttgaagcccattctaatctattttgccaattatattagaacttgtggactccgtggtaacacgcacgagtggtgcttcaaaattagatcgaattatgagggttgttgtgcccatcccacgggaggtcacttttgagaagagcgactctagtagaactgaaatgtgaaaagtgtcaagtggttcatctgaaccacatcaagtgctagagctcctgtacggtccctccttttaacagagagtaggcttgcaaatcatcattaaaaagaggatcagcatcaatcttggctttgcctcaacaaagagcaagtgattggcaaaccatcaaaccttaagataaaaatcatcttgtcataactacgtacgcttaagataaaaaccttaagataaaaaccttaagagcaagtgattggcaaacgatatggtctttgcaggagcctgattcagttaaaactacgtacgtaccgatacgatgccagtaagtggcacaaggatatgcgataccagctagctagcttagtacgtacgcttgcatacagttgcagctgcgtcctgcatccctcctgaatgagatcgatctagctttagtttaatttgttcgatatatatacgattccttggttccatatatcaaatctgttactgtgcctgccttgttcctgcaagatcaatgcatgctccttggttaattggagctttctgaagtatatagcagcatcgtctactacgtatctccggctgctttctcgcggtttgcgtgtacagctagagaagaaaaaaaagcctgaacagcagaaatgggcaggcaaggcaagcaaccatacattctggtgatacccggccaggaggcttttggtggtggccgttgtggctccacggacccgattcatccttggccaatgcaacaggcggcagcagcatctcaaatggaacctgcttttcgatgaaaggatgcagacgacgcaggcgcacataaccaactattcggcttgcgcgggacgacgtctatgtattcctcttggggctagcgtaaagcggagaaagatatataacatattcttggggggaatagtattcatcgagtaaagaaagataaggcaacgacacgacatatgcatggaagttgaattattgttatgggggtacccatcgtcgtatatatagctactgctccattccagccacgatacaaatgaaacggatctgcactcgccaagttgtacgcgttttctcgcgatcgcgactgcctttcgttgcgtgtgtggagagaaaaaaataagcagaggctcgtggcgggcacacacacggacacgggtagtatatatatatacactacacagtgtagctagtatacctcgcccactctaaagcgaagcagcaagcgctctgtgaccgactgtgatcacacaccacgcgtcc

SEQ ID NO: 11413 - DNA, 432 bp, Zea mays; identical to SEQ ID NO: 11411

SEQ ID NO: 11414 - DNA, 172 bp, Zea mays
ggcaggcaggcacacggcacacaccacaagcaacaagcatggatgccagttttacatctatctgatcgatctagtaaatagtaatcccctactacgtctatgtgcccacaccgcatggatatggtaataatccgcacagggtgcgcctaatttatatccgctagctaagggc

SEQ ID NO: 11415 - DNA, 209 bp, Zea mays
tcgacctgcagggatccatcatcgtcccgcgcgcggtaagcaaattgcatggcatgcagttggggtgtagcacaagaagctgctgctgtgctttctgtgtgcgtactgcgtgcgtagtatatatggtctggtagatcgatctgctgatctggtgttggtacttggaaaaggggccggccagccggggtagtactacggtgatgaggtcc

SEQ ID NO: 11416 - DNA, 106 bp, Zea mays
gccgcgccggcgcgcagctgagccgccgaagcgaggaggcaatcgaggcggackaagcgccgcaccaaattcgacgggggatcgagcaccagaggcgtagcgcaaa

SEQ ID NO: 11417 - DNA, 614 bp, Zea mays
ctccctccggtgtactattagttgtcgttttggacaagatttaagttaaatttacaaaattttgactacaaataactattttattatttaattttgaaacctaatgtttatatgctatgattgtcttaacatgtatttttataaatgtataaatatattaagagttaatttgtattttaacaaaaatattggttaaaattatattttgaagaccgttgtaataaaacatcatagtgagtaatatacattatcggtttcttattcgtctgaattattacgtggtccattttatatctctctcaaattttaactactcgtgtcgtctcggatggtaactgttccgttttcatccttattggcaatagccaaacccaacctggccacctccgctgggcctgtctctctcgctgcaccgagccaccgaggtgaaacaaaagcgcaccccgccgcaacccagcccaacccaccgcagccaccgctctgcaatggcggctccgcttcccccacttctccttctcctctccatctcccccgcaatcttcctctcgtagtgctgctctcattcttccaccaaccgaaggttctgcggccgcgagagtgctggggggcgaaca

SEQ ID NO: 11418 - DNA, 80 bp, Zea mays
caagaagcaaattcggtcgctctttccccgctgaagccgagtacattgccgcaggccattgttgcgcgcaattgctttag

SEQ ID NO: 11419 - DNA, 184 bp, Zea mays
aaattttggctgctacaactttgcctatcgcatgaatacaaaatttccagtgattagctaccgaagcaagtggccagctggctggaagtctgagtggttctatgtcaaagttgatgaagagaaggagaagctagtccagagtccattggaattgatcttctgagagaccagacctcggtgcgac

SEQ ID NO: 11420 - DNA, 1172 bp, Zea mays
tggcggcatggctctccaccgctgctttgatccggccttccttggacccggctggtctccctccggatctgccatcggcaaggtctgcccctgctcgggcgtctcctccagtcagcaatttttttgtcttctccctaatttgtgttttggccggagttagtcaatgacaaccggatcccatgtgccattttctattagaatgaatttggggttctattttaatgcctactgctggagcgcaatctagaaaacaggcctctcaaaagtagggggagcacccaaatgggaagtaggggcctgttttgggggctattgctggagattctcgaaccaacaaacctgctaaactatcttcctcatttttgcactaatatctgtgtggattggacctaggagagtaatttggtgattttgtggggtacatgatctggttcaagaacactattatgtcacgaggaacttgtgagttctggcagctgtttgattgatgaagactagcatatagcccatgctaacgctacgatcccgggaaggggagtggtcaacggcgacgacaacgtgagtgtggggaggcggaaggggcggcggggtcaggggaggggggaggatggcggcaggtggtcgcatggggagggatgatccaaataatattgtccattggatttgagtgaatgagagggggttatccaacgatctgaacctttggttttgatggcgtgttagatttgggtgcaatttgtttggtagattttagtggaggttatgagtgtgggggtgatttggttgggtgggttttggcaaagtttgaattggtggattatatagtggtatagataaggggagtgactttggtaaaagaagctacttaggttttcagttctaaatttgaaaagatataatatagatgggaagcaaattctaaggcacaaaactgaagtataggtgggaagcaaattctaaggcacaaaactgaagtataggtgcacaaattctacttaggttttcacatctatacttcagttttgtgttataccttcagtttcttattactaattcagcacatatatgttcattccgacaatggtttatggcttcttttataggtgggccttgaatccctaaatctgggaatttgtccaaaattaagtattctgtgcattgaggccccaaat

SEQ ID NO: 11421 - DNA, 583 bp, Zea mays
tgagtttttttttatgcttttagacttttggaagaagctcaatataaaagtattgcagaatataaatattaggagccgttgaagatactctaaaaagaccatgtcaggtgacacactcctatcgtgtgaataaatataaataaatagtatcatttctattgtgcaatatttatcgtcttacatcgaatccaaaaatatccytagaaaaaaatatgcttcgattaacctatttggtataacacacgtgaatggaaagctataactatgatgataatatattttcgtggcaatagaaggggtataatcgtgtaactaaataaaaaattgtacagactagtctctacaactattaagagcaaagtgtagactgcccccgcctccctacgcccgcccgccgcgatccccgccgtgatcctcgcccaccctccgcaatccacccgcccgccacgatccccaccatgaacgccgtaatccccgcccgccctccgcaatccgcctcgggctgccctgatgatgcgctcttatttgctgccgccccctcaatcgtcccaatccatcagtcgtcctctcgcgagccagagcc

SEQ ID NO: 11422 - DNA, 1234 bp, Zea mays
aaaccctgcaggctgctgcagcaagctgcagctcgccgtccatgtccatcgatcaatcaatcacattgtacctggtttgcgttgtgttgtagaagcagtagccactagttttttgttttgtttgtttttgctatgtcctaggtggcgcttgtgtcctaataatcctgatccaaagatgctaattgatcatgactaatgagtgcatcctgattgattaataatgttcaaactagtgctgattcaggagtaataatattgccactattcattcaaaattcttggcattctttagactatctctaacaacttacttatttacatcttttatttcaaactatattgtttcaagcagcttaggtagtgtttggttactaggtgttaaagatagaagtaaatcatctatacatagaatgcttgcatgcattctttccttagttcgcctgcgtccctgtaatttcgtccctgtaatttggcttgccaattctgcatgcatgtaatctgtatatatataagagaatgacagcagtctgtgcggtagcacattacgtctaatcaacatggtaacagagccaaggttctaatctccaccataccttcttctcccacaaattcctccaccacctcctcctcctcctcaactatggcgaattcatcttctgctgctcctcatatcccaattcatcaagcagtcactattcgtctcaccaaaacaaattttcttctttggcgtgctcagcttctccctcatcttcgtggtgcacagttgctgggttttttggatggttctaatccagcaccgccacagcaaattgcatcgtctatcgatccaaatgccagggctatcccaaaccccgcatatgatcggtggttcaatcaggatcaacacatcctcagtcactacacgacggttgatctttagcgacccttattaggtaccaactgttggttgctaaagattagggaccgacggtcagtcgctaaatccttttgtagcaacgttcggttggtcgctaaaagtctagaaatttaacaacttatggttggtcgctatagatgtcgtcggggactagcggtgggtcgctatagagcaaggatcactatcaaatcttatagcctgaacatgcctgtagatgttagtgactaaaaattaattaaaacaagtaaacattgatcgctaaattgcgtggtgatttatttctttttaatattgcttgtattattttatggtttgttt

SEQ ID NO: 11423 - DNA, 1000 bp, Zea mays
tgaggtcgccaccggcgttgggcggtggactatggcttggtactcagcggtaggagagatgggccaccgcccaccagcctaccaccacgaacggcggcggtcgcagggaagagcgggagcttcggtcggttgactggctgctacgcgcctgcgtgccgtgccgcacgggcgtcgccccgccaggatgggttacaaggaacgaacgaaaagaggcagacgttttggccggaaaaaacatattttcttggcccaacgaacacgcgaaagcgaaagcgggctggaagtaggccgtctgacgaggctttctcgttgcgaactactcaaagcctgtggaccacctgacccaatcggacggacgtcgttgagttgatgcgcagtgcggcttctgtgtagtgtgtagtggtagtggggggagcgttggcttccggtgctcgcgaaggtcgaaattcgaaaacagcgcagccacacagggcgagcgactgcctgtacacgaacgagagccgtcggcggctgtttgcttgctgtttggtcagggcaagctgctctgaacaggtatcacggtcaccatatcctcagcaacgtcactcttccggtcatcgtgccgtcaggcctatcgtgtccctcctccaaccccaagcagcggtcaccaagccagccgggtaaacggaggacgaaagcgaacggggagggaaaagaaaaaggaaaggttatttcactggctggcggcctcgcggggcaagtttttctacgcgcccagtccaacttggccaccaaccaaaagccccaagctgcggcgagccagcgggcatccccttccccagtccacggctgcacctgcacgcaccgccctaaacgtccacgcactcacgttaaggcgcacgcttctccgcaaccttcccagcactttcccctccgtctccagcgcctggtctccgcctcccgcgcgcgcccgatgcagatgccgccgtcgcggccgatctgacgccatcggtcgccggcc

SEQ ID NO: 11424 - DNA, 864 bp, Zea mays
acgctggcgatggtggcctttggcgggattgacccagagggtgcgttacaattggtatcgaagcccacattgccgctgctgcctgggagagctttgagcctcttaaagggtgagatgtgagagaccggtatgcacgctctgggttagtaccaccccgcctagccaagggggtcatggtgcccttataaggacggacctcgcttctctttcagcctaggtttcaagagcgagatgcccgtctgaataggctgccgcgagcgcatgaacgccggacgccgacgatggtgggctttaggcggactggtccagagggtacgttatataattgtgtcaaacaaaagtcgtggaagttactcccatatgcagttaattttttataatatactttaagtatagttttaatttttttatattttttgtatttttttaataagacaagctagttataattgatttaaaaagtcaaatgaattataaattagaagagagcaaagtttgaaatataaatgagacatgggctagtcacaaaaaacatcctgatttatgcaccggggctcagttgcgctgcaggtccacagcccaataacatcttgtcgtcgtccccgactcaccgccgccgtcatcatgagttcatgactggcctaccgatcgccgcaccaggccctcgcgcggggcaatagaactatagaagtcctcaccgcctccgacgacagcgccgatcgttacgccgccggttagttccggcacgtgaactaaccacgatctccccgtaagccgtttgcgtcttctccgatcgcggagataacttttctcctcgatgtgattgctcctcacgaagatccccttttcctccctatcccagcg

SEQ ID NO: 11425 - DNA, 1100 bp, Zea mays
gcacagtcctcctccttctattggtggttcgaggaggaggcagcaaactattaatcggaccagtgacatcattcttgaactccagcagctgtgaagaaagcacacactcctcatcctgaactggctctataacaagcttctttctcctggaataaaccttgaggcagggagaagcatctttccagccatgaatcatcttactgagcaaaaacgaagacattctgttcaagggatcaacagtccaaatatttctctgcacagaaatcccaaactgagcattcacagacacactgcctgaaaggacatcaatcacctgaatatcagaaccaggcggtgcagctggcatagatagaaccgaagaccccaactgaacagcaggcccacaatcaacagtgccaacaagaaccccaggagccaccatcccatcaaccgagatcaaggggagagaatgggcgtcaactggatcccattccacgtcctgggcagtggagtcaggagatccaggagcaaccacctcatcaaccgccaaaaccgggaaagaatgggcatcaactgggaaggaaatcaccgagccagaggacagggtggacccaggcgccatcctctccaccccgaccatcaggggagagatggcatcgactggaccaccacccggcaccgccgaggagacgcgcggaccaagccgagagagcgcagagaccctagcggaaggagatgggtgatagtgcatatgtggcctccgcctgtgattatcccgatcaccatcatccccacccaaatccggcaacaaaggagggggctggtcagcaccaatcatgtcgccagaacgaataaccttcactgcaatcttgaacaccatggtacgcggaaaccaggacccggcctccacatcaacgcgcggctcaacggcgtggagaaacagaacatccggcaaagcctcaggtgagaagcaccaaaaactcacactgaaagcagtcatatctgcagaatccactccctctgaagaaactgtggatagaccttgaaccaatccgtgagccccaagcaaaaattctgctgtctctaaatcccaaaggtgcgcagaaatcccttgcagttca

SEQ ID NO: 11426 - DNA, 186 bp, Zea mays
tgcagagccctagtcttgccctccccgttattcccgggattcccctgttgctgcgtgcgactgcgccccgcccgacccacacccacctacctacctaccaccaacgcctccgctccgctctccagcgagccgcgaccgcgcggcaggggaagcttagcacggacgggaccagctgacgaccaggcc

SEQ ID NO: 11427 - DNA, 1500 bp, Zea mays
gccttaggtctggccgtccatccccatccaatgcaaaaggtgaaaggaagaacaaaacgaagcccaagcagaagacagccaacatctctgctcctccaagcagtaaccacagggatctacagcttccagccagaacaacgcctgcctgccagcgatggcttcggctgtctttggctttggacctatctaacctcgagctgccaggccaggaatggacgccgactttggctgctggttaaatctggacgacgacgacgacgtcgggctctaggatctcgacttgatgggcctggagatccctatggatgacatcaacgaaataaacctcctgatatagctgtacagtttcgtctcagtgggcccctcccacattgaatagctccctcctccctatagtgcacacaggtaacatgtggatttccctcacaatgacccaccaacccagcagttctaacaccaggccggttaggcttcacttagttttgattgataaaagaaagtttatagaggcctcttgacaaatccccacaaccacatgtaatttgcctccctttgttcatctggcgtgcatacgtcggtgtacatatcttgttttggtgctgtacgaggtagggaggctagttactccattcattcattcattcatttatcgaggtgtactcaacaaaggatatatatatatatatatatatatatatgtatatcggcaattcagtatcaccatcatcgttgattcttagtgctgaactatgaagcgcgtcacatctctcttgtttgttgtctctgagatttttgaggggcctaggcgaaagcttatatggagacattttaacccatgtatattcgcagaagacatctgtagcatatttctgtgcctgttgtgtgacttcgacttgcaacagttaattgactttgcaatggccattcccactgatcttgtcaggttctagtatgttttgctagttaaaatgtgaaccaatctgtcagaacttgaccaggaattcggggcagagttcctgctggtctcaccacacggcttgggattgggagcctggaattccaaactctgcgcggatgacacgtgctgtgtccacaagaagtgacctggcgaagcgtgcaagacccgccgcgcgcttcccgcatgcacgatgcatttgaactgcttcatgcgcgtgccactgccacctgccacggactccttcctggtcggcactggaaaacgtgtgcactgtctcgctcgcacaggtcttccaagtctgcgccttctctcgcaatggctgctttggtggccacggctgcagtgctgcacggctgcaccacagtcctgctccgatccaagcgtacgcaaagacggcgagacgactttctttccatcagctgaccttgtcccggtcttgcggtacgtagtttccaagctccatcaggcagtcagagtcagtcaggcatggatggacggctataaatctctccagggtcgcgtcgtgaccggcatcgaagacg

SEQ ID NO: 11428 - DNA, 1500 bp, Zea mays
gtagaagccaagtgctttatattacacgagcaaggttcaaatcctccacatgcagaacctattttacgcgatagggaaaatttatttgctcccctcgctaggaggcgacacaatatagtagagatatgcgaaagccatttttacaaacaacaatgcatcatttcaataatctggccatcggtatatcgcgctagaggtttctaacatttttttgtttaaggtgtttattttcataaagactaatattacaaacattcatatttaaaatacacccaccattccaaaatatagtcttttttagccctcattttttcctgtccacattgaaataattaataataaatataaatatgcatacacactacattcatctgttaattgtattttagaaatgagcgagtattattaattttttggatattctaatttgtattatcgtggtattacttttccttagtgcaacgcaaagacatttagctactataaaaagaaacggtaagaatattttctcagtcttaaaataactatcattgtcgttttctgaggtgactgctatttttaacgttaaccaaagatataaaagatgttaatatttatagcacatgattaatatcattaaatatattatcatatccatttttacaataaatttatttaaaaatataaaatactcctaatattttcgacaaaattagttataaagtttgatcggtacggtacacaaagcgatatgagcggatggagttctcttaaggaaagagatggctattgcgtctcatatttaattgcatcaagttgtattagtactatataatactagctagaatctattcttaatcacgtttacctcaactaatatttatttccgtgcttttcattccatagctgtctaggctagctgacatcagctgctatgctctgttgcatcacttttccatgtgcttttcctgtttgtcgcactggccttcccccgtgggccgtgggattgatagatcttttaaaatacggagcggcgtgtcgcagtgccgcgcggacttgttccaacgatgcgagagactaatcaaaagccaacgtgagagtgagatcggaggaaggaaacaccttcgaaagcagaggcgatcaagtcactcggtcgccagcctagcagccagctaccgcatctccgggcgttgcacttgcacagggcggcctccatagttccatactacgaacatgcccaactgtccgctgggtctgggtcagacagaatctgccacccaccccacctcctagtctcccgccgcggccctctggtcagaggcccacatagatagaggggaaccagcacacgcagacgcaggaagccaagtcgcctgacttgcgtcttcttgcttcctcctgtgccgtgtttcatttctttgacacaacgacgtccgggcagccgcctcctgtcgccagttcgccactctctggttgctgcacgcctctagtcggcggggccaagaggtggaaaagggcagg

SEQ ID NO: 11429 - DNA, 281 bp, Zea mays
actctagtgcaagtgggagactgttagaaatatgccctagagataatcatagagatgagcatatttctttgtatccatgatatatatattgcttaattgaatatccatggaaggcaccttgtattgattagcaattatgtgaattgtttgtgagattctttacttatatggttattctaaatgatgtccctagtcagagtcgatgactagcacatgtattagttgatgactacatttcacaagtcatgaacatggagatgttaaactaataatgtgggcgc

SEQ ID NO: 11430 - DNA, 187 bp, Zea mays
actgctactagcgtagaaatgtcatgtggcacttcaagtttggcggggccattgggccaacatcgggcccattaaaaaccatatacgaggccacccagggtacggcggcgctcggttccgtggcggggagtgttttccaggcggcggcgcggtagcgtgaaaccgggcgaccgagcaagcgacggcc

SEQ ID NO: 11431 - DNA, 1500 bp, Zea mays
atatcttataagtatttatattggctcaattccaagcaacctttgcacttacattatgcaaactagttcaattatgcacttctatatttgctttggtttgtgttggcatcaatcaccaaaaagggggagattgaaagggaattaggcttacacctagttcctaattaattttggtggttgaattgcccaacacaaataattggactaactagtttgctctagtgtataagttatacaggtgccaaaggttcacacttagccaataaaaagaccaagaattggattcaacaaagagagcaagggataactgaagtgtgcmctggtctggcgcaccggactgtccggtgtgccaccagactgtgtacggtgcaccaccggactgtgtccggtgcaccaggggacttcacgmtgaactcctcaccttcgggaaaatccagaggcgcttcgctataattcaccggactgtccggtgtacaccaracagtgttcggtgctccaaggaagggcgtctcargaactcgccagcttcgggaattcgctccgctataattcaccggacatgtccggtgtgcaccggactgtccggtgagccagcggggcawcgactacttcgcgccaacggtcacctgcagaagcattaaatgcgcgccagagcgcgcagaagtcaggcacacgcgaagtggcgcaccggacactctacagtgcatgtccagtgcaccaccggacatccaggcgggcccagcactcagagctccaacggtcgaaacccaacggcctggtgacgtggctggcgcaccggacactgtccggtgtgcaccggactgtccggtgtaccatgcgacagacagccccaccaaacggctagtttggtggttggggctataaatacccccaaccaccccacattcaagtcatccaagttttcacactcccaaccacttacaagagctaggcattcaattctagacacattcaagagatcaaatcctctcccaaattccacacaaagctttagtgactagtgagagtgatttgttgtgttcttttgagctcttgcgcttggattgctttcttctttctcattcttttttagatcaatactcacttgtaaccgaggcaagagacaccaattgtgtggtggtccttgcggggaagttttgttcccggttgatttgagaagagaaagctcactcggtccgagggaccgtttgagagagggaaagggttgaaagagacccggtctttgtgaccacctcaacggggagtaggtttgcgagaaccgaacctcggtaaaacaaatccgcgtgtcacacttctcatttgcttgtgatttgtttttcaccctccctcgcagacttgattatatttctaacgctaacctggcttgtagttgtgattaactttgtaaaaatttcagttttgccctattcacccccctctaggcgactttcaattggtatcaaagcccggtgcttcattagagcctaaccgctcgaagtg

SEQ ID NO: 11432 - DNA, 1500 bp, Zea mays
ggagccagggacaggcgcccggtggatctggaacgcgtgtgttgcgctgagatctgcgtgggctcgtgtgtagagtaaatggtttgcgtgctgccgaaatattgcgtgcagtgttcggcttagcttctgctggcttgaccgatagcaggagctcagttcttgataatagaattttctttcagagcgtactgaagtcagcgatgagctagtgacttccaagtttgaacttgaatgccgagtagtgatgtgccaaggaggttgacccttagctcgctaggctcttgctgcgttgaatttttaggacacagctgactagacatgacctttaaccttgctccacactttctaggaattcagttgcgctaagtagagttttctagggtgcagattagtcaacactagagagtgggcaactctatcacgttttttttttttttttgcataccgtgttatcactctcttgctgcagcactccaaaatagtgagcacgttatgagaactttgcaaagtggaatgccacaaagtaaataaaccactatacaaagcactgcaggttctttaagttagtgttggactgttagggatacgttttgattttgagagagccacgtggccattaattttgctctcgtgggaacataattttgttgtactgtttgttgttgttcaatcaaattgtacttgttatgtttaacacacacacacacactatagcgccatccccgtccatggaaaaacagaaaaaagaatccataattttatagctggaataaacattcagtgtggcaaggttaatccaaaatgcttcagagttcagacttcagactcatgttggatttggtgatgaacatgtaatggctgctccttctgggtaaaaaactggatccaaagaaatatcacaaatacatattattaattaaaagtctggtctaatgctgaatcacagaaaaaaacaaattggaagaaacaaattgtgctgtcatcatctatataaacctgattttttactacgtactgtatgttctaaggaaatgttagtggcacatagctagcagtggcaatggaccacgatccaaatgtttcttcactatttgtttgagcccttaattaattttaattaaaaaatgaaaagaaatagggtccgatcctaatttgaccctattcttaaattttatagtgtaaaatttagatccattaccaccctacacacagttaatgttcagttgataatttctggttttaatgatgtctgcttgtgtatttcagcctttgaggcagagaaggtgtcaactttgtttccatttgattggatattgtctttacgatcattgctagtgtattatgattttatgaaagatgatggtactatgtgaggtcaaatgaaagttatgatatgccttccttctgatggccagaatatgttaattgatcagtttggataccattgcgataagtagctgtctagatacaccagtacccacaaattctctcacacccaat

SEQ ID NO: 11433 - DNA, 1110 bp, Zea mays
gggcggcgcgatgggcaagccgatagacaagaggcacgatgccacgactaatgaagaggatctagacatggtcgaggtcgagacagaggaaagagaaataagataagatgaggctgctcaacgtcatgatctgtggtgctgaggtcagcattacagaccatatgayatccaagtggtgtcagatcactgtccatagtatttgacttatatctcgacatctcgtaacttatggtgctgacacgtgtaatcttgatgcgccatgaagccgaagcattgtgtgtaaacatatgattcgtttctccaaaaaaaactaaacataaattttttatgaaaaaacaaaataaaaaaatcaggcgtacatttatcgtggcactggcatccatcgatcgtccaaacatrtcaactaataaatacttataataacgtcaaacagacttcttataagtgctgccaataaatcactatctgcgtgattggttggttggccgctgtctccaggcccgtggcgttccattgactttgcacaacgtctgtttggttaactgaagaagagggtggcagcctgcacccgcacatgcagcagaagtattttttttcgcttgattgtctgcatgcgcggaaacacatctatcctgcgtacccagcggtccgggctagctggagaccgacgctcgacgtcgagtcaaccaatcatgcagtatatgcatgcgtattcccgtgttaatgtatttcaaatctccaaaatcaatccaagttgctatatgaacatatataggccattagatgacatcgtttctagatgggcaaaaataagtgtgggaaagatacgctagccagctagctagctagtagctactaggtgtatttgaatgaatcagcatcgacacgctaaatttctactattatgatccaaatcttaactgtttccgtatcatagtaataatggtacgattctatatcatttctttccaaacggacggctataaaatgagatctctattcctccttcccctaggccctagctaagcgctccaggatggcatgcagtctcagcaaccgccattttgcgttttgatttgattcccatcgccagcgccggcgccggacgac

SEQ ID NO: 11434 - DNA, 1131 bp, Zea mays
tggctcgtgtcactgtcactgcagaccagctccctccattgccgttgctgctggtgaaattttggaatgtccatgccgtcagattttatatatcaatgaacaaatcgcgggaaaggagagagggctgagcaatcacgactgatccggtgaacagagatatgaaggggatctatggggaggtcactttgttattcaattttaaataaaagagatttctctgttccctacatttacatatccaccaaacgaatcgtaagatggctattccgttttcaaataacagaagccaagatagccgagggatctatggggaagccacaagccaccttttaaacattaatttctcatagcccataagcgttagatcaatattttagatgatgtttaatagttaattgactataaaattactagtgaaattagttagctaataaatatctagataactagtatctaatttgtcaaaagtagctaacaactgaactattagctaaactatttggatgtcttcagataattttagcagctaactattaattctattacattcaaacacccccttagtcctacgaaaacactttcaaatataaatccagtgataaaatatgtgtttgattcgtgactagggatggatctggaaacttattcggatgttaacttttttgtcttattttttcgattgcgaacaaataggatataaaaattgttatgtaaatttatattcttgttttttggcattgagtttattaagattcataaagagtgaatcttaaattcgttctatatatttttaaataattgatataaaatttaaatacggatacaattccgattcatattttttttacctttttcattgtggagagaaaataatgtacaaaaaaatatacgaaaaaatattcttgtcctcaataatatccttaataatatcactaaaacttagcaccaaattctatacacatctatgttaaaatattagatatatttcggatgttttaaaaaaatcacgcattcctacgttttacgtgtgaaactaacgggctcgaacccgcaaacccggttttacactagttctgtattcgtgtcctctggtctctcgcaggccaaacaaaagcgctgccgccgccggca

SEQ ID NO: 11435 - DNA, 399 bp, Zea mays
tctacaaactcaaaacagaaggtaaaataacaggttgcaatcaaccatggcaataaaaaaaatcttttgacgccaacagcaatagccacatgagttcataacaccagaacagaagaactagccaattatcaaaaagattcagataagtttgccagctcgtttgaactgctgaaggtacaaaaattctctctagtaaccgcccttgagatcgttgaccacatcataaggaataggagtgactgtctcgagtgtagcaccctcaaccatgaagccaggtttgggtcccacaggctgcctcttggtgctgatcacctcaccgcgggccttggcatccgccttgagctggtcattcttggctttcctcaagcggaactcctccgtgcaacgggagggctgcac

SEQ ID NO: 11436 - DNA, 1500 bp, Zea mays
atatgcatgtagcaaaaaagatatgatgctggcttgcattggcccgaattggtttacactgtgcactactgcacacatgttcagcttcttgtcaaaaccaaataaataaagcccgtcaacaagcaggtcctttaattttcagttgatccaactcctactttttcacactacagtatatggactagctatagtagtgtccgattccagactactctggactaccgactgtgttcgttccatcgatcacttaactagtattttaggccaccagcgacgccatatctaaatacggtctacccttagaccttgtatagtttatacagccattcattgtatatacacgaggatgattagaagagagagagagagagagagagagagagagagagatttgatagatttgatgtcaacatgttagtaccctaaccatttttacacgagatatattgctattaatcttattatatatatgtagcaaaaaagatatgatgctggcttgcattrgcccgaattggtttacactgtgcactactgcacacatgttcagcttcttgtcaaaaccaaataaataaagcccgtcaacaagcaggtcctttaattttcagttgatccaactcctacttttttcacactacagtatatggactagctatagctagtgtcattccagactactytggactaccgactgtgttcgttccatcactttaactagtattttaggccaccagcgacgccatatctaaatacggtctaccctagcttagaccttgtatagtttatacaaccattcattgtacacgaggatgattagaagagagagagagagagagagagagatcgtaaggggatgattgatatcaggtactttgcgatagaatattaagctagctgatgaggcaacacgctaaagatgcttttcagcaagactagctatctagctagctgcctcgctctcgcgttgcattgcatcatcatctatcaccgcacaacattctagtagctagacaatattataatatgatacggtaccctgaggaagcttagccaagtgggagtggaattgtgactctttaattcctccccctccgccgaaaacgacgtgacgtccatcgcctccgccccccgcaggccgcagcgcgagagagctcccaagcccccaacttgcgagctcgtataaatggcgagcatggccgcccagattctagctgtcatacaagccgggaaccagaccccaccagcagcactccatatactgcatgcatagagatagatagatatatatagagcttaattactatagtcgtcgtcgtcgatcgtaactgcaatagctttagtttttgcagtcatcagataaatatagggtccataaatatatccatcagctagctgtaactgcaactgcagtcgcaatagctatagttttcagttgattagctagctactaactacaacaagctaggcaaatcgatcaaactaaggctcggcagcggcagcggc

SEQ ID NO: 11437 - DNA, 824 bp, Zea mays
cgccttcatgcatgggcgggtaaagccataattttttacccgttataattcacgggccgggtacggggacccaaaaaccgtcccaacccgaaaaaacccgacccgacacgtcaaacatggaggcacgggctaacacgacccgacactaggcacgggtcgcggtacgggccgtgataaatggcccacgacccgacccgacctgacgtttgaacatgtcaacttgtaggcttactcgacggggacttagtcgttcgccccgcctcacagacttactcggcggggacttgatcattcagcctgacttggagacttgctcggcaaatgggtcagagagagattgcatgccttactatggatactcctttcctaagtaatcgacagtgggaactggcttaattacatgaaaaggcccacttaaatctgacccagcacagggactcaacttgccgtgttattctccgaatagctgacattttcagcgaagcgaggcccaatagcatacgagcccatccaccccgatccaaccgtccggctgcacaacacatatgaacacatcccagccgcccattcgaccagtctgtcttcgctagggtttttagcccgtataagagccccttcctcactccggaaccccattccccgccgcctcgcgcccccgctcgcttcacttctctaggtgcgcaccgatcagaaggtgcctgcctcctcctcgtcggcgaaagtatcccgctggtttccttgttcctttgctcgatgtttgctcatcgcctcatgtttgcgtgtttgctgttgtttgtcggtggtcggtgggtgacggagcagag

SEQ ID NO: 11438 - DNA, 1069 bp, Zea mays
agttggctgtttttggcccagtggtttttcttttggcttcggctgtttttcttttctatttgccttctgttcttttttgttgtttttcgcctcctttcccttaagatccttggtgtttgtatttatctttcccttctaatatagatcggagcggcaatccttttgcccctccctttcaaaaaaaaaaaacaaattagcttaggtactttttgtttaccctctaaattatataatcgtttaaataagttaagagacaaacaaactacaaagattattagatggattatataatatagatttctacattataataatctataaacagttcattgacattagacatttatataatctttaatgtacccttgccgtattggttgtccaagagcacttacaattgataggccaccgatactggttttgagtctaatagaccccaaatacgtattttgatgatagcgtagaaattttgcctggcccaagcagtccaccatcagtttattctctttgttttaatctatatcaggttttttactgattctacaatatttttgtctctgtaaatttcagatatagcagttcaagcagccggctttaatcaccagttgtgtcagatacgtggcgctaagagcgttgcccctctttgactttggcagttcggtctgatccaaagtaccccatgtcctcctctacggctgcggatggatggatcttcgcaagggggcaaacgagcgtgaggtagccacacaactagccaattcatcgccacgacaggcgtccactcggcacagccgggcctcttctatgacgccactgcttcgatcggccaggaagcctcccgtgcgctctaccaattggaaaccgccacgtgtcccatgaggctgcccgctgccgctgccggaaacccgtccgggtgcgatgaacctggcytcccgcccgacctatatgtaaaccacccgcccgcttccaccccacgccacagaaaaaacgcaggtgtcgaaacacattttcttgctccagagaatttaaaccgctgcgaattcaattcgaaagccccaagagagcatcc

SEQ ID NO: 11439 - DNA, 359 bp, Zea mays
ggtgtcacagtctgtctaatcttaatagcttcaaagaactaagtttagataaaaaaagttagacacctggagtcgctttagacaccaaatcaaacaggcactcgacggagcctgctttgttcaacgtgtgtgcgctcgcccaaacaactccttcctaccaacactacttttgttttattaatcgtcgtccgattagtggtttccactgaagcacttgctctgctctttgctttccacggacaccatcatttgactgctccgatgtctgccactctgccaactttctcgaaaatctacctcccctttccgcgctatatatgctttgttgttttacttgttggattggacgagttcatcga

SEQ ID NO: 11440 - DNA, 151 bp, Zea mays
ggataggaaaatcaatatgtttattttttcgggttcatggtatgcttgagacgaagtgtaaccgtacggggggatcgtgaccaagtggctcgcgcgtacgtacgatttgaggctcataaaatctctctgattctgaataaatttgtactac

SEQ ID NO: 11441 - DNA, 202 bp, Zea mays
tgcatgaatggcgtcagccgtctgacgtgtcttcagatgggtggagtgcttatgaaatgcttcgcgactgttcagtgaccgcggttgaaagtgagcggttgcctttcccttctataaataacgctcttgctcctctggtttttttcacatctcttcgctgttctttactgcattcttctcctcccttctgtctgcttccgcc

SEQ ID NO: 11442 - DNA, 1218 bp, Zea mays
agcgccactggtctttagatattagtatagtgtagttagaataatgtagtagtaatgtagagtagtatagcgtagtatagtagtagtagtaatgtaatgtagtaatagtagggaagcatcaactcgcaaagaattgatttgtaagcttattgtcttcccttaatgaaagaatgacgttggcttcttcttgatgtctcgctttgcttgattataaaactgattcttttgagacagtagatgaataacttgggcatcacactgacgcttccagaagtagctgccgagtaatcttgtagtcggtatcggcgttttagaggcaacgccgagcgattgaaggtcgacgtcggcattttagaagtaatgccgagcgatcgaacacgagatcagcgttttagaggcaacgccgagtgattgaaggtcgacgtcggcattttagaagtaatgccgagcgattgaacacgagatcagcgttttagaggcaacgccgagtgattgaaggtcgacgtcggcattttagaagtaatgtcgagcgattgaatacgagatcagcgttttagaggcaacgccgagtgatagaaggtcgacgtcggcattttagaagtaatgccgagcgatcgaacacaagatcagcgttttagaggcaacgccgagtgactggaggttggcatcggctttttagaggtagtgccgagtgattgaaggtcgacgtcggctttttagaggtaatgccgagcaactgaatatgaaatcagcgttttagagtcaacgccgagtgactggatggtgacgtcggcattttagaggtaatgccgagcgactgaatatgaaatcagcgttttagagtcaacgccgagtgactggatggtgacgtcggcattttagaggtaatgccgagcgagtgaatatgaaatcagcgttgtagagtcaacgccgagtgatagccggccgcatgagttattttgaggatgataaccgagtgatgaggtgttgcatcggctttttggaaataactgccagatgaccacgtggcatgctggggtttcggaaataaccgccgggtgatgactgggcactttttgaaacggtatctggctcgagaatatcccataagagctgcgcttttagccgcctttgctttccgtgccctagttcttgcattcccgcttctgaatcctctctgccattcgcctcctactctgttcgctggtgaaaatcgag

SEQ ID NO: 11443 - DNA, 751 bp, Zea mays
ggtcggtcacgggcagtccttggaaattttcatgatgatgatgcgcattcattcatgcacacgacacgcctgcccgtaaaaaatttacgggcgtcacatgtttgtgcactgtgcagccatttcctttgccttgagattttgatgatccgcgttctgcattcatgtcttcgttgcagacatcgatcagcgggtgcgcgcgctggcggtggacgatgccgcgccgcccacggagcactccttcgcggagcgcgccgaggagtactaccagaagcggccgcagctgctggccctcctcgccgacctccaccgccgctacctctgcctggccgaccgctactgccaccaccagcacaagcgagagcagccctcgctgccggcgtctgcctcctccgactgcggctcgtccgacgtcgacgaccgctgctccgacgccggcagctcgctctccttccaggcccagcacgcgccgccgcgggccggactccccgccgacgaagaggaggagctgctggtggcggagctggtggccgcgtgggtggagcgcgacgtgctggcggacgaggcggcgcggcgcgcggcggagtcggcgcgcaggatccagctgcaggggagcctggtggaggtgctggagtctgagcgcctggtgctgctgggcgagaacgcgcgcctggggttccgcgcgacggcggccgaggacgaggccgcggcggcggcggccgacctgggctacgcgcgccgccgcgccgccgag

SEQ ID NO: 11444 - DNA, 169 bp, Zea mays
ggtgccggcgcgtactgtttcctgaccccatcgtctccaggtggtgaggcacctggtcaccgcagggcacgacgtgcacgtggtcatcgccgcgcccgagttcgtcttcaccaccgagatcgcctcccccagcctctccgacaagctcgcgtccccgtccacatccgag

SEQ ID NO: 11445 - DNA, 580 bp, Zea mays
tcctttagagttcgacctgcagggttgcattgcacgccttattgttgcggggtcgtcatggcaaaccgagctttttaaaaataaataaataaataaataaatgcgcgcatctactgaatggtcagatcgtcgtcagaatcattctgctcgactgcgctggtcaagcgggccctagcgcaaaataatcaaggtagcatttgaaaactaccgatccgtacagcaaaatactggcaaatactccatagacatcagggactgattaccctgttgttaatcttgctctcaggaacgccaccaaccatacttagcagcgtgagtggctccagagcgacgacagggcccatgccccgtggcagagcgggtcgttgtctccattgccacgcccgctttaaaagggaccacctcgtcactctccctcctccatgtccacggtcaccgtggcgagggcagccccgccgagcgttagtcacagttgttgcctgcctaccatgcggctctaactcgatccgtgcagcagacgccgagtcgcggcaaggagtagctaggaactaggaaggaggaggcagggaaaggccaggcc

SEQ ID NO: 11446 - DNA, 163 bp, Zea mays
tgcagcgcccgtcgcctccctttccccttccctccctctccccgcgagccgccagaggcaatttctccctcgattcgaccccgattcgtccgcccgcgaccgggattccctccgccaagcgcggatctgaacgctgcgctccgtgtcgccgctcgaatccgcc

SEQ ID NO: 11447 - DNA, 1033 bp, Zea mays
tgattgatatattgttcctgttatacgttaatgtaaatcttaaatggctatagtaaacctcgaatggttgaactaaaccttgaatggctgaatatttggtgtggtggacggatcagtcccgttaattacacgcggttggtgcagttaatttgttctctggtcggctagtccggatggaccttttgattcagatgatagacttcatcctgcgagatgattagcatgtgggtacatatatatatggaacgtattaggtgcaaaccgtgccagcagtcatagaatgtttctttgaaaacaactttttcagtgtgcatcagctttcaaatcgaccattccatctcacatgatataatttttaattatagattttatacttaaactcaaaatacttaccaggtttgaaggataacccgaactcaagccgacgacctcgaacagcggaacagggttcccatttggcagttgggcacatgagacgcaggtgtccttgttcctgccctctcccggtacgtaccatacatgcatgattcattgtgctccgatcctggtgcaaagtgcgtaatagcgtagcgtttaattaggtgctgtgtgtgttttgtgaaagctatgatatgctgcggctgctgataaagcagcgaaagtgatgccccactggaaaaacgtcctgctccggctacctcctccaactcttctccctccggccgttggtggggaggaggacggaagatagcatcgccaccagcttcttttcctccctcctcctccatcatccatctctctctgcctcttccttccacctgaaggaagccggttcgggcgtcctgctctcgctcagctcggcacccccgcggaaaccgaaccaggagagcccagccccgtcttcttggttgctcgtctctctgtttgtcagcagcctgctgctgctcttgcttcggcttcagagaggcgccagggcgcccagcggattgcctccgttcttggtgctctccgaagaagagatagtagaagatagagatcggaaggattgtctccc

SEQ ID NO: 11448 - DNA, 1500 bp, Zea mays
tgtttgtttaagtccaaccgtaatcgataccacactataaatgataccgcctttttcaaatttgttaacgccggtagtcgagtgtgaatcgttaccattaccatttacgttacatttcgtgaaccaaatggcaccttattacctccctttgactatcatcaagttgtaggttctttgtttgatttccacaaaagtgatcatttatgcctataaaacaagatcttactaaagatgaatatgaagtttgtgatacaacaatttaatccatctttgggtcaatattaaaaatagtcaatgtaagattgatagcttgagacaagaattgaattaactcattcaatcacccaaagcttcatatcatctccaaaatcctgcaatgctcttcaagcatatcttggtccccatctcttgatgagtccatcaaggttagtgactatttgtttcatattataatctatctagattctataatctagcttaaataatctgaatggtaaacaaggagacatattattagaccagattatatgaagtaacaatgcgctttctcctttaaccaactctttatgaagagattgattaaaggaagaatgtcttgacaatgaagagtaaataaagaattaggtgcataaaggcatttgaaatgaatcgctatgaatgtactgttgggtgtgttctctacaaccggttaatagagaccggattgggcttaacccaactatcgtctcttcaatcgggcccttgatcgggagggcccacactaacctcgattggagccccaggcatacgactctataaatataagactaaggggttgcaggaaaaactaacgctagtacctcgccccaaaactctagtcccgagaggcccccatcgcctaagcgtcagagtgtctggaatcgtgacaaccttcagcggctcggatcccgatgcctgctgattctctgcagggcatcgatatgaagacaacaacaacgacattctccaacagcaacaacaaagatgtgtttctctgttcctctcagtagaacaggccattgaggttttccagttacggattgatattttagggacttaggaatcgatcctaggcaccatagatcctaacatgtactcctttgtttatttccttcttagttgtgaacaattacaatgagttatatcaaccattgaaattgcgtgttctataggagtagagaagtgaaagaagtgcaatagtgagtagatgcattgagatctggaatatagcccaagtatcctgtgcgtcgacagcccatttcaatcccagaacagggcccgagcgagagcccacgaacgaagggctccttctctctcctctcgttgctgcatttgcagacttgcagtgttgcagataattttggatgccattcaagcgttctacggctccaatttctctgacttctccctgagcctttgcggccggctggagctggacggtccccgggcagcgcaggcagccggactgcgggagtcacctcc

SEQ ID NO: 11449 - DNA, 970 bp, Zea mays
aatgcatcttcttttctatgcgttgcaattctgggtacttatctggaagcagcttgctcaaattgaatcagcaactgaagctatccagatccctggaggctcttatatgtttgtttgtttggtgtctatacactcctaattttctcccagtcttgcaaattttgggctaaacttgaaagcagatacattaaacaacctagatactgcagaatacatgcttatgtgtatgtattatgtaggtcatcttccttcatgtttggtgcactgtgctcaaaattttaacatgtcccatattgtttttctctctctttttaccaacatcatgtgaacccactcctttttttgtaaccacgaaattaactttgtgtattttgcttgcaaaaccaattcaagttcaattatgctataatttttaattatagttacacttgtatgtatgtgcattttccatgaaatttcatagttttgcattaatcgtaggtttgaaactgcattagcataattgcaggaatacattggatttcatgttttatcttgatgtaacgccccattttttcgagccaatacatgcatgttaacattatgtaaattcatgtaaataggaacccgcctgacttagttcaataagatagttctgttcgtttcaaatatatttatgttttatcttgaggtaaggccccattttctggaggtcgtctttggacatgtacaaacaatctcaacctatgttgaaaaagtttttattcaattagtgctatccctatcctataacatatgtcatcattctggactcgatcccatcttgtatggacataaatccaacgcaagatacacaattttgcaacacttatatattgaacatgttgtcttttttgtaggccaacattttgcaccatacaacatagcaagctaatcgctatcctataaaaatttgtcttttagtttatgtggtatcctcttgtcatataga

SEQ ID NO: 11450 - DNA, 144 bp, Zea mays
caaacaataaaatcggcatcccatgggccatactggatctccatttcggcccaccaatcacgccctaaatgggctcagccgcctcttcttgtctccactccctttcccgtcgagctatttgcaattttgccgtgggggtaaccc

SEQ ID NO: 11451 - DNA, 1500 bp, Zea mays
ggtatgcatgcacccattcgccattctcctcgaaaggcttttggtgatccttttgagggagcgccgccctccacggacttgacttgcacatactatctaagttctcgaatatttatggttcgctagatctttttaaactaaatcgtgataaataaaaaagaacggagtgatatcttatagtagtagttgttttgaacggagggaggagacatgtcctcttgattcgtgcaatcgtgttcgtgggcgtgaaggcaggatgcgacgtctccgcccaatccacctccccattctaacggtatatcaccgcattctgcatcgaagcactgaacctgaatttcgttcgtcggctagttactggcgtgagagagtcagcgacgattagtgtcagcgccgatcatgctgtccagaccgacaacagaagaggcttcgactccgttagctggtgggctgcaggagaaacgggcgagtcggcccaagacggggtccttcgggcctgcctgaatggagtaagaactataatggtggcgtgagtcggcccaattaatctatagctggcgtgagtagggatgacaacggctaattcctcgctgggaatagctctccaattcggtccccgcgacgaaaaaaataaattcacaacaatgattcccatattgtttaaattataattaagacataagtttttttgttattaatattaaatattgtcatttatacataatatcataggtaagaaatcattatgtatacattaaaataaacacatttgtataattagtggtttcttgaaagataattatttatttttgtcgtcatagtcacgtgcaagtttaatgggtccccgcggcccgcggggaatgagaatggtgaatgattctctgtccccatcctgtttatccgttgggggatacattttctctatttatatcgccgcgaggtaagtttcctccccatcttcatctctaatggaggaatttctcgcagaaaattggggatcgggttctattgccatctctatgcgtgagcaagggttcatcaaagaactctgtaacaaattcctacgtacctgaatagaatcccaaattccgataagcacacaaggccctagtacgtgacatgacaaaaatgacaagcaataatacacacgccgctcgccgtagtgaccttttgctagctggggaagtggggagtagggaggcgggtcgggacctggcagtcgcgtcgacctccccgccgcgcccacggcactcgccactccacccaccaggccaagcacgcggcggcgacgccaaagcatcagggcaccaatggttgtgctccccgcggccccgcggcccctactcctacagtcctaaataatagccttccattccaatctgttcccacagttcagtcgcacactcgggcgggtcaaattcgactcgggaggaaccaaccacccggaaattcccccctcctccagtctccacttgatcggcgaggcgctgcggccgcgggcga

SEQ ID NO: 11452 - DNA, 616 bp, Zea mays
gtataacacatattatatatataagttatcatagtattatatgttcccgttgcwacgcatgaacactcacctagtatttaattaacaagggaacattaaacacctgaccaaccattgtactagtggctcccaaacgatagaaatgatagaggcgacgctgtaaccagctgtctgcggctctgctcgccccggcaggtagaccctcctgggagccactgccgccagcgaggccggtcagtcaggcacaggggatcccctggtcgctgggcctaatctgtcagcctaacatcccatagtcaccaatacagcccctcgcgccgcaccctgaccaaaccctagggttaaatacgtttatcccctgcccctgtctctcccgcacgcacgcacccgcgtccccgcacccgcccccttcccgaagacctcgcgacgccaaaaaggagagaccgacacgcccacgcccacgccctgctgccgccaaccccgtcccctcgcggcggctacggagctcgagcctgagccctgctcccctagctaggttgcccccctggtctccgcctcagccctccagcctctttggcacaacccgccgccgccgcaggcgcaggcgcaggtggac

SEQ ID NO: 11453 - DNA, 1500 bp, Zea mays
atatgtgtatatatgttgtgcctttataaaagttagtaaatttttgaggctatttgtgtattattattttctctctgtagaaaatagtcaaaatacaattaaatgcgtaaaaaaatcttgtggcgaccgaaaattgcaaataagttaccaagactaataaacattatataagaagataacctcaagttgaaagggaaatgtgccattgggccatttctataaatgttttggtgattagatgcccatctcatattattttagtgaatatgtgctaaagtgttaaagagatgtaaatcaataatcaagatatgtctctagccttagtgaattgttttacgtactaacatattcctttaagtactaggaaccttgtcaaaacaaatgagattgaattggagaaggttgacagtgcccaaccagacttgcaccagcctgtccggtgtgcaccgaacagtgtctggtgcccaggatggagcgctcgacgaactcgctgttttcaagcgatgcggctaaaattcataggattgtccggtgagccagcagcgcttgcaccaacgktcggcaatgtaatcagcgcggaatcagtgggcgacgcatggccagcgtcaacggtcaccaggtcgcaccggactgtccagtgtggcacgagggtcggtggctgcaacggtcggcttcgtcaaaaagggaaagaaatcgcgactattcattgtccgctagggcaccggactgtccagtgcgcccacggacagaagacaactattgcctaccaaatggagctccaacggctcctagctgccttggggctataaaagggacctctagcgcgtggagcagtacaccaaacacctcttgaaaatcctaagacgccgagacctcgcattcgcgcattcgattcactgtgctagagatttgagcatttttctgagttgtaactccattgtgctgctttcgtgtgctcactctcgtcttgtgtgcgtgttagtgttgcgactctcgcttttgtgtgtgtgtgtttctattccctccttactcccgtgcttattcgagatcttttgtgtaaggtgtgagagactccaaagtgtggagattcctcacaaggggataaacttgagataaaaaagaaccgtgatattcaagtagatcattgaattagttgaaaggggttgagtgcatcttcgtcgttgggacgccacaacgtggactaggcaagtgttccacttggccgaaaccacgggataaaaatcatcgtgtcacctgtctttattcttgtgcgattgtttttacttctactcactttataattgctctaagtttaatactcatcttgtgaagagcaattaagtgaagaagttgtctccttttctagtcagcatcttggttttgacttcactaaaatttcataaaccaagtttgtgttgttaagtattgatttttataggatcacctattcacccccccgaagagatgtactcttcattcagggactaaccgcccgaagag

SEQ ID NO: 11454 - DNA, 1500 bp, Zea mays
tgaggcatagctcaatttcggggatccaaacaggccataaaaataaactacgtacgaggggaaaatggtctattcacaagcagcgccagcgagctaaatcccatgacagccactcagccagtacgctcttatcggagggcttgaagaggacgaacacctttaccttgctgacagcgagccacatcctcgtcgtcatctataaagcatgtgcacgcgcgttgcgcaaaggcgtcatgcatgcatgcatgcacgcaccgtttgtatatggtcctagctagatcgaaaatgcacggaaggattcccaattttgcaaggcaaggcaggatggatggtcctgcgagggagccaaccctcgcagagtcgatctagggtccagtacggaggactgcaattctgcaaacacgtcctgcaattctaaacaaagcccagattgcatgttcatatccgaggatgcagggatgcatgtgcccagaagttcagtagtaataaacattggacaccctgtcttgtctgaattctcctatgctcatctatatcctggggtgtgctaatggtcactgtccaaatatttattcacgatccgtttgagctattaattaattttatctaagaaataaataaaaatatacagtaccgaaaacaggctctttgttgaatgtctgaagcactcgacaaagtctaaaaaacactcggtgaaggctttgccaactatgacactcggcaaagagagctcgatgaactgtacatcagcaacgacttctttaccgaatactttatgtcacagggtactcgacaaagaaaagtcgtcgttacagcggctggtaaccgagatggagcctttgccgagtgtaggtgacattatataactcgattaaaaaatgaatagaaatatagctcgatctccaaatacgatctaatccttaaaattcatagcttaaaatttagggcccgttgccatcttaccatccctatctatactatattcttcttgtgcaactgaagataaaagacattggcaaaccttagtctaaggaaaacatgggttctaacactgtacatacttgtcctagcttgtgatgagctgtgacaaaactgacactgctacgtcgagcacgcactagtgaccgccatagtttattaaaatctcgattcgccaccatcaatggctcttaattgcgtgctttgactagtagtagtgaaatccttgaccaagcacgcaatttaatttccttgcatgcatgcagtctccaatgaggcccgccgggcagaacctgatcgatggcaagcgaacaattacagctcacctttgtctcctcccccagggtttcagcgcacctaatccactgctacacaacagctagcaagctcatgccatcccgtctaacactctaactgaacaaccagttactatcttgcttagccacactgatcataccatcagctagctcgtcgttcatgcgctcttagctagctagttaaagagattcagacagatcgagg

SEQ ID NO: 11455 - DNA, 1500 bp, Zea mays
aattctcctatgctcatctatatcctggggtgtgctaatggtcactgtccaaatatttattcacgatccgtttgagctattaattaattttatctaagaaataaataaaaatatacagtaccgaaaacaggctctttgttgaatgtctgaagcactcgacaaagtctaaaaaacactcggtgaaggctttgccaactatgacactcggcaaagagagctcgatgaactgtacatcagcaacgacttctttaccgaatactttatgtcacagggtactcgacaaagaaaagtcgtcgttacagcggctggtaaccgagatggagcctttgccgagtgtaggtgacattatataactcgattaaaaaatgaatagaaatatagctcgatctccaaatacgatctaatccttaaaattcatagcttaaaatttagggcccgttgccatcttaccatccctatctatactatattcttcttgtgcaactgaagataaaagacattggcaaaccttagtctaaggaaaacatgggttctaacactgtacatacttgtcctagcttgtgatgagctgtgacaaaactgacactgctacgtcgagcacgcactagtgaccgccatagtttattaaaatctcgattcgccaccatcaatggctcttaattgcgtgctttgactagtagtagtgaaatccttgaccaagcacgcaatttaatttccttgcatgcatgcagtctccaatgaggcccgccgggcagaacctgatcgatggcaagcgaacaattacagctcacctttgtctcctcccccagggtttcagcgcacctaatccactgctacacaacagctagcaagctcatgccatcccgtctaacactctaactgaacaaccagttactatcttgcttagccacactgatcataccatcagctagctcgtcgttcatgcgctcttagctagctagttaaagagattcagacagatcgaggatgatggtgccgggcaggaggaaggagctcaagctcatcgctgctgcagccttgctgctagttgtatctctgctgctgatgtcgaaggctgagagcgcagcagcagggaggagcttgtgtccttgctcttgtcatcagcatggaggagctgcagcgaggctgcttcatcaagggagaagaatgttagcggggcgggggcgccatggcgaggtgctcgcgaatggattaatggagcacgccaacaaggaaggtggagatgcgattattggcgaggaggagaagagggaggtcatcactgggcctaatccacttcacaacagaagataggatggctggttcagcgagctgcgtgctactacactacacgcctacaccacaccagttcttcagattccttttgtttagttcttgtcgcctttttttttgccaattctttctacgataggtacctaatcatgcatagaatgttcgatggaattgttgcttttatttgttttgtacttctgatttgga

SEQ ID NO: 11456 - DNA, 555 bp, Zea mays
gctagttttaatttaattcatctgatgattgatacgcaacaaacgcgaattgttttggtctgggttgcgacgacggaaagagtgaccaatgtaatgtcaaatgctagactagctagggggggatcgatgcggtctgaaattgatgcacaagctatatatattcttgcatcgccatgtatatataattggttagatcgtggttccaggttccaaacgaaaaaaaaaacatcttcattttccatgtaacagaaacggcgcatctaacggttgatttcaacaccccaactacctgtcgctttaatttccactcctctcgatgtcatgcacctagcgcctctctctcttctctctctctctctctctctcttctctctctctctctctctctctctctctctccccggcccccctcttctgtatatatatagccaggctgtgtttacccctttgcaaaaggcattcgttcgttcataaacatcgcctgaacaccaaagtcaccctccagcagtttcgctttcttgcttcaccctgcgatcgagatcgagctcaacaacc

SEQ ID NO: 11457 - DNA, 539 bp, Zea mays
tcagctcaaaaaagtggaagtgagttgatcggaggtgggcgccaatgttggggacttgttctcaaatgctatgaattaagaacaaggcaacataaaatgttaaatattaatgcccttcgtccgctgaagcattatatcccctaaggatttaatgagcttcggacgaaggccataaacaaaatatcacgaaagtcataccttcgtgatcagactcgaaagacaatatgaggtaaaatgtaaaatataaggcattatagaaagacatgccgaaaatgaataacaatattcacatatattttattatgtgaacttaaatattgaaacataacatttaggtacatttataccttcgtcttggcagaaagcaataattccagcgtaatgtgccagtgattacaagattgcgtgaacagtacaaaggtactgttcacctatttataggcacagggcgtagcctgtgaggaattacaatcatatccctcataagggattacaacggtgactcaaacatttatggactaaaatgtcattctactttt

SEQ ID NO: 11458 - DNA, 832 bp, Zea mays
cgcgtcaggcgacaactccgaagcggaggccgaaaacgcctcgatggtccacgagacgtgacgtggtacgaataagaaaccacctgcacgtggataaaatagaacataacaaatcgttaagtcgtgtaatcactggtatggcaggtaattgtataccaacttcacaaaatcataaatttgtagagcatctcttttgctgctccgctaaattggtggagttaaggtaaacttcactctttttccagaaacggagctgatttgagttaggagtgtttgacaactgatgtatgtagtggagttaaaattttctagagcatagcagtccgaaacacccctaggtgatagctagtgcactcgagtcacgacaagcaccaaggtcatattagactgattggtacggtataactgagatggtttaaatttaaaaaaacctgctagggctagtttgagaactttatttttccaagaaatttctattttaagaaaaatgaactactttatttttaaaaaataaaaattacttagaaaataggtttccaaactagcattagaaatagttttcaaaaagttttaaaaaaaatttccttgtagtagtagtctctagtgttcgagtgggacgccgtcgcgaaatgcgaagtgaaacgaaagagatgacctggcccacctgccattgagtgtatagcacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggcc

SEQ ID NO: 11459 - DNA, 132 bp, Zea mays
ggaggcagtggcgcgccgccacctctgtacgattaatcgatgccttgagcttgtaacttgttcgcatccttgtaggtgcgatgcttgttgggtcataaactctgatgatatcgagatttggtgatcagaata

SEQ ID NO: 11460 - DNA, 296 bp, Zea mays
ataagcttttgaataaaatttacatggtatctttattaattttctgtgttgtacatagtactcagaaaacatttgtttatctaatccgactaggatttggagtaacttctcaactgagacggcacctttttgtgtgaggctgctgtcttgaccagtgtccatacacttttatgtttggtcatgttaggtggctcatagctgagccattacatgttagatgaggtacctttcctgggtgtttgaaatggttgccattgtgacaaatactactgtttattgtatgttttctgttgatc

SEQ ID NO: 11461 - DNA, 124 bp, Zea mays
cgggagctatatataaattgcaacacgcaccaccacccgcagccattgaagcaaagctagcataaaggattgtatagcttgagtcgtcgagcgaaacagctagcaaggaattccgcaagcaagg

SEQ ID NO: 11462 - DNA, 387 bp, Zea mays
tgccttccctcttccgccgagcgcccgctgcgtcattctcgtccctcctcttcatcttcatcggccaaccgattgccgctgaccccggccatcggcgactgtcccccggttcgtaccttctcctccttgatccccttttcttttattgctcctcgattccaaaaatctaatttagtacccccaatctccgaaccctaatcccccgcatccctcctcctcgatcaccacgtaagcaggcagatggatggaggatacgtatacgcgcagattacaccacaacataatttcctttttaggcttagatgtttcgtgttcacctcagctcagctctaacgaatcttgtttctcttccctaggtttttctttaacgatttccgattcgattcc

SEQ ID NO: 11463 - DNA, 761 bp, Zea mays
tggcatcatgcaggaaaaaatgtttactacatactacaattatcataagcaacattttttttagtactgaccaatgtaaccaaacagttagcctgttttggcaacttaatgaccatttgctacagtagtatgactattctgataatgggttgtggtgtctgaagaggtgggtgtatattgttatgttaggcaaagggatctttgtttcatcgttaacatggtacagacatctttgcatagaaagtacagccagtgcagttttgaatgtaattgtttttacttatctttaacgtatggactatggagaattggagataccaaataacattaagtagttcttgagatgcgctttttacgacacgtccttgtttttatgatacgtccttgttttatacatgtttgcatcaacaccttaatttactgttaaaagcaaagatacatctatcggtttcaataggttttatctatcgacttcttaatagtcgtttcgtattggcagaacagtctttgagcactgatatttaaccttgctttttacgttataacaaggcaaatctggtttgcctccatgtaagtaaataacttttcagtatggtcttgcatttatgctttgaggattttcatggttgatggttcatatgcgattttcttctttctcttggagcttctgttatggcactgcaatcttatggttattgacatatttgtttctttatattcctttgtaggatgggtatttaagagttttcaactggcctacc

SEQ ID NO: 11464 - DNA, 874 bp, Zea mays
tgtcgaggccggtgggactcggcggcagctcacagccgccggcccagtcctccttcccgccgccgccgccgtgagaagtatgagctctcgtgacctgggctccggcgcctccgtcctggttggctcaccggttacctctagctggtccaaatggggaatccccccgagcacaccagactggggtgctgacgccgagaagcttggccgcctcaagcgatcctcgtcctttgagctccggagtggcgccaacgtggttaaagcagggataaaattgacttttactatacctaatggaaggtaacagagcgcggggtattaactgtctcaatatggcgcggccgtgagctccagaataccaaaatggcgatacgcagctgcggagtaataaagtggcgaagccgcgcgacgagaatgttacaatctcaaataactcgaacctgtgctatacatcccgaaatgcccagaacggaacgtgcttagatccagttttttgatacacgccacggtggcatacaagaccctgttgtattatttggatagaaaaatagaagatagcagggaaggaatctgaagaaggctccttcaagaaactgtctcccgtccacttgtggtggttcttgttgctgatctgcggtttttgcaattcattcaagcttatgttcgtagcttctgcgtgaggggaagggaccgcttgcctcgccctcgccactcatgctgaagcaatccattttcttccgtgtccaactcaactcgtcaagaatacccggaaggcggattcttttcagctgtcgatcggtttagttgcgctccttaattgatccttgcctgtgctcgtgatcgcaactcagagcacgcgctcttcgccacagcgtcg

SEQ ID NO: 11465 - DNA, 1368 bp, Zea mays
tcattcaatccatataaggtaaaattgattgaacagggcctaaaagttgcatctactgttgaatatacactgaatggtccacgagtcataagggtaagatatgttgccattttgagttgctttatttggactatattaggagttgtttggatcctaattctaaatttcgtgggacgacacgtcccacaccttatgtctagataccaattaaaaggagtaaatgtgatttaattattaaattaattatataaggcatggctaattcgtgagaaggatgtactaaacccaatcaatccaagattcattcatatgatgctatagtatatatatgttaatcatggatcaataggttattgattttatctcatgattagctatgacttatataattaattttataattaactaatatttagtctatgtaattgatattcaaatattctatcttactcggactactagtatctaaacaactttagcagttgtgtatactactaaaaaaatcccaacgggatttagggcctatttagaattacctgaactttaagaatttggtttatagaaactagtctgctttcaaacatgccactttatgctttagcttttagaaawtggaatctttattctaagaaacccaagaaactagtctttcctagctaaaactacttttttttgcctggtgttgtccttagttggtttgttacaaattacggtgattaccactactcctagccctatgcatacgatttccttgatatcggttctacctgacttcaacgtttaactattactaaaaaatattgaattaaaaatatgacttcaatctatatttaacactgcagcaaagaaaaattaaagaattaattgattcaattacttttaaaatagagtaagagtagacttatttttgtttatcgaaaaaagtagaaaccgttttctaaaaaactagatttcaaaaacaaatatctaatttttttatgaaccagtttccagaactggagatagagatagatccagattactagaaactatgcttccaaacatgcctttaagctagaatccgataaacatggggcaacctgtgaaaaaacagaacccaaggaaagaaagacgagagcaccatctttttgcccaagacaagaaatacgggagcctgcccggtggaagatagagcatttctcgctgcttctttctcttcaagaaaacgtcaaaaaaacgtcagcaccaggctcctccctctaataaatagcggcgggcctctgtcagctcacagctcagtcctcttcaaccccgtttcgccgcccctagcccaaatcccccacctactcgccgccggcgccgtctcagcctcatccttctccgctagcc

SEQ ID NO: 11466 - DNA, 1066 bp, Zea mays
ttgtacataattcatcatggtattatatgttgccgttgcaacgcacgggcacttacctagtatattcagacaaatgctactgctgcggaagcatgcaaaagtgcagagcttcagtatttcagacctaacttcgaacgtattagctgtcgagcatattggggatggatcctcatggactagattagatccccacccagagcaaccattaattattttatcgcgaatgcaggcgtagcagaaacgatcatccatttaacagactcgtacgtgtcacgagcccagggttctgcacgtcctttcatcgacgacgtgagctcacccccaacacagccacgcagggccatgtaatgtacatatgaggagaggaggtatcggatcccatacgtgtgggctgtttgcattcggttgctccgtgacaagtcgagctgtagttgtatcttccattgtcgcgccgtgctagccggtcgaatatcggaacgtgcaccagcatgcatgggaacaaagtgtcaccggccggagaatgttcagttccccagagaaaagccagtgctggtgctggcatcttcagatctggaatagacgaaggtgttcgttggctagtgctttgtaatcgtcgtgatccgtcgcttttggcgtaccttcaaaccaaaccacgaggctagtcttcgtaacaaccagttgttattataatcacgaccgccgaccggttcatctgatccataactcctgtgtcctgggcctaccgtccttttaggcccgacccgccgaacccgtttccatcagggcctggttctaggacaccagcgccggccgccggcccagaatgcaccgcggaattccccactccaactccaagcatgcagccccgctcggcttccgttgccaggctgccacgccgtcgccgtctcgccgcctaaaacctccctcccccccctcgcaccactccgctcacctctcttcacgccgccgtagccggcgagtagcagcgggtacgtgcctttgcggtgtaccttattggctgagccttccctttgccgaggaagagcacagaagcagggaggtcggc

SEQ ID NO: 11467 - DNA, 121 bp, Zea mays
ggtagatacccaaactggcacttttgtaaccataggtgaatctatgtcaaaagttaaggatgcagagaattcggctgcgcataagatggtcgaactattgttgaaattgtgaaatatattc

SEQ ID NO: 11468 - DNA, 133 bp, Zea mays
ggtcacggggctctggctgcgccggcgccggcgccgctgtgtcgccggtgacgggcagcgcgtgctggacgacgacgacgacctggaggccgacaccggccgctgctgccccatggtccttgtctagatcccc

SEQ ID NO: 11469 - DNA, 1058 bp, Zea mays
ctagggtccaccttcggattcaatcaatcaatccacgtctcarttggttcacaccacatcgccatatccctatcctcactcgatcctatcatgtcgccctcccctttgccaccgcccccaaccacccatcgccgatctactcgccccctccctcccccgaacaccgtggcagccacctcctgtccacagttctgtgccctcctcaaaccctaccttcacctcgcctccacattttcgcttcccgtcgccggctcccaaaaccctagcgcacaccgatgtcaccttcgtcggcggtggcgacaggtgattctggggaatccacggtgtcggcgccacagagtcagagttcgccgaccccatcgccttcatctctcgcgcggacgtgggcgtggctgcctcatccacggacgcgggcgtgtctgcctgggacctctggaccggtgcagaggacatccgccatagtctcaatattctatgcctccggtagccatgccctaggcaacaacacttccacacctcaagcagctgcgccctctaccaccacactatgctacctcttctcttttcagatttatatttagatttattttccatcgatttttctctatttagatcctcaattaattttgcaccttgtatttctttccccttgtttgttgatgtgcccatctgactcaatttttcctcccatttgcactgctcttaggtgaatttgatacgaggatttcgcttccaatttttcaaatcttgcaccttgatgtgcttttgactgatttgcagtgattattttttcggctctatatatgattattaattcacctgtcatataattttgtaatttaattttgctgctctattttgcacaaatttacacattgcagaaattttatttgggtaattatctacagttcctccctttaaatcaaattactattaaattttatctctcttttgatgccaggggtttcaagttgaccaaatagagtggatacagtcatgctcaaagttggcaagctgtgtcaacaagtaggccccaatctgctactcgcttcaagggc

SEQ ID NO: 11470 - DNA, 209 bp, Zea mays
cttacttattcgcttgcgatttgttttgcgccctctctcgcggactcgtttttatttctaacgctaacccggcttgtagttgtgtttatatttgtaaatttcagtttcgccctattcaccccccccctctaggcgactatcaagcaccacaaatatacaacgagtaatgtaaatgcttcaaagtaacatgatcaaagggcatagaacac

SEQ ID NO: 11471 - DNA, 1359 bp, Zea mays
tggcggcaggtctgagatgcgacggccaaggcctgtctcttcatggcggtgggggcaggcagcgtttaaaacgaaccccccacttcaatggatgcggcggggtgtggtacttaacttggctgcacgcggtgcgcttgtgcagatcctcaagcaagcaaggatattatgttatgatgatggtgatgacgaccacgatgttaatagtgatgatggtggaagcgaacycgttggtctttccagaaacagaaacaataatggtctgtatacaagtgtatttactggatataatcaaatgtgctcaaagtgaacactgtctgcactgaaaggaagacaccaaactgaagagagactgtagggcagaataatgtaactggaacaacaccattatcatctccccctccgatttcctcagccattaaactcacggcttacgcctgcagccgtcggcaacgggctgtgactgtgacaaacacacaccttgaacctgcatcacagagtacacgggccatgcagaatgcaactcagttcattgttcataataccatgggtcgatcagagtagcagagaaaatcagtcacaggtttgtcctcctggaccctggtgcggcgcaaatgacagcaggacatttcaatatcaagatgcttacagggaggaacatgggttcgatcgaacagtggggaaccatagcttaggacacagcttataagaagctttaaattgccatggaccacactgagccatgccaccagaagcaagcgtaaactcaaccatccacagcaagaaaccaaataatccttgctattataagaccgtgtgatttaccactgaaaaaaatgactactaaccaagactgtaaactatttttttcctttcatcacaaattaaattgtaacaatcattataatgaccatttttccatataattcctaaacgtatttttatgttctgttcataatcaaccatgacatcaacacgaacagaaagggaataaaaagacggaggaaatcaagaactatccaaagttatacacgtatagatagaaactttgttttgccctgctatcatcttgcgagcggcccacgagtcgtccacatctccgcgctccaacccacaacccaggcccaaaccaaaccctttaccggccccacatgtcatcctacagcctcaaccctagcaccgccattccggtggcgcccaccccttaccccacatgtcatccacccatcaacgacctcagatataaaatacccttcagttcacaaggccaccacgcgcgcccaaaggcccccaaccccaaccttgcaggaaaagagagagagagagacgaccccccaaatcggaatccgcacacccccatcc

SEQ ID NO: 11472 - DNA, 934 bp, Zea mays
cgcatcatcccagattggatacggtgggcatgcatgccaccgattgcggcaggagcgaggagcagtgatcacacacgacacgagaggcgagactggatccaatccaagtgctgcaggaaaatggtggccggagcctgaggacgtagcatggtctgccgacatgcgcgtgaatggtccgccgaaatccgcccccctgcgggggcgcggctaccttttgccgtttgattggtttcttggctgttacgcttatcctaaccgatcgccgggagagggcgaataaggtttttgggaagcgtcttcacgcgactgctcgtgacctcgtcgaccctgctgatttcgctacttcgacatcgtcgaccctgctgattctggcgcgtgtcatctatcaataagtctaatcagtacgcatttatctgatttggcttgttatttcagttcttctgatttggtaatgatttatattcggaatttaaactggaatttgtctaattattcaacaatatcatacatgtgtgctacatggtctaacttcaaatttagctaataattcgcctcgcatctgttcgatttcttgtgccatataaagccatattcttctccattgtgttcctttgttcgaccaattccaaattccccttctcgctcgcagctttcgcattataaatacagctgccggcatcggcagcccagcaccagcaagcagcagtctaccaccatcccaccaatctcccaaattaagccatccgtcaccagccagccaaccagcactcactcactagctacgtccaactcgtacacaacccctctttctctctatcttctctccatccatccatcctctcgctcgcccttcgacagctagctaagcagtacgacgtagtatactagcatttagcagttcatcaacgcgctcaacctagcacgacgtacggcg

SEQ ID NO: 11473 - DNA, 1500 bp, Zea mays
atgacacctaaaaaagtatgtggtggtggttatccattaggtggtaagcatcaagcctatcatgcgggaaaaacctctaacctaccactaacttatcttccaatcaagcccttcaaccttgtgttgctattggtcatctcggtttttgatgatgaaccagagatccgatcgacgaactggaagcgcagtgacgaagctctcgccgagctggtcatggcgatattctgggttgccccggaagatgaacagacagagagaaattcctcatcggagttgtagctttagatggggagaaacttgaacttcgatgagatattgcggggttgtagatggagtcagaataaactgtttaatgctctacaatgggggaagacaggcatgtatttatagggacgacttgggtttatccaaattttggataatttggaattttaaagattttatattttcaaaaaatacaaaaaaacatttttaatggctgaaaaaatgtttaaatggctccaaaaatttcaggaaaattcctagaaatattttggtatacaactatctcaaataaaatgttttaagtgcccctaataaatagaattttgctttttgaaaatagaaaaagtaatcagaaaaatatgaaaatttatcgaggacttctacaaggttggttaccatgtttcaaacaagttttacattgagaaacattatgcaactgcatgaatgcaacaaagcaagttcaaccttatattttgttctaattattttataataaaataaaatattagaactataatttgttattctaaactgcccaaatcttaataaatcaaactaaatcttggaaatttctattggttcaaaaaaaataaggtgttatagtagttgttggacataagacaaattaatgtgcgatgacttacatgggccgtcggatattaattacttatgtccaagaggctacatgtagatcgtcggacataatgtatgtggggcctagcagacactgtcatggccgttaacggagttaattgccgacggctcctgcgtgtcctcgcacttcgcgtargtccgatagctatcgtcggatataatcttatttttgagtgtttacaaccgacagacacttgcgcgccaaatataagccttaagccgtctaaaattatctatgtccgagtccgagagtctaagtctaatgccgtcgattttactgktgtgccttaggaggctcactgaaatggaaatagctccaacctatggtgtacggccataaactagaccacgagcgcgcgaggtaggattgggagaattcctggccacacacgtcaatggagaaggcgctagcgagctagataggcttgtgaccggacagcccagtcccccttgtataaattgagcacgagtggggtgtagatggccggagagcacagagagctagcatacatcgctagctcactttagcatatatattacataaatattggcatatataaactaaactgaattgaggacgat

SEQ ID NO: 11474 - DNA, 305 bp, Zea mays
ggttaacattgcgcgcccgcctccggttccccgacttttcggttgccgccctgttccatgcgctwagtcgcgctgtatgatcgcggatgattcggatagatagcggccatgaatggactgattgctgtgctgattgctgatatgtaattttccattttttaatttatagtcgatcctcctgtgggcttgtatgcatcttagatgatgacatgcgaatgtttgtgaatagattgatcttgattcatatgtcttattattagtgtagtagggcttatcctgtaaccataatttgtcaacatgatatt

SEQ ID NO: 11475 - DNA, 1500 bp, Zea mays
catgtgttgaagtgaattactataaaaaattaaactaaattctacatctatttacctcaacacacgtggtggaatgaggtgaatatatggcatccaatcagttttattattgaaacatctatgttattgaaatcttaaattgtattgtattgtattgtttgatgtgtggttcgaggtccaaacgtccgtagcatcaagccctcaagtaaatttagggtaccaagacattttattctagaacatctccgtcccaaaaaaaacattcttaagggccttataacatagttaattcaaactattgtaaatttaactaaatttatgtaaaaagatgtcgatatttatgatttcaaatttatataatatagtttaggattataaacattgatacttttctatataaactaagtactggtttaatttgactaaacctacaaagtcaattcattcttcgaccaacaagggtagacaaggtatataccataactaataggttgcatgtgcattggccatcttcatccattgatatttagtactacctccgtttctaaatatttgacgcccaacagttcatctttgaattaggaaacgtcatgtataaaaaaaaagagggagtagttagttggtcatacatcactactgtttttatatataacatataattactttatgcaacacaaactgacaagagctagagccgagtgctcatgattcgaattttagtagctgtatttttttttgatattttgctgacgcttgagaaatactcaaaaacgaaattgaaaagagcagtgacgagyagtcaacgttatggacgagcactatggagttgggccgaaacccacccgggccagcccaccggcagtccggcacccagacacagccagcaaccaaccaacacaaaaacgaaattgaaaagacgataggccccacctgtaagtctccttaaggacacgacgcgtgcacgaccgacatccccgaacaaaatctcctccgccaccaaccctcggaattcgggccgcgctccactaatcctcgtatcggtcgctaatggcgtgctgatctggcaccgtcgcatacaggcagggcgctctttattcgcctgtgtgagcttcagcgaagttaatcccattttccgtgcccgcgcgccgtgccgtaccgtccctatcacaccggatcgccactcgctcccccccaccccactccgccccacctccgcgcctcagatccatccccaaccggcaaccctagcgccgggttcctcctcctcggatccgcccgccgccgcgcggactccattgccagaggtaccgccgccgccgcctcgcgctagaagggattccgatctacggccgacgcataccttgccgcggcattgttggagaattcccattttgttttggctaatctgagcgatgctgtctgtgttcatgtgaccaggtgatcgagggggagagatagagcttgggtggtcggattagggagagagagagggaggggagg

SEQ ID NO: 11476 - DNA, 649 bp, Zea mays
atttaccataaatagttgaaatgctcccactccactaaaatgaccggatgcgagcacttttctggacacgagcgctctcctccctcttctccctctacacttatgtgactattcaaccaaacaaagaacaactctactctattttccttttcaaccaaataaaaatagagtgactctattctgtcaaacgcagaatagaacgtctttattctcaaaaactagaatagagcctaatcctggtgcatgcagtttactggctcttatggtctcgtttttttcttacttactcaatggggaatgatgatgtagatgcaatatactgtattttatattaactaatatataatatttatgtaaaatttgaaatccaataatcgaatttgacattgcgtacaggttgcgcagcatacactagtgtaatttttttatcgagcccctaaaaaccctccaaaagacaatataaaatgtggttacatgccatccttttccagccctttccgactttccgtcacctcccttcagacaacggaaccctagcctcccctccccctctctcaccaggccaccacctcgccggaaccccggcgcctcgcccggagcacgtggttatcgccccccgtcggccgcggctgcggaggagcggtgtaag

SEQ ID NO: 11477 - DNA, 1500 bp, Zea mays
tccgtgcaaatgctgctgttgtgcccatctttgtaggcctgtacaaatgtacagtaagcatgtaccgtttctcgtccatatcaggcacacttgagcagtcaaaagtacatatctgctgggactgggagacaactacaacttgttagtttcagaagtactcattaaaattctacagtattggggccggggtaatctttttagtgagatcgagggtaacattttcacttcgtgtgggcatgtttacgtgctctttaattgattcaacatccaaaacagatcgagctatacaacacatatcgatcgagttgcctacaacataacacagtttccatcgacaggaatgagagcccaaataaagctgctatgggctatgggttttaaaaagatgttgtggcttgtagacttttgccaattaagtttaaaatttgttcggtgaaaaccatctaaaatcaacgtggacatatgatcagctgaatcgtcacgatataatccccacgattctcaaattctatctataggtagattctcataaaagctcattaaaaaaaccgaaacaaaacaagctcataactttctgaaaatagttgttagagtcgcacggtcagtggatcccatatgtgcccgtgtctatgcccgcgaccgcaagagccagggcagtgtagtgcttatccctagggctgcccacgcgaagaaggccactagaaattgggactaaacagcaatagagaaaaaccaatggcagatgtttaattttattaaacttttccgtcaccataaaagtgaaagctagggaaaaaactattctcagtttatattatattagagtaagaagttgttcattttaaactttggaacttagagctagaggcaagtccaatgggtagtcagggtaggtccataactactataaaatttgacctaaaaataaactacatctcagcatttaggcctaaagaaataagcctatatatgtaacttgcaacctaatttgatgaattaaatattatgagatattttggttattttctgtttatgtactaaatagttagaaattatatgtgtggtacggaattatacatagtattacacgctcaaaaaaatgtctgctcgaagcctatttgatgcggcacctgcaacggatgcgtgacacagcggacagagctgcaccaaatgaggctgtgagatgtagcaaaacctagctagcttcgggggaagggctctggccggagcacaacgagactacgagagccacaacaaacgaggcattagcagctttagaagaagaaaaaagtgacattatgatatacgatttttaccttaataatgttataagggcaatgtgtggtagctacatatacagaaaaagaggagctacataaggtctcacatgtttctcctataaatacccatactcggctccctaaaccatcccatctcacggctagctagcacaagcatagtgcaggggcttgccacctaagtaaggcccgcctgagagcc

SEQ ID NO: 11478 - DNA, 1500 bp, Zea mays
caggacaggaaggaaacgaaaaagcaggagccagggctgttcaacaacgtgaccgagtcgctgaggcgaggaagagtaaggtgaaggcactcgtcgacgcctttgagactgacagagcgtcatctcgctgcaggaaaccagcaagcctgctgctgctccagctatgaaagtaggtgtcgtgccatgagtgcttcttgacctgcagtgtgcatgatcacctttcttggaatttttggtcttttttggttgttagtgaccgtaaaagtggcgcttgttgaggtttgctcgttcccatgtaaactgagttttctcatgggagtttccatacttttgtagtgctagaaaaaaggaaagtctgtacaggttttgtgtctatgcaaggcttgagaagttggcattgtactgataagtgataagtaaacaagttattgtaatgatttaaactagattgttttgaaaggaaatggaatgcataaagcaaattaaactttgtattatgttactaattcatgaaaaatggtactaaacttccgtcaacgtttttatgtttctcatttcactcgctctatttttcgttacaactacactgcatatgctagcatatttgttcatatagtactcttgctgacatttccactatcacagcagcatctctactactatttgtgttttttatataaatgtattttatcatattgatttcgtccatgcaagaggatctctatcgtgtttcgcaagttaggagctgccaagcacctgttcggttttgtgtagaacttcacgctccttcctatcctggatacttatatctttactcaaatgatggtgtctagcaacaacgatagcctatcattgacttggacgagcagccataaatctctttcaacaacttatgtcacgtcgcaacgcacggggacccgagtcgaaatagaaacggaaataaaaaatcgttcatcttcttctccaagcagatttctgttggttagctactcacgtcaactcaaaatctcgcgttcacctccttcatagtctctccgcctcccgcttacctctttggctctagtctatccccctctcgtttcttcctgtgagcgacagctggtggagctgcgccgctctcaccttcaccggcgacgggcattcacaaggtacgccatcttccattcttcccttacatcctccccaccgtgcgaaaccgagcacccaaaaccctaattcgagttatttgtatccggatctgaccctattacatgctatatattatacccctgctttcgatctttgcaaaagaataaaaaaaacgggtataaatatgtaccccgtctcctacttgatccgcccctggtgggtttatgtcctgtggtgttgtgtagtggtgtggtgatatatgttaatttactgctgaactttgtgttgattatttcactgggggttttggtatctcgtttgcagtagtgatctcttgactaacggcgtagtggtgactaaagagccttgaca

SEQ ID NO: 11479 - DNA, 637 bp, Zea mays
ttgtggcagccatcttttgctactatacactagcaatctgtttagatataaatatgtgataatacaatgtttgtcccataaatattatgccagactaatatgtttcttttattcctagctacatcagacattcttttctacctatacatctatgtatatatctcaattattgatattctatcatctgtacttcacttttacaaccttaaatcgaataaattttttatttctatcaatcaacagcatatgccaggtaattattacagcaaatttgcatgtttatcatctattttaattcaattatttttattaaaaacatttttataatgctatttttatacacattacattgcttacatgcgcgcgctggcgcacgcgagtgactagtattactactttacaaagcgcgacgtaaaagtacgacaccgttcgaccacgtcacctttaaaatttttagccgttcratcagattttagcggccaagaatcccttcgtgtatcaaatcctggaatagcctcgatggttccagacagcgaacgaacgggatgaggaaaaggacccaccagcctgctgtccattgctcctagaagcatcgcgtcgtggatcggctttctccgtgctccgcctcgtcggcctc

SEQ ID NO: 11480 - DNA, 1500 bp, Zea mays
tggaagttgatgcaacgaacctaatgacgtaactgacgccctaccatgcacaacggaaattgagccaggtatgaatctcactgtagctagctttgattggtcagtttattgagacgatccggacgctgctattgacaaactgtcatggggactactggattgtagatagactattgagacatgtatcatgatgacgtcataaagaaatcctaaattggttagatttggataaaatttgtactgctggccctcctctgaaaatgagaggaaatgttttctgactctgttttgggcccatatcatactagaacagtaagagtgacatattttaaatgttgttcttcaaagagtgtagagtactagagtggacatctaactacatggcgacaacaatgataaaggcaatttaactgtatgtatggactaggatagcatcccaactatctacaatggattgttcatgagattgctataaggattgtccatgataccagtaggtagagatggccaaacgggccgcccggcccgggcccggtgaagcccgaccaaaaaccgggccggtgtctgctgagtcagcgggcttaattttctgtccaagcccgacccacactgggcctaaacgggccgggccggcctgtttagcacgaaaaaaacgggccgaaaagcgggctaaacgggccggtaagcacgttttagtgtaaaaaacgggcttaacgggcttagaggtaaacgagccgtgccaggctagcccgccgtgcctagtttcctatcaagcccgcccgcttattctaccgtgccgggctcggaccgggcccaaaaaacgggcttcgtgccgggctcacgggcctcgtgctttttggccatctataccagtagggtacgtacaatccgattgtatttatattctagtatgattgtatgtggactcttaagtgtctcttgtacttagaaaaccaaaccttcaaaccgattgtgcggtcacaccttgtcccccaactcccgcccggatctccatcgccacgcacttctctgctactgatctttagccaaaacaatgccgcggatgacgtggctatgatttcccaaggcaacaatatccacttgagccagttccttgtccagaagctgaaccatccactgatccacccgaaaagcgcgctatttttatacggccaccaccaggtcagcaaggcagccggcgcctagttctctcctccatcgcaactcccacgacccttttccaagtctcgcctccacggctcgtcggctccatccctattcctctcgagtcgcctccgtcccctttgttcaccccagaccccacgcgtgtggctttgaaagagcaccctcatgcatggtctggccggttgaattgaaggagaactgggcgaccggcggttatccaactgtctctaaccggatagagaagaaagtgctccactctccagacaaggtaccgaactcccctcgcattgcgcgtgtcgaatttttgcaaactgc

SEQ ID NO: 11481 - DNA, 1500 bp, Zea mays
ggggaggaaggagattaggaagttgcattgtaaggcataaatttaacagaggaactcgagcaccttggaatccggataacagatcgtccgcggacgtataccaatgtgacgcggggcgcggaggattgacaacggcagtggctcgacgatactgtcagcggcggcggcgattgaagttgagggcgtgcgacggcggaggacggcgaatcgcgctggcggcggcggatgaagacgaatcgccctggcgacgcctgaagaatcgcggcgagtcggccaggaaggttgaccgcgcgggggttagggtatagaaatgtttgaccgcgtgggaagtggggtagtgggccaattcctgtatttctggaacgtgggtcggctgaagtagttacgctaaatcgctattgtgtataaacaggagaatggaatagcgtaaacatgtgttgactaaggaagatatggttgaccacgtggaaagtgggcctaagccgctatttctggaacgagggctcgcggttgttactctgtttacgctaaaatgggtttccgtttacgctaaatcagttcgcttgcataaaaagtgatcggacgtgggcttaaacggatttgcagatttgatggttggggctctccacagttatatagagcccagggctcttaatagataaactatatatatataccaccaataaagaatattttagtataatcatattgagaccttactaacgcgtgccagcagataaaagctctgctatccatttggttgttcggttttgtggttcatgtagtagtatattaattatatataccacagattaccagtagtagtgctttcaaaggaattatctagagattttattggactcgatcattatttggaacctattatgccttgtccaatgtccactcactctctctgtagagagggcgttgacgtacgccagcatgcagttgagtcgaccacacaaccggcctaaatattagtcgatgatggaatgggtcatgtcctaacaaatctccatatcaccgattttattgttcccgaacgaagaaattagccagcacgcatatatattctgcttgttgatcaagtggaaaactggcaatgtcaacaacacgcctttgcaattgaatcgccagctacgattccagcgttcgtrtaccagctaacgacctcccaacagcataattgttgcagctagcgaacatgataaccgatttttttatttttttaaaaaaatactaataaagccatgcgttcatctctataaataccctagctaattaacttggtgtctcgcattgccaccactccaagcatttacgtctctttccccaggctagctagagcgcaactttgcttgtagcttgctagcagctttctaagatcttgggtataagttaataatatacgatcgaggatcaaagagagctagctaggcgagatatataactataagcgcgctgaagaactaagcagcgcatatcatggcgatgctgatg

SEQ ID NO: 11482 - DNA, 467 bp, Zea mays
catttgtactggcctaccgggtacgatgctcatgagctttcttaccatccttctgcgctgggtcatgcgcttctgtacattgatgcaacggacaggagcattgtccatgtaactataataaaaaaatgtctggtcttcaaatgatagcttaatagctgatgcgggaaggacgttaattaaaattttaatagcgaaagctgtggttgaaacggaaaatgtgaaaatcctgaagctcgaaatatcagctagttggacttcttatcttcacgtgtttagagttcataaaatttcccaaccatagaaatcctccaattattcgattcccaagccactaaggcccttggaggaacaacagaatccagaaaccgaaaagaggcctcactgctgccgcctgggccaagtcgtcgtcttgcttgccaatccgtcgctccacctgaacacaccggcgaagaggaggcgaagaagcg

SEQ ID NO: 11483 - DNA, 1500 bp, Zea mays
cgtttggaggcctggtcgacatgatcttaaggtcaaacaagatctatgtgaaagcttatcaaatgccaatgaactcaaactcactttggatgaggaataagtctatatgatcccctgacctttagaggatggtctgcttcacctcgtccctttcaaaattggttatttaaccccctcaacttcacaaaattagacaattttagttggcggttttgatgatgtggcactgattttaggtggtaccagatttattctatgataaaaacctccttaagtcaaccacactgaatgttgaactttttagatggcacaaagttcaaatacagaacaaatggttgtctgcacatattgaggctgagacaaacttgaacgtaataaagtgagagactgaaagaaagcaagaaccatacatcagtgatcaatcagtgtgacgaactgataagctgttgctctattactagaccaaaactttggaacaccatcacaaagtagtgtgacggagacttacagctgttcataggacagatcgataagcatcatcttccctgtaccgacaccaccgtccaccatagaggtaaagcccctccactggagcataggtagaaggctgagtaatgagacgggaccatagccatcgactccttcaatgtcaaagattaaggttaagataacgtgctatatacaaattacaaaatatatcaccttcataattcttgaattgtatcagcctgtatgaaccagtaaaaaggtgggaaaagtttttaccacaacactgatggaagctatccaggaaatgaatctttggtcaaagaccagaacaacacctgaaagctatcgccatttactagctctcctgatgttattctcctctcccattccaccatcggaccacctcttccaatatagtatcagtactacccactaacaaacacaatggcatccccacaatctgaatcaactaattcttcatcgtcggcaagcttcgaggcaaggatatccagtacggtagcaatgcctcccaactcaggccccaggtcctgcccggcgacgaactcgcgcaccacgttgtccacctcaatcatgctgcacccgggcgtcttcctcgtgctccggctccgtatctccttcctcgtactcgccacttcgccccatcggcctgcagcgccgtacacgttggccagcatgacgagattgcccacgtcccctggctccagctcgacgagccgctcggccgccaccacggctgtttcgacgtcgccatggctgcggcaagcgctgagcagcgacccccatatcttgccatctggagggaccggcatgcctcgtatggtgtcgagcgcgcgttggattcgccctgaccggccgaggaggtcgacgacgcagccatagtgctcgacgccgggttccacaccataatcttccttcatttgatccaagtagcgcaggccttcgtccacgaggcccgcgtgggagcaggccgacaagagccccacgaatgtg

SEQ ID NO: 11484 - DNA, 1500 bp, Zea mays
gtcaagttacttttcaagaacctcaaagcaattaatagttggaagcagtttctctttgttaacttgttctgctgcaaccccccctattatgcactgttggctgtgcatatatcttgagtctgaggtctgagctgtcatctttgcttttagctgtgcgaggaacagacttacagacatcatgtttagcaggtacaatagttgaacagaacatgtgtaaatcatctaactccatgctgccattgcaggatctatctaagcacccaactatatgttcaactcgaccaaagataaatgccaaatgatgcagctggcttgatccaggcccctccactggagattttatggtgtcaaatgattttcatgactcagaccctgtttgtttaccttctaggttatataatctagcttaaataagctcagaggtaaacaaacaacacatattattaggtggattatgtaatctatatacctagattatgataatccataagcaagtcaatatgtgcttatataatacataagctggattatataatcgtggaaggaaacaaacagagcctcaatagttttatgagagcatgctacatagagctatgttcggtttgtagcacgcaatcagattattcatcttatgttttatccagctatagtttgagttttggaacatggtacttcgatgttgtgatctgtatcacggccgagaacttgagcgtatcgtttaattgtattgtttcagatggaacactctacttcactgcgttcttctagccacccttatcacaaataaatgcgggcttcagatgatactagaatcgttaccttgttactattgtcactgaggccttgagggcgtggtctgattatctttttaggcactgggtctgtttggtctcaacctggcaggcagtcgctggccaggtacctccgtcgctcgttaatttatttatgaacttaaacatgataaataaaaaagaactcaaatatttgtctttatttatgaactaaaacgtgataaataaaaaagaaaggagtgaatgaagcgtttgaaatcgaacgtctggcgatgtcgttctccacgcacctggccgaaccaaacaagcctgtatcgagtgagtgcttgcctgcagttagtgctgccgaagtgccgatcaagctggacagctatacgcgaacaatggcacaagaggaaaaagtggctatgtcttgtgcctcttgttgcacataagagggacaaatagttccgtggaaccatgcatcagtttttcaattggattttcccgttcggtacaaaatgcagcggtacgttaacgacgccattgcatcacctacacgacgagtatttatgctcgaggtaccttcatgggctcatggcttcatcgacggggtaactagccaccgcaaagcctctatcaggcggcacttagccgaaggatagatttgagcacaacacacccgccggccgattcgtggaacacctcgccgctgttggctgttgatgcc

SEQ ID NO: 11485 - DNA, 1052 bp, Zea mays
gctaaacgggccgtgccgggctagcccaccgtgtctaatttcctgtccgagcccggtccgcttattcgtgccggaccggcccgggcccgcatataatcgggcccaaaaagtgggcttcgtgccgggctctcgggcctcgtacttattggacatctattgacctaatttggaatatttccggcgcagctgaagcttggatgttagccgacacctgccgcggcagggagagaagctggctaccaggcccggtgggacggcgacgcgctttggactctgcacagagcggagcggcgcgacccggtcggtcggccacccacgcgcgcgatcaaggaagaaccggggcaacaggacaaaacaattcacgggcgtcgtgccccctcgccgccccccacttcgcgccctcttcctcccggctcctgctccggctctttcctcgccgcgccatgtcaaactcaacagctaggcacccacgagtagccagccacccaatcattgccccccaactgcgcgtacccgtccccgcctcctcctggatggatctcttttttgttcgcttctccgcccgtcgcgtccacactccccctcacgtagtgcgagactgcgagggatgatcacgcgtttccacaccatcagctcctgctgcccttttgtcttcccctctggatgctctcgtcgtcatcacttgttcttcttcgagctaccagctgcctatcatggtcatcatggtcgagctgctgcccccacttgcctctctaatcctcagtcctctgtagagctggtcctcctacccctcactttgccttgagcaatttggtttctagcatctgtggggtggcttgtgggtggtcgccttggactgctccttcctccacctgccgcgccggcagggcgacgaggtccaaaagcctggtggggctcatcatcaagaacaccgaagcggcgagagtggcatgggatctgatccgaggcggagctcgaggagctgaggggctgtacgtgctcttggatccggtagagattccgtgccctcgtgttcgtccccggccgccgcg

SEQ ID NO: 11486 - DNA, 172 bp, Zea mays
ggtatgttgtggcctcctttgtgcaattgatatcttctttgatttgtttaaagtaattcatgttgcatgctacgttgaaccaacaaatgtaattctatgaagtacatcttgtattgtaaagtcgatataaagctttggacttactaatgataatcactgcttctggtcgtgt

SEQ ID NO: 11487 - DNA, 457 bp, Zea mays
ctgcctttgcctcccctgtcgttataaaaaggatcggagcgggggtcaccgaaggcgtccaattcatccaccttgtccctcccggagaaccagaaggctacccaccctccaaggtccgtcccctccccgctccgtccatccctccgtctcctttttcctctgttgccatcagttcagtagtagcctgcagctctcccaccttctcgctgcgctgtactgtgctggtgcaaagaagatccctgttcccgcttttagatcacctttgtgcatgcttttccctgtggtccgtgggcgaggaggccaaaaactgcatcatgcccctcgccctctctctctctctatcatgctgcctgtatcgcaatcacgagcgagcaggttggtcgtctttctggagacggcgagctgaccggccgacggtgtctctgtggctgttgatgttgcaggcaggggaggggcc

SEQ ID NO: 11488 - DNA, 1500 bp, Zea mays
gggcgaggatggctgataagaagatgcttcattaggaattctctacttcctttttagttttctttggaattactaattccttctcagtttccttcaacacctcaaatttctatgtgaataatgttttcactaattgtttctcagacttcaatatatcagttttgtatatgaacaatgttgtccctaactatggtctgtaaagttgaaacactactggtctcaactgcagactcttctatatatagctatcaatctcaatgttcaccgaatgtatttttctaatcagatgcatgcaaatgttctttcacgttcattcatgtggtgcttatcggatgcatacatatgttgtttcgtgctctaggcaagcggagcaataatttacagttagttcatcaaatgcatgcctagtttcttcaattatttcaggcatgaagtaacataaacgtgtttctggatacgtcaaagggtactttttcaatcattgaaggtcttgattgcgctcatgcaattgaggcttcaacggggtccatggtatttgccatctagaattactatttccacggtacacttctaatataattaacttccattttttcatgaatgcaaaacgtacgtacattcaactttggagtcaattacaaatccatttatgatcctaacatatgtgatacgacattttatagaaataaataggatataaagtgacgagattatcactagtacacagaagctctatattggcgattgtgaacctattttcagtggcgtttttttagaaccttcagtgctaggggcccattagaaatcatcatggaggtgaccaagcgctagtgtacgtgagggtggggagatctaggtcgtggggcccacatggaggtggcagcaacactcgagcgtgggtaggggacgacgactgattcctggtactggaccgaccgtcgacctacgcggtcgctgtagagggaataggaagttgggccgagtccgaagtaggcctaggtttattcttttctgtttcccatttattatttttcttctattttctatttttttatttcaaatcggatcccaattcaaatctgagtttgggttttcatttcaattgaaacacacaatcaaaattcaacatgggtgcaatttaattattttgcgcatttatttgggaaatttattcaagtatgcaatgcacacacattattcatcttggtcaaaataaatgatttcaaaagtgaaatcttggtttagaagatattttattttgatttttttggaggacttttcctaaaataattcgcatctagattttggagccggttaataaaagtgtctgatactagtacgtaccatacagcagatagatattcaggttccttcaaatagtaatatagtcaggggcaaatcatcctgccgcgcgccgcacgtaggtagctacgattcgattcgtgctaggatttagtcgtcctgtcgtcgcaccagcattactagcattcagcaacacca

SEQ ID NO: 11489 - DNA, 210 bp, Zea mays
cgtaaacggaggcttctatttcagcatacgcccaaacatttccgcccttgtccatcagggtgccgtctcccccatgttcagcatgagcgagtggatgaagcagcaccaccaccacgcgcccgacatgactctccacgagatggtgcacggcgaaccgtgtgggagtctttccgagccaaccccgcgatcagagcctggttctacgacgcc

SEQ ID NO: 11490 - DNA, 1500 bp, Zea mays
ttttcctgcgtctaatcgattagatttctggagattctgtcctgttgttgattatttttttacattctgtcattatgccaattctgtctataaactaataacatgaagtctaatagagcctgtagatatcttttaaaaaaagtcaaccagttgcaattcaaaatgagaatttttgctatggctagctattattataccagactaaaactgaactgaaagcatagtgaataatgcacaaggaagcttcatgctaggaggtctttatttctcttgaaaagatatctttctcaacttgtgttctagggatgtaagatatactagattctaattaggacgggcagtccattttcgtgaatagatcatctggttggtactacgaacccattatgggtgtaatacgaaatgtgattgctccatcttggaacgagaatttcgctgcagttgttaaatacttggccaatattggccagcagagttgatacaccagacagcatactgccagaacaccaattttttttttttttttggtttagaaagattatctcagtagaatttttcactgagatttcagtcgtctgctcagctggtgtcctagaaacgtatgatatagattttaaatcggccgagcaggatcttcatgcatggagcatctgtctagtcagagtgccaccaacttcattatcctgaacacgaactcttcctatgtagtagtagcagtactcattttttttctggtaccagatcgatgttgaactgtgtatacatatgatttttcttcttcgtttgtttatgttttagaaatggatttattttgccgcgggacagaaattgaggacgaatcaaagttctagttctaacaatgacacgatggctcctttttgcaggcatcagttcctagggggcggcgagtattacacttgggggtagtagaagaaagaaacacccattcagccaggcaatcccggcgcacacggctgtgaatcggtcggtgattgtcaggttaatacacaggttagtttttgtgtagctaacccagcggcgtggtttgcgaacaccgacatgctagaggtggaagctgctaggctagctagaggaaaggagcgcggatggatatacagaaacatttcgtgaaggttttgtttttgttttgttttttggtttttgcgggggtggtggtcatgttctagttttggttcgtacgcgcgtggtgaggccttttggagttttgaaatgagatgtagtagtaattgttgcggcacatattttagaagtcaagccatgttccaacagaagctggaaagagatgtccgctgtatacgggtgagcatgtataccaaccaaagggatgctgtattatacattagcctgtgtgtgtgtgtgcgtgtttttatttttgtttgatccggtttttagccatttgtcttttttttttcaatctggagattttgctgacttgctctgaattattatgcatgcagtggtgtttattttgttctcttc

SEQ ID NO: 11491 - DNA, 1500 bp, Zea mays
aaactcatttaataaaaaggaagatggaataaaaatgctagggtgaagaacaagagtttcatactccattgcgcaatattatttcattctacatcatttcatttacatctccttttgaagaccttcatccttcacattaacacttcgaaagtcaaggacgaaggtttacatacttaactcgtgttgccttgattttcaacgccttcagaggattgaaatcaagtatccaacaatcatcatcttgttacggtgccagtaaggtaggtgagattggtctgatacacctatgcaaaggaaattcgccgagttacatctcaatattacgacaaagtagttgacaatagaatgatcatgaagtcggttacctaaggtctaggtgaaagtctaataaaactatacgggaggtggaggtggcgccatcgaaagatttatcccctgtcctttgtgatagttgctacaaaagagtcagttatgatgtcagtgtttcaaatcaatacataacttaaagtctaaactattatattagcaacttactcaaagaaatgcttgttgctgcgcaagctgagttgcatagtactcctattgctgtgcaacttgcctcaggtattcctgcaaggccctttaccgctcctgttgctggcttaattctgctcacagtcgcttagcttctgttgtatcctgagtggagcaacatgagctaggcctcgatgaccctcccttttgaaccctcaatcgactcgagtcgctctctaagctagtgccttgtggacccttagcgctcgcgcagcctgctcaccacctgaccccgcccgcgcagctaccacaccgtgcaaaaaaatagtgcagagcgagcactcgaacccacgcccctctgctctagaaatttagagctaacaaccaaaacacacttacctcagtgtttagaaataaacaatatttatatttgaataaatatttctatgatatataacaaccgtggtaaaacacgagcaattggctagtaagacattacaaattgtgtgtggtttctaggacgacttgtatagttgtatattggtacttacggaaactgtagtgttgttcctaggttgaagatgtcatacgccttcaaataaggacttaaatggatttaagttgtctacacgtcttaactttttgcaattataccctttatgtatataaagagccattttgtgtactctcgtcccatattttctacgtgatcttcgatcgcggcatttatttggcacatgcagattaaaaatgttttaggccccttccggctaacatagcaacttgccacgttctctccaataattttgaccggtagaatggtcccaaaaaaaagctctcgatgcctccctataaataccgctattatggcagctcacctaagagctaagagggaagaacaatcgagctactaataaggtcgtatacatatcttctatatactcctctgaaagttgtgaactccggtcgagcttaaaaacagcagca

SEQ ID NO: 11492 - DNA, 637 bp, Zea mays
acctgatcgatggtagctgctgttcctgtcgccattgcctcctgctggcaggaacaggaactctctgaagcacggggtcagggtagttcatgttgcttcgattcgatcgtaggggagataatgccggatggcgctgctcatgctttgtaaagtttgggaggacatgcatcataattgaagtcaagtgataggatcctgttttttaagtacacgatacatccctttttttatttgtcgctctcatcagtggacgactgttgatggggtagttgagtgctgtgaatcgtggtgcagcgatcgcagttgcaaaagttgcagggtcaggctgccgcggcaacgggtcgtcgtctcctcacctcgccggggctttacttatccaccgcagggccaccgagcgaggcgataacccaaccagtatcagccagccagctcgcagtccctccgccaccaattttttccccctcattctcgtttccaaattatccgccgctgaaacaatctgcacccccacgcacaagcacgaagcagtcagcagtggagtacaaatcctcgcctgcttcctggttttcgtccccattctctccccgccactccagcggaacggcggcgggggagtgagtgacggcaacgaggcaag

SEQ ID NO: 11493 - DNA, 795 bp, Zea mays
gttgtattgatcattttcgttttttaagtgagtgttgaatcggtgaggagtaagagagagtttaagtcttttaggctaaatgttttggccttattttgcgagtacttggagttgttatttggtgtctgaccttggccctaccctcgaaagaggcgaaagccgaattttgttccattatctaaaaaaaatgatgtacacccgtgtgcatcatatacacaacgccacccttggccacgtgcccgcatcgtaatcctaatatcctcggctccccgctccccgcccaaggccccgccgcatcggtgcatccgcagctcatgttcgccttcttcggtctcatattggcatccacaagtctcctgtttcatcttgctcttcgctctcaatcccccttcgcccctcccatctttctcttcgctaacttccctaatcccctttgttgagactcacaattagatcgtctttctcctttggtgtttgttgtcggcggccrgtgaatcggcaactctagagctcgggctgctcaaggttagcaagttctttccttctcctttgcgatttctagaggagcatcgtcgacggcttacaagtgacatggtggatgtcttatcctacatcaaagactgrcagttagcgaactctcacatgcagcacaatctggagagggacaccacaaatattgaatctatccttgagagcataagccagagtctaatgcctaacatgagtgactatcttgtgtattgccttctattgtgccttgttgtaatggactaatggaacattaggatttaggag

SEQ ID NO: 11494 - DNA, 1500 bp, Zea mays
tctatcataaaataactacacttttagaattcaaaatttatcttaaaataagtgtacaaccagctgtacaatagctaattttaatagcgtttgctagctgcctcttttcataagacgtaattattatatgttgaaataatctttataagaatatatatatatatatatatattattttattagtattattgatatcttcagtcgaatctagagtgaatttatgtaaataatacgaataaccaaggcaacgacaggcaaatagaaaacattttatatttgcggtagcgccgtagcagaataatgtactactctgtcatattaaaaaaaggattctactgccgccaagccaatcaacatcggatgaaaggaaattgaaaggatacgcgaaagacgtacgccgtcgcgtgtacagtgctggagcggagcggaggatgcgaagggcagtgataatccacctcagcttcaggtgagctggccggtggccgcttccgcccttttctatttctgaggtctgcgcggtttccaattccgacgagccaaaacagacggacgcacacaaagcgaaaggaagagagagagagggggggaggaagggggcagcccagagcaggagagagaaattcgaggggaataaaaagggaaagaaataaagtgagggaggggagagtcccatttccccaagtacgagagagagagagagagagagcagaggagcacgctacgctacgtgaggggagagaagagagagggaggtcgagggagggaggcagcaggggttgcagcagaggccagaagcattagaagcggcagtcgtaaccaagtggcatcagtagatagagccagccatctatctatccatctatctagctctacaggtataaatcctcacgcatcggtaggagggcgagaggggggccgacgggggacgggagaggccgcctgccagcaggccaactaccgagtgggggaggaccgggaaaccggaggaggggatttctcggggagcggagggtcggccaggacctgattgggctccagggcgcgatctttgagcgcagatttggtgcccgcgatctgccatggatttgatttaaggtgagctccctttacttactttggcgtcttgcttgcctggctcggattcgtgttatcggtcgacctatggcggagctgagagttagagatttggttctttcttcgcagatttagggagatcggtcgtgttcgcgtcgcgctgcgagattcgattttttatgcctgttttattcacgaggttggctctcctcagatctcaaggcttcccgtgttcttgatccctttgttcccgttgatttcatctccgcttactttctttctgttcgattttggctcctgcagattgcaagaacgggactgctaagcaagctaaggtttcatatttttctggatcaatttcaaattaggatttaggaggaggaaataaagcaagaatagaaagcttttttttggggtgaagccatg

SEQ ID NO: 11495 - DNA, 283 bp, Zea mays
cgtaagtcactactgaccggccatgaattcttgtgagctgggacgacggtcgttgctgacgttgtgtgagtgtcctcgaacaagatttatgtagaggagtagcacatatggtggtgcaacggctaggtgtactacctcgctgatgagcccggggtgcacttcgtttggcagcccagccaagagtcatcggtactcgccatgtcgtgcgcgttcgacaactactatatcaaggactatggcgtcatcttggcaccagaggtgacgcagaggaggaccgacaaca

SEQ ID NO: 11496 - DNA, 1294 bp, Zea mays
ttaaaaacaatggggtaaaacacaattacaagttctaagaggggtataattaaaatcgcctcaaaagttattgtctactcttactcatttttttactctactgatatctcgtggctgttcagtattttttggttgaataactttcaattctcttgagttctatttattaataaaaccactgtcaatgtttctaacaaattgaccaaaccagtgtctacacacgggtgagctgaaggcgaacatgtccatattcggtacggctgttcgggggcatttcgataggcgtctgttggagtgttgcagaggtacacctcaggatatttagtttgactaaagtttaatttatgtcatattaaatatttaaatatcaattatatacgtatagttaattagatttaataaatttattatgtcttttagtctttatakgtataattagttttttaattaaaatatatttaatatccgtaattgttatttaaatatttgatgtgaatgtgactataaactttcaaacacattcagaagtgagggtttatactttaaagaaacagtctgttcgattgtctttaatacgtactgttttctgctacttctataatgtttttgtctttataaattatagctataatagttcaaacaatcaattttaattcgaagcgaatatcaaaaaaaaatgcaaatcaatctattggcattgtagtggcacgtaggacagaaacaagaaacaatgactatctatttacacccagttaaataggagtaattactttcatttgcatgattgcatctgcgatacttgagtgctcgtgccctgagcctatggaggctgtgatggtggcatgtgtaaatgcgttgcctagcttaagttcgtttctgttgaatttccacgtgtatttattcattttcatacatatgtatatcttgattctgtttttacagccggctgtctgatcccattcacattttcagtaaacttccttttttctgaacaaaatcatttccactaaataaatatagaaatagaaattaaaagatattttcccgtcgtttccgttcatttcgctcgctacttatatcattcttttttgtgtcacacaaatgcaaatatgtgttcgtcctgctgtcgtgctacaagtcgcgctaggccgctggcccattgcacacacggcccaaaatagtcttgcaaagtccaaggaaacgacgggttcacagccgctgcgctcaattgaccctcccctcgccggcgtccggcgatcgccggcatccgagcgatggatcacccatccacgtg

SEQ ID NO: 11497 - DNA, 302 bp, Zea mays
ggtcagttttcttcaatcgatcgcatatgatttcttgtgccaatattttttttttgattcagcctgtgctgccctttgtcctagcatgcagaagtttatcttaacgccatgattaacagcttttatgactccgtccgtagtaaccccgagtctgtgtttcatttcatcatttgtgatatgggaatgttcgttactgttctctctctctcttttggctcaccggctgaagcccgttcaactgcaaccctcatgtgagatttctcgcatcaaagctcctttgcctaactttcgttgttgaacag

SEQ ID NO: 11498 - DNA, 1500 bp, Zea mays
tatgtaaatatagtggcacaaccctttattttagataaacatggttgtttcatacccaactaaaggatttagtcagttgtttatcttttgcatatctatggtacttattctatatatatatattgattgcttagacatatatagtattttttacattttatattaggatttcctatgcgcgcgaagcgcgcgctagatattagtaaccttacaaccttactagttacctagcacactgcacacaattcagtagacaacactcaggcctcaacgatcccctacggcctgtggttcggcagcagccagcaactctagactccagtcctccacgcatcgtccagtcgtccgaccggtggggatggactgagcggcggcgctgagatctcatacgtacttcaagaagggagtgactcgtacacaacacgccgcttaaaggaattcgtatagcatatctgcatatgtatgttcgtatacataggcatacagttagatgtaaaagcttaattaattcgtatatacagttaatatagtaaaatagcattagtaagtttcctcaacttgttatataattcattaccatagggatttgctactcatcaactaaacatagggtgaagtaaatacaaaaaacaaacataggatggagtcactatggtatgtgtaaccaaacacatgattttttgctttactctaaaccaaacaaaaaatagagcaactctattttaactaccaaacacaaaaaaccgttctatccttataatttagaacagagtcgtttcattcaactagactctggaaccaaatgatacctaagatagtgagacacagtaccctagtgagatagccggcgactggacttgggcgcatgaggtaytgactgcggactacaaaagactgaaggagggatagttgagctggacacagtcccctattgttagtgggccacgaccggggctgcaacccaggcagctctggacgcacatctgcctatgcttgcggcaatgcgcgcgataccaactattattatttgctactcaagatactatatatagagagaatatatatttagatgagatataaattaactaatctaaaaatagaggtggaatttttttaaaaaaataactagaagtgggaggattattttaaaatatgatatttcaaaaaataataatttcaccattatttttgtattagtttgtatgatttgcatcaataaattagtttacctgatatactcattgtttaaatatacctgacaaaaaccatatacctataaaaaatgtcgagaagacgatgcttgagttaggcgagatatttgcaatgtcagcatgattttcctgggacccacttcttcaatttgatgagagagcttaacgacattccgcccccacctcctccacctcatcagtcgagcctccgtgcacgacgcattcgccttgatctccgatccctaccttcattaggagagagaggagaggagaggagaggggcagggag

SEQ ID NO: 11499 - DNA, 230 bp, Zea mays
tgtaatccttgggaaaggactctacttctagcataaacgaagaactgaggctactgttatcacagatctcagcttccagggggcttgaggcaccatgggccgatccaggccctagcccacgtgcatatggacgtggtgatgagttggtggtgcagaacattaccaatagattatcacttgagaggaatgcttccggtttggagtctctagacggaagcattgttagtgag

SEQ ID NO: 11500 - DNA, 257 bp, Zea mays
ggtaaatcttccggagcaaggagcatggagcggccgggcgggaaaacatttcgcggctggctgcggttccccgaaatttctccctcccttttacgctccgcttcccccaaacgactccctattaatcccccacgttccccttccctttctctcccgccgccgcacgcccctctcaaacctccgcgctcccgcccagctagggtttccccgatctcccctccttctcaaccgccgccgtcgccgagagcgccgccacg

SEQ ID NO: 11501 - DNA, 897 bp, Zea mays
atatcttaatatctatttatataatatataaaaaatgtagtaaagcacgagcattgtctagtataacataacaatagtttgatttaaggcaacttaattaaagactgtaaaatgacgtgctccactttctatgacgaagatgttaagtagagtatcttgcacttgcatatactgtacctagtcttggagtggcgctgttgtaggctgccattgtaaacagaaacagtaaactctgcctagtttaggatggtacgagcactgttccgtgtgacaggttgcactgtttggtctttggtgttgcggtgggaggctgaactgtacacgccacgccattaaaggcgggcataaatgtagcagcagcgtagcgtcgagcgaaccgtcccgtcgccaatcataaatgcacccgccgtttgcgatgcgacggacgacgacgcggccggaggcgaggcccgcgaccgaggcgaagcgcaggaccgccggcagtcgatcgaaaggcgctctcaaaagctctgcgctgcgctggcagctttgagctttctcgggccggagaaaagccgaaacaaacaaacggactggccgagtcgaggagagagagagggtgagagggagaagagaaggcggagagagaaagcgagctgaggagcgcaggcgctgtcgctggcgaggacatgctcgcggcagcgcggtatgggctcaaaccataggcgtgtcaggaacggtggagagcggcgaccactactcgtcttcgtctcggtcctcgcgcgctcctgggctgcctcttggtgctagaaaccctcgcgtcgcgggtgcttggttgcgactgcaagcgccaagctgctgtgctgtgccgtgggtggcggcggcgggagtggaagtggaaccgcagccggtgctgtg

SEQ ID NO: 11502 - DNA, 926 bp, Zea mays
tgtacattttatctctgacacttatacagttattttgcaatttggacattgtcctgtcctactagaagagcagaagccactgtttctgattttaactgcatgcctattttgtttgcatctattggtttttgttttcataggtatgcagaaatccatatttatattgttgtagtataagtgaattatccacctctgccattagcttaagctttttgggttgaactggtctcaaagtcagaggtcttgagttcgaatcttggttagctcttttgagggggcatttggcatggatctgctccaccctagacttctagagaagctatgctccagagtctaggtgttttctcataaccagtggtattgacaggtaaataccttcaaactccatgtcgaggttgctgtttaaggacttaagggcagaaaggaggtactccaaaaatttatactgcagtgctcttctccatggagtttgcaactctggagttggggtgtttggctaggtctggccagctcctgagttttgttctagagcaatgccaaacactccttgaataaaataaaataatttctgctcgctcctatttcacgcctagggcttggggggagcctccacgtgagggagtgttggaatacaattggattgctcatgtcttttcatcaacttaatcttttgtattgaactggtcggtgcatgcaactcaatgcatataaatatcttttaagtgtttcatcagggcgagaaagcatgtctgttagcatataagcatgaaaatgtgttctgtttacatgttgaggttgcttctaatgtttacctttgaaatacttgtttggcatcttatttgtataaactgtgtgctttgtgatgataaatgcttttgagtagtgtttgactaaccatttatgtggcttgcagaaattttttcttg

SEQ ID NO: 11503 - DNA, 826 bp, Zea mays
ctgcagggccgccgacgacggacggagcgtgaatttctgtgcggcacacacggccgtggtagctgaccggacgacgacgagaccggtcgaccgcatgtagtgcaggtgggcgtgcctgatgagggagacgctgactctgactggctgctgctgggtgtgcaagcataccatactctactagtacaccacaccaggcttgccgcccgcccgcccgcggccacgcgacccaactaaccccggcgcggcgttcgttccagtgggcgggtctcgatccccggcacgtccgccccgcgcgtcgtcgccgcccacgtggcggcccatccgcccgtccaactgacctaacccggtcgccagcccgcgcgcttatataaacgcccccaccgggcttccgtcctctcccacaccacagctcccacacacagcaggcagcagctcgatcgctagctcctccgaaccggaaagccaagcccgctttggcgatcgtgcttgcttgcttggttccttcaattcctgccggagccagcgagagctagctgctgctgtcgcgtggtagacgtcgtcttgccagcgagagcctagctcgatcggtctctctggtacaacgtagggagaaagatcgagggggagaggacgacgacgatggccggcgcgaccgtgaccgtggaggaggtgaggaaggcccagcgcgccaccggccccgccaccgtgctggcgatcgggaccgcccacgcccgccaactgcgtgtaccaggccgactacccggactactacttccggatcaccaagagcgagcacctcaccgacctcaaggagaaattcaagagg

SEQ ID NO: 11504 - DNA, 420 bp, Zea mays
ggtagacatatatctatagtgaactttagttctactgtattttatcggggaatcaatttagatgttgataaggatgaagatgtttgctcaatacttttatatatctatttgatgttctcagttctcaccgtattatcatgtctctagtgttgcctttctatcaatatgttttgtagcttggcagcttgcaaaacacagatgaactgtgagaattaggtaaataccaccttcaagctccagattgatcaaaatccgcgtttgtctcatgttttggttacacatttattgatgctgtggatcctacaattatctgatataatgaaggattaaaaactctcaacgatagtttatttgttacctgtgagcctatgactatggttttctttaatttttaattgcatgtggacttctttcccagct

SEQ ID NO: 11505 - DNA, 507 bp, Zea mays
cgatgttttttcagtatgcttttttatgttccatgctgtaaaaaacgaattatcgactggactttagtaaaaatcaacagatcgcaggaacatctcggccggccggagtgtcggagatggtggtgatgacgacctgggagctgccgaccacgctctgtacctgtggagggtacgcagatctgaaacggcggcgaccagtacttaccaaccaccgtgccgccacccgggatggacggcgcagcgcatgttgtactcgtggcccggacgacgcgaaaagacggcgaggaccctaacccatgatgggctaccccaccccaccaaagcagccgttgcacgagaaaaggacgcacgcacctaccctaccccccggtcacccaaaatgcctagtaaataaacacaccactgaccaacttgcctacttctagtgccacccaccaacttccccttccccgtcgcatcgcatcgagagcggggctgtaccgtgcgagactctactgctcgatcgcc

SEQ ID NO: 11506 - DNA, 704 bp, Zea mays
gctcaacagcagccaacagaggtaatacatgacagtgaaacagtagaaactagctttatatagtacataataatgaccagagaacatgttaggagtgttaactcaatctgtcaaacacaagctgaactttttaaagggataacacaagttaaattgaggtaacagtccaggaaagcttgacagacgtttgtttagcttaacgttttaagactgtatttwaccgatcgttcatatgaccataaaaaatataaaatactgttttgacactatttatattaaaaatttaaaataaagaatgtaatagaagatatgatctcacgcgcacgcgctcaaccaaagcaagacccgtggagcgcaagcgcctgtgtacagcgggctaaagtccagtacagcgacccggaacaacggggcagcactcacccggcccggctatgagcccaatacgggcccactttgtacagcgaagcgagcaaaccccttcttctcgcctttctgtcgcgcttcttctcgatcttgttcgcggagaggggtgacgtgattgacgattttgactcgaatcatggtgtgcatctctaccagatagagagctgacctgaggtggagacgcggatcgtggctcctggggtggaggtacaagcgtacagctcaataggagatcaagagtaaagagtgtggggaggggaaggacgcgatatcgggggagg

SEQ ID NO: 11507 - DNA, 1500 bp, Zea mays
catatattgacttgcgctattattcttaagttcaatatatattccaaaggaacaatcaagtgaagagttctctccctctctattcataacaccttggttttgatctcactaatatttattataaatcaagtatgtgttgtttagacttgatttttatagatcacctatttaccatttatgctctcaattagctattagttagctaactatttattagctaactaattctattagtatatttctagcttagctctgatatatttaaacacccactaaaactaattatattttgtgatatagggaagagtagagagatcaaagaaatccaccggatcggcccgatcccgaccactcgttcctcgccaactcctctttattcggttgatgagactcatattttgccctcccctcccgtgccacggcctcgccccttcgtaccgcacccataagctaggttttagccgcagctttctcctttttcgccgcggcggccgcaagctccaaccttctccccgaagaagccccaagcaagcgacactcttgtcctctccgcgccagatcgttgtttatgaggtacggatcagctctggatcttcgattctgcttctcgtagcgccgtgcctagcggatctatagagcccgtcgcggcagttcgatcgatggggaactggatttttgtttgatgggaccttcggtggtggattttgttgctagaagttagggttttgagtggattcagtgcgagactgcgagggtcggttgggtggggtccatggtgatggttcatggagcttargtgatggttttaggttgtcggaagttagggttttgagtggatttggtgcgagggtcggttcgatggggttcatggtgatggttcctgtagcttacgtggtgaatttgggttgtcggaagttagggttttgagcggattcggcgttacggtcgttggatcgagctggtggtattgcagcttgctaggttcgcgatgatttgagcttttgttttgggtagattacggtggcttgatgtaggttttttgagaccctgggttaacaaactgttttgccagtagtgttggttcctcgatgccttgcaataagatctctcgaagctcatttccttttgctgacagtttgttgttttttacatcgatccgatgaagtgcatgatcttctaattttgcatggtttactggtctgctaataaaatgcaattcaatcttgaagaattggttaaaaagtggatgccattgaatatcattcaatttcttccaaaggatttggaatgttgagttgagagtatcatgtggcagtttgatgttacagattttcttcagtgtggtacaggaaaataaaaaagtttgttaaaacgcgatttgtaatgaactcatttgttagtcttataagtcgacaaacgaactgaattagttttgataacagtagcatatagttgtcattatttattagtaaaccgagttttctttttaggaggctgtcc

SEQ ID NO: 11508 - DNA, 1219 bp, Zea mays
tggtataaatgaacaaggcctaagttggattgaacgagggactaaatggttaaatctggactctatcgcttgcaacggagaaatgagttgaggcttgaaccgtcactcacctctacgtaggtcctgtatatgtacgtctgggtcggcccgctccgatatggcccagacacattaaagcatggtccactaaaatacaacctcaattatgtgttgtaatgaaacaaatcatatgaaataaaacataaacaaaagtacggaacatatatgaccaaaaaaactgagccttttgtggttgtcccattaaaaactttcggtcataaaaaaatataactagctcaaaaatatttaatattcagtgatttttgatgaatcctagttaaataggtcgtgtcaggccagaccagaccgtgtgcttagttgaagtccaaacaccactcacatattatgctataccggcttaggcccacgattaatctactctgtgccagtcttagattgtgcctccaatttcgtggccgtgtcagtcttagatcgtgcctccaatttcgtgatttgtcccaggctcccagcccgtttggcacagtccaaatgtactgcgctctacaacacctaacacacaaaacactcacacggtatcacacagcaccgcacatccgcagcaagagacgaacttttttacatcatgcaagaggcgaatacattactggccttaagctggatcgggatgttggatcatgccatagctagtaaaggaacaaaaattcagctgcgggcgcaattcaaccataatgtgcaaaaagaagcctataatatagctgagtcataacaggttaatcgaattgtaataccgactatactaaaagcgcaccgagcaggtgccgtgcgaatttgtgatgagcttttttgtacatcgaactgagacggcacaacctcctccatccaatgctttgccttcacgacttccgcaagaggagcagctcgattcacaggctgctcccatgggcagcgaagaaaagcccgtctatttgaggtattgtgttttagtagcagtaaggtttcgtatctatacttgtgggtcctgaaaccgatcttgaatcagggcaggcctggttttccatgttcctcatctgtggcattgtctggcactgttgtttcctcggtgagctctgaaagcacctcgcctggctgcggcggtgcagggttgatagggccctgggga

SEQ ID NO: 11509 - DNA, 58 bp, Zea mays
ggtgattttactgcatttcgtccatattaaaactaggtgatgatgtctgtgtgctcag

SEQ ID NO: 11510 - DNA, 106 bp, Zea mays
gaccgaagccgccttctccacagacgacacaaaggacccctcggccgaagccactttggtgggcgggaagttttattccgatgtctgggtgaacggtgaccgagaa

SEQ ID NO: 11511 - DNA, 308 bp, Zea mays
gaagttggagtattgtattatcctttttaatcctacattaacgggagaacacgagtggacagtgggctctgaattaaacacaagccctaaagctagcaagtggcaagtagcaagtagcaactctacttaatttcaacctgtcagcaggagcagctgttcatgcggatggcgcccctcgccttcccctgctacaatgcgaagaccaatatcgatccaaatggctcctcacatacacaagtcagtcaggtcacgtatgtgcactgtgtacatggcagtagcacccaaggtgcaagcaagccaagaacaaa

SEQ ID NO: 11512 - DNA, 560 bp, Zea mays
actcatacatggtttatccaacggggaaggttattatctattaacatcccggggcacgcgagtatataaattatatcatacccgcctatatacgtaaaacacgttagttacttgggtttaaaatacccatgctccacttctaacggggtaagggtaaacatgtaacttcacgattaactcacaacgaaggcaacgactaggctcggaattaatccccacccgttttcccttccaaactccaaagacacgattgtagttggattaattcccaccccacaaccccccaccacaagaacttgttcgatcgaattcttcttcaactacccgccgcgggaacccaaggaaggaggcaaagcaaaggcttctcgcaggttcgcatcctccggaaccatccactcctctcatcccgctcggagtttgacctctcccgacctgagatccgattgaatcggtactctgctcttggtttatttcctctccttggtgaattcgcgcgctgattcctgctgcggtggattacgtcctagggtttcccgtcagcggcttctgcggcgggcgcc

SEQ ID NO: 11513 - DNA, 376 bp, Zea mays
cccacttgcggtagtgcagaacaaattctgtcttcttcttcttctttttccatgcctaaaaagaacggtgtcaaattggaagtcgtaacccgacaagccgaacttggaaaacaactcgaattggattctagtactcccttattttttttggttcattggacaaatgctgggacggcacaaaagcaagcatacgattcttgtcaaggcagaccttcactttattccgcaataattatcactgcagggaagccgcctttggactgggcgaccaggaggaggatagctcttggcgcagggagggggctgctgtacctgcacgagcagtgtgaccccaagatcatacacagggacgtcaaagcagccaacgtcctgctag

SEQ ID NO: 11514 - DNA, 369 bp, Zea mays
cgcttgcaacgcaagcaagccattgtgcgactgatcacgccgaagtcatgcagcctcctcagctcgctcgtccacgtgacgtcgtcgtcgtcccccataacactctagttaatttgagcaaacacgtactcaaccgtcgtaccaccagcatgttgctctctctcgccgtccagaccagaccacgcgtactacgcggcgtacgcaaccggcctcgtatcgtatagagctaggcacctccacgccatgccattcgagcagagcagcatcgtcacccagagccaagcagctagctagtagcggccggcagcatcgcgtagtagagtgtgctagctcagagcagcgcgcagcttccaccctgcgcgcgcatat

SEQ ID NO: 11515 - DNA, 202 bp, Zea mays
tctcttcgggcgattagtgcctttcttgaagagaacgactctgatacctattgagagcacctagagggggggtgaataggtgatcctgtaaaaacttgaaacttaatgccacaaaacttgattaggcgttagcacaataaagccaagtggctagagaggagttcttgcaaaacacaataaccacaaggagatcaacacaaag

SEQ ID NO: 11516 - DNA, 1210 bp, Zea mays
gagacaaatgtattgtgtctaagtgctagaaacaggaaaagaccaatttggaaaagacttggctatgcagccaagactctgcgcagtctgggtgcaccggacagtgtccggtgcgccaggctggcgactgtcaactggctgctctcgggaagcgatcaacggcgtaccgttataaatcaccggactgtccggtggtgcaccggactatccggtgagccattcacaagcgaagtcgtcgctctcgggaagcgattaacggcgtacggctataaatcaccggactgtccggtggtgccggtccaacggtcggccaagtaatccgcgcgcgacgcgtggccgagccaacagtcaaaagggggcaccggactgtctagtgtgcaccggacagtgcccggtgcgccaacggctctggatcttcaacggtcggctgcgccacagaaggaaagaaatccgcaccggacagtgtacggtggtgcaccggactgtccggtgcgctagacgacagaaggcaagaattgccttcctggaatgctctcaacggctcctagctaccttggggctataaaaggggcccctaagcgcatggargagcacactaagtattctctaagcattcctaagcaccaagacttcaattccgcacattcgattctttgtgatagcaattagagctccatttgagtagagaactctttgagttgtgttgagagctcgtgttgtggcttgtgtgcgtgtgttgctctgattttgtgtcttgtgtgcgttgctcatcccatccttacttccgtgcttctttgtgataatcaaagtgtaagggcgagaggctccaagttgtggagattcctcgcaagtgggatatagtaaagtgaaagcaaaacaccgtggtattcaagtgggtctttagaccgcttgaaaggggttgagtgcaaccctcgttcgttgggacgccacaacgtggagtaggcaagtgttggacttggccgaaccacgggataaaccactgtgccatctttgtgttgatctccttgtggttattgtgttttgcaagaactcctctctagccacttggctttattgtgctaacgcctaatcaagttttgtggcattaagtttcaagtttttacaggatcacctattcaccccccctctaggtgctctcaataggtatcagagtcgttctcttcaagaaaggcactaatcgcccgaagag

SEQ ID NO: 11517 - DNA, 363 bp, Zea mays
agtaaggtgaataaacaaactcgagaaaccgaccccaccctgtccttacctcctcttctcttctcatctccaccactttccctctgcgcctcggcccccacgaaatctggagaccaggacgccattgctcaccttttccgtccagcgcaaggaaaccgcgcgccagagagggtgagggattgccgtcaccaattcggaaggtatctcctcgccgcgccgtctcttcgtcgggacgcgccatctcctcactttttttttttcttcaggggggctccattacatccaggtcgcgtgaccgctctgatctggattcgtcttgcagccgcttcaggcgcgcgtggaatcgccccgtggccggcgggg

SEQ ID NO: 11518 - DNA, 1500 bp, Zea mays
gggaagayaagggtgagggtgaggctccttctcttctcgccttgccctgaattgctgtcatttttggttcatttgcgcttgcttcggtggtgatttgtcgccgacgcgtccggattctgtgtcggtgcgtttcttacggtgtctgtgatatggctgcgactttttcccttcctgttttgagttacgttttccggttgcataatctgtaaccctttatccactctattttctccattttgtcttctacgtggtatatcagatcagctgtttgctactaacatttacaggaaaattgtgattatttaaaggttcgtccgttcgtgtatatatgacgctaagtttagttgctgaggatacgaagcctgctggatgaatgagtaagggctttgtgaacaaacatatggtgagtggttgggttctgaaaaataaaaacaagtggcactacgagggaacaaccggtattgtagaagctgtagtcggtttactgaaatgctactgcacttgataattgtaactcctccggattcataatattcctacagtggtatttgggcaatcatttccgtgttagccgcaagtattgctgtcaggacacagtaccaagtttctgctagttcctcttcatttgaattttgaaacctctacactttagttttcatgccttatttattttcgggctacttagggaaccaatcttgcctcagcattgatattgtaaacataatttctccttgatagcaccttataactgcttcataccgtcatacgttcatggaattgaataattaacaatgatgttgatttctgttctgtaacatggccatgtatcataagtcggtcatagtgaaattcacactttagtattcaatgcccagcctgaaaggaaaaaaaaagaagataatgtactgttaaggagatgaaaatatacagcaggtcaccttgtgcttttatattatttgcactgaactgtatatactggtgatgctatcactgcatgcctagttttgtaaagattgtattagctaaatagacatatggacatttcagtggcccaactaatgtgtgtgtgatatatcctttttgtttcattgctattgactttgtgtaactattttctacttctactagaaagcaacatatatttatttaaaattttaattctgacgctggcttaaaaaaactcgacttgcggggtaagacaacccccagacattgtattaagaagacctttttcacacaggtcgtgaatcccacgaacccctgctgatgctgactttacaccaaattattctttaggataatagctatagacaggatacaataaggtcaaccaaaaggttctttccaatgagatacacaaggagaaactacttggtgcttgtaatgatgttacatatcccactgactaaagtcggaaactactgtgcctgtccaatttcacacgtatatcacaggaaatacttaaattttgaccttttctgtttgatgacttccagaatt

SEQ ID NO: 11519 - DNA, 693 bp, Zea mays
ggtaatttcacgactttgatgtatcaaatattaggattatctgtaccagttcaacacagaatccaggtattgcatatggatcatttttctccactgctaattgtcatccaactgacaataaacgatcgccggaaaataatactgccatttgtagtgttactcccttgcaacttgcaagcgcatcggaatgatgtggttctggtcactgtttaaatttcacccacgtgagcactgtatgccctttccccttcactcacctggcaaacccctcttctatggaaggatccttgtgctaaaagacataagttttttggatcttgatagtgactagaagtttgggactgaacctgctctgccgtttaatctattggctgctagagcagccacaataagtctatcagcatttggaccatttggttttggcttcttcaatggcaagggcaaaaggcagaacaagaaacccaacaatctagatcagtcccaccagaagcctatattgcattgtacttggccttgaaaatagttatattatattttacttgaatttatgtttatctttttttatctgtttggacagatctctattaaatgtcatgtgctactatcgttaggactattaatagatgttgctctgtctatctatccatttacatcgctggaaattcccatgccctttcatagtacgcctatgaa

SEQ ID NO: 11520 - DNA, 1500 bp, Zea mays
tcaacaagtgaatttgacttagagataggaaattgagtttgatttgcaaaaacaaaccaagtggtggcaaagaatgatccaaatatgccaaatttgaatcaaaacaaatttgtgttcttatttgcattgatgttgcacttcttttagttgctttttgttgtgttggcataaatcaccaaaaagggggagattgaaagggaaatgtgcccttgggccatttctataagattttggtgattaagtgcccaacacacattaagggaatgagtatatgccaaagggtggacaaagtgcaaatcaatacaaaggtatgattctagacttagtacattggtttttgtgtactaacatatttgtctaagtgctagaatcagagaaaatacaattggaaaagacttggctctagcagccaagtcttcgctcagtctaggtgcaccggactgtccggtggtgcactggacagtgtccggtgcgccaggttggctctgcgtgaaaggccgctctcgggaattcgtcggcgacgtacggctaaaattcaccgaactgtccggtgtgcaccggattgtccggtgagccaacggtcggccgagacaacggtcggccgctcaatccgcgcgtgacgcgtggccgggccaacggtctgaaggggacactggactgtccggtgtgcaccggacagtgtccagtgcgccaacggctccaaattgccaacggtcggctgcgccaaaacaggaaagaaatccgcaccgaacagtgtccggtggtgcaccggactgtccggtgcgccagtcgacagaaggcaagatttgccttcctggaatgctctcaacggctcctagctgccttggggctataaaagggacccctaggcgcatggaggagtacaccaagcattctctaagcattcctaagcaccaagactccaattccgcgcatttgattctttgtgatagcaactagagctccatttgagtagagaactcttcgggttgtgttgtgagctcgagttgtaacttgtgtgcgtgtttgtgctctgattttgtgtcttgtgtgcgttgctcatcccatccttacctccatgcttctttgtgaacatcaaattgtaagggcgagaggctccaagttgtggagattcctcgcaagcgggatatagtgaaacaaagcaaaacaccgtggtattcaagtgggtctttggaccgcttgagaggggttgagtgcaaccctcgtccgttgggacgccacaacgtggagtaggcaagtgttggacttggccgaaccacgggataaaccactgtgcctctctgtgttgatctccttgtggttactttgttttgcaagaactcctctctagccacttggctttattgtgctaactcctaatcaagttttgtggcattaagtttcaagttttttacaggatcacctattcacccccctctaggtgctctcaattggtatcggagtcgttctcttcaaagaagggactaatcgcccgaaggg

SEQ ID NO: 11521 - DNA, 1500 bp, Zea mays
atctaactttttgtactttcctttaaatcagggtccttctttggtaccagtccccaacaaacaaactagttagtgtcttatatgtcatctaacaaaaaaataacaggcctgccccctcccctgctaatataaggctatatttagcggtctccataccccaccccctattccactccatgttttaaacgccactatgtaaaccgtgtagtctacagtgtaaaacagtgttttgtacgattatgtgcatgctctgctgatctaaggatgacaaattttttgtaaggggcaggtccccgcggagacccgacccaaaggggcggtggtgagtctaaaatttcatccgcgggaatagcagggtggagacccaaaactcaagggacaggggcgaaaattttccgtggaggtctaatggggacccgaattaggagtcatgccatccctgtgaccccatataaagatgcaaattcctcactcgctaacccttatttccttcactcagttatcactcgctcacgtggcaatcctggtttatatgtgtatattgtaatatttgtattcaataattgatcgtgcacgggttctcgtgggtatcgggctcccaacagggatagggatgaaatcctctctattacgggattgttgagttgggagtggagtgaaggaaattgaattccactcaattcttttcgattttgtgcaaccgaacaaaggctaagtgcttcggagctgagatgggaaataagtttcgaggatgagagccgggatggggacagagacggagacgacgagcacttccccagccccaacgcaccccgtcgccatctctaggctaatagttatcccgtacatgagaattgagatccaacaagaccagcgatgcatgtacctgtagtttaggtcaacttgcgttgccgaaagcataaaaaggggcattttcaggcgacattcaagtcgtggtccaattgaaaaacccacagaagatgaaattttcaggtgggagtcccaactaaccttcgtcaaggtccatgactccatgcgtccacattgttgctttggagtcacgacattatatcgtccagaactccagatgcactattgacagatgtgacgaatttctagtgtgccacttgttgtcagagtacaattagatttccgatcaatcacgacaccgtgagcgatcacgccgttgtatattaattggaagatgaatcaaggcaggtcgaggaggaaggcaatgaaacgcaaccgccgtgtattcatacctgcagtccttgcagtcttgcgcacgccgttgaatattgcatgatgagtcatggcaggtcgctctcatggcgaccctttcttgcggttctcgatttcttccagcctcagtgtgtaataaataaaattagatttcctggctatcacaagagtaggtttcctggcttgacttggcgctagatcaatggagcatttcatttgttagtgtccctgtgagtgacgtggaaactgtgcatcgcc

SEQ ID NO: 11522 - DNA, 990 bp, Zea mays
attgagggggcgtgtaaagcaaagcgcctgtaacagataacacagagttagtatatcaatcgtatctcatatagtcgattgtattagagtttatctcgtgtaaccaactctgcgtgattatctgaaacagactcatgattatccaaatgtaaaccacggcaatggttgttattgcccatatataaacatgcagcacaccggccaagggcatcacggtgttttccaatctcttccagcgcctctgatattctttagtgtatatatgtaaaatagtactctcttcgtttatttgtcttggtttggtttwaaaataaactagtggacaacaaatatttgagaactgaggtattatatccgatatccattcgtttttttatttgtcgtagtttagtttaaaaataaactagtggactacaaatattcgagaactgagatagtatatcctatatcgcatagggaacactcaatccctatccacttactgcatagggaacatgctcgatctctatccactttctgtacaacggatgattggcgaccatctgtgtggtacagacgcagaggcacatgagttggtggccggtcgccagcaatgcacaagccccgcacagtgacacttcgtttggcagtgcagaaatgaacagaatgattatgatcacagtgacacttcgtttggcagctagcaatgaacgtatcgtattatttatagtttacatcgtactcatcgcactttggcttgaccgacgaaaaaaacgaattaatatttgtggtcataaaattcatgagatcctgttgatgacgtcgaacacaaatgagcagctgattcatgtgtaataatagcgctgtaggatcggaggagcatgtgcaaaaaacatggcaaacttttctataagattgcaaaactgtgttgtgcttgtatgtgctgagctttggattgggtacttctcttctctccaccatagctgaagcctcggattgcaggttgcagcc

SEQ ID NO: 11523 - DNA, 1256 bp, Zea mays
cttgcatgcctgcagaggttagctggagcctggagcacgctagctaccggcgcgacaacaacagccagcacccagcaggctgtgggcgtgtggccaaagccctcctgcactgcactgcactgcacggaagctgcctgcctgcctcggcgcctccggaagcgccaagggggcaaaatcgcggaaggcaacggcgtacgggacggagaaaaatccaggcaggtatttccgcggctgtggctcactcactcgggtcggggtcagcgggcgctacgacgggtcgcgtcgcgtatcgctcgtatttgattactgccacgggctatcttttccatcatccactccttcccatctaaaaactataagctatccatccctcgcaaagacagcagccggaacaactcatctaataagctatttggtttgaggaatgatctagtccatcgtcttctcactactcacttttttgtttggtttgtggaatggattaagttgatccatcatccccttattcttatagttatttagttagtactaatatgaggaataaggctatcccactaaatttgaggaatggacccatgatgcaccaccatattttagatgaagtgattcctcaaaccaaacaccccctaaggccttgttcggttaatcccgttacctatgaattgaatgagattggaaaaaattcttaagaactttgaattgtttgggattcaaacccatccaatcccactcaatccacatggattgagagctaaccgaacaagcccttagtgggtttcagagattttatcttcagacctataaattataggtgcagatatatagactaaaaaacatagacatagatggtattatagcaagaaggaacaaattcagtgctaattatttcgaatacggtactgcacatccggactgtcctgtcccagcctctcccaggttgcatgctcatctacaccgtcgagcgtcgaggcggctagctctagccgatcagcgagcatcgcgggcggcgggctatatacgtccagactgcttttatttgagaatgcgtagtttggcttcctaatycatctgactaaactatgaaagtaataataaacgtaccgtygcgaggccattctggtaatccaacatttctcgctcagccgcctataaattgggccgcgcgcaccgcctcgctctccactcaaacaaactcaagcctgccctgtcctgccttgttaagcaacacagcgagacatcacgagagctagagagag

SEQ ID NO: 11524 - DNA, 1500 bp, Zea mays
gtagctaccagccacattgctacacgtcgagcccatgcacctttgggagccacaatctaggagaactgccacgtagcaaacaggcggaaggtcaagcttgatagtttggccacggtgatgggtgtatcttctaaactggaagcccttcgtgctcaagatttagacttggtccgttaggctgaaattcttcagcagcagttgatgtcaagtctagggaagagaggcttgccaaagtttccaaaaaatcagaaaactcttgctgtagactttgtcttgctggttaaggaaattgacactgagcgagtaggttgtaggtgcaacaatgtggatgactatgccaaaatcaatcaattattcgcctttcaagagccttcaagcattgttaaataaagtttgtaaccttccttgatgaaaattgatctgtctgtaggccttttttttgtattagacgtaccccggacatattctcttttgtaatagccctgtcctcggtcaagtcgaattgtttctagcactaagatgatggttgggcatcggaaactcacaattgcttttatttatttttatttttatctaaaggcaatggtggtacattggcttttttggccggagtgtgagctggcctttttatctttttttgtggtgyggatagggatggtaatggaccactatccattcttcacaaaatattagggtactaaataaattttagttcaactttgagctccactttgagcaccccattctccatagaggcgctgccattgaagtcatttagagtgatgttagtcctgatcagatcttgctctgttctttcgatcttgtggcataccgagtacggcatcacgttcaccgtggctccagtatctaccaacgtcctaccaattggtttgccattttagaaccctttgatgtagagcaacttcagatgtctatgctttttctggtggttaggccattgtcaattggagttttatgagagatgtctagacattaattagtgtgccacatatgatttttgatgagatgaaactacacttattatgaaataagtgagactagtttcatcaccataaaactatgttgacccattttcaatgttttggaaagcgtgtgaaaccactattgagggcaatttattttatctccatctatttatattagttatttagatgcaacatttaaatcacatgttagcagttcattgagagagcatatttcattcttcattttatcttactcttattgacatgacaacattagaaattgtgataaaactacaatggccttaggtggatccaatggcatggacacattgatggccttaggtagcgatagtctgacagtatcaaggaaatataagtagctttgtgctgatggatctagcagagtaggcacctgtcgcttggacgtgcttcggagaagtaggtgtccaaaagttgcttacagtggatccagatccttcgaacaacattgctcaagctcatgatatagactgtc

SEQ ID NO: 11525 - DNA, 569 bp, Zea mays
ttgcatgcctgcagcagattgagaagctccatccccttccatttacatgggacccataggtcagtgtcacctctctcctttcctctccctccgtcgtggctagagatgacaatggggacccgattccccgcgggaaattgctccatggggatagggatagagaaatttcttccccgcggggatgtaaacgggaaaactcttcccctgacgggtaaacggggatagggacggggaagcaatccccatccccgttccccacggggacccattaaacttgcacaggacgatgttttcgtgtactagttaatgataaaaataaacaattaccttgtcaagagatcactcgttgcacaaatgtgttcattttggtgcacacatagggcatttttttaacctcattcccctatatgacaggttatagggaagggcggggcatttgttcaatctgacgtagatgctctaatacaacttttgtgtgtgtgtgtgtgggggggatcatgctggtgaaggatgctgacttttaatttttgaaatgcagaacgtttgtttcgttctaatatgttcatgtt

SEQ ID NO: 11526 - DNA, 1278 bp, Zea mays
cagctagcctggcataacacgtcgtactcatatgacgtcgtccactgttcatcgtcgttctttttatctcgatccagatcgaggcaagagaaaaaaatactagcaagaacaacggcaccgcacgacacgtacagggtgcaactgcatgcaccttcgtggagatgatgattagaggcagggctggaggacgacgaatcgaagacttggcaatggcgcatctgggcccactagctaggcggggcatgggcatcgatcgccagcgcgcgccgcgcgcgcgacacaaaaacaaacatacatacagacagggtttggatggtggacgaccccctctccctccgctggggcctcggccctggtcactgggcctcgatctatcgtagcctacaagattacaacggtcaggcattagtgcatcacgtatcttctcactccagtcttggacccttcacctacgtaccctctcacgtcccaacaacgcaaatcaaaattcaaaagcgagcgatctaacgtcccgtttggatcattagaattgagttacattctaataatagtaatttagacatctattaataaagctaattcggttttatataaaatatatttgtatattattgttagaaagatgtcggagatatttatatgctacatttttactatagaagagtgagacaaagagtgtcatgtaagttacagagtataaacaaattctactaatgcataaaatcatttccccacccctccacccatgaatttaagatatgcttatatctgaagttagaaagtggtggaatgttaaattccaaactaaataagtaactttattaagtgaatttcaattcttctaaaatgaagggatccaaacgcccccgtaagatctaagttgtaaaatagtgttttgcacgaccatatatatatatatatatatatatatatgatctaaacacgactatatgcatgatctagtagatacaatttaatatggtgttacgctgcggttaaggtttgtttcttttctcccatgtgaaatggagtggatttagtgagattgaagtggccaatagtttattttcaccgctaattcgtatgtattttaagatggtatggattttgtccaaagccccggcctgtctaataccgacagtgtccctttggccctgtctcgcgtctatatatgacaacccgtcggctctaaaactaatcgctgagatttatcttgatcggctagagaagatcgagtgagaagttgcgcgtgtgaagccatcacaccaaagatcatcc

SEQ ID NO: 11527 - DNA, 1500 bp, Zea mays
cttatcacattttagactttattcaatttttagcaacttcaattttcaaaagcttcttttaactaatgcaatagtcacaggcacaatcatagggcgcacgtcacaaactcgtttgaagcgatcagctaatagatggcgccacacgttaggtgctaggctacggaagaggagacacatgaatatatgtgttgtatggccaagcactctaaaccagttatttgtcacaaggatcacgtgctagttggaatttaataataaatatgtatagtaatacgctaccgacctggcctactggaggtgggaccccatagaaccgggggctcgaggcgaccgcaccgcttgcctccttcacggaccggccttgctcacacggtcgttagctgcccttcagttgtaccccactacacctcaaacatctaccatcgttttattgataaacttaattattttttgctttatatacataaacaagtttatttttattttactttatagataaataaaatttgctattaaattagagttgtatgagacatgtgttttatatagagatggcaatagggccttgatctttgattctccgcggtgaatggagaagtttctggtgaggacatagaagcatttctcattccctttcccagcaaggactcgttaaacttatatgtgacgatgttttcgtataatagttaatgataaaataaataattaccttgtaactaaacaatcattgcacaaatatgtttattttgatgtacacataataatttcttacatcttacaatgtgtataagtgaatgttttacattaataacaaatgatgtatgtcttaattataatttaagtgggataaattttcgatgaggaacaagaatgagaaagaaatataccctgtaaacgttagtggggatccaccgagattttttttgtagtgggaacgaaaatgaggagctattcgcataagtgaaattcttggttattatcttagctttatatcctagtctccttaaaccatatatttaattgatttttatttttataaattcattttttaattaaaattatagaaaacttacyataactacttctaatgtcctccatgatttattaaacagaatgagatgcaaacgggcgaaagttagcaaggagtttaggtctatattaaatgaactcatagactaaagataaaaaaatgtatgtaattttaagtaataggaaataaaaaagtaaaattaaaataacaatgagactaaaatattattttagagaaactctatatttgaaagtattactattttaaagaagtctaaactgaagtacagttacggaacaaccaacttgccagaggacgacacgacccaggccacagaccctgccccgccggcaccgaacggctactgtaaatgtcgtgaccgtctcgtccccgtccagtccaccttttcctcctctccgactccaccgccgtcacgccatctcgccgggggcggaaccccgaccgcgagt

SEQ ID NO: 11528 - DNA, 329 bp, Zea mays
ttaaataaagaataagatataaggtgatatagagatgccgatccttccaaaataaagacccaggtaagaaatagacatctctctattgtgcccgtcagcccgtgtgagcactagttgaaggtagggcatcagaaataaaaaaagaaaacggcaagccaagtctggtggaaaagctcagtgatcataggatgggccgatgacgatgcctgggtccagtccagccaagataatcttgatcggtccaaattgaaaaaacagactccggccacagccgagacgagactagcagcagccgcttgctcagatcggcagcttcggcggcggcggag

SEQ ID NO: 11529 - DNA, 721 bp, Zea mays
gattcaaaataaaaaggagacaaattaggagaatgaaaatataaaaggaaaaacggaactgtgcgcagttgggccwaatcaaccacatatggcccactcccgttttcccttctgcgcggcccaagccttcgcccctgcgcgccgcgcttatttggctgactcgctgatgggtgggccaggcagtcggtctccgtgcgcgcgtgtcgtcactgcgcagccgactagtgggaccctgggaacagacacagcgaacactacacgcgggttgaatcagtcgcttgcgtgcgggtcccagttgacagatccatccctctattttctttccgctgcatccacaccgccgctcgagctcgatggatcgcctgcgaacttcaccgtgtcggtggcgcggagtcctggtgcagcgcagcaaataaccccagcccactagcctcctctagcgggaccgaatcgtgaggcgcagcgtcttcctccgcgagatctcaggcaacggacccgcgaactgggcatggtcaagaactgacccaccagggatgctgcggctgtgcaactctcaaccggattctggttcttggagtatataagccaccgttccccttacctccctaatcccccagctcaccatcccgagatcttcccccgatcgacctcgtgatccttgtggccatgtcgtcgtcgccagccatgggcaattgatgaattcgtctagctctctgagtcc

SEQ ID NO: 11530 - DNA, 113 bp, Zea mays
gcttcaaattaatcaatccatttatattctgcaactctgttaatagagtttgagctgctggctaacaaaaataactgaactcggttatttcatgcttctacattcatgctaag

SEQ ID NO: 11531 - DNA, 109 bp, Zea mays
ttgtgtcagtcgagctctgccttctccgatgctgctagctagaagattgaacttgcctctctgctagtagagaggatcggagagagggagagggagactgacacaagaa

SEQ ID NO: 11532 - DNA, 479 bp, Zea mays
ctggcaatagggctggaccgtgcggtgaaccccttttggtactcaacaatatgtatatgagactagcttttgattaaaatagtttttatttttaaatatattaaaatatgcttagataagtatttgactttcgaacacgccaatcttttttagtaccaacatgtcagcttatcagggaccattttcggtaatgtacggagccatgccagacgctatgcatgcagcccatatacaggaggtattttatacgtgcaacaagccaatgtgagattggcgtcctagttcgttgtgtgcatcttgccagtctcgttgcctatatatacgagacaacgatgatcagtaagccgaccaaagcaagcagtcacacccatttcttgtgtcagtctccctctccctctctccgatcctctctactagcagagaggcaagttcaatcttctagctagcagcatcggagaaggcagagctcgactgacaca

SEQ ID NO: 11533 - DNA, 1478 bp, Zea mays
tggcgcgcgcgcgggcggcgtcgccctcgcccggtcgagagatcgagaaacgatggagggaggaaagtgtggatctccaacggctcgagtcacggtcgcccaaagaggtctggacgtctggttgccgagcgggctgcgggccggcagaggaggccgcacggaccacggagtgggagggatgaaatggaaaaaggaaaccgacggcactgcgcgtcgcggtcgcggctattcgtcgtctatgctatgctagcgcaagaaaaatcgcaaaacgcttgacttggccgaacgcggtgccttccttagagcatctccaataatgcctcaaactaatgcctcaaatcgaaatatagggctctacacaggaaaaaccactccaacagtgcctcaattaaacaaattttgtcaaaaaactatagggcaccctctcaagtgccttaaatatattacaccgtagtgggctgccctataatctagatttagggctttactattggagcaaaatattttgttggtttcctaaatcatataaaatatacttattttttaaattatatggtatttataggacacattgttggagatactctaaattgtctatttttagagtcctcgtaaaactataattttagctatgattatatctaagtctttgaagtagcatatctcctatttcatctcttatcttatctcctatttagctatgattttcatttttttaagtgaaattagttcattttcacttgagaaaatagaaattctttggaaaaatagagttcacaaacaagccttaaagaaattattatttttatgtacataacacacgatttccaacttgtaaatgaatattaaaaaaacaatgattccaaaaatattcatacgtataccataatttataagttgatgacttaaaattaatttgatccggttgaaaaaaatgatgcaaacaatttctgttaatatggttgttgaaaatatggatatagtaattttagagaatattgttggagattatgatgatatagagtaggaaaaattttagagtgctgtgagaatatattttttataggataaaattttgagaacattgatatttgatagagatagtctaaaattctggaagagatgacaataaacgggccagcgaaaactctgagacgaactgtgcccttttcttctttcttcaagcaatggagcctttgccatctgggctcaattttagtgcttcagccgcgcagctgggccaagagatattttccccttcagccccattcgcaaccgttgtggccgcgtcgatccccatcgcctctccccatcccctctcctgtctgaaaaccagcacgccacgtcccaccgccaaccaccgcgctccggctctccccaattctaagcgagacggggcacaggaagaggagagcctaaaaccctaaccccccgaatcggatccggccgccggagcgcggaaccccaccccggccgcc

SEQ ID NO: 11534 - DNA, 1478 bp, Zea mays
tggcggccggggtggggttccgcgctccggcggccggatccgattcggggggttagggttttaggctctcctcttcctgtgccccgtctcgcttagaattggggagagccggagcgcggtggttggcggtgggacgtggcgtgctggttttcagacaggagaggggatggggagaggcgatggggatcgacgcggccacaacggttgcgaatggggctgaaggggaaaatatctcttggcccagctgcgcggctgaagcactaaaattgagcccagatggcaaaggctccattgcttgaagaaagaagaaaagggcacagttcgtctcagagttttcgctggcccgtttattgtcatctcttccagaattttagactatctctatcaaatatcaatgttctcaaaattttatcctataaaaaatatattctcacagcactctaaaatttttcctactctatatcatcataatctccaacaatattctctaaaattactatatccatattttcaacaaccatattaacagaaattgtttgcatcatttttttcaaccggatcaaattaattttaagtcatcaacttataaattatggtatacgtatgaatatttttggaatcattgtttttttaatattcatttacaagttggaaatcgtgtgttatgtacataaaaataataatttctttaaggcttgtttgtgaactctatttttccaaagaatttctattttctcaagtgaaaatgaactaatttcacttaaaaaaatgaaaatcatagctaaataggagataagataagagatgaaataggagatatgctacttcaaagacttagatataatcatagctaaaattatagttttacgaggactctaaaaatagacaatttagagtatctccaacaatgtgtcctataaataccatataatttaaaaaataagtatattttatatgatttaggaaaccaacaaaatattttgctccaatagtaaagccctaaatctagattatagggcagcccactacggtgtaatatatttaaggcacttgagagggtgccctatagttttttgacaaaatttgtttaattgaggcactgttggagtggtttttcctgtgtagagccctatatttcgatttgaggcattagtttgaggcattattggagatgctctaaggaaggcaccgcgttcggccaagtcaagcgttttgcgatttttcttgcgctagcatagcatagacgacgaatagccgcgaccgcgacgcgcagtgccgtcggtttcctttttccatttcatccctcccactccgtggtccgtgcggcctcctctgccggcccgcagcccgctcggcaaccagacgtccagacctctttgggcgaccgtgactcgagccgttggagatccacactttcctccctccatcgtttctcgatctctcgaccgggcgagggcgacgccgcccgcgcgcgcgcc

SEQ ID NO: 11535 - DNA, 182 bp, Zea mays
ggtggttttcttcacaatattattctcttttgttgtattctcctaactgagtttacgtttgtgtttgtactcaggcgtgtgccagcttggaagagggctaccttcctccaattacattcattgtggtgcaaaagcgccatcacacacggcttttccctgaagatcatcatgcacacggacag

SEQ ID NO: 11536 - DNA, 1428 bp, Zea mays
cagccttgtaaatttctcctcaaacgaattcatttagaattcaacgaataaagttttcagtccaaaataatctcgaccccgtgtgttatctgagaaatcatgtttgaaggtaatgacatggtctggtccgttatttcttgctctactctgagcattcgggtaggagatgagtttatcaggtctcagttatatcaaaagaaatctcctatgtagttggcaaaattattttggtttgaccaagttaaacctcatttatatattgatactagattcaaatctgagagcacgaatatatatggattagtgtgtaaaaaaaagaaataaaaaaaaggaaaatatctcagccgctcctatccttccaccgctttctccttgattttttcccctggccgcgttggcttcctaggcgtgtctctctctcgccgtgtctctctctctccttcagctttcacggcgctcctcctctgtctcccatggcgcgcgcctgcttccctcataggggcggagctacatagaaattagggggtgcacatgcatccacgaaaatttggaaatctaatggtttggaccaaattttcaccatatatgcaccacctgtaaattgttatcatgcaccctcaagacatatgcaccctcccctaatttactctagcttcgccactgttccctcatggcactcgaccatcatctcccatggccgccatgccctggtctaagctccctgctcttctctatttcgagctccctccaacagcgccgtcgtacctgcgtccacgaatccaaagccatctttaactccgccgctctacgctacgacatcttcttgaccctgcgcgccgctccttggatgacctcacgctctctcccatttgccggccgtgcaagtgatccctctgcgtcgagcatccgctgtgagctcaccgaaccgccttcccatggccgcgccctgctcggctcttacaccgtcgatttggagctctagcgagctcttctctggtgcccaggtgcagttcgtctctcttagcattgtctccagctgctcggtgtcagcactcaagacaatacacttcagacatctacgccttcagttactgatggagacatgggagcagaggaagtgcaggtttgaaggcctaagagaacggctaggcccagtagccgtgttacgggcccagaatgggtgcgctagaattgtatctcgctaagcccatgagcttctatatgtatcgctgtatccgaacgagaggagaacaagaaaagagaacactcatttaccaccatcttcttctccaagcttctctcctacctgtgcttccctgctcttccctctgcctccgtagccactgctaacatattggtatcaaaggtcatcgatccctggatctagatccgatccactacacccgtcgagccaagcgtctcggtgcc

SEQ ID NO: 11537 - DNA, 274 bp, Zea mays
cggcgctgcacattggctagctcgtcgctctctcgtcggccgcccgaacgtacgtgcctctataaattgatctgcatctccctccagctgcgacacacaccacacatacacattttcaaatctagcttgttcgctaagctcaagctagctgagctgatctgagaaacgatcgcttcttcagtttcagcttcatcgctagctcgctacacagatcgacctcttatttagcttgttcctccaaggaccgagatcggttgttgttgataaaccagcc

SEQ ID NO: 11538 - DNA, 812 bp, Zea mays
cttaggattatttaatccagattatataatatggggtaaacaaacaggccctaggagtctaggacaatgagcaaaccctgttcttcaccgcaagcctcaagggaaaaaaggattgttttttaccggagaggagcgcacaggcaaagaatctcgacgccaaagaaaaggaattcagaagaaaaaaaaggatcaggatattcacaataaataaatccgatgccatggctcagatgtcatggctcgtgagcccatggtcctcggctctcgcgtgacagcgacgcatcctcggtcctcatgtatggcaacattcttacaccccatggcgacatcgtcctcgtttctcgcatggaaatgtgtcctgaacaggattattccgtgcgctgggctgggattaggattatccacgccccccttcctttgtctcctctctttctgtacgataacaaataccaagaaataaacccatttatttttcctgctcacagacttgcgttggccgttggcgaacaaagcgaattgtcatagtgacataatttattgtcaggaacctttattttatctttatacatcgtacatgttttctctccctgtctctagtactgtcgacatttttaaaattgcgcaatttttttaagaacggggaagaatgcccggagcgctctataaaacctgggggatcagaggaggaggacgtaggtatcgtgtcggtgtgcagtgtgttgtcatctccatctccagctccagcgccgccttgctctgtgtgcttccgcccgctctgtgttgctattgctaaactagtgtgttctgtcgct

SEQ ID NO: 11539 - DNA, 1500 bp, Zea mays
aactgaaagtgatattttttttgtatgatcggaattggagggttcaaatgacgaaggaattccagaaatctataatatgtatgccttttctatagtctccttgggggcacaacttakataagagcaggttagctgaatgctctctaagaggtgaagttttccacgactttcttccggactgtatgcaattgtgcctcatcrtctgtagcagtagggcgagatgtctggtaggcgacctacataaaatacctggcttagatacgtggatttggataaaagttataaactttttcttgtttttggagaaacatgtaagataccaatatgtgtacgttgatgctttcatcacaaaagtcaagatggccgagttggtctaaggcgccagtttcaggtactggtccgaaagggcatgggttcaaatcccattcttgacattatattttttttatttttactcttttgtaacaagtcttggtaatttgtataaaaacttattgtatttttatcttttgccttttctatcttccggttaaccttatcttattttttacccttttaaatagtctgggttcaagtctatttcgtttttttttgtaatagaacttctgtcgtttaggatcccaaaagaacaaagtaaccatgtttacttatatatcccattcttgacattatttttttactcttttgtaacaagtcttggtaatttgtataaaaacttattgtatttttatcttttgccttttctatcttccagttaaccttatcttatttttttacccttttaaatagtctgggttcaagtctatttcgtttttttttgtaatagaacttctgtcgtttaggatcccaaaagaacaaagtaaccatgtttacttatataggggtatcccttttttagattttgtttttttcagggttccaagtctactcagtcagagcctataactctaacgaaaaataattaaatacgggaaatttcttttcccgttttttgttttcagggatccaaaacctatttttgttttttgaacaaacttgtagtactatctatataccaaaagagcacaaagtcagccgtgattactcatgtatagggaaaattgatggtgggcaatgacattttgttgttaaaagaaacgatgattagcccctgggcagctgcagctctggtgctgtagaaacgcgggaagcatgggccgcgcaaccatgacaaagatatgaatctcgtttcttagatctcgtccgtccctacattggagggctccaaggatgcggcacaaaaggctcgcctccctcccgaccaccaaacaatctccaagaatagcgggggggacggctataaatcggaaaatctgcccctcaagtttgccaactttaggataggccgtgcaaatccatttcttgccttgccggcacagctctgcatagctcctcccaagctttaggattaggatttggatttggatttggatttggatcgggtgtgtttcctgcgtaacc

SEQ ID NO: 11540 - DNA, 1500 bp, Zea mays
tgacttcgaaggagataaacttgtcgtttcaaccagaacgtctctgtgtagtacgaaaataacaaaaaccagctccgtggtgtcattttagacagcaaaaagacgaaagtacatttgcagacttggaggaatgaccgtagcatctttcgaatgtcaatttggtttggtgtcgtgtgctgatcatcagtatctggtctgctatattaattatatgtaggtgagtaggtctgtagtttgtttatcgaattgtcattttttatgcgataatttacgttgtggtgcctattggtaaattactaattgtgacgccttttcagctgacagagttggttgctaatcagtcaggtactcaggtctgcttaggttcattggtgctgttcggtcacgggtcaccttgcattatcgcattcgacattgaccaacaattagagtactgaacgctgccatcagtactaattcactatggacagcatttccaacatccgaatagaccattgagcggaggcgcgcctagagccccttcacacctgtctccggcccctgcagcatggaagaccctacgatacgaccactggtactgggatcttggctggcttgtttgggcagcaaggagttcggagatcctcttcaaagtccttgttcccagacacgtctttcccatgtagtttcatagactgcgtttttaaaaactgttttaaaagattctctttatctatatttaatcttctagctgtatccaataatttcctctatatttttcctctctatatattttatgaactatttaaaaagattctcttatctatatttaatcttttacaactcatcctctttatctatcatctatggactactttatctttgaagatgtttttaaaaactatttataaaaaaacttataataccttgtgaacttgttrgtggtgatactgtggatctaatactttatatttttttaattatataatttgttttgactcatgtaatatatagattttgttacatctagaaaagcttgttgttagggagtgtttggtttatagaaactaattattaacctatctattttattctattttaatttctaaataatcaaatataaaaattagaatattgttttagtttccgtatttgataatttagggaccaaatatctcttagtatgtttatatgttttacataaatagcactctctttgtttttttatatatatgtgatattttttagttaaaaatgaactattagacgttaaatatttagaaacggaggtagtatatgtttgaaaacaaataaatgatgttcctatgtttcgctgagaagagagccgactcctgctcctattatccgcctcgctcctcagggcggagaggaggcaaagaggaaggaagcgccgcgggagcgccagacagacagacgaaccgagcaccaccgccactagaaaaagccagcccaaaaccctagctccggcgcgccaccgcgcagatccagtgctcccgcgcg

SEQ ID NO: 11541 - DNA, 315 bp, Zea mays
ggtactgactgaattgctgaatcttctgtaatacatatcagttataatctgctcctccaagtattagcatatcagttacaatcatctataatctgttggagctaacaaagcataaaaaaacggcattttttttcgtaccgagggaaaatgtagtggtggacagtaagaaaagtgacacgcaaggaggagagggccatgctctgtcatttttgtttgggcaatagcagcagcagcagtgcttgttgtgactgggactgggaggagtgatgatgagccccttctaactttcccccccgctctctccatctccactgc

SEQ ID NO: 11542 - DNA, 187 bp, Zea mays
ggtaaagcatggccgcatacaattgcgttgctctcggatgacagtggctcaatcttttcagagcatgatcttaaagctaacctgctttggaatgtyttcaaatgtcgcttgggatcctctgattttgtggaaaatgtctttgatctccatagcttgttgttcttccacagtgacttgcattggttag

SEQ ID NO: 11543 - DNA, 1500 bp, Zea mays
ttcctctcactcaattctttgtagcagttcttttttaaaagcataccggccacacagagatggaccgggttttcggtcttcttataataaccattcctttatttccaaaggcacacaatatttatttaagtaaaattatgcggtaacatttccggtgtcttgaataatgatgatagagaggcgtggcatgagatgtctggcttcacatggaagagtgatcagaggagtcttttcgttcccggctcactagaagctaaccaaattttgagatgttggaagtctgatacgtttacaatggtgttggtaatgcagattctgacccagacaagctctgaaagcaattcagaaaaagggtgacaccccagcaaagcttgtgaagatacttcagtgatgtactattggtaatctgatgatcttaccgttgttcaacattttttttgtcatcttcaatctcgattttcctaaatttcaggagattaaaaacctgacaaagctggtggagcacaaggccattgagtcaaatcgtacaacatatggtaagcataaattcataggccccatatggatatggttaggttgttttgactgaggggagttacctgctctgctctccacactccagggcatcggatgagtcagccgctgcgtgtggaacgcgaccgaatacacgaagccgggttcatagcgaagcacaggaccatacttacacaagaattcgcacagtttcgcaatatcggcggccgtttggtatccagtggatacgtggctgtttgtcacagcatcagatctcaagttcaaaccgtagttaatgcattcccttatcattttattatgtccacacttatttcacttccattttcatggtacaaaatttattgaaattggagacggatacttttcatataatcatggcaatgggggacttgaaacgtggtgtgttggagtcttggagagtcacgtgcacacagctaaacggcctcaacaacaacaacaacaacaacaaaacaacaacaacaacaacaacaacagaggtaaggttatccaatatttgcgctatatcagtagatagatgcacacagcacaactttatcgagcagcagtggagaaaaggaattttggagccttggaggatgtaaataggctaaccataaaccatggattgcacctcatcttcttcatacatacaggatatccaattaccgggccttgtaaaccagatcgaggcccgccgggcccaggcctgctagtggtatcaagcttgtacatctgccagatttttttaaaaaaactactcctatattggtgctccatatataaaggaagctttaacgaaggcgcagcacaataagccaagacaaacgacagggaatccacatcatccgtcggtctctcctagtacacacgcggccacacccaatcaaagaaaaggtaataagcccgcatcatgattcccagggaatattgccattacaccctactaccactagtgcctgcctacta

SEQ ID NO: 11544 - DNA, 785 bp, Zea mays
ggtcacagccccacagtcgccccttcggacttccctttattccccttcctatataatcccatcgccactgccttcttcttccgcttccaacttccgttccgcaaatcgaaagctcggcgttgccctgcctcgagctcgaaggactttgtccctttacgtcgttgtccagctcctcgcatattgtggcctggtgcagattggagatccgcccggacttggatcgagtcctcctgtctttggtaaggaaaccctagtccgcttcaaagcatgcctttaagccttttttattttttgctgggatggatcatggatgcagcaaatggaccattgaattggcacatcctacgatctgagcctcgaccttgaggctgtgatgttgtttgcgaattagggcttactgctgaagtgctgagcatgcgtacgccatggcgtgcatcgacccctagtgcggactgcggtgtcactgtcgttggatgtttccttgtcttatatagcatccagcaatcagtaccgtttcctcatgtaaagcccctcagtttaatactttgagagctaattgggtagcatactgccgtcactgcaatgttgttttgactttaatccgcacaggaactcctaggctccgtttatgatgtgaatccatactctgctgcttttattaatgcattgcaattacatcatatgtattgaagattatgtctacattaatattatgttggccctttttcttacttcattacatgttcccaggacattcattggagtgctccattcattgaggcagc

SEQ ID NO: 11545 - DNA, 1500 bp, Zea mays
tgctatccaattgctacttcttggttgcaacgcttgaccagaacccaggtgtcctgtgccttacccatactatgcagcaagtgcaaagcatatactactagtatactctcaccacattattagcagcaggatctttggcaaagcatgagcctcattttttttctcacccagctagccttagccagggcctgggaactggcctggtaccgacgccgcaaagtgtgcagcgtatctcctctcgtctcatcaatgcgtagtcgccccgcccgccccatttgcatgcagcccagaggcaaagtggacgctttttagggttggtgccccccctcctcctctccaactactcacgcacttgtaccgtctcgttaaatgctgctggcctgccgctgcacatgaggaagcttttctcgccatgccagggtacggatcgtcgcycgtgcattgttgttgtggtagcagcacaacggaatgcggctgtaattcataaattctggcgaataaataccgtggcaggcccgctggatgtaagggcacggttaattgagtcacggtcatgtgcacaccagtaccgcgcgcgggtgtgtgtttgtgtttgtccctctgagatacagagtattctgcgcaccaaattagggtttgtttggacaatctcggattaaagtggattgaggtggtatggaacgtatcgaagtgtaatatgaactaatttctctttcaatccctccaatacacctcaattcacttcaatctctctttgcacaaacaaagccttagggatttaaaacaaccaaaagtgaggggaggggggacatagggcaacaaaattttatctgtatcagacaccttgcgatcaaggaaaaacaagctgatttagcaagtgtcagtgatcaagtaaaacaaggcaaattcgaaagtgtgaatatcaaacagtaccgttaggccgctgcctacgacttcctcgtctcagtgatgagaggctccacagtcgttgtcccttgcaaattgcaactgcaaagcgcggccctgcttgccggtaggaggagggtccccgccccggtttatagtaaccgcagcagcagcagcaggtttacgggcggagtgaagggaagccgcgccgcacccgcagtcactctcgccgtcgcagcacagcggcagggcagaagcggctgcccctgctgcgtttccgtccgtcgcccgcccgcccgcccggcgcccgcttctcttttgcccgcctctctctcttttgcatacgcctttcatctccaccccagtccccacccgcccgcaccgaggaaaaacttttttgaaaacaaaaaaccccccactcccacgtcccaccacctcgcctcggccgctgcgacagtgcatacgccccctcccctcctgactcctgttgcgtatacaccgtatgtgtctactgtgactccgggtcccgggggggtaagcgaccgagcaagggtttcgtctccggcggctgcagcggagacggatctgggaggg

SEQ ID NO: 11546 - DNA, 884 bp, Zea mays
acgaccccggacaccgtctgaccatggtaaaactggtagaagcaacaaagatgcgtgaggaacagatgaaggccgaagctcactcagggagaagcagcgctgcagcagtagcttgtaggtggtgtcaagattgtagctcttgctatcagtgttaatcgttcattgtcaggtggttgcttattgtcgtctgcaactgatgccgtgtactccccgatgcagcatgtcggtatctgactactgaatttgagacggcttctctcggatgttttctcataatctgtgttgcactgcaaatatcaaacaccaaaggttatggataagtttctaataagattggaaagatgtaaaccaaatccagaaaaaatatttctctcccggaaaaaaaacacgatcctaagtgctagtttttgtaaaccctatttttaaaaaaaaatattttatcaaaaaaaaaataattatttttatttgggaaattgaaaatctcatgaaaaaatggggtttccgccctaaatgtttactttatgagcgcgcgtaacgtgtgctctcaccgtgagatgaccgcgcgtctcacctcacacatgacacatgtaattgcttgaaaatctatggctcacacatgacacatgtaattgcttgaaaatctatggtttagaaagagggaatcagggaagtgaactagcggtccacgatactccgacgcccactttgctacctcggaaccctagccgccgcccatggatatcgccggagaccggcgccggtagcgatacgcaaaaggagtggtacgttctttgaccttgtttattgctgcgcccgaggcgtgtggcgcggggggagcaggaaggagaggggaagaacagaaggggaaggcgggcggggccgcg

SEQ ID NO: 11547 - DNA, 1500 bp, Zea mays
tttccactattcgtaccatgtaatctgataggctgtccttggcttgttcctttcgcctccgattccgtcgccattcaggccggagtaccgccgatctgagaaatactactgcgacgcgagtgccgaaaggctgacgcgaacggatagagcgaatcgcgcctaggtgccgtgcgtgggtatcagccgctcgtaggcgctgccgcgtcggacgggtgtagatagcggccgacccggcgccgcggcgcgccccgcgtctatccccccaccacgtttcgtggcgctgaagcgctgctgccctcctgccgtgctgagtcagggttgatgagggttacaacttacaacccccaacggcttctcgtggccactcgcttttcacgcaagacggcagaacctgcacccccgtcccccgccggctcgtgtcgtggtgggtggccacccctcctccgctccgctccatttgggcggaaaccgaatcactcgggtcagtggccacttgaccccctgagctttccttccactttgcaggctcgagatcaccggtcacaaacggcagtggtcgtcgtatcgtaccatggtaatcatgggatcactatgaacggacccgacggaccggcgagagttgtgcggcaaaaggggtcgactcatcgtccatggtgtggttcggccggacgttaaccgacccagtgaagcgcgcgtcgttgtcgctgtagatccgatccggtgcgttgacgatgccagtagtagtatgtactgtagtagctaggtcaactcgggtagtgttatccccaacccttttgccacgtcaggcccaggccaggggagattaccaggggctctctccgccttcccagccagcctgggatgctggtgccgctccccgtccacgcacgcccaagaaaagtataaattaactaggaaacatacatacggactctacagcaggattaacgaaagcgagagtggaggggccagcatagcaacgccaacgatggagcaaaagcggcgaagggataaggcccccccgagtggggtcccgtcgcaattctttaatcggacccatcgtggttccacgtggcggtccaaccctctccggggggagaagatcggcaagatgacttgcgtggagacgcgcaacgagacccggccggtccgcctccgcccccgacgccgttatatacacgcccctgtctcccccctcgcctggttcgttgccgcacccgctgccgcctgccgtagtgctgctcccggccctccctctaattgctcttgccgctttatgtatttgccgcgcgcggcgacagagaatatacacgagtatatacagtagccgccgccggtggagtctctatctggcagccggccggtcggtcggtactctgctctagaagctagagagatactactctgcaggctagctagctagctagaggtagtagaagaggccggcccggcccgattgaagaataacatagagctgtcagctgctgagcgacgacggcg

SEQ ID NO: 11548 - DNA, 1500 bp, Zea mays
tacaatgttttttattaccatactacagtacaacagtaagttctttcttctgaccagagccagcgctttaactagttctactctcccagccagctatccttcttcaaactagagagagagctatccatattcctattcctgtgacctatccttatatctcgagcactacttctatcaccgatttcttacttctctcccaactttgcctaacaacccgaatctctttcctgtagctagtcgctgatagtcagtctatctcctttccttgcaaactctctaagctttaggtagttcgccgtgcgatgggcctgaggatctattccaaagggtgatgggtcgtgggtaccactcttcagaaggcgcttttgccaaccaccgaacaccaacaaatgaagagagttaccacaagtatgagaccactgaaactacttcgcctgctttgaatcagagcaaactgcttttaagtataagaccaccaatctagtacgcaaccattgcctattatgccatccatattgttgactttcacagacccactatgactgcctacgcccatatagatagagaaaagttcacctaaggataataaaacgtttgaggaaggttaccgcttacgatatacctatatatagatagtgtagtgttgtagtgtgttaagtagatcggtcccatataaagttgcaatgtatctgcaatgagttcatctactccggggtgttctccgcattctcaagaaagaaatagttggaaattccccggatcgtctgcgcttggcttggtattcttatactgaatcgctgttggataaaagaaagyataaagtttttaagcctgcgttctcgttggcgaaaccactaggaggcaaccatgaaagcggtttctatgtttcgatcgaaccaacacagctttacgcttctttccaactctacccacgcttcgggttcgcacttactttacgccttaccgaacttgggcttagttcagccagcttcgtaacatgcctgctcaaagtgagtagttggaagttcctgtaagcatcttcccatgaattgacgtatataagcgtagttatcaggtacgccgtgagctggattctatccccgaggatagagattgatgggtaatagttttgatagaaaactcgtatgttaagttctctagttgatgtgatgcggctcgattcatcattgctctcacatcaatgttttcggttccctttttactctcccattttcatagagaaagatgttctgattcagttctctctgaaaaggaggggcccttagggacacagtagtaccatttccattgtgcgaaaggtcgtgtcctggtagcctctctgctgtagacggtctcattggtaaattcttccatttctgaaattgtcaaatcgagattgtgtgggtgttcagtctactctaccgctcatgaaaagatttcgttgggtagaaccaagtctcttttgggagcagattgtatttgattttatatagttactcc

SEQ ID NO: 11549 - DNA, 176 bp, Zea mays
tgcattccagaaccccgttcagtccaagcagggatggttccatgttgtctcaacggcatatttggttttaagaattgcctgacacatggtacaagccatatgctgacaaattcaggatatggcacagcaagcttcactcaggtgacaaagaaataccaaagagaacaccagaggga

SEQ ID NO: 11550 - DNA, 1500 bp, Zea mays
ttattccgtgtcgcgtagaccgtacgcgagtggttcggtttgtttgatttcgcccttgcgcaggcggcytcagctgctaaagtcttgattaaccccgtctaattgcttgtatctgcagccagttcatctggaaagggttttatctgttcttttacaaaggttgcttttgcctactgacgcgtgaatatcgaatagtgatgatagtatattcgcgctttgcttgtacgtgtctgtactctgttgtcccttctgttcaaagcggcaactattcatctgcgtcgaaagggaatccttttgcagcgtgaatttgactgttcttgagcgaaatttgccgcgtttatttgagtggcgcagagagtccgctggcttccagccttccacgagtagccggcaagcgaccagatagagggaaaaaagagagggttagtggtgcactggtgcttaacacctgtatttgttgtacctgaagtttggcatatggccacttattctgtgccacacttaccggtcatgtgcatggaaagcgtccattcgatatgccaagatatgaacatgccacttaaaatgataacttgggaccagggagccatttgcaatagaggtcgcaaaaagtttggttgcacttcgtcctatttgtctctcactcactcagtcactcctatgtgctgatatgctgtgctaagctggcatgaaagactcttgacttcttcagagcattgatgccaattgcaataaaagcgtttgtttgtctccaagatgactattcatcactctatctttcggtggtaccaaatgcattatggtcactctatttgaaggtcttttgaatttactctgcttacctcccccttatgctttacagagattatatgctttgccaatagcgtagtcccaaattatggaagcccccttagattacatgtctgtacttctattctgaaacttcttgtagttatctaatgcgctggctgacagatataggaagaatatctaaatctcaaattttctgtgagggcctcaggggaagcgtcctatgtagctaaatgagggagcggttctgtgttatctatgggtgacaatgagctctaaattttacactataagatttaatgatcggatcatattaggatcaggccctaccattttgtgaagaagcatttggattgtaatccattaccatccctagtgttatcataagactgtcactagctcgtggcagagtgtatgtagatgcatatttttgctgatgtggaacagaataggtatctgtttgcatggcctggggaaaagttgccaatttttctcaatactcaaattttgtctctatgcgaaacagtcagaagtaactataggtttgctgtattgttactcattgtttacttcttaatgcttgtatcacatagaattccactggatccagctgctgaacggggtaccagaaggtggatttggtagtagcactgaacagcgagtggaatttctctaatactgtccaggatc

SEQ ID NO: 11551 - DNA, 655 bp, Zea mays
catgtcattcttctctatacactgagtcattgtatgtgtggacttgattctagcgcacatttaagatgcatctatttttgactttgaatccgagtgtgacaaagttgttttgcgagaaacccaacaaaagtaatcacgctctctagaaaatgtaaaaaatgtaagtgcttacaatcatatgagaagttggtctatgtcatatcattacataatgctcaaaatgctaccgtaaacatttgctaatcatagattaattagtttaataaatttatctggatagttagtttttagttgtgttattatttttataattaaactatatttagtactcataattaatatttaaataaataaactaaactttagtcataataaccaaacaaccctgaatgatattgttggagatgtgtgagcttgagttggaaattagttgcaacattccaaatcgaccacgattccgctagcacctagaagcgcaataaaacgagagcacggctgaatattattagtggggcaaaaagacacaaatccgaaaccctcgcatcggcctgtacctagccgccgtcgccacagagccctcatctcgtccgtcctcggcggcctccgcggagcagccgtcgctggagcctggagaccaaagatccggccagatctg

SEQ ID NO: 11552 - DNA, 1500 bp, Zea mays
gaaaatgaactaatttttcttgggaaaatgaggtttttaaagtaaccctaaggactagtttgggaacaagaaaacaggaggagaaaggagaggctagattgtccttcttatttcaaattgaataagaagaggaattagctatctaatccacaccggttttatggctttcaaactagttttaataggaaaattccccgcggcaaaacgggggatcgagtcctattgccatctatatggtcgcaagagaaatttgattgcacaatcgtttttaccaagtaaaaaaaatctttttatatatataggtgcaaaacctcttctcggcttcgagggagtcaagcagaagcagaagcgctgaagcagcgcgtttgcagactgcaaagacccctgtgaatttgtgatgtactgaggtgttgtccagccaacagtccttgctcccaagattcttccgtactcccccctccatcggaccatcctctaccatagatctcccgaactccgccgtaatcsggacgaatcccgcgcgtgctcttgctccctgtcgttctccgcggccggcgcgagctgccggtggttcgttgccgtcgacctcgtctggccgctcctctgccctgccagctgccggattcctgctgctggactggattgctgcgcgtggagtcgtgagtatagctccatctatcctgactgatacggatcgacctctcctctcgtgggtaagtgactcgagctttgcctctctcttggaggtcgtcttctttctgcggctgctagcagtcaagttcgaaattttattgcccggttagctgtgggctcatgtgctgcgtggtgtccttgttatcgagcgagaacccatctagaatcttgcctagggttttcagtgcctcaaaccaagttgcgcccgtgccattttggagttcgttccctgacaattggttggcgaggtttagggagggtgttgtgatactctgtggaaaaaaatgatgagtgaccgtgtggacatgtaagtacttgaacatagacagtgaggataatttagcttaaaatttgtgcaggtcatacgaaccaacaaacaacaaggaaccaaaaaaaaaagagttaaggcagtatacatgcttagagagcttgcatttcgtattatccctattagcttgtagttcatttgtggataggcacatttatttatatacacatagttctgttcaaacatagtgcactatcaatcagtttctgaactgatgtgtgtctttgraatgactccatcttctatacatgtcattttgttatacaatatggattgttattcgaaacatgaactgttttgcaatgcacaaaaaaaaacgtgcagttagctgaaagcctgaaggcattaaactaaaatgtttcgtttccctgtgttttccaggtttttgggttttcatcagttctatcagaggagtgcttatggatgattgcatggctgtagctagctaggccctgctttcctgtttgtaaagatacatc

SEQ ID NO: 11553 - DNA, 1500 bp, Zea mays
ttacatacctcttctcatcttttcagcgtagacctagcggcagtggcggagctacatagggaccattgggttcagttgacaccaatgatttttatcaaaccaaggattaatgtatatagtttattgcttgaacccaataaaaatttagtcccgaacccattaactgacttgtggtcagtcctgttcgtgcaacatggctggctgcaaaggatagaccaccaccatttagtttggtgtggtatagtcattatgatttatarttatacatatattcctaagtgaacccattggcaaaattttctagctccgcctctgcctagcggtgtatcactggagaccacaccgaatggaaaatatgtcatgtgcagtttttgatatacatcgacgtgtcatatgcgcactgattatggtgtaccgaacagggcacccagagcttgtagttcagtttttaattttgtctgagtattcgcttgacatgcatgtcactggcgagtactcacagagcttgtttattatgtcgttttgagttatactcccccgtttcgttttacttgtcgctggatagtgcaaaattgaaatattcagcgacaactaaaaagaaactgagggagtacttactaatatagcatcccgcgacaagcacatccgccagatttgagagaaaagaactatttgtatacaagagaaactaagagcatctccaagagactaactaaataactcgtcaaaccaaattttagctactcaatagtaaattaaatctccaacagactagctatttgactagcaagttatctgactctgtaaattgtctctctcactagctaaatttggttagccacctgactagctaaactagatagatagtctgttgggctgagatgctatatatagagtgtagtctttatgaaaatgtaaatagatagtcaaatagagagaaaaaatgaagagtggagatgctcttagcctgctactgtattcacaagtactagctgcgtccacacctcacactcatcgtagtaatcaactggatgtctggatgacgccacacacggggtgaattcaatttcaaattcagacaataggaatcgacgtaaataaaaataaaaaaaggatgaaagcatcttcttttctgttgtcaaactgattgtgatcggtgcgggcgcgcgagcaactcgagcaaacgcgtgcgtgcgagtacggtcatgccagccatgagccatcccattcccatgcccatcccagtcgtcgccggccgcatgcaggcaggctgacacagtgacacccgacttcctagtctaaactaaacggcgggcgccagcggccagcggccacccacaagcagagtaaaatattccgcctaggaggatccgcggaccgagcagcagactgcatatatatccgtgtccggccgcgccatttgtgcacaccaacaccaccacggaccaccgcgcttgtcgttgcattgcagggcagctagctaggtagctaacatccgcc

SEQ ID NO: 11554 - DNA, 766 bp, Zea mays
ggtgcgccaaataacatctccggcaaggatcggtccggcctactttcttctagttgctatgtatttttcctgcatatgaattatattatttcattgtatttatgatttaagtttttttccataaatgtagtagggtaattagaaataagtaaatagtcacaactttatggcactgctgtggattttcctgctgagtggaagatatgtataacagtagtttcaaatatgggaaaaactatagaaccaaattaagcagtgacatggtcgcatggggtaacaaaagattgcagccgggcactattcatcttacatgaaaatgcttcagattagtagctcgcttaatgtaagatttttatgccttatgccaaactgctcgcacaggttaagaaatctagctcagaataacctgatgcttgaccttggcttgagtctgcttgcctactttggagcaataactggatcttgagaaatactagtgttgtgcaaaatttctcaacaactttaaagcctgagcactttgtagttggccttttttttgctccactgttagtgacttgcaatgcgaatatgcgatcgatttcattggtaatgttcattgaatgattcctgatcagatggtaataacttgagtaccatcatcatgtagctagtgaaacttggcttctctgttgttacctgtaccataattccaactgattttttcctcatgtactcctttttgtgcatcctcgtccacatgcaggctgcagcaagcaactggacgatg

SEQ ID NO: 11555 - DNA, 207 bp, Zea mays
ggaaactgaatccatggacacagaagactttcctatcatacatcctgactactttattgacaccattttatggacatttccaaagaggaggttttctatggctgaatactgctcaaggcgcactgtgaatcaatacactctgccatctgacaccaatgttcaatttttccacattcagctccaatttgatgttttttgggcacattg

SEQ ID NO: 11556 - DNA, 1500 bp, Zea mays
aggtgtattagagagtagagaccatatggatgaaagatcttgagaactactcaccccggccatttcaatatctaatgcagaaggatgggaagtcgtcatctctatatacaacttttgtctgttttacttaggagaaacatccatgtccctacttcccagaattcagaaacatttcataaactgtaattcagagtacaaacctacacatccagtttgtttggggcatgtgactcagttaactgaaagaagcatctgattaattcatacatagcaccaaataaaaaagagaaaaaatggaggtgacatccagtttgtttggggcatgtgactcagttaactgaaagaagcatctgattaattcatacatagcacgaaatataaaagagaaaaaatggaggtgcggggaatcgaaccccgtgcctctcgcatgcgaagcgagcgctctaccatatgagctacacccccaatggtgttgagatacagattcggaaattctttatccctctagcaagctcatgtactttattttttttatataagctttgctacttttgaaggtatatagtatagctactgaatactcttgctgaagataactttatgttttttttacagagaagttttgctatgtaaggttacttagggcgtgtttggtttaagtaatcattccattcaaaatgaggtggtgcatcatagattcattcctcaaatttggtgggatgactccattcctcatattagtactaactaattaactatgaggaatgaggtgataatggatcaattcattccattccacaaaccagacaaaaatagtgaggagtgagaagatgatggactagctcatccgttcaacagacccgtattaaccgtagtgtcatttacgttcaaacctttcacacagaagtatagataatcttgaagataaaaaccccctaacattcaatggttgtatctgtggttagatcgtaatataatggatcagatggtttgcttgcacggttgcacagaagcactgcttgcatagcagtcgttgccgcattgcatacctcagagcctggaggctagaatggagaaaatataaaaaagattcttagcattgtacatgttgctttggtagaattgatattgttatttgtgttcttccttgtacctagtatacattttggtatgtcgccagtaagatttctagccttaattatttaccccctgcccacacacccccacccacccgtaccctggatgatttccgccactgatcagcagctttcttttctcctctttattcagtgaaccttatcaagtcatgtaaatagaacaatcccacgtgcattcatgcgaacctggtgctttccattccattgtctactaaactgactccgcgtgcaatctccttccttcttgcagttgcagctccagcaagtcgccattgctctagagatccacatgtggttctcggtgcattttcgtatcttttagaattgaactgtgaaaaacaca

SEQ ID NO: 11557 - DNA, 1500 bp, Zea mays
ctttcacagatgacaaccatttcaggcccagccaagcttcagagctaggccccaccggcccagtctgtgtaccaagcatgcgaggctccaggcccacatgcacctcagcgcctgtaataagatggcattccatctcgcccacatggaccgagcccatgcacggcgggctcacgggccaccgggtcacgctcgccgcctcatcccgccacatcagacaaaaagggcgaaaaaaatgcatcagttacagtactttcctttgcctaattggtcgtcttggcgcggcatcaccgtcgtagcatttgcgtcaagcccactctgggcttctttggattacaggaattttgaaggaataatgctggaataggaaagtttcctatcctatagtttggctggcatgatgcaccaattatattccataggattttatctcttcatgtgttgattccataggatttctaacattcactcagagctcttggaaaaattcctacacgcgaagcacgagaagtggaatgctaatgctagcaactaatggtccattatggcttgtcctacccaaatttaaatagagaaaaacacatacaaaacacccatttgatattgtttttatccaagcttgacattcatgcaaaatgaacccttcgttttttccttgccccaaccaaacaaccttccactcaatattactacgtttttcaatcctctgatttgcacatacaatcctacatttttcctattcctatatttttcaattcctgtaatccaaagaagccctctctccggtctccgccgcacaagagcagaagggggaaaaaacgcaggtgccctgcgtagctgcggaaacacggccgtgttgtagccatctggtgccttttccgtatatggacgtgcatctttgctatggctactactacatattaccactagcccatctcatgattcgtgttaggtacgtactaactacatacatggtgttaagtgttaacgagaagtgagacagccatttgttgttgacatcacgggaaaatggcaaatataaatatcggcgccgggtacaaaatcggatcatcccaatcggacgcgaacccctagcgcgatcatcaccattattgtgatgtgcccggctcacctgtgccaggaacccggtggccccactacgaacaattgctcgagtcaatccggtaggtgtagccgtgtctgcgtagccgttccggggagccaagggctcggcaccaccgcggcatcggtgcacaaggacggcgcacgtacgcgccacgtccttgggccccggcgcagttgtaccctccatctctgtcctctttacttgccccatccatcccacgccgatcgccaggcgccagcagcaggctagctctgctccgccgctcactactcgctagctactggaccgcgcttccctctctccatcacgccggcgcgcacggctagctctagctcccggagccgccctttcatggtccccgccgtggtcgggacgag

SEQ ID NO: 11558 - DNA, 73 bp, Zea mays
ggtatgtgttatactttacgatccactaaggtagcaactctttcgattacaggtcacagatctatccgacaag

SEQ ID NO: 11559 - DNA, 60 bp, Zea mays
ttgatctttaagtctccctttctcttttgggagcagatctttcaaagatgggaaattcca

SEQ ID NO: 11560 - DNA, 934 bp, Zea mays
ctctaccggcaagctgaggtgctgatcgcggggttcggtcgtaagggccacgctgtgggagatattcccggtgtccgtttcaaggttgtgaaggtctcgggcgtttccctgctcgccctcttcaaggagaagaaggagaagccgagatcttaaaaaccctatccccctcgccacaaatgaatcatgtaatgcttttggagttctgggacctcatgttgagaacctagcgattgttttgccatagttttgtttagaagattctgaattgaattctatatccgtaaccgcttgccagtgcgtgatctgtgttaatattatctttccgtggtatcttggtagacctgaatctctgaaccgctgatgtccgggtcgacggctccaaagtagcccagatccctgcgctgttgcgattatgctcagtagcactagcagtatccatcagcgaaaacttgcgaagcagtggaaatctggaaaccaggacccgatccggcgatcccgaacgtgaggctcggtgccaagtcagcagcctattcgggtccgtgccccctgtacctataggccgcacctcctacacgcactccacagatctcgcctccatgcggggccaccactaaatctcacgctcgtggcccgtcgtgtcagtgtcagggccccacgaggcggcatcgcgtcgcgggccgccaggcgtgaccgaaacaaacgaacccttttgcctcggccgggtgccttgcccggcccatgccgtgcccggttgtgtaaatagaagataggcgacgaacacgaagcaagcaaggcagccgaatcccaactcctgtgtgtgcctgccaacgcctcgtcgcccgccgccgccgctgcttcgcccctctccgccagccgctcccgctcggagcacgccgccgccggcgtgggcgcgcaccgacggccgtcgtgtcgc

SEQ ID NO: 11561 - DNA, 940 bp, Zea mays
ctctaccggcaagctgaggtgctgatcgcggggttcggtcgtaagggccacgctgtgggagatattcccggtgtccgtttcaaggttgtgaaggtctcgggcgtttccctgctcgccctcttcaaggagaagaaggagaagccgagatcttaaaaaccctatccccctcgccacaaatgaatcatgtaatgcttttggagttctgggacctcatgttgagaacctagcgattgttttgccatagttttgtttagaagattctgaattgaattctatatccgtaaccgcttgccagtgcgtgatctgtgttaatattatctttccgtggtatcttggtagacctgaatctctgaaccgctgatgtccgggtcgacggctccaaagtagcccagatccctgcgctgttgcgattatgctcagtagcactagcagtatccatcagcgaaaacttgcgaagcagtggaaatctggaaaccaggacccgatccggcgatcccgaacgtgaggctcggtgccaagtcagcagcctattcgggtccgtgccccctgtacctataggccgcacctcctacacgcactccacagatctcgcctccatgcggggccaccactaaatctcacgctcgtggcccgtcgtgtcagtgtcagggccccacgaggcggcatcgcgtcgcgggccgccaggcgtgaccgaaacaaacgaacccttttgcctcggccgggtgccttgcccggcccatgccgtgcccggttgtgtaaatagaagataggcgacgaacacgaagcaagcaaggcagccgaatcccaactcctgtgtgtgcctgccaacgcctcgtcgcccgccgccgccgctgcttcgcccctctccgccagccgctcccgctcggagcacgccgccgccggcgtgggcgcgcaccgacggccgtcgtgtcgcatggat

SEQ ID NO: 11562 - DNA, 103 bp, Zea mays
ggtaaaatgcctgttcgtcgctgcttcattgctcgattggttccttgctctaatctgctttcttgtgccatgttgattgatcgtgcagaacattcaaggtttc

SEQ ID NO: 11563 - DNA, 251 bp, Zea mays
tacagtggatgagctggtggtaccttcaggaatccaccccgtcgtttgttgccttctccacgtgtccaggtgattattcgccgcatgtaaatgcacatcactgctcgtcgtcgtcaacacctccaccagatcacagccatcctccccacaaccccctcccctcaactgactgaatccctgacacgtccacacgaaatctccccgtgatcgacggcccatccttctttctttctactctccttccttggaac

SEQ ID NO: 11564 - DNA, 332 bp, Zea mays
tgttgacacatgctaaactctaggaggaggaaccaaacacccccagagtgtatactagtctagcaccaaagcgaccgagccgcggatttcacccctgcctttccttcaccccgtgtccaggccctggtgcccgcgcgttcccgtgcggcaactggccgccgccgccgcactacgccaggtgcccaattcctcgtcgggtcctccgccggcgacgagcacccaccaggtacgcccttctcttcccatcctaccgtgcgagacccagcacacgaaccctaacttaagctatttggctatttgcatccggatctgatctaattaccagtgtgtgc

SEQ ID NO: 11565 - DNA, 1500 bp, Zea mays
gttaggataggactaggacatgcttgaagtacgctttgtctaactataaatgattgtgtttttcagaatgacgtgagttttaaccaaatgatatatagcataatctaagttttgaaacgatggtgaccttttaactagtagtaaaaaagaaaataggtttcagttgttttgtttgttgggttaaaaccgtcattatgtttgtttggttctctgatgggtctagaggtttttacagtgggccacgacttgttttaggctaaagcagcaaggcagttgaattttgctctgtaatttgtgtatgctgatcttaggcacagattcttctcctttgttgacaagtcaagcatctattatgtaagagcaggtaacctctgcagactattttgcttcccataaagctagagagaagccttctattcaaaataaaacacaaatttgctgcagttaatgcatccctcatgtattagaggttggtcagttgctgaatgtaatcagggcggcataagagagaaatatcgcaaatatttccgatcatggctgttcttagcttgataataccatgatgccccgtttggatcattggaattaaatttcattctaataacagtaatttagacatatatcaattaagctaattcggttttatgcaaaatatatttgtatactattattagcaagatatcggagatatttatgtgctacatttttactatagaggagtgagtcgaagagcgtcttgtaagttacagagtagatacaaattctactaatacataaaatcatttcttatactccaccccatgaatttgaaataggcttataactgaactttggaaagtgatgaaatatcaaattccaagctaaataggttactttattgagtgaattcaaattcctctaaaatgaagggatccaaacgcccagaggaaatggggacccaattggagccaaataggactcaaacctgtgtggggtgtacactcgctccctcccatttatcttcaagaggaaaatgggcacctgattggagccaaataggacttgaacctgtgtgaagtgtacacttgctcctcccatttatcacaataaatactagtataaccgactctgtacggactaaggatctgtaataaacaattgaagagaagcgatcatattcctcctgtctgatatagatatactgaaaaagcagtggctttcactggcaatttcatgtgaagactacaaaaccatttttcccaacctcatcataacactttgaatcaaccatctagaaatgcatattagtttcgttccatctctttaactatggcgaagatagaccaggtttaaaggcacatattggctagttttatttaaagtagaaatagaaggaaaacattaatagagagatctaattgacattgttagcttatttttatctgccactatttgttatatacaaaaaaatacgggaaacaaccggagtgatcaacactgattctctacagggaaggactg

SEQ ID NO: 11566 - DNA, 203 bp, Zea mays
ttgcatgcctgcaggttgacgaaccgccgcgcgaagtactggaagcgctggctggcgaacgtaatccgctttatgaagagatcgctgacgtcaccattcgcactgacgatcaaagtgcaaaagttgtcgccaatcagatcatcaacatgctggaaaaaaattaatccagcaccctgagggctcagcaataggtatcggtcatc

SEQ ID NO: 11567 - DNA, 174 bp, Zea mays
gaaagctacacgtaacctcccatacggccatatacacacggcaactcctcccctccccgatccctttctccctccgcgcgcggtatcggcccgtccgtcacacacaccatggcctccacaccgcggacgcccgcgccagacaggtcgccgccgccgccgctcgtcacacacacc

SEQ ID NO: 11568 - DNA, 1204 bp, Zea mays
cataacaaaatctcagtttgtatcatctgataatggtacacaactgagaatgcaaacaagtcggaggatccatgcgactcaattcttacattcaggaatagaaataaaagcaaaaaaacatagacaagtttagtgtaaccaggacaaatgactaaggttgggagggctcttaaaccggctctggtttcggctcctagagaagccagaagccctcataaacagtcttcaaaaagagttcctaacaaaaaacacttaggagccatagccatttctagaaagagaagccggagccaaaaaaaaaaaaaagctcctaacgtctcctccttccactctccatcttgcccttctcttacgttaagagaagtcatgctgctaaacaatttgttaaaaaaatactagctcctatagagaaactgctcttgaagagaaacaagagccggagttattttcaaagaagccaaagctgtgctaaatatgccctacgactatctccaccaaactctctatctcacctcatatttttaaatactactacataaatagtatagtttactgtgcaaaacagtgttttgtgtggcgatcggcgatatgcacgatctgctttgttgctcgttatgtcttttgatgagagttgacagtgttttaggtgcctgtcctagtacaaccttgacgtgcctctcatcgacgttgtctttgtgaaagatgtttgatagtctatcaatcgaataatatgatcaacactaatttaatcagtttttttttctaatcttagattgtaatattatgtgtcaatcttagatgtgctaatcttagattgtaagatcgtttttgcaccacatgcactggtgcggttaccacgggactgccgtgacgtatatgacaaggcgttctttgtcctagagatctagatccaagctgtggattttctcgagaccaacagcaattttcgtctgtctgtgtatatggcctagtaagcccataatttaagaccggcccgatccaagactaagaggcccatcccggaagtccgttttctttccttgttggcgtgtccaaggaaatacgccgtcatgcgtcattgcttacacgacgctgactacgcgacttcgacgcgggccggcaagccgaaccgattccggcggagtccggatgattcgtattgctgcgcgttattaaaactttgcggtgcgaccaaccaaaccca

SEQ ID NO: 11569 - DNA, 507 bp, Zea mays
acctgacatgcagtttatatatgtcttacctggttgggagggttctgcacatgacgggcgtgtgcttcgagatgccatctcgaggccggatggattacgtgtccctcaaggcgagttctgtcccttcactttgaaaaaaacaattatttaggcacaattattggctattaaagttatactttcttttttccatgttaaggttgctattatcttgttgatgctggttacacaaatgcaaatggtttcttagcaccatatcgaggacataggtatcatctaggaggtttcactactcaaaacccaccacatagtgctaaggagtacttcaacttgtgccatgctagagctaggaatattgttgagagggcatttggaaggctcaagggtcggtggggaattttaaggtctccatcgtttttccagtcaagactcaaagtcgaattataatggcatgtgccctcttgcacaacttaattttgcaaaatatgtctagagacccatttgaaa

SEQ ID NO: 11570 - DNA, 705 bp, Zea mays
cgacccgggcatcggattttattgccgaggccgaaatgttaaaagccaagccgcttctctgatcacagagcaactcttttcctgtcgatgctgacctgtcaattcggatatgcgttcgtatttacgtagtactgtatatactagtacatgttttacctcttgatgaatgatgacagtggacatgcatgttgattttgagtcctgtccatccagagcgacaccaatccgccggactgcgcggtcgtgctcaccactcacagatgcagcgcaccgcggtctcgtcacctcggcccaccggccgcatcgaacaggaaaatcaatcgtatgctaggcccgttctccggctcccccccttgcattccgacctgaaaaatcaagccttttcttttcttttctttttttttctttcgttcatggggtccaatggcccgacctttctccctcgaaaggtgaagggctgaaggcgagaaagaagcttcaaaacgaatcatccatcatcttgccaacccagcaaccctgccaagccatcgcattccagctctgcctttgcaagatcgccgccactcgcagccagcaagcaaccattccaccacatacttttttcctccggtttcgtccggcggcgagcgagcgaggtagcgcttgtccatgccgcggccgtgagggtgatcgaacgaggactacttcggcctagcgcggggagcc

SEQ ID NO: 11571 - DNA, 343 bp, Zea mays
gatccatggggtgggaaagagcagaaaggttgggagcaggcgtgttgttttttgtgctgcatgtaatccaggattcactggttttcatcaaggatttgaatgtcactaacctgtcatactggtgacaaccaattcctggtattatggctcaaatatgcgattttgaaaggtcgagaaaccatagattattattttcttcatgctgcctagtaatttcttcactccattttttatcatgttcaacttcattattattgacttcacaccccaatgactttcctaccaccatctttgttttaactcatttttttcctgttgcagcttgcgtaaaatatttaaataa

SEQ ID NO: 11572 - DNA, 108 bp, Zea mays
tgttcagcacgcagcagctaagttttcagagtatatatagaagctagcagagacgaagctagcaggcgtacgttaattttcatcagccgcgcgctgtagtagaacagc

SEQ ID NO: 11573 - DNA, 1500 bp, Zea mays
agaaattggcacaactagtgccggtcgttaaaaaaaagactccttttacactgcacggtacaaaatacgtagtgcaaataaaatcctattttgcagccagaaaatgagaatagagtcaaatctgaacaactcaattgacattgtttccaaatttctagcatgtagaaagtggccacgttgtttcattttgtcacaatcaaatcactctatgaaaaaaaagtatactgctgaaggtttttcaattgttacttgtcaaattgtgtcatgacctgtggggaatctgggtctcattccatgtttatccaatatagataatgaagtacttgcatagtaagtgaaacataggagtattattcttgtgtcagcagcttcagaggtaaaatatcaaaacaagaattaaagatagcttctgacacctgataaagttccatctcttgccttttgcccaattgataggactgcttcaagcgcaagcggtgcaaatgaggaccagtattcttttttttcttcagcaatatcagaatgtatccctaaggggaaaagtcaccattagccaaactagacattattgtaatttgtaactggacattattaaaacattgaaacagaaaggttgcaatatcagaatgcatcctagcccatgatcctaaggttgcaatatcagaatgtatccmtaaggggaatatttgagacattatttaggcactgggaatactccctagtagtaaaggagtataaacagtgcaaaagtgatcttgataccaagtttagaacataatgtccagtagcgggccagccaacatctctttagcacaacctcctcctgattaaggaatttcatgaataattacaatgataagacacagacaagaagtcctcatattgtgattatgtaaccgacgtacataccagctcttcctgtgacaggatcattctgttagctgttgcctgaagagatctcaattctgatctagcacttttcactctccgagatagagatgtaaccacattagtagtaacctatcacaaagtgtaaataaaagtttatgattacaaaagataaaaaaaactcgaccggtaggggaaagaccgcccccagggtattatattaaaaataagctcaatcggagccccgaccgagaaaggtcacgaaagttggtcccccgtgcaacatgagggtccgccctctatagaccggatctttactcgtgctttgagccctcccagcctctacacgaggattcgtcctccataggtcggtccatctcatgtgcatacaatcaggggaaccaacgagtgaccttttttaatctcagcctgaaattcgtttctactgggattcgaactcaggacctaaggagtgttactcagaccacctaaccaactcggctagcggtactttcgctaccacccacctccaaatagtggcaaatagttaatttttgtgtacgggtgttgataggcaataaacatcactaaaacgatcgtttcattctttca

SEQ ID NO: 11574 - DNA, 97 bp, Zea mays
ctgcagctcgcgttggcacagcgccgcctgaacgcgtgctaatttaagctctgtcgtagctcaacgcggccgccgggctttcgccgacgacgtcaaa

SEQ ID NO: 11575 - DNA, 1155 bp, Zea mays
atattatggtgtccttgtaattcttgttccaacagttccggaagctaacaataatgattgaggatggcactacgctacgctatctaacttccaccgatcgtacatatgaaatgttgtttgctaaactcaattgacttgctccgacggttggccctaacacttgagggcaaccaaaggctagccttacaattaagtacgaaaaggaaaaaaaaacatgtcaacggatataatcacttttatgtacaaacagaaaaaaaatgaagtccgatatcctcttatctcagcaacaggtgagtgtggcaaaatcaagtaaaagttgactttcggagattttttttttcaaacggtgaagattttttccacgacaattcaatgacgatgaagagttgaatcgcatacagacactcggacagtacagtacagtatgcccacaataggccgtattttccgtgaaaggaaaggtccaatctgaaaaatactctcatttttctttttgttctcttcttcttctatcctcctcgtcttcctcgtgacttctccaaggtgaaaccctagctgctgcttccgccactcacgccgctcgccgccgacgccgactatcgccggaaacaggtcaacaggagagcccgttcaagtccgggacccctcaattgtccttttctctctctccccgcccaacttcccctgctctgccgccgcctccccagtccggcgtgcatcagcagcgacatcagagtcggcgatgggaggcgtcaccgacgttctcgtccccttatgttgatgaagtggcgtgccgtggagattcctttttgaccgatttcttgccggtaagtaaccctgtttcgcttgcacggattggcctaccaatccaaatctctccgtctagtttgctgcttagttgcttgatactacaatttaatatagcccatgcccatccactttagttactctagcctctgatccatccgtccatggttccatcaggttttttccttttctccgtcgtgcaagatcagtcctttctttttttctccgtccacggttcgatcaggttttaccttctcttcgtcgtgcaagatcaatccttcattttctccgtcgtgcaagggggtcagttgaatcagatgctccacgttacgtccacccttgagctcg

SEQ ID NO: 11576 - DNA, 1500 bp, Zea mays
atcaccggatgcaccacgccgattcccaacctaaggccttgttcgtttctaccggattggtgggtcggaatgattcctggccggattgtttctctaatttatacaaactttgattagctggaacgattccgggtgtaatccgacggaaacgaacaaggcctaagggaaaaaaatctcggctttgcccaccagattaccgccggtcggaaaatagatcgaaacaaacccgcaactgaccccaaatcccgacaccaaacccagcgaaaacagcaaccctcacccaaatccaccgcctgcgcgccccccgcgaccgagccttgacgaacccagcccgcaaacggcggatgcatcggggcacgcgcgcctcatcggatcgatgttccccacgaatggccggccgatcgcgcggaaaacgtgccccagagcaccacccggcgaccgaaaaaaaatcttaagaaaaagatgcggcaggacgacgatgtagacatcgtctgcgcagggagggggtgcgggagcttacatcggcgaccggcggcggggatgggtgcggaggaggtggctggattcgtcgcctcgagcgccgcgcacgcgcgcgagggggccgggtttgaggcggcggaggaggggaggacgagggaggaggccgaggcagggaggcaggcacgaattgttgtggagctgctcgtccccgactcgtgctcgcgttggttttggatttggagacgcggtgcgccaccctcgtgccgtgggtcgtggcgctcgtgtcgtgcatggagtggagtgagagggcgacgrggccgtgagactgctgtgtgggcccgtgttgtcagcgggttgcctctccaagctattgccggataagactctcctgtgggcgtgccctccaaatttaaatggtaattttttttaaaattatgcatacatataaaaattcgaaccattggctacaaaattcacattcacactcaacagaactcacaacgagaccagattctggattcattcgtacatagaaattcgtacacagccgcgtcctcagttggaaggagaaaggcccgttaaaggcccaactacaaccaatcaggtggaaatatataatgcgaagtgcgaagtaaccctaaaacagccaccaatccgactctcgtccctccccgactcaccccactgcccagccgcacgcgccgccgtgtgttcgcgctctctcccactgtgtctgtgacgactgggtaggctacagccgccgcccgtcgccaggtgccgatcccttcgccgacgaagagcatccaccaggtattcccatcccaccccctcctctcccctgtccgccgtacgaaaccgagttcccaaactctcgcatcatgctatttggttgtttgtgatgcctactaaacccctaacgttttgcagagagaaatcgacttcactagatccgcacctgggctggatggtttgacgccatgtatgatgtttcgatcgtttcaggctccggccaagggcgtg

SEQ ID NO: 11577 - DNA, 242 bp, Zea mays
aagtacgcgggccacttacgcaactggtcgcaatgggccagtcggtctttttccttcccctccgccgccaaatcgccaatgcttcctcgtgtgcccggcgccccggccctcctgtcgcccttgctgtctcgggagtcggggccccgtaaaaaaggcaaactcgaccccgcgaccgcttcctctgctcctcttcytcctctcctctcgcatccgcagcttccccagccagctagggtttgcag

SEQ ID NO: 11578 - DNA, 1500 bp, Zea mays
taacgacaaaacaaagttgtattgtatggcctaaattacagcacactgacaccacacgtatattattctctctccattatcacaggatgtaactgtaaaaattttgtatgttaaacatttgtagtaaatattgctagcatttacgtctacggaatttattgaaaaaatgtagtattgttttatataattttaataaaactgtaaatcgtctggcttcgtttctggatggaggataaatagtcaatacgaatgggaaacaccacaacaaccacgccgctgcgttctgcgaatcacatgagcgatcagtgccttgctgttccgtgaacttgcacgcaaggacgagagcctttctgccgttgcatgcaaggacaagagtctttacatgcaaggacaaataactcccacgcgccccaccgtgctttggcaagccacatggcaccctgccgatcacaattcacaggtccaggcttccttccggtggtcgcgtgccgtgagcctgacaccgcaccacatggccgccgtaggccgtgcctacgcaccaaggcgactcgtggtgccaggctctcggcggctttggagtctgtgccatgccgcggggtccgtggaccgctcctaggggccaggacgaagctgcaccgcacaagcgggccgcgcgtgacgccgtgaccgtgagtccgtgaccgtgaggcgggcgtaccaggaccttccgccacgcttgagatgagaccacgtgacggcgcagaggagctccacgcgatcaaaagcgcccgccacttctaaaggtcaggggtcttgcgttctgcccctcgtgcttccttcaaattctggacctagtggatcaatttacgtacacctcagcaaccgatgcagccagtaagtatgatgagcacgattgtgacgtgttggggtcatggtcaatggcaaccgagcacgaattggtagtgtcagctttttgtacacgtgatagcatttgattcgttcattcaatttgaactgtttgaacttatgtatagagaaattagtccaactcatgtttaataaatagtataaaacccatcgaatttctgaattatgatagcaggtatccattgtcatcgctcagtcacagaggcagccactgccgacgggcgacggccgacggcctcccatttcgatcccctcctactcctatgctgcggtccagcataagttcgggacttccggcaatccgccggcgcccgtcggctcaaatcgcatctaccgcggctagaagctctctcttcctccctccgatccggtggggtccatttccttcaattgtggcagtggccgtctcgaaccctctataaatcccccaccccggacacccttccccgaccacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaag

SEQ ID NO: 11579 - DNA, 576 bp, Zea mays
agctcctccggctgcagggccggccgcgcgcgtgttgccgcccccggtcccggagtgatacataataatatataccagttcatcgcttcttgtacttgaattttaccagtattttcatcttgggtgtgttttgatcgcttcacgcacgcgagtcgccagttgggagagtgtgtgtgtgtgtcttgggttgttgattcatgtgtactctccaacgatcaacctgtttacaccgctatatatattaatgcagtgagtatattgttggggacttgttctcaatgctaagagttaagaacaaggcaacataaaaagtgttaagtgttaaagtcattcgtccttcgaagcattatgtcccttcgggaaataatgagtttcggacgaaggtcataagagacataccttcgtaaacataacaagtaatgacgaaggattcatataaagcatgaaatataatataagcatcatcatagaatcatttctattttattaacatggaaaaatagaaatgatttcaaattacaaatgtaccttcggtcctgagagaaggtaaaaagtacaagcgtgacgcaaaagcaa

SEQ ID NO: 11580 - DNA, 817 bp, Zea mays
ctgcagggctgggcagcacaacagcatccacagatcagactgagcacagtaacgtccacgaacttgctgatcccttccccctgcgcaagtgacaatctcgttctcacctggagctggaggcatgtcgaacaacatggtctcttgcattgggtagcgtgcacgtttttgtaaaagatgtcatattccatttaaaaaattgagacacgcgacccaagaagcatttctttaatcgagacggtacggtgacttttggttggcccgctgaatttgatcggtcagaacctgtggctctctgctggagtgcactactagcttgatccgaagaacggaaaagtacacggcaatggcggcttctcttctgctgtattttgaccgtgctgattgctgaagaaagaaagaaagaaaagctcagctggtactctgtagtctgtactcctcccgatatgatgctcggttacaaagtacatcaaacacagagaagaccccttcggtcgaaggagaaaaatcagaggcgttggtcagcaacaatataactatttttccgatgattatagatcgcagtagatttactataaggtgtcgatctcccagcgacagacctccgctttacttgccaagttagtcgctttctttagaatttagatcacaaactcaacatgccccgaataacggaccagactcttcttcagtcgtcgcctcagctcctctccgtcttccaacttttctgctttaccgccctatataaccctcggtcggcaggccgcatgcaccaaccaacacaacacgaactagaactaggcgtggctcaccgttcgag

SEQ ID NO: 11581 - DNA, 1500 bp, Zea mays
gtgacgcgggcggcccccaaatccgcataacaatctctgttgcccccccgccaaaatcctcagatccccttgctgcagtgcagatctctctataatccgcgctcgtggcgacctctcctccagcttccgttcctgaaatccatctctagtttcgccatttgggttttttctcgagggtttcgctcctcactcatctgatttaacgaagggagctgggtcacacccacaggccgcggcttctgaaattcgatggccgtggctgcagcgcgcctgacgctcccagatcgattcgacgaggtttacatagcctctgcccggtgaaaagatgggctcgtgggttatacgcgcctcgcacatgcacgagctgaatttcttctcgccttttcgatcatgacgtctttcgtttttttgacgtatatgattttccctggtgctagcgccgagcgcaactgtggttgagatccaatgctcctcgttactccgtccacctttacctatggaccagtttgcatgtagttgcagtctttttctaatgtcgataatctgatgttgtggctagttctcctcgagtggcaatataatattctccggatgcacatgatttggatcatccgctgtggagtttagggttttgttcaggttttacaggctctgctttctggtatctagcagtgtttgtttctttcgttctgaatctcgcttttcgttctgaatcatctctcgtttcgggacatcctgagtcatctaattttttccttttgaataacgtctcctactaagacgggtatacccttttcaagcattggatttatcagttattattacccatgtctctcctttttcttttcaagaatatatctcttacttattatttatatacatcatgataagcctcagcactaagagacaatgttcatatttgtgtgtataaatagggaagtcaatggatcaggatccaaatgttttttcacaatatggttaattaattttagtttaaaaataaataaaaatatacatttaaataattttagtttaaaaatcatatgaatagagtttaatcctaatctaatttgatctttaaattttatagtctaaaatctaaaccacattaccacctctatgtacggtgttagtatttttttaacaaaatccgagcctaaacgagtattttagctcgtgagcttattgggccgtatgtctgagcagtccaagtcccagatctagggttcctagttccttccacaatactggcactcgactcccagtcccagaggctacggcggctaccttctcacttctaggttcgctctgaatccagcggcgcgaagagcaccgcgctcctttccggctcgcaccgaagccctaataccgtcttcttccgtccggcgcggactgctgggttcccgttcccgcatcgcggactgctgggttcgccgtttctgcacggtgcggacgccatgtcgggtgtcggcccacccccgtgaagcggttttgccgccc

SEQ ID NO: 11582 - DNA, 192 bp, Zea mays
ttgatccaatgacccattcaccaacgctgcaagcaacgcatgcgcaccttcagtccctcacttactcccggcacgtgcgcgccctgcctatatatactatacgtgcgcgcagagccgatcagcgagcacagcaagtcggcaatacactaggtgaagtctcactacactaggtgaaggtgcatccatctcgcc

SEQ ID NO: 11583 - DNA, 1199 bp, Zea mays
ctgcagcatagaaagtgacgtcgccgtcgccgcattcgcgccgccctgggctccgtccaactaccgttgcaaacccaggtgtgtctcctgactctcctcccgctctccgtcttacccatctctcctcagcacatccttttctcttgctaggcttgcctgacaccagaagctgctcccctctccgatccagcggcgccctgttcgactgcggcggcggcggctaccatcccgatccggtggcgccccggccttgctcgattcctacagctgctatccttttctacctgcggcgccctgctccactctagtggctgctcccctcccaatctggtgggtgtttactcaaatccccgttcgtcaccccgacggctgcgaggcagagagcggaccctgtgctcgaagccgtgcgccttcctcactgctccctgttcttgctcacacagacacaaacgattaaccacgtttcatctacgcttaatctccctaccacagctgaagccagtataatataaatatatgtcgtgatattgaatttttgcctgaagcctcagcttacattttttgttatatttgtagaaatttttgaaccaattctaagagctgatgccaattattgatgtgccactgtaacctgattaagtttccggaaaaatgtagattcgatttggcaaataaaggctagattagatattaaacctatcatggagtgcacgtgctgcatgtgcaagcgcaaaggtgccagcgattcaaatcgagttgggcccacatgtgcctgaaaattttttagctccgccttcaaaatttgagcgtcccgcccatctccccgtttcaattcttccactttgaattagatcccccgccaccacagcctgaagcacccaaatccatgagatttgccctaggtctattactggatagcaagtgctagttccatcaggggtcccaggtgcctaggttggatatccagacgacctaattgtgaggaagttttaggattcagccccttcccctcccatttcttggtgttctgatgcgattcagggtgctgcttcccgtgaacctagtggcaggagcagtagtagtatttggaccaggcaagccaagaatgcgataatttttggggttgctgccttcccatttgtgtttattttggtgctcaccaatctctctcggccgcatgctttctgcagagccccgag

SEQ ID NO: 11584 - DNA, 1251 bp, Zea mays
tcggtacccctgccgggctgatatccaaatgggagaaaagacagaaagttcaagcaaactgaaattgagcacatggtgacctattcatgctcacacaaatacttacgcccatttgggatcagatgcaccacagtcagcacaaatgtggttttcactcttttgcaacaactccttcagtttcgccatcttagctggaaggcaaaggtgaatgtgagttcataatataagcgaagctgctgtgaccttaatacataatataagtatacttgatagagaaaactagtggctgtaccataaatgtagcaaaaagtgtcaaaaattggaaagccttcagggaaaaaattgcacttgtgttttcggcagatcgtgtgtgcattatcacgaacatatatgtatttgctcaaggttgctacagaatattccagtgcgagcaccaggaatttgtgccatgccactccgaggtggtcacagaaagccatttacgcatacctgaggtcgcagtgtcaccatgcccactcatcttgggtgcaagaaagctcggccgcaaatgcgtcaaatcgtactcaatcctgccaaatggatgttgagcacgaaaaaaacgtgaataaaagaagcatgtaaattccaaagtttgaagaataccgttgggattactgaaagcggagagtacttgcttccaaattcctagccaacgtggccacgcaatgcgtagattttactgtgaattgggaccaagcgcagctgaaatccccatccggaattaaagacgcctcgccgtgctgccgcagcgacgggacagcccgccgccccgccaccgcggtagccgcgggccggctgccaaccccgggccccggctgcacccggcgggcgacgacgacaaggcggccccggaaggccgcagcgcagtggcgcgggccacgtgccgctgctgtgtggacctgggctgccgccgccacctgttccgcacgcgggcgagcgggccaacgacgcttctcggaaggcgggggcgcgaccgggacacgttatcgaatcttgggcgttgactggaggagcacgccgatccaacggatggcagcgtctggtggcccgctggctgggtcactataaaggcgtcgtatcctgtgcgcaaagagccctggtgctcgctgagccccgcggccgtgtccaattcctcctccgacacacacacacacataacaacgagcagcacagctcacgctcggctacgacgactacgatccgcgcgcgtcg

SEQ ID NO: 11585 - DNA, 732 bp, Zea mays
tcgacgcgcgcggatcgtagtcgtcgtagccgagcgtgagctgtgctgctcgttgttatgtgtgtgtgtgtgtcggaggaggaattggacacggccgcggggctcagcgagcaccagggctctttgcgcacaggatacgacgcctttatagtgacccagccagcgggccaccagacgctgccatccgttggatcggcgtgctcctccagtcaacgcccaagattcgataacgtgtcccggtcgcgcccccgccttccgagaagcgtcgttggcccgctcgcccgcgtgcggaacaggtggcggcggcagcccaggtccacacagcagcggcacgtggcccgcgccactgcgctgcggccttccggggccgccttgtcgtcgtcgcccgccgggtgcagccggggcccggggttggcagccggcccgcggctaccgcggtggcggggcggcgggctgtcccgtcgctgcggcagcacggcgaggcgtctttaattccggatggggatttcagctgcgcttggtcccaattcacagtaaaatctacgcattgcgtggccacgttggctaggaatttggaagcaagtactctccgctttcagtaatcccaacggtattcttcaaactttggaatttacatgcttcttttattcacgtttttttcgtgctcaacatccatttggcaggattgagtacgatttgacgcatttgcggccgagctttcttgcacccaag

SEQ ID NO: 11586 - DNA, 626 bp, Zea mays
tgatctatttttatgatggcactctcagcttccgctattgtgatccaagtacgtcgtccatcacgaaacgcacggcacagatattgccacgcactgcccacaaggtgctcggcattgcggcgcacgaactcgaaaccgcagaaaacccacgcctttctagctcctgcagtcctgctgttagtgctgttcccctctctcttccccgtcctgcaggctccaggcgctgctgctctcgtcctccgctagcgagcgaatcgctgacgctggcccgacgccgcggcgggaggtatctcgctttcgatcaggtgcgcgtcctactctaactcccagtcgccttcctcatctggctttcgattcggtccggtctgcgcccaacccgtgcgctgggcgaagcttccggaagcttcagggtttatcccggcatttcgttttcagcgacggcgcgcccggatcgcttgatctgacggagtttctatctaggattttggttggggcgtcgttctccggtgcttatctcatttctatttatcggtgcctcgggttcacggccaaattcgctgctgcgtggggctttggagattggagccgattccttaaagtggcggtggcagcgtctggtgggaacc

SEQ ID NO: 11587 - DNA, 969 bp, Zea mays
cataccttctcagttttgtttaggtgttagttcaattctgaagtcataccatcaatattattttttttgttatatttattgttccatatatctcttattgcatctcaagaacattctgaagtcacaaaatgctctcggtttaggtcttgatatagacacacccattgatgtaacgagagcacaacttgcatataaactttctgatgaggtaactcttttcttatacaactttgttgctgcatatttgtttttttatttttgggatgaaatttacatcaacacttatagttatagaggaatgtcattttatattcatgctaggtaaatacctgtatgttgcaacaagaaaaaataatgcagcaataacatatgtatgaccatatattgtgctgtcaaccaaaattaagttgtctctagaactttagagtagtcctacatcttttaagatatataaacatccacgtataggataacatttagtatttttgcatatcaatgtattttaacatattggttccgttgcaacgtacgagcatatacctagtggatagtataagtgtcatcacacggtgtcgatttaacggtagayagaaaaaaggtaagcttacattgatgcggcacgaggcaagtggcagggttggcatgccgctggacgaaggaagcgactcggcctcacctcacctgcaagtctacaaccatcggatgaaggatcggcgcagcagatcgaaccggtgaggtgtccccgtggtctgccctcctcgcgcgtttgacagaaacatttccatttgttttctccttgcgtaccattcttttaatcgaaaattcctctttgtttcatggaatccctacgtctatatatacagagctgggatgcatgtcatgtcaggtcgtctttctatataggacacaccttagcgagcgagacgatcgagaggctgccgtacgtgccggtctctctcgtcggcggcg

SEQ ID NO: 11588 - DNA, 692 bp, Zea mays
ataataagattttgaaataatctgaattgaactatccaaaagaaattccaattatttaatatgaatgaataattcggattaattaataaatgtacttttatgtgtcgaattcctcggtacaatattcttagaacgaatccctccattatcattatatagaacaaaagtttttggtatattgtgtcctcagtattcttttcctatcaaagaacttttttttataatagaattctcataaaaacgaggattctattataaaaagtagactattcttgcaataggacttacaacctccacctaatcttatccaaaattcccatataaatgggtttaggactggtacatcatattaataagagtgtaaaggctttcattctatcaatttttctaaaatacaaaatgcatttcattgtagttaatgatgaacttctaatgatgaacttctaatgttcctaaattctatggcttctcccagtctcgacgattcacgataaaataactattattcttttaagttaactattattttaaattagccgccatggtgaaattggtagacacgctgctcttaggaagcagtgctcaagcatctcggttcgaatccgagtggcggcattctcgaaaaagaatacaataaattagaaaatggattcaattcgaaatttccaattttgtaatgggaccttatcgtt

SEQ ID NO: 11589 - DNA, 185 bp, Zea mays
tcttaaaaaacttcttgtcttatccacattagacaaaatgaactatagaagaatttagaatttaagtatctttcagtatctttcagtatctaagtataaatactaagaaaaaacagaaagaaggattgatttgtggcaatagatgtctttcacatacaactagaaaaaagtaattccctttttga

SEQ ID NO: 11590 - DNA, 266 bp, Zea mays
aaattggttcgttcccccctgcagttttaatttgcactatatatcgaaacagttccctgctgatgaactcgctactagtgtttttgatgctatatacaggtagtggtgcttctgcattatgtctatatcacggggacgctgagctatgcaagagatatatatcttaataaaactagagagctgctgcttgtatttaatttgtatatacctctagctgctcatgcagccgtctctggacttcgatctgcatctggagggcttcactt

SEQ ID NO: 11591 - DNA, 754 bp, Zea mays
cagtttgcagtacatcttttttttttcttctcaaatgggattcagtccgtgcactagtagtacatgccggtgatatcgctattgtgtccgatatcaaagttgtctctaaatgtagatctttttcattattatatccttgttctgaaacttgttcttgatgctccctgctctccctccttagctttgaaaacctcgcttctgtcgagtccaacaaactctgaaataacctggagaatgtctggccactctcaaaactgcaaatggcaggcttggctttaccctatgatgctaatccatgttggtgcaggtgggtagacaagaacacagatggatcaatcagcgtctggagcgacgcggctgtgcgcctggccctccgtcgcggtctgttacctatatctccgcaaaggcacatggataaattttttcaaggctgaagcagttattagttgcaatctccagcataacaaattcgcgaatccgactctcgagcgtacctaccatggatccaaaaatcttagggatacccatggcctaaacttgttgctgaatccccgctgcctccacggcgtccatgccctagctatttgatgcttgcttcagcccagggttttcctccgaatcccccttctccagcctcagctcccctctccaatcgcagttgcagttgcggctgggctaggctttcgtcagcagcactttcctcccctcggctcttgacagatcgaactgcttccatcagcaattcaatcgggag

SEQ ID NO: 11592 - DNA, 251 bp, Zea mays
tgcatgcctgcagctcatcacgtgcacacaatcagctacctagcccaaggtaagtagaaaagctgaagcttctataagagaagcacaacagaggggacaatgcaggcgtgttcgtgcttcgaagaaacctaattgtgctggaaacagccattttcattctcaagactgtttgcgcaaatctctgcaataatctaatgttgtacttgtccatattgcatgtttaggtttgtatttaatcacgttcatcaaat

SEQ ID NO: 11593 - DNA, 1410 bp, Zea mays
tttttaatataattagatatgaagggaaacatgtcacttattttctctaatataacaacataaaaagccatcaatccaactaccgataattttctagcctacttccgaccagctaattgcaactattagagacattgacattaataaaaaattatttacatgcctatagactatggtttgaaacattcacaagacattatgatcctgagaccgtgaagataacaaggagatcatttttagattctaagcgaaaacgtaaataacaagtcatcgattggcgaccaatggatctacctaaaattgaataagaaatttacttgcgtttagttgagaaactaatcaagtgattgttattattgtaaaagagtaaatagaatgtttcaaatggctttaaaccttcaacataagtcacatgctcaagatgtacaagctcgagaaaagttaaattgatgaaggccctcaacttatcaaagtagcaattgaatttgaattgaagaaaagctcagctggatgatcaacttttattatttatttcagttgaattagtggcggaggacaaaagataaatgaagtatgacaacatacctggtttctggtagaataaaaaaatggtgcaaactacaagaatgtacctggtagttaggagaaaaagaaaaaaaaatggaccaacagaagggatcaaatatcgaccaaagcacaaccactattccacatatgctttagtactcaagtgagatataaaatttgaatatgctttagtactcaagtgagatataaaatttaaggtatgacagctgtcatgctgcgctataacgggtgctccgccactgagttgaatattaccacactagctccagtgctgacagtgctgaattgtagtttataatgttaatttaaataattttaaaaatattttaatctaaaattaaacaaaatgacttgtctaaatgtcttctaaagacttacaactataactctatgattttttggagcacctaataatctgcttcactaactttagcaaattttctgaagccagagctatcctaaattggtgctaaatccagaactgatttcctttttaaagattacacctttatggccagcaatatactagaacgcgggcctaaccaacacgaggcccaatccactgcaggtccacgcacgaatctcgacaccacatcgctgccgtccagctaacacggctgactggaaccttcatcttcttccctgccaagaaaggccaaaggggaggagatgcggcgtcccgtgcacgccttaaaaacgagatccctggggtcaccactggtcaactgcgtcactgcgccgaatcactagaaaccccaacaaacggaatttcacacatccagcgagcaataccgcaccgcaggtaagatcaaagaggaggcg

SEQ ID NO: 11594 - DNA, 206 bp, Zea mays
ggtaaggctacatacttcacatgtctcacgtcgtctttccatagctcgctgcctcttagcggcttgcctgcggtcgctccatcctcggttgctgtctgtgttttccacagctgggagcatctgttgaggaagggccggactactgcatcatcacgccgccggagaagctgaacgtgacggcgatcgacacgtacgacgaccacagg

SEQ ID NO: 11595 - DNA, 466 bp, Zea mays
ccgcaatatattcttgttaggctagcacatacaacatattataaacatgatggattatgctttgcgacaatctttacagtgcaacttaagaatgctatgctctaactttatacatttcaactgtctataaatatttaatcaatataatttcattttagtacctaaagtctctgatcttagttgttcaatgaatttaatgtgcatttatcctctgtgcatgtaacgcacaataactgtagggccattttctttcgttgcacaaatgcacacagaatattctgaaattcggtaccccccgtgtcacccagggaaaaagactgggaaggccccatggtcctaggttcaaaatgaagcctcaacatttcatggcttatgtggaatgagtaatgtagtgtagaagatctatctcttggctggcaacaattatctatgtacagactacaaaacgtaacattgatatgacgat

SEQ ID NO: 11596 - DNA, 717 bp, Zea mays
ttgtgcagattaaactttgtgctaagcacaagtaatgacacaatatttcactccagtatggacatggctttaagtaaaaaagacccaccagatacatctcttgttactgatattaatatcgtaaactacaaagtatttgatatgtgcatgcttaagctgcattacctgaagcttgtttcaaatacaccagcagtcagccagccgtacatgaaattcgtagggtatgtttataactgccttgtcacttgggagcattgcgttaaatatcagtgtttgatgtatctggtgcttctattcttcaaccgtaggcatgccctcacatccatgctgagtactgacattgcctgtatttggtctagatatgtgttgaagttcttgaccactcacttcccttctgttttttttctttccagacttcctatgctgcaagatctcaattgttctggacaatataaagtactaccttaagaaaacaagtataataccaaaaaaacactaaacaacaggggcacacttttcacttgtttgtggttatgctattcctaaattttctaattttcaatcaattgatgcacccagcttctatgcataccctgtgctgactactgacattgtgtgcgcttttagtgaagagatgtaggatttcttgatcactctctccccttggttttgcataccactctttgtgctgcaagattgtccatttgttaattttga

SEQ ID NO: 11597 - DNA, 1500 bp, Zea mays
agacagacctcacgggtatcttcaactttcaaattccctgcacacaaagactaaaacaaacggacgtccctgctgacggcaatcacgaagtgaaattgtgaaataacaggacacagatttaattcatttccacaggattatattcatgggttaacttaatttaaaagtagccatccgtttcttttcttcttgttttcttgataatacctgactgtataatgtattaaagcctttgtagaacaatacaaggaagcttacagagcaggtaagcctcctacactacacagaattacaggaagggaacgctcatattacgtacagatccgggaacttcatctcatctgtgttcactattccgattccgatttccgaactgggacaaactggatccattccacaccctgcatggacgccgaaacgaaccatctcttatctaaccaaaacaaaaaaaaacaaaaacgtctcgtaaaatacagcagaataaagccacatatagtagcaatatatcaacatgaggacgggcggaggcaggcagggcccacgtcatccagccacgccgccggcccagtcgctcttatccagatcgcggagggccgggcgtcctcgcgattccgacggcccagctgcctcccctatccgccatccgacggcgtgcgctgcccttccggacctttccgcgcggttccgtctcaccagcacgtcacaggaaaccgtccgcggaaacccttcgccctcgtcggggccgtccgtccggagaccgacggacggggcgcgttccgggcacggggagccaatccggtgtgcccgcgcggcccacccgccatcatggtgtccgtccagatttgtcccttttcggatacaccctcgtaggtttctcgtttcaggtcgggctcccggccggcccggggcgccgggccggggtgcggctgcgttcgaaattcgattagtgtgaagtggagggggctttgtgacaagcgatagagaaatgagcttcgctgttcgagaaaacagcagagcccggccgaattcgttgggcagcctgcggagatgcagtagaggccgccaggcgcagatggaatgagcgaccgggctctgctccgccgctagcctgccgccgcaccgcgccgtcgatcgccgcgccatgaacggtccccgcggctaccccctttctccaccggcaccttacccccgtatggtgagcgccgagatttgagctgccgtctctccttcgcatcggttgaattcttgcccccgctttttttttcatgttccggactgttgattcctaggggaagtcttgtaattttttttgtttgtttcacggattattggagatacttgccttctttttttgtttcccccatcctcatcctcctggcggtggctggtttgcaggcgtgatccaatgatagcaccaagagcgcaccttcccctctccctgacggcgtcgtcctccccgcacggcggcgcgcgcacccgcaccaagaagaggaataatcc

SEQ ID NO: 11598 - DNA, 216 bp, Zea mays
ggtaatgactgaactcttgcctatcaggctaagtccgctggcattggaactgacgaagttttttcagagggacaaggcagcttcggcagcaaaaagtcctgtgaagccgaaaaacggagaattattcaagtaacagatgtgatccatcagacgccgccgccggcaacggtgtcaaaaattgcttttgctgaaactgccgaagccgaagttactgga

SEQ ID NO: 11599 - DNA, 1230 bp, Zea mays
tgtctgatcgcggtgaccgaaaacgatgtgtttgggacgcaaggttcttgtgactgagaaaagccatcgagaacaaggaggcattgtggagctgctttttttttcccaccctcatcctcatgtgccggttactgattagtgtagctcacatctccagtacggttctgctttgccgctttgcccgcaccgtttcatcatcagcggtatcatctgactgtctgatgcatcgacgcgttcacttttctgtgatccagcctggtgaggaaagaagcaatcatcgccatcgatcccgatatactgatagataatttgaagtgactgttttttttggcaggggtaaatgagctccctttgctgtggaaggtgggagcctgttcagctactagcagaaagtgagtgaggctcactcactcactaaagccaaggctatccgatacgttacctcagaaacgacttgcctggcgcttggctaccagacaccgacactatcaagctagctgcaagttaaaaaaaacacacacatgtgcttaaaggctggaacgttcggcagttgacacggcataggtctctgtcttttatgatcgatccatcactttccttgcaatttttgtatcatgaatctgtcctacacatcatcagcaacaaacctgtactagacatttattaatgcactatccgctaggcaatacagttgctggttccaaatgttaacttctgattgaacacacagtaagcttttaaggaattagagaggaaaaagaaaagatttcctttttgtttgttgtggctagtaaagcaaacccactgaatcagtgagctcagtgcaggaggagagtgaaagcagcttcacttccaccggtgaagaagcgtcggaccgcaccgcgcacatattccctccgtgggggccaagcaatctctccagcagaacgatctccgcgacactgatctggacctggtttgggtttcacagggacacgcgggcgatcatgccgcgacggggacgacagcgaatccccacgggagaagcttccatccaccatgattgatcgcatcgaaagcgatgcgatgcgcccctgctccaaagaggccagtcagagcccaggtgaatccgattctgtcaaaagcgaggctcggctccagctacaaattgcgcccatgctgccggtaccagtccctaccaccagtgtcccgtccccggtttgactgccgagctgattcgtgtgggcgtca

SEQ ID NO: 11600 - DNA, 561 bp, Zea mays
cgtacttaatactttaagtacgtcgacactactaaaccgacatagataaattaagtatgtcggagccgtacttactcgcttaagtatgtcagaaaacataggtcggttaatcgacgtacttaatctaagcacgtcgatttattagagtaagaatatcagttatactggtcgacattctttaaacgtttttttcctgtagtgaaagtgatgaaaaagaacataagatgttggatataggagatcttctatgcacattgtaaggatacatcagatagtatatctcggggagttgcttcttgtatttggaggtaaagatctaactaacccacaaggccgcaccaagcattaggctcccagtcctcatcacccacctcccaccagctgctgatgttacgaacgttttgctgaatcttgaagcatcaaccaaaagtccaaacctaaagtattgccatcccaacgcacaacccttggcaggcacttgaaaggccaaaaaggctaaagaaaacacaacaaaactcgtcagtagctgagtagccactgcccactgtgctcttgagaagg

SEQ ID NO: 11601 - DNA, 47 bp, Zea mays
caggtcgccgaacgcatcgccgaacaacccgctctggagcccaccgc

SEQ ID NO: 11602 - DNA, 1500 bp, Zea mays
gcctgcctttaattttcttcgcaaacacatacacttgcttttttgtttaagaaaacgtgtatggtggtgcgtacctgatgactgacaatgtacgagggaacttctactggcaggtgtggcatgtgctcttcaatgatgagatcatgcaaatcgtgccatatatcgaagtctgcatgatactaatggttgtaatgtagtagtgaaacagctaaattaaaataacaaaatttatgtatggctaatattacaaatggattatgaaacattttcttataacaatataagacacattttgtatataagttattatattattatatgttctcgttgcaacgcacgggcactcatctagtatagtttagaatcatttaaaacttttaaaaatcttatttaagttttcttatttattattactcttgatacatatattcataatttacacaagaacttaagaaagaccaagaggacactaatttatatgacctatgtcaagtaggagtacaaatagaatataagtgtcatttcattatacatcttcattctactttatttaaatacataataatgattttattattgtatacttcttaccttgtatacttaatgtgacctcctactttatatattattattactaattttatatgaatatatgacttgcgtgaatttttgaagtcaattgagagtacatgttacagtttttaccgatcgaattttagattccgatcaaacccggtgtaattttcgtaccgaactttcgttttcgatgtttccgaattacctgtcgttttcgtttccggagctaccgttttcgatctcgtttctaaggagaaatatgaaaacgaaaataggtgtggagataaggatgcggacgagtatggcttcatgaggatgggtccagtggggaattccccattaacacctctacatcagctagatatctcaagatcgaatgaggccacagtatttatttctgatagcggaagataaggatttgaagatacgtagtcccttgcgaaataaatcatgtagtcccacccactgcaattttgcatgcaaaataaacgtgaccactgatctgctatatcttaataacatgtgagcaaaattaaaagcaaatgatttttactctcactgcaattctacatgcaaaaccatttgcgtaatacaggcgtacaactagctacaggctacagcgtagccgcacaggtggttgtagaacgtgaatgcgccaaccgcgattgttgcccactagtatgttgtataaaatagaagcaagagtgcaagacggcgacgacaatgcctccaaacagatcaaatcagcctcgcgtaccttgcttgctcccttcccttcctttcccttcctgcgcaattattgattgcaaattcgaagcctctcggacaggctccttgatttcagcaacattcgcgtcactcgtctcagaatctcagtcatcaatcgtcagagctaaaaaaaattgttcttgatcgagcagcgcc

SEQ ID NO: 11603 - DNA, 167 bp, Zea mays
atttggcttgaaggaagcgggatctttctggacaatggctgtctagcttcatccattctggtaacaaagaaaaaaacaagaaacatctggtatctgagtccagtagaaagttgtgcaaagagaagagcaaaatatctacaccagacgtctcttttaggtacagaggg

SEQ ID NO: 11604 - DNA, 580 bp, Zea mays
tgcctgaacagcaaacgtccggcgtgcagagcgcctttcactgctgctctgaatttcatcatccaatgagcatgagccactactagtgtcaataggcaagacggtgtgccgtgccactaggcaagtacggcttggttcatccctgctgggccaattggagcccatttatatggatggatccttggaattgtttgatccatcggattgttcctctgtggaagcccaactacactcgagtggtaccgtacgccattcacccttttacgagaggattgttctattcacgagaagggccaagactagtagcatcttgtatcgtcatcgccgtgatcccatggcacctcttcccttcgcactccgtgcccggccgccgtcctgcccatacgcccatacgggtaatgccataccccatcacaacggtccgtctatcccttcccttggaaacgtccacgcatcctccgtctccgtccccatctcgcgaagctagcgggaataacaagcaacgatacctacgacgacctacccccctttccctgctctctccttccaactcttgtttctgcaacgccagggcgcaacc

SEQ ID NO: 11605 - DNA, 668 bp, Zea mays
gcgacgacgacgcgcgcagcagtggggagcgacgacggcgcgcgcgcagcagcagtgggaagcgaccgagcgagacaaggaaaaggaggtgaagaggacagctgcttgcctgcttctgtgacacatgcgacaaaatgggaaagtgaagaggcgcgagaataccaaaatcaaacagtgaaaaggaaccccgatcggacggcgcacaaggcgagcacaaacagccacagaaacacgcgcgcgtccgttagcttttccctaattttattttatttttgccttaagagggaagggtgaggtagaaaggtcgttgaaactgttgttttaatatagtatagacagagatagaggtatacattaccaataactaatgtgtggaagaaaatttacaatttatttctaaggcccaataatgaaactggcttcaagtgatactagctgggatttagctcgaaatggcccacgtgccgatcggagctgggccggaaaatgcttgttcaggctttgaaattaacaccaaataaaaagaagaatggcgggcgcgtagagcattcgcagtagcagataaggcgcgttgcgttatctaatccgtccaagaggctgcggtgctcgctcaggctcactgctcagtgctcactgctcactagctaaaaacatctcctttcttatcc

SEQ ID NO: 11606 - DNA, 55 bp, Zea mays
ggtaggtaacaggggagcgcacgcatatggagcgtgcgagggcgtctccgacgtc

SEQ ID NO: 11607 - DNA, 582 bp, Zea mays
tgagttgtcgaacacttagtatagagttgagacattttaatttgtttttagtcgtactataaagagatgttgtatatgagtaacttgatcaagacatgtctagtgtagcgttggtgtatatactcacataaaactagtgctaatagcccacacaaagtttgaagtgaaaatcgatttgaaaaatctaagttagaaagagttggactcactcaataccctccgatcatagtgtaaataaaaaattacaccacagaaatttaattatatttgaattatttaataggtttctatagaatccaatctgaaaatttgataagatttcataatatccactctgaaaaaatggaaacaaaggtctgccaaatgggtccacagtgccacgccgttccgtacacggaacagatgacctcagccagatcagaaacgtcgctattgagtccgttttttttttaaaatgtaatacgcataaaacttccaagaaatttttgcagacaaaaacgaaggccccagcgcctgacctccaaagcccaccttttcccaccgtttctttcctcacctcccgcgacagcaccggtagctgcc

SEQ ID NO: 11608 - DNA, 1128 bp, Zea mays
ggacggaatataaaaaaacaaattaaaaagcgggtatgtggacactttgccgagtgttgcactcggcaaagggtacaaccaaggtagaatagctggtaaccgggaaattatctttgtgagtgttatgtctaaggtactcggcaaaggctccacgtttgccgartgatatgtctcaggtactcggcagacgtgcaatcttttgccgagtgcttcagcaactggcactcggcaaaggatcaacctctgtcgagtgtcatacggcgcactcggtatagaaactatgcagggaggcccgtcggaggttttttgccgagtgcctcagacccaggcaaaaggctctgtcacagtcacccgctgccgtcacgacgactttactttaccgartggccaattgcaagtacccgacaaacaagccgttgtcaccgatgaccaccgttttaacgagccttctttgtcgagtgcgtgctttcgagcctttgcagaactcggcaaataagccgtgtccagtagtgtaagggagacaagggcaaaaaaaaaagagggtaatacagaatgtagaagtggtgtggacgtgtcttttgtttgttggatccccataatcctgcgagcaattatattgtcgtgcagctgcagctagcctgcagtgcatcgatgaatcaacaacacgtactggtttagtgttaacgtacatgttcctaaatcgtaacgggtggccattatcctgaacacaagagggccgacgtacggttgtaaaaatatactacattattactactacggaaaaaggttggtttgccagtacgtgggttttcaccaccgagagacgattattgttgaaacgaagccgtggtagctgaccaggtgacgacgcgagaacgagcgagaactagccatacccacgcgacccaactaactactaaagcaccccgtggcggcccttgcgcccgtccaactcacctaacccgaccgcgcggctatataagcaccgcaccccggcgggcctcctctgccattaagactagctaactagcgtgaaagagctcctccgacgactactagctctcgcttgctccgacgacccctgccggccgcctctggtacaacgtacgagaggaagagagacgatcg

SEQ ID NO: 11609 - DNA, 395 bp, Zea mays
gtattattggaatttttatgtttaatgtatgcaattttcatgcttatttgttgagtgtcaaactttatatctatatatcaaattgtttaccaaatttactatgaaattatatatacattagatagaattctacatgaaaattttgttgcggcacaccctatgtaaaaattctaggtccgccactgccggttactaaggtggaactgtataaatggatttactatctttttctaacgacttaagcttttggttctcaaccagtaacatggaccactccactcattggtaacatgaaccgacgataatgatggactatcaccaacggttattgttaccaaccattggtgataattgcccccattttcatcaatggttcgtaacatgaaccggcggtg

SEQ ID NO: 11610 - DNA, 433 bp, Zea mays
gggccagccgtgatagggaatttctcgaacaagagattgtcgaagattccagatcaatttaataggtcaagtccattacgtagaaggcagtccatagcaaagtagaatgaattctagcccaactgtgagatttggccgccacacttgtggctcaaaagtgtggcgcggtgtgtcgtcttaggcgccacaccaaacacgcccctagtaggttctagcccacgctggggcacacgagaaaactccggaaacgcacagacaggccctcccgtcgcttcctataaattgagcccccgcgtcggcactcggcactcgccatcacaagccagaacagccaagaacagagatacccaagtcaccgaagcaaccgctcacaatcccaatctcccgcgtcactcaaaacccgaagtaacaaccgtcatcggtccgaccaaca

SEQ ID NO: 11611 - DNA, 1093 bp, Zea mays
cccaaacctggcagccctccggctgatccagcgtcttcctcgccatcgccgacacgctcaccggcgatccactgctcggctcacgtccggcgtaggcgcgtcgtggccacgggtcgtcacacggtgctctcagcgaacttgccccaccggcccgcccttcccgggccttacctgattccccgtcctccagcgctgggcgctggctgtgctgcagcgtagccgcacctccagacctccgccgggtcccctggctgctggcgacgaacgcccctgcgcagtgcgtgtgcgccagtgcctgccggcggccgaccgcagttctttgccttgcctctgttgctcgtcttcttgcatttctggtgagcaaaataagtactgagacattagattaggtgttggcccatgcttggaattgcttgttgactgcttgtgaaatgtgaatcagttgttggtagacagtacaaaatagggacgaaggtttccatatgcccgtgattggtgattggttgtgaaatgtgaatttatgatttaacatatctgcatataattggggcttaggactgatcactgatgtgccttctttttgcttgttttctgtaagaccgactcttatgtttcaacaatttaattgtcggctgtgtaagttttgaacttttctgttgaatttaaggtattgtgaggtcttatagatacattatctctctttaccaaaccgtttaccaaattttgtattgtattgtatagggactttttagttaggcacaccctgtattctaatcttgggtcttcaccgcatggaaacattgatgtacagcaccacaatagagagtagattaaggtcagtaaaatgtaatttgttacatgttctagagttgatgtacgacaatacaatacagagttcatttccgtggatcactgaaataaaatttcttcatgtgcttagagtacaatacagagttcattcgaaatggatgaagatgaaatgctcaatactttcatgtccattagaaggcataagcccaaacaagaagtaatattgacttattgtagatagatgtgtaaacttcttgtttcacactctgctacttcaacacag

SEQ ID NO: 11612 - DNA, 469 bp, Zea mays
ccggggcaggagaaataaacatatggccataaaggaagtgcttcatactgtctaagatacgtatacgaagaagaagaagaagctgcaagcgctcggcatgcatctagcacgtactacttacgtagtatgtgtattttatactgtatggaatattttttttgctaggagtaggaccaaccaacttgcgccacttggatgcagcaccaagccaagccacttggactgacaacgtacggtcggcgcggtgaatgtagtcaagtagtactactacttgctttttctgtgcttctgtgagaaattaaaagaggaaggggagagacatgacacaagagaacgtacggatgaatagctagctcactgccgtactatattttttagtagagcaacgataaataaataaaggacgggagcgcgtgcacgttcatcatcagctacactacagctaggctttgagaggagctgagagagg

SEQ ID NO: 11613 - DNA, 186 bp, Zea mays
gccctttggaacccgatcccgggcgcaccagctggcaggggaattccctttttgcccctcactccgcctataaattaccccacaccgcgaggccttgtgatgaatctactcccatttctctgcacgcagctcagtctcgtccatccagtgctgtagaattttctttggtctgttggcaaggcagcc

SEQ ID NO: 11614 - DNA, 189 bp, Zea mays
gggaattccaatttcctccccacctccgcccgcttcccagttcccagtgcacagccgattcgtctccattcctatcttctcccattccctccccagtccgacctccgaccccccatttcgtcgccgccgccgtactcgccgagaacccgccccaaatccataggcccatcccttacccattaaccccca

SEQ ID NO: 11615 - DNA, 133 bp, Zea mays
tttcttccgctgttccgcatcgcatcgcatcgcctcgcctcgccgccagcgcaactccagccctggccgggatctctttcacccccccctctctctccgccgcttcgctcccccgtctcggggcctgcctcgg

SEQ ID NO: 11616 - DNA, 1500 bp, Zea mays
agttcgacattgtttttattttttatctatccaggctcttcctaaatttttgtgatgttcggaacatagttgttccgaaaatcagtgcatccggtgtttatttaaaattcatcgctcacgtaaatacgaatttgggaattcagtccagtcctccgatttttatcccgaaccaattaatttgaactcgacgacaaaaatgttcggagtaaaataatctgaatcgcgtatcgtccgagaaaaatcatgcgcgagattatgatcccattcgttcgtcagcacgttgttgtggcgataaaatcgtgtatacgatagcgaatttggtttcgactaattttagtcgaatcccacagagccaattatcgaagacgaaatcagtcttattcgggtcgtcgtttctcgtcggattcaaatcttcaaatataaataaagggtaagaattcatctgacactgaaaatatttatcgaatcaaatggaacacagtccgaaatattgttgttaacatcattctgatttgttctgattacgtctcgtctcgatctgaatttctagatgtaaataacgggagaaaactcaactgattccgaaaaatttaccaaatcacatcctgtcaaatggttgttatcaatcctaattattcgatccatttttcgctaaaatctggagttagaaatatctgcgaatttctaaaaacaaaaaagataaaagaaaatcaaaaaaaggaaaaatatcccgccgggccttatcccgccgcccccctgttcagatttttcacgctgcgtcgctgcttcttctttatcttctccctagccgccttcatcttgttcgtggctccagtgcccacacggtcacggagcaccggttctggtgctgcggaagcagccatccgcgcccaggctcgccctcgctccatctcttccctgacgcgcgtcctccctgcatcgcgcgtcgtgctccgtgcgcgcgctcatctctctccgcgccgcgcgtctgggtgcctgcacgcgcctggagtctcctcgccgtgcgccgttgctccatggccggctccttgagcttggcccctggcttctctgctacgcgcgcgcggtttcctctctcctcccttcatttctcttcagccgtcgcgccctggttctctgctcggccatggaggtcgcggttccctgatctcctgctcgcctggccacgccgagctccatccagggccggagtctcctctttgctcggatttcgtcgggcccacgagctcccctacgcgctcgtactctagctcggttttccttcaccacggctctccctctccaagctccctcccccagcttctctctccccatggccgcggcacccctgctccctggtacagcgcgcagcttgcctgctcggctgtagccgccgcgcgttcccctgccctcggcttcctgcatcgcgtggtcgcgtcgcgcccctcccttttctccagctcgaccgttcctcctctcttttcctgctaatcgcgcgcc

SEQ ID NO: 11617 - DNA, 398 bp, Zea mays
tgtaaggcggagtcggcttgctttaagagtttgaagttatacagtagaaacttactattcaggctacggctccattccggccctcagtcgattgtggggtgccacatcgccatatagcatctaactgctttgtgtaggtagtctattttggtgtttgaatgcactagagcctagttagctgctaaaattagctgaagacaaccaaacattatatctgttcagctattagctaattttagcaatttagctaacaattagctagttatttgttagttagctaattttagtagcattttttagccaacaaactattggttctagtgcattcaaacaccccctatctctagctcttctggtaaaaacatatttggcgctcagggacaacattctaccgtagc

SEQ ID NO: 11618 - DNA, 181 bp, Zea mays
ggttctcatatgcctggagttccacagatgatgcctcacatgcatctgcacccacagcagatacctgggcaaccgccgatggttaggatgccaggtcaaatggttcatatgccaaccagcattcctccgcctcctggccaaactcagtttatgcctgggtccaccaccacacacatttgct

SEQ ID NO: 11619 - DNA, 207 bp, Zea mays
ggtacctgtgcaagcatactgtagtaccgtacaagggataactcaaaaagaaatggtgtgttggatctttgcactactttggttctgacttctgaacctctgctgtagctccttttctaaagtgctttttgtaaagaaagttctcctgtggccaccagagcaaaagcaagttttcaagccgaatttgtacgattggaaaacaaatct

SEQ ID NO: 11620 - DNA, 302 bp, Zea mays
ctacccttgttaaatacaaagctgcttattctcgaaaaaatatctgtggtcacggatgttaagtcttcaatctcctgagaatcaaagacaatggaggtgcattcgtttaatggaggatctctaagatgtgagcattgaccacagagaaataaaccatagatatgcattttttaattgctgacaattattttgatgttgaccaatgatcattctcttttcttatttacctgttattgatatagtgttgttttgctttcgtagggagggcaacttgagtctaagatattcaggtattgctagag

SEQ ID NO: 11621 - DNA, 426 bp, Zea mays
gatagacgacggcctgttctgttccggtagggaattcaccttaggcgagaacgcggccggctgcaaagcttggcgagtatggagtaaaacttattttttgagggctgccgcctttggacaaatccagtaaactcaccgagtttcggaaatgtgggactgagaagggacggcgatcccagatcacacagaggacaggggaaaacgaagccaccgagcccccacacgtcgccatccatcgccgtaatcgatcaccgccgtctcctcccccacacacccaccggaaccgtcgtcctgacctctcgccagcgataagcaaatctcctccccactttatcgtccacaaagccttcttcccgccctcccgaatcgctccctctctgtccctgcgctccagccgccgccgtcgcctccgccccccgaatccca

SEQ ID NO: 11622 - DNA, 175 bp, Zea mays
gctagacaataaaaagaaatgcccagcaactgccaggaaaattgtaggtggaaactgtaagctactgaagcgaggtgaaatggtccagtagtccttacccatcagctcggccacactgcccaggacgagcagaaatgtaggccaacaatctcccactgccaaattgctcttcaat

SEQ ID NO: 11623 - DNA, 1500 bp, Zea mays
atataaaatacaattaaggggttgtttgaatacactatagctaacagttagctactaaaattagctaaaaatatccaaacagactaactaatagttcaactatttgatacttttagcaaattaggtaatagttagctagctatttgtcagctagctaattccactggcaattttttagccaactacatattagctctagtgcatttaacactccctaactgatctgtttgttattgtcaataggtacggctggccattccgaaggtagtgaacaagaactgttaatagaatatgacaatgtagaaacagccgtgccatttgttttttgtgctcagctgtcaaaagcaaatcaaccaaacaaattggtgatcctgaagtcactgatcaaagtgctatatgagttgtctgatactctgatgcacgtttccgttttgacaaaaaactttattgtttcttgttcggattcttctcccccttctttttatctgacgatggcaacactcgtgccttattttcaaaacgataatatcaccggtccccagagaaaaaggagagaataaattgcggaaggatcttcgatgattcttgaaacttttgcagccaccaacgcgcacgaagcggaagacttttgctaaagatacaaaagcggcattgtgtcctgtgtgtttggatagttggatagccaagataagctgaaagggacttgtcacttgtcagtgctaccaccaaccacatgtaaacayttggtcagaatggaaatgaggacaccaggattgaaagataaggtcccactcaagagaatccgaaagagtagtccacaagcatgttgcacgagagcaaccaaacagtctgtgcaacacagttacaacaaacaaaaaacaaagtgataaagtgaaaccatggcagttaaaaaaaagaacaaaagtgttaacgcggtataggacagattcagcaacagcgaactccgcaagtatcgcaatcttgcttcgtcgccagcgccgtgctgctttgtcataaaaagaaagaacgaaaaagagttgcatggccagcgatgaaccagcatcttcagcaatgaaacatcaggtagagaactgagtgcagttgaaaagaactggcttatacttttttttagaagtttataaaattacaaccataaagatcagcactaacattaatgactttgctaacataagagtggcataccatgcgtgccatacaaactacaggtacattcatacatagcataacttacagcacatgatacaagctaccgagcacggtcaatcttaaatatataaaaaagacaatattgaaggctcccatatgagtggggtctgatgaaggagagaaaccagggcaggctttccccgcaaatacggagaagctacttcgaaccagtgaccttatgactcagtgatcttaaatttagaagaagaaaaaagagcaaagcttattttgcccaggattccatctaaaatgcagtttctgtgctggtagggg

SEQ ID NO: 11624 - DNA, 1018 bp, Zea mays
ggtaacttatacttgaatcagtactcaacagggcacatatatttagctcaaaacaccataaatcggttgagcagtactccctttgtcacacatataggtcaatttagatttgaaggaaacaaaggcctaggtatggtcaatctagcacattcaagtagagaagatttttgaattgcttataacatgatatatagttcaagaaatcagcacaacagtttcatgctggatgaatgttctaatatctagatattggaaattaaatgtattgtgcagtaagtctagcatgaactcagaaaatcctgtgtggctatgaaatcagtatcagacttgagatcaagtatttcattgagttggacttggtggttaaaaacaaaggcttcttgtggatgtcatttgttcagctcccaagttggctacaatagatcgctaaagttgaacaaaagtacatgtttggcttattatgactttcaagtgtctttgctgctgatgaattatgcgctcttacagagttactgcttactaagcaaccttcaagctttcaacaagtgaagtgattatatatcagaatggagataaaatatagctgaaagtaaaagttgtgatgtaatctgaactttctagtttcagcttgcagtaatattgggtgtttggtttctaaggactaatttttagttcatccattttatttcattttagttcatccataagaaacgtatttggtaatttagggactaaaatggaataaaatggagagactaaaaattagtctctagaaaccaaacaacttctaataattagaatagctagtagaaaaatagtgacagaagttcacattgtgcaagagcaccaactatgaccacaagtcttaacacatcactgtctgcatagtactgtcatataatcacgtttcttatggattagagataattacttttgacgtacagactatactagctgcatgccgttcttaatatctctttctcccagagaacaattagatccatactaacatcatact

SEQ ID NO: 11625 - DNA, 648 bp, Zea mays
cgaaatagatgagaagacaatcactactatttactactaagacatcgcagtcgcagacccgatctgcttatatatactcccatccgttccattcctgcttgttcttccaatcccccctcccccggcgtgcgctccctcctgtctctcttggcgacgactgggcaacggtcgcagctgtatgttcgagcccttcgccgacgacgttcaccaccaggtacggacgccactttcccctcccgctgtgcgaaaccgagcacccaaaccctaacttactatttgtattcggatctgatctaattacaggtcctacttacttcgattgttttgaaaaaaatacccgggggtgtagatgtgttcatccgtttccttttactgggtccatcctgtctctactttgctggtgatgggttcactttcgaagtgtgattattcagctaggaattttcatctgtaataacttgacgcattttgcattgtctgttgttcaggattttgcttcagtagatgtcatacctgatacatagcataagttttgtgtttaaattgactaagtatgttagggtaacacggatctgtttatttttttccaatatgtgataacatttcgatttttttaaaaattatgcaggaattttctcagctgtgcca

SEQ ID NO: 11626 - DNA, 1240 bp, Zea mays
atagcggggtactcgttgctgcgcggcatgtgtggggctgtcgatgtgaggaaaaaccttcttccaaaaccggcagatgcatgcatgcatgctacaataaggttctgatactttaatcgatgctggaaagcccatgcatctcgctgcgttgtcctctctatatatttaagaccttcaaggtgtcaattaaacatagagttttcgtttttcgctttcctaatgcttgatggctgattgtttgcacttgtttcattccgttgggcactgatggtcttagagttagacaatcggctgcagcgcataggtttcaagctggggggttgcatgtccgactacagagcagccagcaatgtggcccctgctgcctgctctgcttacttttaaatgccacccctcccgattaccgactcactcagattcagacacgcaaagcactacctttccagtgtccctgaagacactactcccccgtcccagcttgccgttgcaggtatacctcggcttgcctgccttagatgttaatcctacaacgatagacatggatacggggttttactaatgcttggatgcatgcattatcgtatcctcgcctcggagacgatcacgcgtgcatttggtcacaccaactggtgacagggaatgtacactgagattgctcaagagttactcctactcgacttgttggatctcacctaacgcttttcaagtttttatgatacttcgctgttggtcttggccttgggccagtccggagccgctctcctgctcacatcacatgtacgtggaatgatgttgtctcgggtcatggcatacagcttggttggttttatttcctccatcgatgcccaggaagcttgtgctatcattaccataagcagctaatagtatgagttgatgagtgacaagtgacacctgcactaagatacatataacatcaatcaaaacaatataacaattcatacagatcaccggtgcttgcttaaaggttcaggcttcgagtagctaggacactagctagtactgggctctcgatcgtttgcaaaacaatacaacagtaaaagggagagcgagcacatggaagctggaggaataaatagatggacggttgttagatgcaggctactcctactaccaatttctttacacggcttagggcgcaagaggcctctcctgctctacacactgccctagcttagctagccgtttggagggcagtgttggcagctagcagcgacgacag

SEQ ID NO: 11627 - DNA, 208 bp, Zea mays
ggtaagccgccgccgccgtcttctccgtctgggatttgctttgtactccggcggggaatcttgagttgactttgcattgcctcgtcggctccccctggacaaggaggctgcccggaggctcggggaggagctcgtcagggtgtgcaacgagttgggcatctccgagatctcctacgaccgcaacggctttgctcgaggcgacaagaag

SEQ ID NO: 11628 - DNA, 1450 bp, Zea mays
ctgcccgtagtctaagtttagatgtcctaaaatgatgggtctaaccttttttagtcttttgatatcgttccttataaaaatatgggatctgctggagatagactaaagggctctagtattgaaggcgcgaggagacataaaagatccattatctttttcttttcttttggtggcaagacaagaacaaaataatatacgagaactctttccttattactattataagtgggtacaaattcaatatataaagatgtgtagtcctttatagacatgtttgatattagttcatataatccttaccatatgcctctaaggctctatgctaaggagggattattagtttagcttacgctaaggttgtagcccctcgcaccagaagacctgaaarcttttagattgtccgcagcggtgatctctaaattttcccactatatcatttttttgcgtcacattatcaacatttcaccctctaaattttcatctcccgcagtgattccccctatattatctccctatacccactacaactataaaatattattatctaactcttttcatcttttattactatttttttcaactattaaataggggagcactgtgcaagggggcgctacagtgctccccttgatctgggggagcggcgcggcatcccctagcactgcaacgcgtagggggccatttggaggccacagctgctcgcgtagaggccccctacgcgtgtacagtgctaggagagagggcaccgcgcggcatgtgctgcggacggtcttatacatatgttttaaattaagacaactagaaaactaatatttattctaagtgttatgaacgagatagattcaagtccacatctaaatgttgaacaaggtggacaactataacagggatggtgacgaccacaaaaataatgaataattaatcaacatataagaaataaagcaaaacgcaaaaaaaactcaattcaaattttaaaactggtgtattttattcttatcgattagaacgtaatataatgtacgattaaatttagaataaacaaccacactataaacataagaaaccaatgttcaacaagagaggcaaagagctcacgtgtgtgtcagtgtgtgagagaatgtgcctgtgtaagtttgatcagcgagccgttcccaaatccacttgctcagtcggccgtgcgatcgggatttagcggtggggatctgcacaaaagcggcagtttacagcgagccccttgaactagcctgtattaccgttgcgcaaaagcggccgttacccttgaactagcctgtattgcagcggagccaccgccgatccggaacaattgaatcgctgcatcggtgtttcgccgccgccgcaaaaagaggcggccgcggtgagttcaagggaggaggaggaagagggtgtgaggcgctgcagaactcctgtggatcggtgagccgagggcgat

SEQ ID NO: 11629 - DNA, 1274 bp, Zea mays
cgagttttataaagataagtttgaaattttgcttctcgaccgagttttataaagataagtttgaaatagaagatgaaaataaataacctctaaccaaactcacatcatactgtatcggaccgaggggacagtttgaactctatatagaaaggtgaccaaatttttttttcttacaaaacacacttttttgtctagcgcatgatcccccgttcggccgttctttccgtggcggcctggcctgtgcgtcactacttactccctcagtccctcactccctctgagccactgttactagtacggctgcttcctcttgtcgtatggaaaaggtgaccgccgggaatagtagccccatatgcaaagcctgcgatgcggcatgcatgctgtacccgcgcgctgctcgtcttgccactgggccccttcagcgctacacgcatcgcatggtgcttgtgtgcagcagacatctgcacgaggcccatggccatgccattgcagatagacagtgaaacaggggcacggttgggtgggcaataaaagcccctcagaaatggtgcttgcaaattgcgatgcagcagccctccatagaccagagcagagcaggacaagcatcaccaatggtccgggctcacatgggattcttgttatttccagcgtctgacagagtcaaagagtctacaagaacaggctgcacatggaggcaatcaagcgagcacagtgggccagcagttgatgcatgaccgcggcagttctcttctgacctctcctcgcaaacatgtgggagagctcatgagacgcagagaaatgatatggaaaccgttggccccagcagcctgttaaatactcggcatcatagtctctctgctctcaggcaaattggagtggagccgggggggtgtacatgatgggtctcagtgcacagcacaagcacgtctttctacaggctatacacaggctacagctaacaccaacagatcagatccacggcacagagctttttttctaccaagacatattcacagcccacgcgcaaaacaacccaggaagctcaaccaccatcttgtattgtacctagctactacatcactgatgaatcgtacagggaacacagcgactgcgcctgtcctatatggccttgaactgtcagttcccttgtcgaccatttcagcgcttgtgactcacaagcaccacacaatgagatctgctgcacactcccccgtgctagctgtgaaacaggaagcactgatccaacatgatcgcccccccatggttttaaggcc

SEQ ID NO: 11630 - DNA, 74 bp, Zea mays
aagtgattcagaagagacaaagatgttctctgttttttattggatggagcgcacagtcctgaaagcatggaagt

SEQ ID NO: 11631 - DNA, 125 bp, Zea mays
ggtaaatgaaacagaaataatgccatactactatggatagataagcttttttccatctgacttaactaggttctaacaaaagttctttacatcgcttcccagaactcaacaagggctgatgaata

SEQ ID NO: 11632 - DNA, 659 bp, Zea mays
ctagagtcgacctgcagaggaggctgctatcgattcggttccatgggtccacgtccatgtccatcctgggccgttgggccacatgcagatcccaaagcagtaaaaaatggcgtaaccgtggacggactcttgcggcgcatcgcccgccggccccgctcgccacagctggagcacaccgtcaccggccccggctccggaatcagatgctccgaccggaccgactacgagcaacagcaaaaagaagaaaaaaaagaaaaacgggatcgccctaaccgtctctgcgtggtgggcccaaccttagcctctccactgtccactccaagcaaggaaggaacgtgatacccgcgccccaccccgcagtgtgatagcacgatagggacactcacgcctcgcctgcccccgtcgcgagctccacccgcttcgcttccctgacacgcaggcctcgcaagcgaccgccctactggagcccactcgccagggaaggccgctgaaaatacgggggaagaaacacgaaaaaggcaaggaattagaacgggcgaagcggcacacaattcgcgcagcagcgtagaaactagaaagaccagtccccaaactccccagcgggggcgagtagaggaggaagagtcgccgccgccgccgccgccgccgccgccgccgcc

SEQ ID NO: 11633 - DNA, 1204 bp, Zea mays
tccttttgttttgtttcgtatgattaactaaagtttagttcgtgtcatatcaaatatttgaatattatttataagtattaaatatatacttaattatgttgagtaaatttatcttatttttgttttatctgtataattaattttataattagactatatttaatataattaattttataattaaaatatatttaatatttgtaatttatatttaaatattctatgtgaatatggaaccaaacactatgtccccgttaccctgtccagaaaaaaaaacagatgctgtgtaatctgtagctactctgtcggtgtagcgtacgtgtacggcagcgtcgtttacttcacacggtgcgccacacgtggacgggacgtggagtcgcagattatcgccgaagagccgaagacggaagacggaagacggaagacgtggggggtgggggccgtcacggccatggggcagtggggcaccgggaacaggaacatgggtccgctttgctctgagcctctgactagcccagagcaaggtcacatgcgccgcgacgccgagtcgctccacggtttaccctttccctcgccgtgtgcggcgtgcccgtgtcgtgacactgacacacatcccccatccactgcgcgcgtccaaaccaaacccgacgcctgtggccggccgcgccctggctttttcttgcaacggctgcatcggccgttccgccaccagaaacgtgggatcctgtcgcacgctctgcgctggaaccggcggcagcaggcccgccggcggggcacctcgtcgtgcctgggcggttggtcttcatgacgggatccacgtcgtcacggaatgacggaacaggctgttctcactttggacgaacggcgccggcgggtggccgtccacgacgctgtcacgcacgcttggcacggcacaccgagagagagagagcgcgcgcgcgcgacgcagccaatcccccacggcatgcccaaaaccctcagttccgtgcaataattctgcctcgtcctcccatcgctgtcccccaccgaaacactctcggacgcgtcgtcgtctccccaagaccaaagccaggcggcctgtctgtcctccagtctccccacttcgctctcaccccacgccgcgtaccgctattaataccaccaccagtaccaccacctctgccagttcgccaccatcgtgctccgtacacgctccgctccggcc

SEQ ID NO: 11634 - DNA, 1500 bp, Zea mays
cttctatgcgtagggtacatcacgaagcgcatgactaggcgttcaagtttacgggacctacaccgcagatcaagccctcaatcgcaccgacgacggcgcagggcagaggtgtggaaaacgcccaacttcgatgagaaatctgacctcccccgcgacccaaacccggtttctaatgtctaatacatgatgctaccattaaatcgagtcagtggggaaaggaattacctaaaaccgtggagtagaaggttctacccacagagagcttcgtcccggcggcgagacttccgctccaatgagtaatttcccccacgccgacgagtaatcccacccgaaggcactacgatcacgcgcggggagcgttggcgaagccctatgactaccctctgaggttgtatcgtggtcggaagtcgcaaacgtcgacggcggcgaagttccgcccctcacctcgctctctctcgctttggtttaatggtgacggtgtctgtgatacgggggccagaaggagattagaccctaaacttacgactttgtagtcccacgaggtcggtccaggttaggtttaaggaatttattcatgtaactttgtatatatatgcttgtattaaataaaaaaaggaatccatctacattaaatattataacacctttatttactataatttgggtattaccactggatggctaatttgttggttcggttggactaaaagtttcaggcgatgtaccgattggttcatcagcttagacgatgcatcgtcaccttaggtatgtgtttatgtatgtatatgtatatgtatatatatataaaatattgtatctgtatatatcaatttgtaaatatatagagattaaaaaaaaatctctagacatttctgtacaatttcacgtttagaatcggtatttcaagatgaacttaaagatgaacttttttatcagttcatgccatgaactagtactaatggctcacaattagtacataaagttatgcaatcaggactaaagattgagatttagtcccggatctcaatactggttacaaattcggtactatagctggtttatacatatggtgttttctctagtagtcttgtatatttagctcagctttgatattgatatagttacttactcaactgcatgcagtttaaaatttgcgcatgttatcttcccagtaataataatataaatatcatatcatagacggatcgagatatagcatgcaactatcaatagttgttgttaccttagttagctttgattctaaattaaatctaagctcaagctccgccactaatataaatagctggtgtggttataaacacacatataccatgcaataacttgtggagcagctgcgttgcatgctggtatccttgtgtataaataaacagggttccatgcccctattctcacacaatttaagaagagccatatttgaaacagttaagaattcatatataagagtgcatatatatatataatcctgccaagacaaaggta

SEQ ID NO: 11635 - DNA, 1500 bp, Zea mays
atcaggatatatatgttccctcaacaatctggaatggcatcaggattattggaaatagaagctttgttctgtctgacctttttctgcagtagtagttcttttcaagtctaactatacatatgtaataatattttacaataacacagaggcttccaaaacgattctttcaaaacaattctggatacgtttgatcctcccccaaatatcactgtaatgtatgttatcatacatttatgctatgtatttcagttttcacctccacatgaatatcaatagtccctgtacatattggattgcgattatgcacttttatttactgtatataatattaatagacattctatattctgttactgagctgtatttttagataatggaaacatttccagccttcccttcaatagaagttaggtccgggtacaaaagcatgacactaccatccacaaacagacacacgcaataggaaagccattagatcgcctattacatgataatgattgcaaaccaccaaccaacgactggaatgactaaatccttacatgtgtttcagttttatgctgggctacatgtaggaatgatctaatctttgacaaaaaaaaaccctctctcacttatttgcgagttcttttttgagttacctattggctaaggttttggagtaatctgcaaaggaagggtgaagataaggatttaataaaagcaagttgcaggtccttggagacagttgctatgcagtttttttgcacactttggctacatttttcttttgcgtatgattttgtttattttcattgcaaatatgtgaaaaatatctatactcattgtgcatattaaattgcgattatgcaccttcatttaatatatacaatgttaattgacattgtatattctgttatagagttgtatagacctcctttttttcttttgcatgtgattttgtttattttcattgcaaatatgtgaactttgtatacctattatccagtgaagagattagaaaagctcccagccgccgaggtcctgcagcggggacaggtcgacaagaatgctataagtcttagattttgagtgatcccaacaatctcgctgcccccagtactcctgattttattactcaaaacacgatatgctgttgggaaaacaagcatggtggtgtcgcttgctgttgctaaccatgatgaaaggtcatttcaaactatttgcttagctccagcttccacttagagtagctccaagagtcgaccaaaacatgccccaaaactcgttttaaccttactaaccaaaaatatcttgtccaacagttcccctatcttacctcaaaatttgttggtcccgcatctgagccccgacgtcccgcaatttttcacgttgccattttctccccaatccatcggctcccgcgcgtcgctgctgtttcccgcgttgttttgcctgcacactcagtttagttggcagcggagtggaaagcgacggcggtgagagagaaagcagaggcggcgg

SEQ ID NO: 11636 - DNA, 1500 bp, Zea mays
gcccgcacacacacagtgtggtggtggcgatgcccagatctttttgatatccccaagaaacctaacaactagatacaaatcaatgtcatcacgttcgtcgttaaagatctgcgctagggcagcgacggtcggggaagcgagctcgacgtcgacggtgatgtagttcccgttgctgacagcatcactctagatcagtctagggtgtgaggtgggaaactgtagacgatacagtgactgcgaacctcttgtcgagccgtcaacttccacctctctatttataggctgcgcatcaggggtccaccaacctccaccaacctcgtcttggtgtagacgcccccgatcagggtgtgaggtcaagagcccagttctccgttgggctaactggtgaagattaattccaacattctcacccttgatttcatcttatactttcaactttataccttttatttttttcatattccattacagattagtgtgtagagcatgcttcattcacggtcaatcgtcgatagacttaacagctacaatacgcatctctggtctgaaacagatattttaactttgggtccttttattgcccaaaaaacatatgctataccataaacctattgttgactgtgaacgcactgggtggtaagcctttggtaagaggatccgcaagcacttgcttgttacttatatgttcaatattttagtatgattctggactttctccttacaacatataaccttgtgtcaaggtgtttggcagcacacttaacccgttgtcatatgagtgaactatttaaatgattattgttgttgtcaaccattatcaatttcgggtacaacttctcttaaccattttgcttgtcccttaattaggtgtgttgtctcagttttgaaacagacgaaaaggatgagtaggagcgatttggtgaggcaaatagtcggtgataaggtattggtttgttaaaccatttttggtttcacctatctaatagaaaaaagagaagtgttttttttttctaaaagccatgtaaaaataatgtttggtacaatttctccatctatctactatataaagcatcaacttctatggtttcgtagtcgttgcgcgtcactcttctcctcctcgttttatacaaaaataaggtaaaattatgcacaagtgaaggttgaaacttaagttgtctacatattcactcacataaccaatagaacatatatattttgtgttttattaaacatgaagcagctgaagtcgctgaagagaagcctcgccaaatgtgcactaaatccaacccaattctgttgggccaagttctttaccactaccggcccagacacctaaacgatgacacagcgtgcacccaccaccaccagcgccgagcgccggccgcgataccgtcgtgtccccctccccaccgcattagcgccggccgacaaaattactaggtgcttaatttaactactagtggccctaggcgtgaaacttcaccagctccgccactgccc

SEQ ID NO: 11637 - DNA, 1500 bp, Zea mays
tggatttgaggatttgattaagtgagagtagggttatccaacgatttgaatcgttagttttgagagtgcgttatatatgtgtgcaattcgtttggtggatttgggaggtattggtgtggggtgatttgtttggatggattttggaaagttaaaagtggtagattatataggtgtatgtatagaatagatccaagagtattaaataaagtctaaagtacattgcatttagggtgggggttgttggaggtgggctcacacgacaaaatctccgtaggccatagatagcccatgccgagatgtcttctagccccggaggcccggacgccagcttggcgaacagaacggcagaggcgccagaggtgcaatggggccgggctcgatgaccggcccgttacgcccgcgttgtgctccgttcccgtcgcaaaaccccaccgccacaggggtagatccacgagcccatcggcgcccggcaatggatggtgggtccggcggagtccaggcccacgcgcatcgtgaccacggccggatcgaaatacgcaagcatcgcctaccgcttcttggtttcttgtgccagaaaggctcgccctgacctcccctgagctggtcggtttggtggccgtcaactgccaaccccacctgtcatagtcagacccaggtgcctcggccccacccgagcctcaggctcggaaagccgtttgcgcctcctagcctgccacgcagcatgaatccgagcccgaagccactaaagaattcggaagcccatcagaaaaacagaacgaagccaatggaaggactggaggaggggagtagcgtgatagtgatgccgtagtggtcgagctcgcggcggagtagagaccagagagtgagagcgagcagagcaaccaaagcgtaggcgacctcaacgcgaagcggaattgattgcgcccaccaccacgtcttctccccctccgtccgacccgtcctcaagtcaccaggccaccatcattgccgccatcgcgccgcccggccgcgggagcccagctacgcattcataactgtttctctcttggcttctcggcgaagtgttgcggttgcgggtactggagtgcggagagcagcgcggcgcgagggaggaagccaccacccaccaccacctccattaaaggcgctcacgcgccgcctccgcctccgcctccgcctccacgagagagctaggcgagaggggcgtacgagacctcagctgactcctgtcgtcaaggccatcgatctctcccctcacgggggcagccacgtacaaaggcaggcagctcgccaacgcccagcaccctctcgccgcgccaccccacgccgtgcgcctttaaagagagcgcacgacaagcttaaaggttcccacgccgccgctcgcgcttgtcttggcgccgcgacacagctggtcggtgcctttgatccgttccttccttttccagctgcagaggtgacagagtgccgagccgtcgcgcgcgcgaaagcagaggagcggca

SEQ ID NO: 11638 - DNA, 987 bp, Zea mays
ctgaattccgcgaactatatgctccactagtgttcgtgtgtttgtggaaatgtacgaccaaatgttccacttgaccatcctgcgcttcttttgcccggattctccctggttccatgaaatacaaatgttccagaattgtagcacgagcttataactgttgatttcggcataattgatgtattcatctcaccaaactctatagcaccaccttgataattttagacggccaatctaaagtattcagattttgcgagtgtccacgcactgacgatttcagccgaaagatcggtaaagttcaattgcatatgatgacactatgctgacggtttgtttgaagctctgaattgaggtgtatttggcctaatcctcttggtttcgaagataacataaacaaacatccaaattagacatctcttctcccgtgccgttgccgcatttctccgtgcggccgaaaagatgtgtatgtgttcgtgaattcacctacctgcagcaaggcatatataccaagtcagttgtagttgtggctacatatgctttcagccccatcgaagcgtcctccatcccttggtgaacaaggaccaacgccttttccttgctcctcttctcctgccgcggcatccttgtctcgcaagaagatagaaaatcggctgtcaaggcattttacgcccatgccctctaggcctgacgcctatctgatccagcgaccagcgtggcagcacgccagcgttcgcgaggcggcgagggcacctgtgtcatttccggcgtctgtcgttctcgcgcggcccaccggtgatggcccacggcccgcgagaggggaggaggagagcaataagcaagcaccacatcgccaccaccttgaattaccgcacacggctccgctgcttcgcgactcctctccgactctccgcacaggactccaaccgcctcgccgttgcatcgccgcgggcgtcaacctaggctgctgccggtaccggtgcgtccccagcc

SEQ ID NO: 11639 - DNA, 1500 bp, Zea mays
attgtgatttaggtatagatcaattaagctaatatgattttatatataatatatttgtatactaatgttactcatatgtaggagagcgagccgaagagctttttataattttggagagtagaaacatagactagtaatacacaaaatcaatttccacccctcatcctatgaatttgggatagacttatatctaatctttggaaagtggtggaatgtcaagtttcaaaccaaataacatattctattaagtaaattccaattccttcaaaaatcaaaatgaagggattcaaacggtcccttagtgtaaatgttgttctctagtagcgggctgagtgctacatcatcagtagcgggctgaggagtgaggacatttaatctttagtcctgccatattggtacctagcaagagatggttttagttccaacctttggccctatatctattataagtagagtacttggagtaggtgacatgacttcagtccctttcaaaaggccttatattggtcaaagtctgaacctaatatcatattcttgtttgaatctgcacacattttgcactagctcattaatattttgttgacttttgcttctccttttttacattcttccttgtaaacccaaaaaaattgattgcattttctttgttaaccgcttaattatgacgaagagcataatatatttcattctcactttactgctgggaagtccttaataatccagaaaaaatgtggatttaaacgcttgtcttgtgttataatgttgcttgatatctataatatgttggcctacatgaccgaactttatcatattagatcagttgtagtacataataaatagttaatatcttcaattgatatttggctacggatctaagtctggttgtaaattgaatgttaaaccagaacaaagttcccaagtaggaatttcgtatagctgcaaattggaagactttactaccattttacagctagaaggtgatgaaaaaatgtggctgcatggctaacctatacctgaatggtgctattcctggttgtgaatccataaagtggctgaaagcagttgatcattgtaccagtgtgtactactccgttcttttttatttgtcgcggtttagtttaaaaatgaactagcggacgacaaatattcgagaacggatgtagtataacattagaggccctggaaacagctggtgcctgtcttaaccattctgtttgggtagtcatgggcctaacaacttttccattccaccttttgtgcagacgatgatgaatagatgcccagatttatttgccagcgacctgtattttttttgcaacatgttgtcagtacacatggccaggactgatgatcccccatcgtcttagttctctcagctttccgcatttcaactgtgatcttgtaataagatgtcggatctcatggattaccaatgtaatacaccaattatgggttcttgatctgatggttggctttctctgataaaattactcaattaaa

SEQ ID NO: 11640 - DNA, 596 bp, Zea mays
atctctcatgtatagccatgcccacattattcattatatcagtctggtgatggaagcatgatcatcatatagatagaatagaggttacatgctttcataaaaggagaaaaaaaatacaagcacagtttacatggcaagctaggtagctgaagctgaccaaaaggtaaaagaggatgagttggccagagttgctgaaatgtttgagaagatgaattgggttgggaagctagtgcagtgggtgtgggtgtacgaccgtccaccacagtcattggttgatagcaatagcatgcatgcatatggagcctgtcaaggaaggggagtttgaagaggaaaggagaaaagggcagaatgtgagtgcagctatgcattggttcatcagcagcaacagccaacagaatccattcaagagctaaaatcacgctaaccacaagaccaccgctgcctgtctatgactttgcagcgcttctactatataggacaggagtatgcagtaggcaccatcttttcttttccttttcttttcttttttgttgggtttccttggtacgtgatcgatgtgtatatgctgctgttggtagctgctccctgctctccac

SEQ ID NO: 11641 - DNA, 1500 bp, Zea mays
gtttgactgatgggaggggcccatatgttgacacacatgtctgatggaggcgggctgagctgatcaaaaagggagaatgggctggccaggccgcatttcggcccaagcgccaacaggtgagttttcttttatttctgttttcttttctatttttattcccaccttcaaaatttagatttaaatatgggtttcaaattctaatctaaatgtaacatccagaatagcagcatgaaggcaatgtatataattttatagacttatatatttattttagttattttgtttcctttgtttagttaaaggttcaaagtatgttatgcacccatattatttctttttaggaagagttattactcttgagtgtgtgatcaaattctaagtaaaaataaatattcattaccttacttgtttagggaaatatttctaaccatatgattcaacaaaggttggttttaatcatatgattcaacaaatatttcttttatttaatctcttaatataaaagacttttattcaaacatgggaataccaattcctaaatctcaacatagttctaatatgaatataaatcttactatttttatattattatttattgttttccttgtcatttatttatgtgaggaataaatagcttaattgaaattttctttcccattttctattcctttataaattgaggtcaaattcaggttttcaataaatgcatgataaccacatcatcaacaagagatatgccattctttactttgtttgttggttacttaactgatttaataccatttgttgattataaataggaagagtcctaatgaagtttcaagggtttcaacaactctcctaacatcatcataaatttatttatttattttatatctatatatttttttcttatactaattttgggatttacaatgagtcagggacgtcggcgctggcaaatgaaagagaaaagagctgattgggtccggcggggtgtgctggccactgaaattaagcctaattttcgatggctggagcggggccaccgagaatagtagcagacgccgaaaaacgactagagttgttgtagtggagaggcatagtcctataattatttaatattattttataaaataggattcttattggagcaaagttttagtgtcagagtcctatatatttcaaaatacaaactctggccggagatgctccgatccttagcatattggttataatattatgattatttgatgtgctgcatattttgcccacgcgaatctcatactagtgcacgcttataattgagctcaccagacgtcgatatatatgatgggcccttgctgccctcattggtgctatatatatcccgccaccccgagggacatggaacagcaagctaggtattgaactcacgaagcaagcaagactctgtactgctatagaaagcagtagcaaggtctagtcggctgtgtggcctaggcgcctagctatatgcctatatagtaaacggtatccagc

SEQ ID NO: 11642 - DNA, 1500 bp, Zea mays
ttgtactttcggccacgtctctttctcagcttcagttgttcctctcgtcacctgttctagaataccgcaagtacagactacagaccggagtaaattaatctgttctcgaatttgtggtccactagtttatttttttagctagaatataataaataaataaaatatgtttaacaacaagggcaacaaaattgatactctctccgccctaaaaaagtcagactttagttttgattttctacaagcacttatctagatttaaaacttgaagggcaacatttttgacaaagggagtacatagtctttctccatattttctagaagaaaaaaaagaggaagggatggatacagcggtgggatgaccctaccgttccagatcctataaagccctgtgaaatcttctctaaaatttgatcctatatttttattatgtatttctagtttcgttattcattgatgttttaatataagtctaatttaaaccattatatttgtctattgtaagcggtttagtcagtctcctaatattttttttctgggctccgtaggaaaaaagttatcgtattcaaagagcaggtaagccagagcatgcgagcttcgtttcaaaatagatgtcgttgtcgtttctcagtaatcagatgttttcaattttaactctaaccgtacctgtattttgttaatgcaggacagaacaactgtggagtcatcgataacgataaccatctgccatgggcaggctggagacagcacacgacgacgaccgagagacgatacgacacgcgatcaccccccacctcgaaaaaaactgaaataaaaagctacgcttttccccttccctggtgctttacaccgcagagaatcccgtcaacccatggccaccacaccgctgcttgcactagatactaggcttgctctcatcctttccactcgtcgtcttccacggcttccacgccttgccttgctgctgatgctactccatttcctcccccggtacagcctgacccaacaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagtagccttttccggtagggcatctgctagagccggccggttgaagcaggggagcgagaggaggagggcagccgagcaggagcatcgcagtggtggttaagcagcagcaacgacgacgacgacgacgctgagaggtttccccgttcccgacggcacgtccaccgaggcggcgccatcgcgatgggtcctctggcgccgctgaggtgtaacccgccgccgccgttctccaagtcgccggggtccctgctgctgctgtccaagtcgctcaccctctactgctgagccgagccccctcctcgatcggttcc

SEQ ID NO: 11643 - DNA, 1500 bp, Zea mays
ggagtcgtggaagatggagcctcaccttatgcttcatgttcatgtcattttattaacctccatgcaatgcttagttctagttgctagacaatacatttattttatgcataattgtttttatgtaactcaactttatacatattggcataacaaccttagatttctagtcaccagtttacttgtaaacaccaagcatacgagataagagatctacagtctgttcgtttggctctaatctgtacctgcttctactgcttctataatgttttgtctctatagattgcagtttcagcagtccgaataattgactttaatccgaagtgaataactgctattcttactagacgtagaatatcatgtatctaaaccattataaatttgtgcctattgtagtatccacctgagtcatgtgcatgattccctgttcgattttctctcaatctatatggattggaggggattgagtgagtttaaatccatatgaagtcaaaatccttcataattttttaattccttccaatccataaggtataataataatcgaacaaggtctactatgttagatatggttgtattaggcaacaatatatgattgcaaaattctataagggccaaaaatataatctcctcaccgctttcgcatctattaggacatagtagccaataggtgtggttgtggattccacacgtggttgtaggcacatgtataaaattctaccacaaatatatctatggttatctcattacattcaatcatgcttaaaatacaaaaaaatctcttattgtgtcaatctaatcgttcggggcagacacccacgagcacgggtgcaaaatgttacctccgcgtatcgatgtgggtataaatttttaccaattagaaaatttattgcgtataaatatatactccgctcataccttgacaaactgtcatccctatatgcagcacaatgctagcaaacaagcataatcttactaaaatrtagcctacatgcccaggacaaccaaataccaatgtgttacatagtttatgctcgcttgtactatattatatataaggtatcatgcatattaggactagcataagagaccaatcacaccttagatcttgtttagatgcacaccacgaattgaattttggtgaaagtcaaactaatttccactttgatctacttcgatacatgtggataagatgaatatatgcatattcaaacaagaccttagcatgtttctatataactctttctcttaactaaggataaatatagtatttaaaataaaaataaatatgcatggaacatgcaaccacaacagacataatacctccaacataagtctaaatttagcattgcacatccatggttcctagccaccacaattctccaccacctccaaacaccacgaccttcccccatcctcccctccaccactcccgcctagcccttcgctccaccaccttcgagactcccccttcgccggtcggcgtcgttggtggttggagag

SEQ ID NO: 11644 - DNA, 831 bp, Zea mays
gttggctgcaacaaagggagacaagtgcagaagttggagataaatggtccatccgctggttacaaagcaaataaagtattggaccggtagtgatagaggtgcatcactactggctacaaactaaatcgatagcgatcgaggagtcatcactgccggtatcttaaaccaacaatgatgtgtgattattgtcattgctggttgtagaaggaccaacttagtttagtttaatagaataaacgatactgatgtcccctgccctttgaaaagatcatgatatatctaagaaagaaaagaaagaggtgaattgggtttgtctaaaattcataaatcaaatcattagtgcaagcccaactttacaatatgagcctatgcatgtccgttcgttacaatcaccatactagctagatttatcttttaaatttttatccatacaaatgaagaaatccagttggatacaacacgagttatctatatagtgaagtttcttcctaacaaccagaccatggaagctggtcatgctgacaaggactggctgactcagcagaggatcacggtggttattcagcagatggaaacgttgggacgggatcacggtcgcagcatgggtcgaccagtcaggcggcagcgacgtgcctccccactcccctccctcgcttatccgcgacccacttttgtgaggtcgcaattcatcctggtcgccaccagtaccacctctccatccttaatccttcactagcttagctagccagccacctccgttcactccatctcttgccggccagtgctccgtcgatcgacccgtagccaaccaccgacaactagctagcaaca

SEQ ID NO: 11645 - DNA, 437 bp, Zea mays
cgggttctaaaagtcaaacatgttgctttttagccgacttttatgaaaaccatttatgtaaaaatcgcataaatccatgtaaagcaaaaaaccgatgagtcaccgtgatgggaagaactgaccgctttctaaaccctaaattatgtagatcctttgatcctctacacaccgcgatacgtgaaaatagattatatacaattcttgatttttagaaaattttctttagaaaaaggtgtatgcccgaaatggttcgattcaaaggctggtgcccacctccccacatgaggcgtgggcccttctcgccatacagagagactccctcacgaaaactcaccgtctcccgctctcgatttcgaaacactcgccactcttcgcctcccgttccccagcccagacccgaagccctgcgcctccccctccgccgctcgccgggcgag

SEQ ID NO: 11646 - DNA, 1500 bp, Zea mays
agataataagatatggtatggtagtactaaaataagtctgctcagattgtacaccattgaactttttttataaaaaaaatggcaccccactaagtgactattggctgttggtggtggtccagagtactagaactccagatgcatactatagaaaaatcccagcgcgtgtagaagtcaaccatgtcaaaccacagagatattccaagttgttgcaagtgagagcaaacaactgtcatgtcatgctataccataccataccataccatacccacggggcgctataacagacaagatgaaactggaaggaaatactagtttttactgagacgacggtgacgaatctggatcctaagatagccaaaaaagactaggacgtgattaatcaaataatctatgaagcagaatctcaatgccaccgtatcttatgagcaaggagccctgctgctcccatgagcaaaatcaatccagatcacacccttcacatccaacggtgctgtattaggggggtttttgtaaaatgtacagagttgcaaagaacattttataaaaccccctgacgcagcaccgttggatgtggaaggtgtggtctgaattgattttgctcatgggagcaccaaagctccttgaaaaaactacatttttttctactagacttgatgactgacagagcactccccgtgttttttacagtccggccggtacctctctctctctgtctctctggccctcgtcctcccctattgtctgtaagtagtggcaaacctggctgcaatcattcataaccgaattcttcgtgggggcgccccacctgcctgcctgcctgcctccgctcctcgcagtgcctagacatctgctgcttctgctcctggcactagttcctgccttcttttgctccgctcggttggttattgctgctctgctgctgcgtcctcctgcagtctccacctcaacttctccgccttcctccttttcctcctccccctcctcgcgcagctctcgtgcttcgcctgttcgttcggggacggtcgtgcgtggcgccagcggcgtcggagttcgatttccggtgagcgcttttcgcaggaaaggttgggtcttgtcggttgggattactcactcgaccgtcgctacgggaaaccgtgccccatctctgcagcggattgatttctgtccgtgctgcgaggttggtgtggtggtttgtctgtgcttccactgtcggaccgaagattccgtcatcgtttcgtgcagtaaccggagcggtgtttagtggggagaagatttggctggaaggcttggtgcttgcaaataaacactgcacaagaatcgaatgcaccgcaccagtgccgattgacgagattcgagtctggatttcgagcgtgatatggtatcaccaggcacctgtggactctaaataccggttccaaggacaaggttttccattcgaagaactgtcgctgagggaagaagaagaagaagaagaagaagaagaagaagaagaggtca

SEQ ID NO: 11647 - DNA, 1500 bp, Zea mays
gagtcaaaatctgagcggggcttatactatacctggctatccgcacctccaatcatctgatatatggaaaattcacccctggttctagactctgactttatggcaggtgaaggatgtggatttacatgtccattatgtgcttatgatgatgtgaaaacagagctccattcttgtttctagtttgtttaatttcttagcataagtgattcctccctgacttctataagtagtgtttggttgagaagccaagtggaacggagtcgttccatccctgattctaagaacggagctgctctgttctgtgtttggtaatctggaacggagcggctctgttttttgtatggttgcagagtgaacggaacggagcgtgactgtgcaagcgggctgggaacggagcggctccgtccggttgattttttttggagcggaatggtttcggatctgaggagaatattatctaattggagtcattccgttttagttactttataaccaaacaacaacaaaactgggacagaacatctccgttctacttggctcttcaactaaacactaccaaatatataacatttgacattatatatttttaaaatggagtattaattagttctgcttttwattaccttggacaatatgttaccgaaccaagcctggaaaatagtaaaactaaacaactattctactgtattacgaggcagaacatttcatacagggaacacaagtcttcatgggaagggctcatgaagcgtcgctactcgctactacgatggtatggaggaatcatgtaaaggtaaagcgcatggtgttcgtgtgcctagcttgcgttcccggccgggcacgggtttccatgtttcaggtgctttatacttgtcgtgaccacgtcccgtcagctaatggtcagtaaccttcattaggagcatggccttcgttgcgtgatgcctagattgcagtgcttccattccggaccggcatatcagcttgggatcgatccttgatcgtcgtgtttgtccaacctggattccttaacagccaggccggtaccaaaccattagatttattttgggtggattaaatatatgtttaacttgactaaagctggcaacgaagaaattaaatacgctggaccaaattatagaagaaatacttcgtgcatgtttgtttcatcataccatatattttcaggtctgtctgaacctgcgcgtcactccgatcttcgattctatcaagacactgtttgtttggaacgtgtgcatatctctgtacgttttcgaacagaccaccctccatgtcacgtaagctgcttgcagcgcttgccttcctctaatcacgcatccacgccaagcaagggagattactggcaaattcagaaagagtggcattgtcctcaccggcccctggccctcgcgagccagacctataaaatcaaaccccatcggccagccagtcagccacccacccacccaccagttctgaaacgtcaccatccgaaataacgcgaaa

SEQ ID NO: 11648 - DNA, 1500 bp, Zea mays
cggaattcctgcaggcaggtcgtcccacatctccacgccgacgtgaccaccggaaccacccaccacaccacttgagtcagtgccctcgatcgatgagtgaggaatgtcggtctgattgatccctgctgggtctcgcatgcccagccggacacctgtagtctgtggagcgcgcgcggtcgaggtcgatctcaacagtgattaggacagagtggttgtgggcttgtagccatggccgttaagctagccgtcgcagcaacaagcaacctaggtggcagcccgcagacgatgacaggatcaaaccccccacacccccctacgaccgcgacgcgaatgaatacagcagcacgcaccttgcggggcgatgcggccgacgcaaacgtacaccaccaccagtccaccaccatagcaagcaagatcggcggcgggcggccgcgcgccgttcgttctgacctcgccgatcgagctgtcccccgccggcgccgcgcgaggcaggaaggccgcccggccggctggcgcaaccaccggggattgagcgccgatcgttacggcacctaacctaacacggcacccgcccctagcgattcgggtgcgcgaggcaacgtcaacggatcgagtgtactgctggtcgtccctccgaatctttcgtactccgcagtaccagttatggaaagggactcggccgtggtggcagcgcgggtttgatcgaactgggatgggactatgggagtgagtgatgaagcaaaaaaaaaaaaaaacggacggaattggtgccgtgcgtctcggccttttccttccgttcttggcgagtctagactctagagttcaaaccgagtacgtacaccgagcacggcatgctccaaaatctctgagctgatctaccagtaatctaggcaagtccgaatccgaactgcaccatcgctattgcgcttaattagaccaagcaaagcatccatgacatgtttgtttatattcgaaagaaggcgtatttggtgtttcgccaaccatcatcccacgatcgtgctagagggtccacataagtagacacccatcccatgcacggaatatgtgggaacagacgaccactagcaccactacacaaagcccgaaagggatattggggtcgtcgcaaaaaagggcaacccgtagtcgtatgtgcacacagcacacaaacgacaagatctcgagcaagattatagtaattttctgaaatctttaacaaggcataccgcatacagtacgtagcagtgtccgtgcggctgtcgcgaaataatggcaggccccacctaccagctgctcccccacgattcataaaaacaaaaccggtgcaagtccaccgaggccccaggacaggcactgaggtctgaggcacgcacatacataccacgcgcgctccagaggacttgtgcgctcgtcaggccacaaccgcagcgcggcacaagaccaacggggaagaggaaggcagtgagctgttccgcacccgccgcccgcccgtctcatctg

SEQ ID NO: 11649 - DNA, 811 bp, Zea mays
gagaatgtatatgccctcctcccataggaccgatgaatcaatttcaaccctgttaagaggcacttgatcagaagcctgaacctctgccgatgtaaattaccattcttttagaggtttacggcatgagtaccgagaatccgggtgaaaattgtaaccttcttgacatgatccctgtgctgtataagagaaaatcatattacagtttatacaaataataccgaccaattctacatccaggtggctcgataggatataagatgatttcgtcaaaacatgttcctgacgcttctagctcccagtaaacagtgtcttccatctggctactctatccgtttcttatgttaaggtcacgaagatttatcttaaattaatattttaaaactttgactaataatatttataaaaataattatttttaaattagaaaatatatatattgtgatagatgttttaataataaatctaatagtttcatttttattcagtaatattaatgaatattttgctactaacggttaaagttaaaagtatttaacttagaaaatactttcgttaagtgactttaagatagagaacggaggagtagttcattcatgagaaacaccagtgcgtggatgttgacttgatgctgcacgtggcagtgccacgatgtcacgcttgcacgcgaactccatgcgtgtcctcttgccgcttaacctgctaccaccataaagctgcttcggcacggagcaggacaggacacagagcttcctagtccgtgtagtggaggtagccatcatcagaatccagaaaggagcaccgtgtgtgcgtg

SEQ ID NO: 11650 - DNA, 52 bp, Zea mays
tctcggtgcctcgagctcgtcgtccgcgcttctgtggccactgccgggaagc

SEQ ID NO: 11651 - DNA, 1273 bp, Zea mays
tgttcactataccgtcgtcagcgtagtcgaccgttgagcgcagttgaccgttgctccgttggctcaccggatagtccgatgcacaccggatagtccggtgaattatagaggagtggctctgagaaaacccaagagcggccagatcgtgaggtgccttggcctgggcaccggacagtgtccgatgtgccaggaccagtccaggcgaacaacctgctctcgggtctcgacgacggcgtacggctataaatcaccggactgtccggtggtgcaccggactgtccggtgagtcgtctgcggcgaagtcgccgctctcaggaaaccagtcaactgcgtccggcaaaaaatcaccggactgtccggtggtgcaccggactgtccggtgagccaacggtcggccgcgcaatccgcgcgtgacgcgtggccgaaccaacggtcaaaagggagcaccagactgtccggtgtgcaccggacagtgtccggtgcgccaacagctccaaatcgtcaatggtcggctacgccagaataggaaagagatctgcatcggacagtgtccggtggtgcaccggactgtccggtgcaccagtcgacagaaggcaagaattgccttcctagattgctctcaacggctcctgctgccttggggctataaaagagacccctaggcgcatgaaggagtacaacaagcattctttgatcatctctaagcaccaagtcttcattctagcacgtttgattctttgtgatagcaatttgagctcctctcgagttgagaactccgtgtgtgaacttagagctcaagttgtgactagtgtgcgtgtttgagctgttgcttttgagacttgtgtgtgttgcttttccctcccttacatccgtgcttctttgtgatcatcatttgtaagggcgagaggctccaagttgtggagattcctcgcgaacgggatatagtgaaagaaagaaacaccatggtattcaagtggatccttggatcacttgaaaggggttgagtgcaaccctcgtccattgggacgccacaacgtggagtaggcaagtgttgtacttggccgaaccacgggataactcgcgtgtcttttgtgattgcttttctgtgatacttgtgttcacaagagctcgctatttagcctactaacacataatcacgttttgtggctataagtttcaagtttttacaggatcacctattcacccccctctaggtgctctcaattggtatcagagccgttctcttcacgaaagggactaatcgcccgaagag

SEQ ID NO: 11652 - DNA, 1306 bp, Zea mays
aagcagagttgttcgcttcggactggtacggattaaaaccaaacgaacaggcctgtctctctctagttgtgattttgtggtggagtgatggatctgttactttgtcagttttgtaatagtatagctggatgtaatctagaggtgctgtttggtttacgaaatataatggtaacgataatgattcacactcgaatgatgttggtaataagtttgaatagttagtattaacttttggtgtaatatctaattactgttgaacctaaataaatatggtttaacgttaccagttatccatcacattacattagaaatatgtggactaaacatcatctaattttgaagccttacgcgaatctgtgcgatcagatcacgaaatagccggagttcttccatcatcccctgccttctgcttgacgtgtaccttaggttaatgcaacaatatgtcgcactggaaaaaggttcctcaggaatcagttctgcacatatttctttcatatctgttatgtatatttgtagtgtgctattgattgttgaattgagcctatcctgatcctcatgcggtcacgccctccatcgcaatgcatgcactgctaccgttgtgtacatggcgccacatctagatcgcatcaagattcacacttgtttgcaatggaatatattagtagtagaattgttgggcagtatacttgattgttactatactatgtttgtttgggtttttttagtttctggccaccaaaagttgctgctgactgccaaacacgctaacttttcagtccgcttatataagaatcgctgaagatcattggaattgatttcattttaataacaataatttagaatatatcaattaagctaattcaattttatgcaaaatatatttgtactattattagcaagatgtcggagatacttatgtgctacatttttactatagagatgtgagtcgaagagcgtcctgtaagttacagagtataaaaaaattctactaatacataaaatcatttctcattctttacctcattaatttgagataaacttatatcagaactttggaaaatggtagaatatcaaattttaagctaaatagattattttattaaataaattctaattctataaaataaagggatctaaacatcccgttaggaaaattgttggaatacacaataggtttcagtccgaaaactttttcgcctcactcaataatcagtttgtggcagaagttttttaacattctttttggagttgctctgctcttatccccaccgcggaaccagcaaaacccgctgcagcctttcgaatt

SEQ ID NO: 11653 - DNA, 464 bp, Zea mays
ggagggccgtctgaaaatgacctgaaaattcgggcccttgaaatatatagggggattaaatatataggatacaaaaataatcatggaaaaatatgatatgtttctcatagataagtataatgtctgctatcactcaaacaggtaacttaaaactcgcacttttttatagagaaagaggagaaatcctattatatggggtacaaggatgaaatgaaacttccaaccaaaacttactttagttatcttgtctagatacatgccaaacttggagtaattttgactgtacttaagatacgtgaactgattaccttttcttttaagatctgcgcacttacaacgatttcctttttgacaaaaaaaaagcagtcaaactgctgaaaaatcatttgccctgacctttgctccctaggaggctacggaaatgatgtgtcctacatcttacagaaggcaatcccactctgcag

SEQ ID NO: 11654 - DNA, 804 bp, Zea mays
gcagagtacctgatatgtctggaatctaataactaatccttagtagctaattattagtttgtaatgtgagtatatatatacacacactagctttccatttaaaattacaagacgttttacttttctagtcaatctatttatataataaagcaacatattaaaaaataaaaaatatactttagaaaaataaaaaagtatcttatagattaaaaaggaagaaatataattcagaattacgtataaatacgtaattgagaaaatggacagagtcctgccatgccaggccggtccaccattgtagttctcctgctttctctcgatccccactaccctcagcaaacaaaagaatactgaaccccttcttcgccgattcctgtaacccaactcatctcatctgcgctcccaaggcgagatctcaccaccccattcccaaatcaacccaaacaccgaattccaaacctggtgatcgatccaaaaacgccataaatcccaccgaatccaactcaaattcgcaatcaaatgccccagattggcacccaaaccccgcacccagcaattcaaatctgacctcgccattcccgctcctcccactctaccctgcgatgcatgctccagactcccatagcaatggcgaccgcgctctccaaatctgccgtcaaatcccaccctaggtcgcctaccacagcgcagccgccgccgccgaaccccggctcaaacgccgcgtcggctggcgtaggggcggctcctccgcctccgccgccgttgtcggccgccgccggtgccacgccgtcgaagaacgccgcg

SEQ ID NO: 11655 - DNA, 642 bp, Zea mays
accgtgggcgtggatcaggaggagcggaaacaaaatctctggccatcacatggcaatggtatctgctattgatggcacaaattttcatttccagaagatatgctgcttcctcgggaaataatataattctcgtttctccaaatgttaaagaatcatcagtttaatcaagtttataaacaaaatactttttatttaaaatatatttattacgaaaaacattctatatttagtgtaatacatttattatatttcacaaatattaatataattatatatatagtcagaattggtaccggttcattttgacggagtgagtatatggagcaaggccacgtggcacacggaaacacctattccttcaaatgtttcccaaacaatagcgtgaataaaaaaaaggcacggattaattaggggccgaagcttcgccacacgcaataggtcggtcgcctctggactcctcacacgaaacctctataaaaggagtgccaagaggcagccaaggtttccgcaaaacaaaacaccaacctttagcaccaggcaaaccaaacactaggccaacgcaattctctagagcactgtaggctctagttctccagaggcccgccacaaccacaagccaaggccacagccagtgccctcgcc

SEQ ID NO: 11656 - DNA, 1500 bp, Zea mays
tgcaaaatggtgcaaaataatatttttggtgaccatatgggtgaactgttgtatattacacccatatggtcgtccaaaacactattttgcaccatttacaatgtttgtatagtttagtttgaatataggtatgtgcagtggcagatccaggatccatggcaagggggcctagaagctaactatcttttttctctcgtattcttcttctttttctcttcaccttcttattacttcttctcccttctttctcccttcctctctctttctcctcttctttcgtcctctcccttactccctcctacttgtaagttgtcggcgcaagcggggctggagcccacccagcccccctctagatccgccactaggtatgtgtatgagtaagctggtagagataataacaacttcaagggcacaccatatatggcccccaccccacatctagtgaagtttggggaacaacaccttcaacacctccaaggacacgatttacaatttttatagartttatttttctaaatctcgacagttgacttgaatctagaccattgataaatctcaaggaagtttctagtgacatatgaggagagggaacacacgtagcatatgaggcgtaatggttacatgcggtgagttatgttttgtaatcgattgctcatgggtttgatccctacttatggctagcttggaaatcccattttcccacggggttttcattttcccaagggaaattagttcattttcccttgggaaactagaaaccccttagggcttgttcggttattcccaatacacatggattggatgggattggaaaaaattgtgaagacgtttgacttgtctgggattcaaacccatcaaatcccactcaatccacatggattgagagctaaccgaacaagcccttaggaaaacgtagttcccaaactagcctctagatgtttttttactcaattcgccacatacgaacaygtgaagcagtcaattataaggcagattagtagaaagcgtctttggtgcacctagcgataaacgctcttaaagtcaaatccacaataaatcatgtatgaaggtatttgaatacactagaggtaataattatttagctaaaaattactagtgaaaagctagctatctattagctaatttattaaaagtaataaatagttaaactattagctaaattgtttagatgtttttagttaattttagcagctaattattaactaagtgtatataataaataatacttccgtattttaatatttattgagcgctagtttatttttaaacaaaaggacaacgaatgaaaaaacggtagctgtgggagacagtgattcagcctgatcatgtgacggtcttgccggttgccactacaaataggccgcaccgcatttcgaaaggccacgcgaccgccacctccacctcctcgaagccgccgcgaccgaacgagcgaagcgtcccttcccgcgccgacgccgaaaccctagctcctcttacgcc

SEQ ID NO: 11657 - DNA, 668 bp, Zea mays
gctctaagattttttttgcaaataaccccttaaacactttaagrgactttacattaaacaccactgtacatgccctaagagaaaccgtcgcgtcacttcgcctacacgcacgcacagccgccgttcccgcccaaaacgcgcgcggctgtctatggctacgaatacgatacgagcctatccgcggttccacaatccacaccacccgctgcagcttcttccagcttccaattcacggcgtggccagtggccaccgagtgaccgaccgacccaccacgcggacgatttccccgtctatcctccacgcggagtcgcggacgcaccacctcaccgtcgtctcgctctcgcactcctttggcttcctatatctctgttcctcgtcattacttaacgcggacggaagcaagcaccccaggccagtggcctcttttccggtccttgtccttgtgaccttgtcctgctcctgcctgatcttccagctccagacgagcagacccatccacgagtcctcggctcctcgcccacccgcacatctcgtcagactcgaggagccagccccgcgaccgcctcacctcgccccgcaccgagatccccaactcccgcgcgccccgcacggtatgccggccgaccaaatctccggctaaaccccaccccgccttgccgctcatttt

SEQ ID NO: 11658 - DNA, 360 bp, Zea mays
ccctacccctgtcccctgaccggctgacccatgccaattacaattccatccctccaaaaccaccaaaccacacacgaacccagtccgacctgctcgctctgcagtctgcacacctggaaagtggtgttccctcgtctgaagccgaggaaaaaatctcgcattcgcaaagcagacaaaacagcgtccccctccctctactaaaaaaaaaatggaggcatgagctccgcctcctcctcgtctctcgccgatctcccccaaaccctagccccgacctgaccgccggcgggcccgccggccggagaaggagtcgctcccacccacccaacttctgcggcggaaggggagcgggcggcggacgag

SEQ ID NO: 11659 - DNA, 646 bp, Zea mays
ggtgtcggagtaaggcgaggacgacacctttacctcgctggtacgccttaccgcctaggcgacacctaggcaacaccttaataacaatggttggaatataagtgaattacctacatctttctatyagctttaaccttttgggttgaactggtacatgcaactttaatatgatatcaaagacaatggtctcaagtttgaatcctataaataaaataattgtcgctcgttcatattcccatctaaggcctgagaaagtctcgacgtgagggggtgttgaaatataaatgaattgtagcttaagcttttatgttgaactggttgatgcatgcaacttaataaggggagatagcctaaccacaaatacacaactattcatttccaaatgttagactattatggcaatgttcctaggcttccttttgtgtgaggtttgattgtctatttgtttcctcctgcgtgaggacaagtatagcaactagatgctccctcgtatggtagataggatctgctatctctgtataggaagtaggatcctattcatggtaggcaagcactgattgcaaccaggctgccacactccttcctagtgcgtcaccctgtggctgctatatattgtaatgcctctctcagtcaatactatcaaatc

SEQ ID NO: 11660 - DNA, 97 bp, Zea mays
ttagtatgttctggtattctggaatctggacatgtaatgtgggactgtgggttctggacatgtaacttaagtctgtgatgaactaagtgatgaaata

SEQ ID NO: 11661 - DNA, 390 bp, Zea mays
cataatatagtcaattcatagtaagttgcgctactggagtactagtgcacaatataataccataatatagtcaattcttagcaatgtaataccatagtaagttgcgctactagagtactagtgcacaatataaaatagcataagaagctagccaagatctaagcggtgacggtcgggtggacgacgacaggaggccgagcgagtagcccacaacgaagacgagcaggaaggatctaagcggaagagaagcataagaagctagccaagatctcttccctcagtccctctcttttacggctaggaggaagagaagcctaagaagctagccaagatctaagcggaggtgaggcggaacaatgaaagtacacacaaagctggtcgtcagacaca

SEQ ID NO: 11662 - DNA, 1500 bp, Zea mays
tcggaaaaagtggttgttattccttctgacgtctggataatcttatacaaatcttccagatttttacctgcctcgttagaaaattctaaggaaccggtagtctctagtagtaaaagatggcagcttccctagttaaaatctctgacgaaagatcaacagtgacaggagaaagcggccaggtcagatctgaagaagaagaagaagaagagcgaatcggagatcccaaacccaggtctccaagtcaacttgcttcgcggaggcgatggacgaagcaacagcaccacaaggaaaggaaaggtgggggcgtactggcttactcagcaagcagcattgaagcctccattactcctcyacccctgctcaattctgttggaggagctcacaaggacagcctgttctcgtggccttttcgggtgaggctacagtaacagtgagatcagtcagatagcgccacaaattctcaccctgcctatatttctgtaacaagcaatgaagcaacagaacattattaggattcagaaccgtcgtttacaacaagttttggcattcttgctgaaaaaaaattgtagtggtaaatattagcccctgcctctgcttttgaggaccatgtttcatggcaacgttccgaggggctgaaacaattttcagggaattcaggtaaacacatacacatgagtcatagttacaggtttgcagcaaagtggtgaatagatggcaacaaagccaagaacaaaagaagtgcatgacaccatgggctgtgctgtgccaccccaaccccaccaccccattcctcctcaccgaagcacagcacagcgcaatacacagactcgcagggcagccagggctcctagaaaagagaaagtagacgaccaaaagaaactggagaaaaagaaaagagctcaaaagctagtcgaggcctcctccgccccttttttttctccccctcccaattcacacaggattcttcactcgcccgcccagttgtttcttttagtgccgcccccattccgctctgatccgagcctttcgctcaaagcctccagcttttccaattgtttggtcacttcgggaaccaaggaataagttcttgcgctgtgcgcgatagagagcctgatccatccttccccatatcctattcctgtggcatttcggtgtgcttgcgctctgtgcgtggccactgcaggggaaggattttggcctggtttctctcttcttggggttccaagttttcgggcgagatcttcgcctcaaggcggttccttgcttttctggtattggcgcggctcttgttgctcccctacaagtccaaggaaagaatttggaggccgtgggggggtcccttgcgaccggttctggtcgatttctcgggcagctccagctgaattcaagatgccgctgtgacccaccgctgcctggtttcttggaggaaggaaattttgcttcaattgggccgttgggcgtcgttgagctagacccctcctccagctcttgatccggtcc

SEQ ID NO: 11663 - DNA, 568 bp, Zea mays
ggtaataccgtttttattttgtgtaaagactagagttgtttttaaggtcatctctaggtgttcagtaatgggtaaagttgtggtgagatgtggaagtttccctatacaccatattaggccattcgccaatgagagtgatacctcataccactgtggggggctaaattcagagaaaacaaacagagaaaattccttatttgacactcaaaaaacttgctcttcccaatttagcactttaaaactgctactcccctgcatctcttcaatcatccatcttgctcaaaaactgctacaatgtccgcggccgtttcgaggagacgtgccaagaacccatgccaagattttccctacgttgaaacagaagagtggctggcgtgggcccatgttcgcatggacctattatcaatgattytcagaggcgtatcatcaagaacctgggttactccactgatgcagcaaggattgaccaaagagcacaagacatacagtgagctgttcaagacgactatcaatgatgttcatctttctgctctagcggcgatttttggctggaggacagataaaatgg

SEQ ID NO: 11664 - DNA, 1500 bp, Zea mays
ttaagaaattgctattttatccttttttgtcctcatatttggcaaaccaagagagacttctcaaagcacttttttatgcgaaattagtcttccgtgtcttctgtttttattctctttttattttttattaataaaatttaggctactacgggaaaagaattttgttgcaagttacacttttttatttctacgtggaaaagatatttgcgtttgttttgtacacataattttagaatcattgcaaaaacaatatcatgtctgatgagaagaacataaaacgttttaaaacatgagagcgagaggagtttctagctgacatactttgaaatattaatttggtagctaaaatagagaaccattagagaacatatattttttaaaccctactatcatttagcaactctccacatctgtttttagagagttttttttttacaaaactactggagatgctcttagcgtattatcgtcttcaaaatggttggcgcaaccataagcagcacagcaggaatattaccatgctgcgaagcggagcacagggaaatgggattcttccctgcttgcctcccggtgccggcgtgcagccacgacgtatgtccgcggattggacggcaactcggtcagccgcatggaccctgtgcctcccatgtgagtgacagcaactgtgacgcttctctactccaagcatggcgaaataggctccgtgattgcttcacttcatgtgcccgggctgctgcgtactgcctgttgattcatggacgaccaaggacccaaagtagtgatgcaaacggatcaaatattgtttatatttgtttgccattcgaatcatgttcaaatttggatagtgtcaactatatcggataggatacaactggatatcgatatcataaatatacgatagcaatttgagtattcagataagttgaatatccaaactctagagaactcgtcctgtttggcaggccaggattgaagcaagccaggaaccaaaccagcccaggattgagtggatcataagctgtcactcattcctggtcggcagccaacttccagcacaggaatcaatccgaatggttgctcacctgggttcattttgggctaaggatttgaggcagaggagttaaaaacaggcggctttgtggcccaagacaaacgaacagctccagcaaactatatcagactaaaccaaaccaggctgattggttccacccagaaagaggcccagaacgggctgttcaggcgaaaacaaactaggcctaattggatttgatatcgaatatcatcggaaaatatccataccatttacacccaaccctggaccaaggccaccacatcttttcaactcttggacgctggaaaaacaaaagcagagccatgaatgtacacaatggaagtttctatttatagaatccagcagccaacagatcgcagagcgctcttcattctacagatttcaggagcctgaacaaccccactgcctcccttattcgcgagaaggcg

SEQ ID NO: 11665 - DNA, 569 bp, Zea mays
cttcatatgatgcgggtatacatagttgtagagcatctcgcgtggacctagccgacgatccctttttgcatctctcagcttgtatatctagacaagggaaccaaacaagatgcgctttaatgaggtgtttggtttaatgaatcactatctaaaatgaagtagtgcatcatgggtccattcctcaaatttagtggaatgacttcattccacatattagtactaaacaactaactatgaggaatgaggtggtgatggattaactcacttcatttcacaaaccaaacaaaaaagtgaggagtgagaagatgatgaactacatcattacttaaaccaaacactccataaatgtccgcggtgcagctgcacgtcccgagaagttgagctgataatgagttctaaattttacactataaaatttaaaaatcaaatcgggttaatatcaaactctatttttatttatttttttatttagagctctaataaattgtaaagaagcaaatcacgycgattctgttgccgcatctgaaatggaaactgtcaactggccactataatctctcagatygtca

SEQ ID NO: 11666 - DNA, 187 bp, Zea mays
gccccagcagcgccagcaccgtctcgacaagaaggtcaagaccatccaggcttttcttttggtgtcaagcatcatcttcgcgaccacgttcgcggccgtgctcatctgctcgattgttgccgcggtcatcgctgccccgcctgtcgctgcggcattggccgcggctgctgcagtcccgctgggatcc

SEQ ID NO: 11667 - DNA, 923 bp, Zea mays
ttgaagtcatctgactagaaggtttgaccttgtgtgagcattcccttttatggggctccaacaagtatcgagggaaagcttgcacacttcttaaaaatacatgtatatcagtaggagtttatattcctatcacacttcaagattccatatttatattatgttactttggtcatatgctttattcttttagcttagttataaacatgtataattctttatggtagaaataacaacatttagtcaaaacaataattacacatatgataatttatttattgcatgtattttaactaggtgaaaaaatagaagctatagtttagagagaaattagattacccaattcaccctaacttttgtacgccaccattcatttccgttaggaaaattatcgtgtcaacacttatctttgtgttgatttgtaaatttttagcactaacttgcatttacttcttcatactactggctcagacggcgtgatgcaattcgtctcgctggctcagacggctgtcctccacaacgcggctcggttgcgaccacggcgaaagtcgcgtagccacttctccgaatcgagccaaattggctcatgcgccaccagctcctccctctccaccccgatcgcaatgccactacgtgatcaaccccaaaggtcgccgtgaccgtgccggagagatctcgcgctccgggcccgttaccgcgcagctgtgctgtcgcaggcccacccgttcacccactccgccacgctctcgataaggccgccgcacgcggccgcacgcaccgacaagctggagccgccgcagcaggaggcggtgaaaccatcgccgaccaacggtcgcatccgctaccgtacgccctcggcagccgatctgctccccgctgacgatgtcgcggcggatgccgcggcagccacagtggtggccgcgagg

SEQ ID NO: 11668 - DNA, 262 bp, Zea mays
ggagttaaatagggtagattgttagagatgtcttagaaccaaactactcctacggtcctacctggctaccttcacgcagctcttactccgatcctccatcctcatctaaacaaatacttctcatcttactttttttcgtcttcttccctataaataactggccttcccaaatcgcccacaactctcacacaacagagaccacccacctgcgctgcgcctcggttttacggcccttccctcaccgccccgcgcgagcgaagcc

SEQ ID NO: 11669 - DNA, 975 bp, Zea mays
ttcaggaattgcaatataatttttttgtagtgcatctttgctgctccgaaatctagaaaactgtagagctactccatgctaaagctgtagagccgagccatcttcaattctgataaaaaagcccaagactagctagctctctagcacaagacaagacaaaaaaaaaacacgccttctttcctttcgagctagtaaacttttttcccacaagaaatggtcattactgaacccccttttgtgattcattatattggaatacccaatactagaagggaaaaaaatttaaaggtggtcacattccacatccaaagataaagtgaatattaattgtcatgtatgatcctttatcaatttgcctcgatctccatagcgaaacaactcactttttttggtaagtgaaacttgtttgttgttattaattttcaacataaaaaaaactcacttttttttatattctttgcttgcttcgaattatatcaattgtacgtggtcgatactcgatagtatgatgcatgctatccggctaactaacatgcatgcatgggatggggatgggagagcaagttggggttggacgctttccttgctgctcaaggagcagctagctagcagcttgctatagaaagtaggcattgcttttaatgcaatcgcacatcatcgatctaatattaatcttggccgtggcgttgaccttcttgcatgatatggttggtccggcgatggatggacatgcatgcatgcaacagctagtacgtacgacgtactacgtgcaggttgcttacaaacaagagatctgaatggaagagcatgcatttgctgatccgggactcaagggccaatccatccatccccagccggccgcgatgtgtaaatgtcaactgaagatgcaggctagggacatgcatgcattatatatataagctacctccagctttggctgcgatcaagacaccaattaagccagagcagtctaca

SEQ ID NO: 11670 - DNA, 201 bp, Zea mays
tctcttcgggcggttagtccctttcttgaagagaacggctccgataccaattgagagcacctagaggggggtgaataggtgatcctgtaaaacttaaacttaatgccacaaaaacttgattaagcgttagcacaaataatgccaagtggctagagaggagtctcaacaaaacacaataaccacaagagatcaatcacagag

SEQ ID NO: 11671 - DNA, 1500 bp, Zea mays
actgttttgcactatagactgcattgttcgcagagtagagtatgaatatagggatgatgatgtgtaagctactggagatagccttattatcccacgttgcacgcgtgggcaccttgcctgatcttcgatagcatcatggggagcagctcgatgcacacctcctctatcaccaccttcgtgacatcctctttggcggtggtcttcacagggccgggccggtcacttcctaaaaaatagctctgtcggatcctaataaaagtatttgagagttcgaaaaggtcgagaactttgttagactgttttcaatggcttacccatcctatcttctaatccatcttttattttaaacttcattttgtagatagtataatatatagtgcaaaacaatgttttgcacgaatatatgcatggtctattggagactccagtagcttacccgtcctatcttatatcttatcttctatttcaaacttcactgtgtgatgagtacggtgcaaaacagtgtttcacatgactatatgcacatgcacaatctgttggatgttagagaacttgggcttggcccaaataataactcatgtaaatcccaaaagcccactcacacatacatggtatggtggaaactttagtaccaccttgctactctaggtggagtgagaccaacttaaataattgatttgtctccaactgattgaagtcattgagaagagaaaaaaagagaacacacacgcgtgctcgcttgcctcgccaggcggggcaggacggggcgggagaatgtgcatgggcacacaatatgccatatgcgcgtgaatggtccgacgatttctcggttctgaccttgtgggtgcgcgacttccttttgctacttgatatttttgcatgcatggagaaaattttgctgacctgttttgataagaaattattctcgcattaattgtgattgattgcgagtaaatcacattagtgttgtgattaagtgactggttacttgtctgttttggtcgcgtcgtgtgtacatattgagggtgagacgtcgtcctcagaatagagtttttcagcccctcgttccatcgcgttgtgctgccctcgtcttccctatcctgccgtcgacgtgccatcgaggttgggagagcaggatctttgaagcctacatcccctcgtgtccctgcacgtggtagaggccatatcaagtttttgggaagcgccgtcgcgaatgcttgctgttcgtctgcttcctctacaccgacgtcatcgtcctcgctggtctggcacgtctactcttgcgccgttctagcgctgacaaccctaatgtgagaatttccatactttctctattctcatattctcatatcactagcactagattatgaattgctagtgagttatacatatacgaagcatgttgttgttccttgtattattattattatcagaatcaatttgtttatttctaaattgctattatttccaacaatccaaaaacctgataggcatttagtg

SEQ ID NO: 11672 - DNA, 60 bp, Zea mays
gtgtggatccatgcaacggattaggaaattgggtcaatgtccttggtttgctaaccagta

SEQ ID NO: 11673 - DNA, 1500 bp, Zea mays
ctagtccggcagtatctaggagcgcacaagctgcatgggcaccatcatcgtcatgtaactccgctaccatcgtgcgtggtccacatgtggtagatggaaacaaagagagaactaccgaaagagggttgccagttcaccgacaagtggtcgctgaactagagtcayaagttatcggtgtcaaagcatccgcgaagcttctccgcacttatggagaaagtaattaacacaacataattattggtagatggatattttttgaacagtcgaaaaccaaaagcgaagttaagggtgttgtaaaatttatactaaataaaactgggttcgattgtatgtttagataagacccaactcctttttggttaactctttaacttttgaaaaaacaaaaaaaagattgagaagaccaaacaaaagaaatcttacatgcgagctatctgtttcttacttttgaatttttaaactctactatataaagcaccagtttccacagttccacagtcttcgtgcatcacccttctctatcctgctttagtttaaaccttgtatgttggtttcaaggtcacatctacctaaccaatagaacatatttttgtattttattaaaataaactatattcatgtgatatatagaaacgtaacaacatataacagatgactagtctctactatacaaatcactagcttccatccatgtgatatatagatcgtacaaatatacgtcaactgacttgtctctatttccatcatcgtcgtgctccctacaaaaactgaaattatgcacaagtgaggatttaaactataattgtttgctcaaaacacaattcatacctacttaaccaacaaaacacacgtgtctttacattttatagtttatatttatagatggaaaccataacaccgtagggacactttgccagtaactaaggcgtcactaaagcaccggttttttcagtggtagagcgtttttttccagtggtagagcgtgggttatcactttaactcatgaacgtggttttaacattttattcataatatatgtaactataaaacgattacttgtaagtctacaaaatagccaaatatattattgttgtatttggttcgagatactaaagtttagcccatgttaagtacgaatattaattatagtctaattatatagatgaggactaaatgtgagatcaattttttaatcataattgattagcaaatatttattgtaacattacatgagctaatcataaactaattatacttaatagatttattttatcatttagttcttatctgtataattaattttgtaattaaaatatattctaaaatttagtagcgacgacaactaaagagacgctatatatatgcgagggtctgcgcggctgtgtcacgttatatgtttagtaggtacagtgaaaagaaaaaagatcagcgtgtgcctagcatttcttccctggctgaaggcgtgggtctcgagagctgcttaaaaagctttgcacaaaa

SEQ ID NO: 11674 - DNA, 1500 bp, Zea mays
taatatcagaaaataaatgttgtggaattatacttcttcatttggagttaaactgttaatgaatggagttaaactgttaatgaaaccttttcatgggttatttactttagatggaccttttacattggtttttcccatattggttattttagttatatcttggttctgattaattggtatctaagtgtggtgtattttttagacgctaattctatatatatagagcgcgacgcaaacgcgcgtacccgtacatccacgtcggcaaaaaaaacatatgcgcaggatgttccatcaacggacgagatttttttctcagcctccccgggctgttgtagatgcctggagaattctagcgatgtgcagttcataaaaaatcaaccgttttctagaagggtctcaataggcatcgcgtgcctagcgtcggctaccgcgactgcagcgtcggcggctgggaccagttgatgtgcgttcctctctctagaagttacgtccgtcttcacagccttttcctcccaacaacgcataatattagctagggtttcaacgcatctgacggcggaagctagggcgtcgccaccgtcaatgtcttggcactcccgctctgttcatcaatcgcatcgacaggtagcagtccatcatctccgtatcacctccttggatcctcctctgttccgtcacttccacagcacgccgccaggagccctatcctcaatcatgtctttcccaccgagctacacaccttcattgtagccaggaatggaagaaaatcgcgcaccgtacatgaacagtgactgtccggtgcgccacccgacagaaggcaagattagccttccaagaatgcctccaacggctcctagctgccttggggctataaaagggacccctaggcgcatggaggagtcaccaaagcatactttgagcattctaagtcttccacactccgtctccgtgcacttgattgactttgttagtgatttgagctctgttctagtagtgaactcgttgtgcttcattcgagctcaagtcttggcttgtgtgcgtgtgtgttgctgtggatttgtatgtgttgctccccacccttactcttattctttcactgtgatctttgttgtaagggcgaaagactctaacttatggagattcctcgcaaaccagaaaaagagataagcaaataagaacaccgtggtattcaagttgatcattggatcacttgaaaggggttgagtgcaaccctcgtccattgggacgccacaacgtggaggtaggcaagtgttatacttgaccgaaccacgggataaactcgcgtgtcttttgtgattgtttttctgtgatacttgtgtggtcgcaagagctcccgctacttagccgtactaacacttaaccaagttttgtggctattagtatttgaattttacaggatcacctattcacccccctctaggtgttctcaattggtatcagagccgttctcttcacgtaagggactaatcgcccgaagag

SEQ ID NO: 11675 - DNA, 1495 bp, Zea mays
tcaaatttatcatatatcttcctaaatgatatatataaaaaattggatacaattcgaaaacaaatatgtgtatttttcattttttgttgttgtagggggcaattaatatataaaacaatttgtgctaaattttattcttatttataataatgtgcttcataacataagaaaagtttagcgtcaaatttcttatatatctattttaaaatattaaatttgtcttaacagttcggatagccaatttcgtcccttcagatagggcataagaaaccaccaaacccaacacaacaggaatccacgtgcaacacaacgctcacataatagcaccctcctaggtgaaggtggacaagcgaccaaacgagctataaaaaaggttgtggtccttttcaacttatatctttctctgtcttttggttaaaataaaatgtaataagctaaagactagaagtagagacgttctgtctgaatcaatataaatcttacgttcactgagcacaccatcgagatacaaaacacacacatacaaatttattcgtcgatgctgattcgaaacatcgacatatcggatatccaacaggatacccgtatccacgggtaaattctccatccacccgggtaaaaggtagtaaatctatattcttgccaacgacaatactattagaccttgttcggttaatcccgttacccatgtattggatgagattggaaaaaattaagaaaaagtttgacttgcttaggatgtaaacccatcaaatctcactcaatccacatatgttgagagctaaccgaacaagccccttaggggcttgttcggttattttcaatccatatggattggaggggattgatacggattggaggggattttgacttactagggattgaaaccccctcaatccccctcaatccatatggattggggtagaaccgaacaagccctagatggatctttcaatctcccgcgtcgagttattgtcatgcgattagtatgacatttttgtggggggcaattgggtgggtatccgtaccgcagaactccggcaacgggttgtagccagaatagcatgccgaaaagaagcagatcagctaggctcgggaaattaattttggcttcacaacgcgaaccaagaaaggaccgggattaatttccattcttaatctggtacgatgattttggtccggacaaaaacaacgggccaggtacggttttgtctagaactcaagcacgtttttgctctgaggttgtaggggctgtttcctattatacgctaataataaatttcctcccgtagtcttctaaagttttggagcggccatgtaatttctttcaaggttaatatattatatataaatatactatagtacttgtattatataaggctaggctatgccatcatttagataccactcgtttcgcatcagccttatctgctgactatagctagccctaccaaaacaacaacgacaacacctgaacagcaatagtagcaaggca

SEQ ID NO: 11676 - DNA, 146 bp, Zea mays
gggagctgcctttgatgaagcctctcagctcatctgccagcccgatgctttccgtcacaacgatatggtgatttttccgcatgccgatacagcaagctggccgctgcgccggcgccagcgctatcggcttaaacaaggcgtgcgtt

SEQ ID NO: 11677 - DNA, 510 bp, Zea mays
atcctctttagtcgacctgcagcaggggtggcggcggcgatggcgatggctcctgagctttccgctagcggcgccgtgtaggttttcaggtgtttgctgggttgggttggcttgtcatgttgcctagttttggtactgatttggaccattgcttatttgctttgagcgccatgctcccgtgctcggatgcccagctttttagcttgccccccgggtcgccgaaatgccgccttccatgcgcctcatcattgtgggaatctgctgctgcgtttcggccggcttacttattagtgtatttgttctggatgcaaatctaggggtggggtggcatggaatgattagagccaccggcgcgtatcagcctgtgtctgtatttttttttttttacctccgtgtgcggagaggaatgctcgtgctgtcaccgcgagaaactgctccgcggctgctcgaccagtggttgttggtttcagtgattgatttgcttcgttgcaggcaggcggcaggccgtcc

SEQ ID NO: 11678 - DNA, 1500 bp, Zea mays
gacggtcagaactgaagaattgccggaggagctcgtgttccgtgattgtttttgcatgagtatgcctgcactgcactgcaccctctcattgcacaactgtgacggatgggcgctggttccgcacatgccgagtgtctgctgccacgctctcccgacgccgagccgagcccgcggccaactacaggcaagcacagtctcgtcgctgcagcgcggccggcaggccccctgcggcgggacagcgacggagccggccagccggggctgctggtccggcccaccgcacggccgccgctgaggtcacacggtacgcgggcgcggccgacccatctgccccctccgtccccgcacccggccgacggacggccgggataatccctccccgcccgtgaccacgtctcctttcgaattaaagcgccgtgcccacccaaggacgggggcgccggaccgccgattaaagcctgcggtttgcacatgcacccctgcgttcctgcgcaattacgcccgtttaatcgtcgacaaagcgggagcaattcccaagtaaagccaggatcctcttcgatacagaagctgtgaatccacctcgcttcttgtctcattgccacctgggccccatacgttagggtgcaaaatgaaaaaaaagaacacagttttctctgaaagaaaaaaaacctagatccgtttttttcttggattagagttaggagagctgtaggcccagcaacaaagcccccgccaccggatttggggtgatgagatttcgcttcatctatctgcacgggcctcgtgagccgtacaccgcagaccgtcactttaattgcttctttgtccgtacatgccccgtgataaacaaaccattccccgcaagaaacagcaaacaggcacagccctcccctcctccactcctcgccctctctctctctctctctctcatcccgtcccgagaagcggacaaagcgcggcgctgcagatttcgatccggttcccaatgcctcccatgctcgccgtcgccccgtgctagctcctctcccgtctccgcttcctccacctgccgcgccagcgccacgccgcctggatccggcgagcgcgtggccgggagcctcagatccgagcgaaacccagccttcccgtggtgacggccttcgctctagctccagattggctggcggctgccattcctcctcctcctcttctcgctcgaggtttcaaggcgggtccgttcagctctggtgggttttcgggtttgctcatactttttcttcggttggtttgcttcagcgtggtccagatttagctgcattttctcgggctgtgttttttctgtgccagaaatctacggaggagtcttgccgccgctttaaacgtagaggtagagctgtagtatatattttggcgagtaatcctgcttcttgctccgttcccgtgctagtgctggcgtgacagtggaaaggcttactgttgccatggtattggtgtgacgaacccgtcaaggttttgcgcaag

SEQ ID NO: 11679 - DNA, 316 bp, Zea mays
gcttgcatgcctgcagagcaagcagccataaagaatatcattatgcatagttagcagactgcaacttcccttcatttctccgtagtagtgttcgacatcataaacattaactggtcagcgattaaacttattagacaagactctaatccaataagacttgctagctagttcatcaagcgatggccggagattaaggatcagcagccagcaacacattgagtaaaaaataaggagcaaacttgccttgtggaaatcccaataagtccttgtggaaatcttcagtccagacaacaggcgaagcccagaaatcccaatc

SEQ ID NO: 11680 - DNA, 390 bp, Zea mays
catttggccatttcccactggccacgggcctccccctccagtcggccagtcctctccctccctccctcctgcctggccgtccaggcttggcgcgttcgttgcttggcagatggcaaagagtttaccaactcccttctccctccccttccccgccccgctcccgcgtaatctaaccgctgctccgattagcgccatcccaccgctataattacgctcccgccctgcgcgcgcgggcctatcagcgctagcttagctatccggccgcatccgctgctcgcctcctcacttgcgcgtgtgtcgtgtagcatttagtcagctgctcctgcttgctagggttagggtttgcgggcgcgcgcgcgcgtgcccgcgcgtgagctggccgcgggaggg

SEQ ID NO: 11681 - DNA, 1446 bp, Zea mays
aagcaacacttaaacaaagtcttattagttgcacgtagcagcccttcccaacaggccaaactttgtaataataattgtaaaagcaaagttgaaccctctggaaacaaaatagacaagagaggagagcctggtgaacggtgaccacggccgtgcacgtgcacgagtgagcagagcagggaaggaaggaaatacgctggcattccaagaggacacgtgacgtcgtcctcgcgcgcggccactgtcctgtcctgttccagtccagacgcgaggccaggccagacagacccatgctaggctatggtggatgcttcctcaggtgacatggacgtgtctgtgcgtcttcagttatccactggtcggtctgctcctagaatccagtccagagtaacgtaggagcaagccatggactggagcgatagcatagcgcactgttcatgcatgcatgggcatctatctgctggtgtcgtcgtcaggtcgatcagcttccatgggtcgccacgccactccgcggccgctctctttcggtcaggtgacgagcgatgcctcggcgtaccgatcaaacatgtgcctacacctgcagtgggtctttgcatcgttcttgttcgcagtcgcccgcagtggcgagaagaggacatgcgcaacgtacaaagatttcgccatctcgccctgccagacagccatcactccccgtgatgatggacatggcctccgagccgacggcgacggtggctgggatggggcaaagttgctgtggtaggtttcgccgggctcctccttcaatcccgtgtcaggtgttggtggagtgcaggtgcagcagagagccgttggcaggccgtcgaatctcatatagggcccatgtaaatctggcctgcgcctgacgtatgggcctcaaaactaatttatccaaataagtttttcctcttcttttttattaatgccgtcccgtggtgatggtgatggatattgatgccgatgcggacaactggatgtgcagtagcgtacgtgtctcgtggtggttgataggttcgcttctagtaatcagtttaataattagattatatttaatacttctaactagcattgagatatctattgtgacatagactaaaattatattgggtaacttcctatattattaaccttgctctaacggtaatttgagatagggatccatttcatatggaaagattagagatgctagcattaattatgtcggtgtccaagcagggagaaaataaaccacgaatcggataatgctggtggacccagctgccacctgccatttgggcccccgatgcttgaaacacccgccgcgggccgcgtcggcgtcggcatccgtcgccacaaaactctcctcgcaagcgtcgccgccccgcacagatcaaccgctcgaaatttgggggaagcaagcgagagcagcagcaagcctcatcgggaagtggagag

SEQ ID NO: 11682 - DNA, 1500 bp, Zea mays
atgagataggtgatgaagaggctccgtgcatcacgctaaggaacatgtccattggggatgtgtgtcctaaggaatccaaagagcctccaaatgcacaagataaaccatcctcctccacgcaagcatctccaccaactgaaagggaaatgtgcccttggaccatttctaagtattttggtgattgagtgtcaacacaagtgcttaaatgtaaatcaatgcccatggatgaacaaagtgcaaatcttcaacaaaggtatgtttctaagtcttagtacattggttttgtgtactaatatatttgtctaagtgttagaaacagaaagaagaagagaagagaagacttggctgtgtgcagccaaggggctgtttcggtctggggcaccggactgtccggtggtgcaccggacagtgtccggtggtgcaccggacagtgtccggtgcgccaggccgcctcggccgaagaggccgctctcgggtttttctccggcgacttcggctaaaattcaccggacggtccggtgtgcaccggactgtccggtgagccaacggtcggccgggccaacggtcggccgcgcgatcggcgcgcgacacgtggccgagccaacggtcggaaagatacaccggactgtccggtgtgcaccggacatgtccggtgcgccaacggtgcgcagatctgactcagacagcaacggtcggatgcgctgtttaaggaaacaaatcgggcaccggacagtgtccggtgtgcaccggacagtgtccggtgtgcaccggactgtccggtgcgccacgagacagaaggcaaagatggccttccagatttgttcccaacggctcctagctgccttggggctataaaagggacccctaggcgcatggaggagtacaccaagcattcctacaacctttctaagcaccaagacattgatctagcgcattcgattcattgtgatagcatacagagctcttgtggagttgtgtactctttgagttgtgttgcgagctcttattgctgcttgtgtgcgtgttgctctgatcttttgaagtcttgtgtgcgtcgctcattccctcccttgctccgtgattctctgtgaacatcttttgtaagggcgagaggctccaaattgtggagattcctcgcaagcgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccaccgtgtcatctctgtgattgatttcttgtggttattgtgttttgactcctctctagccacttggccataattgtgctaacacttaacaagtttttgtggcttaagttttgaagttttacaggatcacctattcaccccccccccccctctaggtgctctcaattggtatcagagccgttctcttcaagaaagggactaaccgcccgaagag

SEQ ID NO: 11683 - DNA, 1500 bp, Zea mays
tatgccaaattgaatcaaaataaatttgagtttttatttgaagtgatattgcacttgttctagttgcttaatgttgtgttggcataaatcaccaaaaagggggagattgaaagggaaatgtgcctttgggccatttctaagtattttggtgattgagtgccaacacaagtgcttaaatgtgaatctatgcccatggatgaacaaagtgcaaatcaagagcaaaggtatgtttctaagtcttagtacattggttttgtgtactaatatacttgcctaagtatcagaaacagaaagaagaagagaagagaagagttggctgtgtacagccaagaggctgtttcggtctggggcaccggaccgtccggtggtgcaccggacagtgtccggtgcgccaggctggctcgagcgaagtggccgctctcgggaattcgccaacgacgtacggctaaaattcaccggactgtccggtgtgcaccggactgtccggtgagccaacggtcggccgggccaacggtcggccgcgcgatctgcgcgggacacgtggccgagccaacggtcggaagggggcaccggactgtccggtgagccaacggtcggccgggccaacggtcggccgcgcgatctgcgcgggacacgtggccgagccaacgggtcggaagggggcaccggactgtccggtgtgcaccggacatgtccggtgcgccagcggctcccagatctacaacggtcggctgtgccgtttaaggaaggaaatcgggcaccggacagtgtccggtgtgcaccggactgtccggtgcacccgacgacagaaggcaagattggccttccagatttgctctcaacggctcctagctgccttggggctataaaagggaccccctaggcgcatggaggagaacaccaagcaaccttagagcattcttgatcatccacactcagtctttgcgcattcgtttgtcattctcagtgattcgagctccgttctagtgagaactttgagatagtcttttgagctcgattcttggccgtgtgtgtgcgcattttgctgtggatttgtgtgtgttgcttccctcccttactccgtacttctttgtgaaattcaattgtaagggcgagagactccaagttgtggagattcctcgcaaacgggaaaagatcaaagtaaagaagaacaccgtggtattcaagttgatcattggatcacttgagaggagttgagtgcaactctcgtccgttgggacgccacaacgtggagtaggcaagttttgtacttggccgaaccacgggataaccaccgtgccatctctgtgtttgatttcttgtggttattgtgttttgactcctctctagccacttggcaattactgtgctaacaattaaccaagtttttgtggcttaagttttcaagtgtcacaggatcacctattcacccccccctctaggtgctctcaattggtatcggagccgttctcttcacaaagggactaaccgcccgaagag

SEQ ID NO: 11684 - DNA, 191 bp, Zea mays
ggtaattgctaggaaattagggtcaagatgcaagggagataaaacttgcatttgggtccctaaaaccattgtgactaaccttgtaggacccaacaagagttgggtacctaaaacccaagcctaaatttgccttgcaggtttatgcatccgggggttcaagctggattatcgacagcggatgcacaaaccac

SEQ ID NO: 11685 - DNA, 266 bp, Zea mays
gacaaattaaggatgagaaagaatgctagctagccaggtgcatttgaatgaaccagcatggattcactaatttctacgatcatccaaatcttgaggtgtaatttgtttccatatcacaataattccatgcaatatgccatacgtactgctataaaatcaccatatctccgtccctagctccttcccttcaggatcgcagccgccattccattgcgtttgatttggtttgatttgcaggctagctagggcagccgccggcgccgggc

SEQ ID NO: 11686 - DNA, 904 bp, Zea mays
cgtcctagttatcatgggagaacgactagagggcagaggctccagcacggcatgcatggcccccatcctatccgtgcaataaaaaaaaaggcggaatcgacggagacagaagcagaccgatcgacgaggccggtttgaggcctagtgctgaaagcgtccccggccgtcttgttcacgttattcctgacgatctcggtcaaagctccgtcaaaccgtcgatttggtataaatgttggaaacatttagccaccaacaggcctacctgaatcacacatcttaaaccaccacctcgctgcaaaggaatatgatacggttgatcggttatccatcagcaacagcagcatcagataggcatgtatgatgacgtgtaatttggcccgtgtatacgacttggaaaccgatgcggacatgcccagccagcccagctagcgaccacaccccgcaccttccagaaacgtacgtggcagaccctgcctccgccaccttacgcactctcaccggcaggtgggtcctcatcctccgaccccacgcgtcggtggcgtcactggctccctgcacccctccccgcgcgccctcccgtacacgcaaggcacccccccgggacgaaacgaaagcgagaggagggggcagagctttaaatggccgcgaagctaaccaccgccactagagtctagactagagccgcccgcccgcccgcccgcccgtgtgccgtttaccggagcacaacacaacgcggccccctcacggcgtggagtggattgggccgacgccgatcgagagcagaggagaggagcgcggtcggatagggtttgtctgggtgaggttttgagcgagagcgcagggcgagggaaggaggaggaggaggaggactggctcctggaggaggaggccggccggggcttgg

SEQ ID NO: 11687 - DNA, 286 bp, Zea mays
cgatagaaataatagttctactaatatattgggtgaaattttgaaaaaaaaactccgcccgccatcgcgggcggccacctggtagggcggttgctgttgcggttgcgaagcacaagtactgaaaccacgcccacgcgcggcccaaacgccccgtcgccgccattcgccgttaacagcaacaagttctcgatccgcgtattcgccgatcagatcctctcctccctcacccccttcagccttcaaactctatccgagaaccataaccacccatccgatctagctcgcc

SEQ ID NO: 11688 - DNA, 101 bp, Zea mays
ggtgagcgtccatggctttttcacctgccgccgagtactcgaatgctcttcgatcccataccatcatatgagctgccaatttggttgctaggtcgtcgtaa

SEQ ID NO: 11689 - DNA, 834 bp, Zea mays
aaaagctgtgaaatcttttgaaacttttatgtcatacttttatcatcaaaatatatgtccataccaagtttggtaatttttatcacatttacatatttttgaataggtatgtagtaattcatttaattgatataaaatagtgaacgggttaagaaaaataaatttgccattccaaaataaatgaatatgctatattaatgtgtgtaccaaaatgtaaatgaatataataaataaattaatctatataatgtaaaatggagagttgtagttgaatgtttatgaaaataattgagatgtgttctatttgctaacactttgacataaaaagttgcaaaatcttataaaaactttatgtcatgcttttatcatcaaaatatgtgtccatgccaaatttcaaaatttgttgaccacatttacatatttttttacaatttctataaataaataagcagcaattcatttaactgatataaaatattaaatatgctaaggaaaataaaattttcattccaaaataaacgattactctatttatagaaatttttcttagggctagtttgaaaaccttatttttctaagaaattttcatttttaagaaaaattaatttattttcccttataaaaataagaatttcttctgaaaatagagttttcaaactagcccagtttaaaagcctggtcgttcaaaattgaataagaatctttccaacaagaaaatctgtactaattcggcggcccacattccccaaccccaaaacgcagcccacttccatcgaagctacgaaacccatgtcttagcgcggccttggtgccgtcgactcgacgcgctccacc

SEQ ID NO: 11690 - DNA, 1500 bp, Zea mays
ttatgctgtgttaagggccatagaagacaattttttatcatttttaatcctttataatgcaagtggttttgtttttttatctctttatttatgtttttaaattagaactcggagtttaatatatattggtagagtaaataataaaatacgtctataagtttaatttttttttcatagttagttagtcacacataaaacttgattgcacaatagtttctaacaaaactgtcacgcaagtgcttgatctgcgcttgtagatggtcaactaataaattgaacaagctaagggtcgttgagttgctaactgtgtcaacctgttagcagccgcaagtaatcttacaattaaagggcgggtgggttgccggacactaagaagcggccattacaactagccggatgctgctgtgtaatgaaaccgttccagcaattgttgtgtaagtaaactactaaaggttgttaaaaattgttaaagcatttttttggaaatatactttattatttactctactaatacatcaaattccaagttctaacccgtcccatattaagagccataaaagagtttttaatcacttttatattggataagattttgtgtgttttttttattttttaatatatgatgacttgttagaactccaaatttgatatattttggtagagaatttctttataacttttgttagtttaattgcacatcgattacatgaaaagcttaattgaatagtaggtttttttttgtcgaaaccgtcaaggccaagtgcctcatatgctctagatgttggtaaacaaataaattaaacaaggtcgtgtagatgctaactgtatcaacctgttagcagccgtaaagtaatctaaagttaagggggggtgttgctggaggttaggcactgagagaagcgggcattgcaactagctagcctgatgctgctgtccgcatgcagctactgactttgcatttggaaactattttacgcgcctccgttcttcaacgaggtcacttcagatgttttggttcccaaatatttgcccggccagttatcctgtagtaccgagagcataataatcctcatcacagagttactccaagtctaatacgtataataataataatataagtaaaatgaagacagaatagacacaacaactagagaaaagagcgaaaagaagactgacccggtcgtcctccactccacaccacaaattaaagcgcacgtcgcagtaccgcagcatgcaacctccactcccccctttttccacagcacgagaaaggaaaattctttggcaatgaagcagcgtgaaattaaaccatcaccatgtcaaactctcgacaacaacaacgcgcatccagcctgcctatatatataacctgacgttacctacctgtgttcaattctcattctgttcttggagcctttttcgaagcgtagcgtagtacgttgcgttcttcttcaacagtcaacacgaccacgtacgggcgacctatacaccgtcgtcgac

SEQ ID NO: 11691 - DNA, 189 bp, Zea mays
gatcggcccactagaaaagagcccagaatgtccggtccatccaactatgatagcccagctaacaaatattactaccaggaggggctccgcaccatctagccatcagatcaaacaatccccaaacgcctccgcctccgcctccctagggttttgctctcggctcgtcggatccagttcgggggatcctcc

SEQ ID NO: 11692 - DNA, 575 bp, Zea mays
tagtcttttatttaaaaataaattagcaacgataaatattcgaaaaccgagttatttctatttctacaggggtaggggggagaaacaaatacgcgtccgtgaataaaagatcaaaaggaatcgatctaccaggcttattttacggggaaattacgaggctatcgatagttagttacaggataagggggattggcgcccgaaatcttcgcctaccgaccgctggaccccgcgccaccgcacgccctgaccaaccaggcgggtccacagggcagagaccaaccaggcgggcccacagggcaaagggagagaaaataaaaagaaaatatatacgtaccagaaatttatctattttacgggcggataaagacgggcggtaaatcctagtcccatccaatcccgtcacgttcggcgaaacccgggttataaaaccggagcacctcgccccccctctaccaccaccgcagccgcagcacaatcgcctcgccttcccttccccaccagcccgtctctctcttctctctgactctctctctcgtagccgcgtccacctcgcagcagcaagcaagcgcgaccaa

SEQ ID NO: 11693 - DNA, 84 bp, Zea mays
ctgctgccgtccgtctcgcgggcggcgtccctcgccgccacggtggtcgctgtcgcggccgccgccgcggcgctcctctgctgc

SEQ ID NO: 11694 - DNA, 1500 bp, Zea mays
ccgaaagtttttctcctcgcgaatcagacgcgcttccatctctaccgcgcaaggttttgccaaaaaaatagtaaaaaatcctaaaagcggaggtgcgcgtggaacacacctgccgcccgacctgtttgtctgtttgcggcgcgacgtgacggtcgcacggcgcggcgtcacgaatcggtttggtcgctccccaatgggtccgaaaggaacagagcggaatggactagcacggcccggtttccgtgcgggcgccatcccgtcgcggagcgcccaaccgggatggaatggaacgctgcaaaactgaaaccaaggggcagcagaaacagacgcgcccggagttgcccgagtcagcacggaatttcctctccctcgcccacccatcggaaacgaactccgcttttacctcttcctcgcccctccctcggaaacgaactgacgcttggcgtggctgacgggtggggccgcccaccacgtgtggcggccgggtggcgtaaagggactcccgtttcctgtcccgtgcgtgtcccgcaccccacctcgcaacaacccacattaatgtgggggccgctgcaaccgacacccaccgcgcccggcatcggccgtccgtccgtcgcaacccggcgaatctcgaggcgtccgcccgcgtgccctgcccccaccgagcgctgccgctggtggctggggccctcactcgcaggcagagacaggcacgcgtgaacgcaccaccagcaatggtgatggcccacatgtcggacggtgaaattggaacagctacaggacgctgctttgttgctccgtataactgtaacagtaggtgcagtggcttttctgttccgcttttcccgtcggccatcagccaatacaaaattgtctcgccaaacagaaacagaggcatgagccacagccacagatccgtgccacttatacaagcgggtcctgtccacccgcgagcatctgggagatggtaaacggcgatcggcgaaccaacaacattacaacagacgcccgcctcccgtaacagcatccagaaagcccgcgaatcctaaagcacagcacccacgggctccggccgccgcctacccgccgcttcccgatcccacacgccgacacatgggtccggacccatctatcggccctgcggctccacatagtcgttaggtttccgctcgacgccgcgtcgccctctcgccggcctcccgtttcacgaatcttcggatgcccagatccggctctcctcttcccacctcctcttcactgtctactactgccgctagccgcgcctgcttgctgcttccccctctctttttctctcgtctccattccagcatcgccaccaccagtccaccattccagcatcatcaccaccacccgagacaaaaaaataaaaaaaacccaacaacactgtaacgagaatatacggcaaaaccctagatctctctctcctctcggcattgctggctggggtgtgcggcggcccgcagtggtgagggacgcacggcg

SEQ ID NO: 11695 - DNA, 998 bp, Zea mays
tgcagcgatgtcgtggactgtccagtgcagggccgcagactatccgcgctcttgcagagaacaccgttttttccggcgtttggtgtaagatgggtcccaacaccatcatcttatgatagcatgttgacacaccattatgaatgactaaagtagctcaaaagtacaagccgaatcatcccgttcgcttgaattctacagcatggcagtacaacggttctgactaaaagccgtttcatggaacattgtgcatacaacagtaggtaattagaaataaacacaactgaacaggctcaatgatagccttcatctaacgctcacatggtacaactgctcttagcatccggatccgtggttctgcttcattgatgaattagattttgttggttttgtctttaaaaacagctttatcaatagagtcaaatttatttattaaacattgggtaaaacattttcttttgaaaattgtagcaaagaaaaaaaaagaaagagctagtatttttagtttactgtgaagttagctaaaaatagcttttagagaaaaactattatagtaaataaactgtagtacagtattatgtaattgtttccaccaagccagtccaactcgagccaggacactagacaccagaccgccggcgacagagtgtgtgtccgtgccgtgcgtccgtgtgcgccgagcaaattccccaccccggtcccctgccgacgtggcttggcatcctcagctggatcgcgctgaagtaaacgccgcttccccaatccccaccccacctggtcctcctctccactctctcttctccctccaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatcg

SEQ ID NO: 11696 - DNA, 1500 bp, Zea mays
tcccaaacctttggtttatatttcatgatgagtttaaacgaataaaaaaatttaagtagtcatggattattttagggcatggattgtagcatggatttaattccaatccatgttaatccagagcgggattggtgtaaacgaacaaagcctaattwggctagccggggcgggacttcaccactgctttggaacaatgcctccctctttgatcatctcttctctgcccgcccgtgagtccaaaatccaaatagcagcaaacaaatggaaaatgttggttgttggtcatgacaacagttttaataatatagcaggtttagaaagaaggtatgcatgtcttgaaaatttttgatgtcaatgagtgataatcttgtatactaagggactagattataggaatctatggtccatcaaatctatgatacttctgagttacagtctggaagacttatagtcaactgaaaacctaaaatatgctctcgtgatgcctgaagcatgaaggtcaacgattttcttttcaacataggttcaatctgtcaagcaactattattactcaagaacaagcaatattcctggaccttttccaaatgtttagcacgagcaaagactggacctgcacatgttaaaaggtttacatgtgttcatgtccttaatgttgattccagttgttgcgtgctaccaggttgggttgtcaatcacatgctatcaaccttggattttgaaactctcttttagaattgcaataacttgaggaaggacaacagtcatgtcatcttggctaaccttcaggctgccgtttacatgtttagttcttataggtaaattttagtaaagttcttgtgtagctatgtattatgcatgagtattgagattcgagaattagtgaattggctgttggcatgaatcgtatcattagagcggcctatgctttgttgttaattcatgttgccggttcaagtattgttaatttttagggaaccatatcatgccactgctttggaacaacattaatgttcctctcagtgttacctgactaaccctcgtgactccctctgtctccctcttcaatcatcattcatctcttctctgcccgcccgtgactccaaatatgctgctcgaagtccgatgagcaagcacgctgccaatcacaaatcagctcgtgatcgcgttatcgccgcacagtagagtgttgactctgttttctcgtcactgatcgtcacagtacggcatcggcattccacggggtgtggactgcgaatttcgcgccattttccatccgttaattaacgccgagcatgacaatatacgtctcgtcgttcaccatcagcggaggcggccccggaacgaggtgctgactggtgagccgacgagcaagacgacaagagccacccccacccaccacatctcagaccacaaacgccatcatgcaccgactctgatccaatttcacacgcatactagcgccgccggtagcagcaccggcagccgcgttcctctccgcc

SEQ ID NO: 11697 - DNA, 143 bp, Zea mays
ggcatgattgagggggcagggggctctgcctggtccctgtttcgctgacctcgcaagcataccaggatgacaccctgccggactgctgggcgcccgcgtacaggggctgcctgtaccgatgagctcggcatggcgacgactgc

SEQ ID NO: 11698 - DNA, 1500 bp, Zea mays
ctaaaagaatgcaaaaatgcaacaagtattactcaggacggcgatgaaattcttggtggattgtactgggttaaattacatcagattatgaatagacgtcgatgatgcgggcatgtacttggctatccagtgttttctgaaatcgaaagaggataacaaattgttattttagtcagtcctacaaattcgtgtcaaaagggcaacatgtgtttaaatttgatatattccactcctgacgagttcagaaaagtgccctctttaattcacaaaaaaaatctttgtacctgaaggtggctcttgatgtgatagattgtgaggccatcacagttcgttagcatcataatccccttgggagtcacctctgcaagtgtcacgcaaaaacaagagaagactatatgaatccgtgagaaagagaaacaattccatagccttcaattcgattaagcaaagcagatagattaaccaagaaccttgcagagaaaaaaaaagagcttcagatcaaggacggttgctcaatgtccgcgatgtcgagctggttcacgcagtagatgaagcactcgtggaggtcctgtggccaccagatccgtgacttcttggtggcatgtaccaatgttgatatttgcttatatatgaggtattccgaatcatagttcagaaggctaaaattttggttggttttgtatgttcattctggctactacacttttcgtctacaacaacattgtaacaaaggaatcttaaattttttattagaaaacctatgcaacaaartcattctgcaaacagaacttatatagtgtgcagtctgacttaaaaaaacatttagataccatgaagatccatctggcaatctgaacatcctatggagtagatgtttctgaaaagaccatatatgacataagacttgcacataatggcattgggattttaataagtagtagagattagtactgttcgatggctcaaatcgataatagtatttgttttattttcgattggtagcatcaaccggcactaaagctagacgagcctttgatggccaaaaccacgttctaaatgctcttctagatttattattatcaatctatcagccggttctaatattagtactgttaaaaaatcggtactaattggctcttttaaagaaaacgctaacattttttttgttccatcaatttagtaggaacatgtgtctccctgtctctgtttggtgttggagccaccggatccggacgtccaattttctgcgaccattctaaattcgtttttcataaacattatgaaccatatatagactcaaattcccgcaccatctcagtgggtcgaccttgcgtaagcagtgagatcacagcactcactatctgtaccacaattccacaaaaagaatattgtgctcaatctcgccggcccttgccgccagcaagttatagcttttaactttctcaggacacgggagcccttcttgccacaaaagttttagttccaactgggagagctagc

SEQ ID NO: 11699 - DNA, 587 bp, Zea mays
tccctaacaagccctaaagcttccatagtatgttcatctaacctaaatttaatcatacactctattgtgttttgaccaacaaagcaaaattccatggctgtaccgttgccttaaacccttttattttgctttttttccttcccctttacatttgagcacttaattgttatttgtggccttcactattctttctatggttgctattcggtgatcaatcttaaatttggagtaaccaaactcattcacagtactataggcccaaagtgttgactacctgggcggcagcccggcggctaaccgtagctccgctgtacagctgctagtcctaaactcctagcagctagcattgcagttgaacccattttatttgaaaaaaaagaatagaactaatttgaaccgattggcccaggtgtcagagagcccatgtataccttttggcccattccttcctcattcggctataagatgagcacctcggctgccgttaccgccttcctcccataacaaagccacgttagccgagagctcctctgctcctctcgtgtctggccgaacaggcagagcgaccagtctccagagcgctcccc

SEQ ID NO: 11700 - DNA, 260 bp, Zea mays
gctaaagattagtacgtaatattagttagagtatctaatgaatcgactttgtctcgtcaacttcctccaccagcattctttttcagcgttgagtccaagcaatgcgcatgcacaagcatggagatccgagcctcacagtggagtgtaccctaatcaagaactgatcactttttcagtttgccacgtcaattaactagctagtctccggacgatccaaaggaagtgagtcgtcctcgtccaagacggcaacctgctgaata

SEQ ID NO: 11701 - DNA, 1500 bp, Zea mays
gaagaacgcgaacggcctgacggcggagcggagcggagccgacaggcgggcgggcgccgacggcgaggacgacgcgtcgagccagcggcggaagagcgagctgaacccgggcacggaggagagggggctgcagggagctgatcacatgccaactagcgatggccaaaggggtcgcccggtccgggtccaggcccgatgaagcccgactcattttgggtccgatccgctagacacggttagaaaatcaggctgggccgtctaagcccgtggactcgatttcctgtcgagtctggcccacagcgggtctaaacgggctcacggaaaaaagcgggccagtaaacacgttttagtgcaaaaaaacgggtttaacgggcttagaggtaaacaggtcgtgccggactagcccaccgtgcctagtttactgtccgagcctggcccgcttattcgtactgagctggcccgggcccgcatagaacccatgctagagatggcaattggtacccgctacctgaaacccggtggatttttctctattagggtatgagtttggattaatttctctacccatgggtttgttaatgggttcaaatgaaaacccaacgggtacgtgggcatggatttgttcttccactaccatacctgcaaacccatgggtttttaaaacccgccttaaaatcattattccttataaatatgtatcataatattattaattgaatatgttctaattgaaataaaatttatgtaacaaattttaggctaaaattagttatcacttgttccttttatgctagcttattaatgtattgattgtcatttacatgatgaattattttttatgttgatgttagtgggtatgagaaacctgttgggtacccgaaacccgcatgagtatggatttgggcaaaattttatacctgtcatgggtatgaattttttagcgggcgtatttttcttcgcgggtatgagtttggccaattaatatccagtgggtttttacttattgccatctctacaccttacgcaggctagtaactccacagctgacatgtaggtacaaccctacagcaaatcagcaagtgtatgtccttcaaagaaaaaccaacgtgtcctttccctttcagcctatcgcccactctgattctagtgggactcattgttcagtgtaacagatgcgcctacgtgccatcctccacatcagacaactgcctcccgaccgtcctggtcccaccagtcagtatgtttatgctccaaaatccaaatggatatggatatccactagactccccgacagaacctggcttgccgtcgcctccgctcggtctcggtctcgctctcgctgcattcgtcttccccgcccgtccgtccgcccgctgatctcagatccagaccaaacgaattccacactaaaccccccctgccccagacgtcgcgcgcatgaaatgaaaccctagtgaccccgtccagatctcggcgtccggatcactgcgtggcgccgcc

SEQ ID NO: 11702 - DNA, 423 bp, Zea mays
cctgtcataggtgatgagatcctggacgaagaaagtgcaggagtatcccctggttttgttcacagtctagatgttctgacagacaggacctctaagctgaagctatatcttaattcgaaggatttccttgatctttggaggagtgtagcggaaggccttgactacttcatctacaacatcatacgatggggtgaagtgtgtttctctgaccctgcacctgcagccatccagctaataagacttgatacaaaggcccttcctccacatctttaggcccttctgttcaagacctgaagcttttctcccttttctaagcgaatcccccgaggttgttgaccatgaacttgttggaaatgctaacggttgacacaatggagtgacaaatgcggaaatgcctaaagcatcaagggctgcaccatgtaa

SEQ ID NO: 11703 - DNA, 1500 bp, Zea mays
actgtgttcattgtgtaggctcctaccgaagagggctgctcggggctgtgaagctcctctgatgattgtagatgtagacagctagggagccccacaaggatcttcggctggcgtgctcacagctggtaaaatgatgctggttcaatcgtatgtatttggcagaacccgatgcgctagcacctggacatggtgcgcgtaaccgtggcgcataatgtaatagtgtttgtaccagatttttccttctgaataaaattctgaataaaagcatgtgcacatgacagctctccagtttagctggtggccttgagtttccaaacgagacgtgtcctgttcattttaatctcaatacatgtggattgaatacacgtggatcggactggaatgaggccttagttcgtttgtgttggattgcacccggaatcgttccagctaatataagtttatataaattagagaagcaatccggttaggaatcgttccgactcactaatccgatacaaacgagcaaggtctgttccgacacactaatccggcacaaacgagcaaggcctgagtggatttaaatctctagaagttaaaacatttcttagggctcgttcggttatttaggaaccgttgtctgctttagagctagtttgggaacctcattttcccaagagattttcattttcccaaagaaaattagtttatttttccttgggaaaatagaaatcctttggaaaattggagtttccaaactagccttgattttttttcctaagatatgtgcagatctttctttgagaggacacaaaaaaaatggattgggattgggctcatcgaaggccgaatattcctatccatcgttcgtgccggattaggcccagaaccagaaaagagctaggccgggctgcagtagcactatcctctgtttcacaatattatgcacttttgatcactttatttatgtcaaaaatacttgatacatcacgttttattttcactttcgcctctataaaagtattaagggatttctagacaattcaaaatgtaattttataagactatgtttgtcattttataaaaaaaaatagtttgattattttggtgaacgtgccttggtcaaaatttgtgggaacggaggatgctatcaaattcgtctgcgcagatgtacgcccagtaacgaagtatcgtcaatcgactgatgaccccgtcaccgtcagcaagacagcaactcaacattcaaattcgaccgtaataacatccacatacatacacggagtatcaatctagactagaggagacgggtgaacgtggtgagcctccgcccagaatgcaaccctactagtgctagctttcggccgcgaaaaaacgtccccacccccacgtctcaactttatagccgccccctccccaccgccgcggccgccacgcgcagcagcaacccggtagcaggagcgcagccagcaagctcaggcccccagccctactgcaaccgccgctgctaccgcactgaacacc

SEQ ID NO: 11704 - DNA, 1500 bp, Zea mays
tattaaattaagtatataaaaaaaaacgtgcccatcttcactgcagaacgcagtcggatgcttacgaacgttcatagatgaggagttcccgggccaaaacaaatccgcacatacactatcacgaccatgtacttgaagttgcctaacaagcactgccaacggcaccgacacctatacatgtccaaccggccgtgtcggcccggcccagccaggacacggttggatcgattggatccgacacgagtccaagcctgacacggttcaatatcgtgtcgggttagactggctcacgggctggctgacatgacccagactcggcacagttatactgaaacgggccatgccgagtcggatttggacctataaacaaaaaaaacactctaaaattcagaatttaaggataatattcaaatttagtttagattcaattaattatatttataattttagatacatacttagacaaagaatttcagatacacatataaacacatataacaattcagaatactcttatataataacatattatcagtattatagctaaaaacagactgaccgttttaaaaatagtcgctcagtcgggcacgattctagtcgggttgagttatgttcgtgccgggccacaatcgtggcgggtcatggacccactgccggcccggcctatttggacatgtgtactggcagccacgtacgggaccaacctgctagcatcctctccttaaattttaagcaagtccgatgtgtcatggcatgtaccctaccaacttctctcgagggtgtcttcaacataacataatatagatatataattatttgtatagtgaggtttaaaatagaacatgtgtgatagggaatgtgatatgaaagctgcgagagagaaactgaataaaacattttccgaacacggcatcaagccaaaaacctgaacacgccaaacccgtgttggctgtgagatagcatttgcatgatcggtttaggtacgagagtcccgtcgggaaaggcgaaaatggtaggcgtccctgccgtgcgatgcaagtatgcaacgtttcttctaaaatattcatacgtgtcatgacgacgactttcgccattgcgctcgcgctttgttgcatgacgataccggcccctccgcaaactagcaataggcaatcccaatgcatcatgccatccggccactacgtacacgtatctagaacgacagccatgctgtacccgctaccgtggtccagcagccctttcgcgcaccgtgcaaaccacgagtggacgtgccgccacacccttttttttctctctttcggttgcctcgtccctatatgtcccgcgcctttgtgttgtgcgtgccctccggaatccgatccgagccatattaaacagacgcatgcacgccgcgccggctggagcgcacggcggcggcggcctcctgcccacccagcttcgcgctattagctagcttgctgcagcagygtacgtgctttttcgttcgtcctgccggtctcc

SEQ ID NO: 11705 - DNA, 779 bp, Zea mays
agaaatctacgtgcacaactatttaatttaatgaaacggttgtgaaaaawttacttagtggtagtttgacgactctatttttaaggaatttccatttttaagagaaattaatttatttttttgagaaaataagaatcgcttgagaaaaataaaaagttcccaaactacgccttaaagaggagtatattcgtagatcattgcactacatctgccttctcagtcaaaaccactctgaaaaataatatactacacatatttttgtagactacggacgtaaacgaattttatatttgaaaactacgtatacggttataccgtgctaatttgaatagcttgggctccctccccagaattgaccgccaagcctctgcacctcacgttcctcgcccacacgatgttcacacagcaaacaccatctccacacaaccagaacttcacacgtgtcccaccgaccacccccgtccatccacctcctggccacaacactgcccacacaccctccccctccgcaccgaaccccctggcgcgcgctgcgctcccttgaccggcacgtcatcccactgccatgcgggccccgcaccccgcgcgcccgggggccgcgccctcctcaaatgcccccacccctcgcctcccctgccctcccctcctccgcacaaactcgtcgcttccgctccacaggatcctctgcgccacccacaaccgtgcgaccgtccgtgctgccggcgaccccgatccgccgacccgtcccgtcccaccacaccctaccgccgctcgcagcc

SEQ ID NO: 11706 - DNA, 441 bp, Zea mays
tgtttttagtttggacagtcactttattctaaatgagttgatttatcataagcttaccatatgaattttgatagaatgactatatttctaatgctagtaattattattagcagtaaggaatgaggcaacaaaagaccaatccattcaatttcactaaccaaacaatcactatgcttacgttcgttatatacttaaatagaataatattatattattaatattatttgtttgtatgagatagggccctatggcttgtgggggcctggatcgaccgcatcgtcacgagccattgctaaaagtggtatacgattaagttgtatacgcgatgtaacacctatgccgcataatggatgtcgacctctaaaaaagatgtctataaaaaaaatgaaaccactttcaagagaaataaacgattcaatgatcaaataatactagtctgtt

SEQ ID NO: 11707 - DNA, 166 bp, Zea mays
agaggcgctaccgccgctggtggccgtggcaaaagtcttgggtcgcggtcaagaaatcgagagtattctggatgacgtgcttagtttcgtagtattattatcactagtgcttattgttagcggttgttgggttcgaccactctaagccactgtcaaacagtaatat

SEQ ID NO: 11708 - DNA, 907 bp, Zea mays
caccctagtaaccgagcagcaaaaaaaagttgatcaatcgattcaggctggttacagaaacaacaggacaagtctccaatccaccccttctttgccatattatttttagttaacaacaaattgttttcaagtaaccacacaaacattttaatatttggcaggattttttgctttccatacatgtttcatgctagtaccataagtatagttatgattcacaatgtgagtataaagggatttgacactcaatgacttcaggatcattgtggaaattaaactgcatatgtcttcccacttaattctgcaatcttcatataaccatcttctaaagctcatttgccaaccattttcatcaggatttggttttggaattgatgaaataaaactagacaatgacgataatcaagagagagaaaatgattttttggattaaaacagcccgcattgacacagacagaggcaggccgacaggtagtgccgaaatgtgtctgcgtcggcccacacgaaaaactggatcgtcaaaaaaagctagcgctcccgcctctagcctctctcgcgagtcgccagtagcagtgggcgcagccgccccggcccggcccgccaagcggcaggcgccaactcaaaaaaggtagtccgaaacctcccgccacaaccacccaaggtttcgactttcgagttcgaatgcccagagcaggcaacgaaatccccccggaacggcggcggctctccccactccttttaaatttcgaaacccaccaccatcccagcaaacacaaatcgcgcacgctccccagtccccacactccccatccaatccgcgcacaccaagcccccaatctcggccgccactcgctgactagctgctccggcaacagtcccccccgaggtacgagggtgcgaccgcggc

SEQ ID NO: 11709 - DNA, 1086 bp, Zea mays
tttaagttaatgagttatatacttagcttaactcatttatgagctcgaactaactcgtttagctcgtgagacagagcagaataaataatatatacataatatttaatttctagttaattttaaactaatttaacaatataaaataatataaaatactaattatattcatagtttcatagaacacattagtgttaaattaatacaactcatcacttatcaattcacaattcacacacatatttatcagtttaattcatagttatattcacgtagaccaatttaacgtataaatatagtttatcaatcattagtttaatttataggtaataaatacaacacaacatataaatacaacatataaatgatatatatataaatttattttgctaaaatgtactagtttgtttagattacgagctggctggttaataatatcagattaactcgagtaaaaattcaaataagctaatcctagtcgagaccagcttaggctatgcgcagcgcatcccgccacacgccctctccccttcgtttagcgtgtgcagagcaacgctacacgctgcagcgctcaccgctaccgctgctacagtacaagcgcaatgcacagtgaaccgccagatgcagggtaacgctaacggctcctcttgcgtatttttgtaacacgtgagtatttattagatagagaaaaattgatagtaaatgaaaagtaggtataggaaatgatattttatagttgtagtggggtatagggggagaatatagggggaaccgctgcgggagataaaaaagtaggggatgaaatgttgatgatgtgatgtaaaaaagtgatatagggggaaaaatttaggggtaaccgttgcagacagtcttaggtagcccagccctatcgagaagctgccccttccgcctctatatcttcttcttgtcctccgcctccatttcgcgttcccttcgttgcgtcttgaaaggggagagagagagagagaagagagagagaagagagagagagagagaggagtgggagacccgcgagaggctgccgtgtagggaccgtagactcagcgactgcgaaggagggataagggg

SEQ ID NO: 11710 - DNA, 1169 bp, Zea mays
ctggggaggacgcaattaattaccctcccagatgcatacggatactggtgctagcctaccaccactcgtgagttgagttcagcacgcagatgtttggacgggatatatataggcgcgatgcagcagagtagacttagcagcggcacagcgcggagaggcagagaagtagccaaagccaagtaggaggaggagcggcaggcagggcgcggggcgagagcttgacgcggcaaccaccgctgcactgcactgcaccccctcgctcctccgagctcagcagctcgctcgcggcaagtcgccatgtatgcttttgctggcgcccgtcgcccccacccttttcccgttccccttccccgctcgcggatgagatctttgggtttggttggtttctttaagacccgagcgtccaaatcacccctgtgctgtgcctgccttttcttttgatcccaatttcctccttttccacccctgccctccccaacacaaagcgagattcttgcttgcttggcagaggtaaaggggggtgcctaggctatctgctagcggctcgtgctactattcttgctctcgcccgatgattgctacttgcaacgcatcttatttgacttaattagcttgcttgcttgcttatgttttctcctttttctctctcttttctcatcaggactgtatatgttttctctggtactccgtatatgtgtgtgtatacatctctctctctctctctctcttttgctgtgtgtctgtgttcctcgttgatcgatgatcatgcgtgtcgtctgggctggtcgacgatgagctatagctgggtagtatcagtagctagtagctatccccatgcatggatcatatcactgctggccggccggccggtggtcgctgagcactaactacgtgcctcttgtagccatgtcaggaaagatttatctggtcggccgatcgagctcctctcctccgaagcactgaagctccagcggctgccctgcctgacagccactccgcacgacaaaattaaagtgactttctccttctccccttgttcgatcctattccttccacttccactctctctctttccttccccgccctctccgccgcgcttctgctgatccgtgtgctgtgtgtgtgtgtgcgcgcgcgcgcttcaacctcaagaagcgcgggcgatcaag

SEQ ID NO: 11711 - DNA, 255 bp, Zea mays
ggtaattcatattctgataataacgatgaataaaatgcaaatttgcctcagaatttgtagtcgtcctcgtccacttcacaaatttgcagtagagagtccagtccagactccatcgagttggtctttggtcgtgcatcgtgctgaactgctgacgcttcgcgcgggtccgaggtcaggcagcagcagcacggagtagcaccagggcgaccgcccaggttatcgtcggccgccggcgacctgtaccccggcgaggag

SEQ ID NO: 11712 - DNA, 158 bp, Zea mays
ggtgaacttatttttgctccatatttaaaacagttatatggacttgtagtgaggaccaatccttgacataagttgtgcctgtgtaggttggcgatatctcagggagcttccgctgggcaccatttcttgcactgcagacatctgacacattccttacc

SEQ ID NO: 11713 - DNA, 292 bp, Zea mays
cgtttagtgacactgaggtttaagttagaccatggtgaaccttggactcaggtcgtagggtaacagggatagatcagctttttggttaatgcgcaggtctatagttttcccaatgctgttatgtccatcaggacttgaatttgttaagtctgtatatgtaattatgacaaaacccagtggcactcctaatggtactgccttatgttattatggtcccttaccagttcatttagttttcttattaactgcacttcaatacgtattttgaatcatctacaatttttcgcactag

SEQ ID NO: 11714 - DNA, 629 bp, Zea mays
ggattttactgggcgggttcttgtccgctcgcaagtcgcaacatggagaatgtggacggggaaaagcagggaccgacaccacagtctatggcgcctcgtgagacgtgggtcgtgacaatgttcatccctacgtacaatgtggtgatcgatgccagggtccaatagttcgtctgcattgctcggtgaggcctctgcagctggttcttttctcttgtcatatttttttttggttggctcttccacctctcatgtattgccaagacccacattccattatttcagagaacatgttactggctttgcaatgaaatgggtgagggaccctttctttgcacttaaacacacagcagtttgcgttcggaatttcccatcgtcatagccacccacgtaggctctgttgtcgctgaagttgcctgtggcccgtcatcacacccccacccatgaggccatgcatgaccatgaaccaaagcttactcccaagaagcaacaaagctgcaaaccgactgcgcttcagggtgtgtttggatggagggacgaggaaggatgaagaggatgagatgagatcattttaatttgacccgcgtttggtttggaggtccagagtcagggtcaagcaatattgttcaaaa

SEQ ID NO: 11715 - DNA, 1500 bp, Zea mays
cattcctttgctttgctagagagagaaaaaaacaaatacatagtgcagtctagaaagtatcctctacatgactacatatgctcctagctcatctccagaaccagtatgcttttatacgaaatttatcgacacaagctttagctttccccgggtgatccggatccttgggttgctcaaggactgttgccaaatgtcacttacacgagatgttacagaaaaaaaagtacagattttgtcagcaaaactacatgcatgtcgatgtcgagacagtagaaaattatgcgattaaactattataggtatggacgaggagttcatgtggaggggaggaaacagcaagaatcagtggaagctagcagaaacctgccctgttagcttacttgccggtgcggtggtctcaggattaattcacaaaatgaggctgagcagagcagagaataaagcaggcagtgtttgttttgttcaattttgcagcacacaggggctttcaggaggagaggagcccccaacttgcgcatgcatcgaatgcagctgcctgctatgctaggcatccaagcggagccggcagcaacagctttagaggcggcggccaaaataaaatttatatgcagcggcactggcaggcacttggcacggatggtagggcccagtgttattctggggatgattaatgctaaattgctagtaatgaatggggcaccccactagcaaacacaactcactgtgttgacaagattatccggccggagcagctggttgggaggagcatcaggccataatcccagggctcatgcctgcctatatataaaaccgccaaaagtggcaccgccggcggttagttcggggatggattcataatatgatatccaactcatcttgctagctagcttgctgttggccatcctctgctaggtagacgatgattgggaagacagcagaggatataataagattccagtgttgagtcatggcgagagcagcaacagtaaaagatgcaggcactatgatggccacggccggcttagtgctaagccaacgactttagtttggacactgcttccgaaagctagctggcgagctcggcgaatttcgaattcaaattagacaggccgtggtcctttttgttttcaatcttttcggctgatgaatgccctaaaagaattatcattggactagctgctgcagcgtaataatcaacccagatcttgactggaacaaacagtcgaatttgttactgtggagggagttcttctcgcgcctggttgcgtgaaaatcgcttcacgagcacacagcggcagtattctcaatcatcaccgtgtatcatcggcgggtgcagttggaggccacgacaaagttcggtttggcgacatggttagctagaaagagagagagagagagagtcaactaaccctccatgatcctaattccaaggcgtaatcgacggcactggcaaatgccctcccatcttttccctcctcctgttcctgttcctgtgtctgt

SEQ ID NO: 11716 - DNA, 122 bp, Zea mays
ggtttttttattttgctctgcattatctactgcttctccatttgataagtaaccgatcaattttttgaatatttcgaggagtatttcgagcacatcggaggtgtaggagttagtgaacaccc

SEQ ID NO: 11717 - DNA, 76 bp, Zea mays
ctgcagcgaccgcacttcaaacctcctcggccctagccttcccttgggctttcccaggccacaccccgactcacca

SEQ ID NO: 11718 - DNA, 1238 bp, Zea mays
tgcataactgatacggtatcgtaaagaaatctactttcatattacattgttaacatctatgataaaaatataagcatctatgcagatctatatcagtttttatgctacatcattttcttcaatgttgttatcgtaaaatcatctccgttcatgtacttacgatattgggatcatcatttgatgacatagttatggagtttatatacattaagacctaaaatgtataaattaggacaccaacctttaggttttacgtcaatttctttcaaaatgatctattatacgccccatgcccattctcaaatttacgtgcattttcgcgcatgcaatagatatgatttgacagtggaaacttatcacaagatttacaaacacatttatttaatgcgcgctagttgggtgatggttacatgtgactgaccagagcttcctgtagcggggcgaagccaagtgtttttattataccatccctatatagagagagagtcatatagataaatatggtctgtttgaaagggctcctaaaccgctccggctcctacaggagccttatcaaacggtataaaaataagagctcccaacaaagagcattaatgagtcggagccagagcaaaaaaatctggctcctagtagctctttttccccactccccttctctcacaccaagagggtccgaacaatttgttaaaaaacactagctcctatagagaaactactcttgaagagatgttagaaacactagtcatttttcgagaagcccgagctgtatcaaacatgtccatactattcgcgaagagtacatctctcatacttttttagttaatcccctaaaaaatctttaagaaacatcatattatatatggttgtacatgtcgtgagttcataaaatcatgaatcttccaaggacctgagcatttaaatttgaattttgcagagcctaaacgtttggcttaaaaattattatcgcaattgagcttttttttgtctaagctgctagagtctagagagacccacttcccacacccacggttcccactccccaccagatctccggatcgctgatccactagtcgagaatccagatctctcgcctgctcgctaccaaataccaaccacgaagaacaggaagaatgcccaaactgtcgtgtcgggtgctctttgcggctcttctcatcgcttcgctagccgctctgctcgtccggttcccgatccacaggctcctcaatccccacgccgcc

SEQ ID NO: 11719 - DNA, 119 bp, Zea mays
tgaccgtggtaggaggtgagtggttgccttcttcttttataaatagtgtgcttgcttcattgtcgtcttcacacatcttactgccgcttgttgcttactctcttctcttctactccacc

SEQ ID NO: 11720 - DNA, 1220 bp, Zea mays
ggaagggggcccggaagcgttcaccgtggggttcagtcttaccataagatgcgatggtgcgtgagccacgaggtgaacgaccttagaactagcccatgctttaatccgtatcaacttctgttgtttttataatgtttatttgtctctatagattatagtttaaatagttaattttaattcagtgccggctccacgacacatgaatcgtagcgtcgtagggcaataagagccgtttgtaggacgctagaactgtagaagatagtaagctaaaaaaaaactaatgatttggagaaatctaaccatctgtgtttctttatatatagccaaatcttctagtgcctttacaagtctgtttagaaagatgatttttggacctgcaatgttactatatatatacaatataaacctttctagacaaatctttctgttccaagtacgcagttaactaaaatttctctcttctggttcactcgtttcctaggcacccaacactggcccagctgctggaagcaacaagcaaggcagccgcctcttttcaacgtcaccagcatcattaaagattataagatatcataatcccagtgctgactgactggccctctcttttagacctgtttagatttattattatcggctaataattaactagctaataactcatatttaatgatatagttagctaactattaactgaagtgtgtttagaactgataacagatgctactaggataactattagctactataatcggatttttttaactagtgagatagttattacctagaggttcagttaacaattacctatttttattacttgtacatgttgagataacaaaggtaattattaacaattagttattttattagctatatattttagatctaaaagcgataactactagcatattactattatatataggcatctgaacagggtcttaatccatctattttatttgaggctaggatgcagtcaaaagcaccatccggacggaaacaagcaagcggctgatccaacgaccagccgcaaggaatgaactggttgcctttgcctgttgtataaactagcagtaaccactatggcactatccattaaccagacacagcgtccagccaggcttttgcctacaaaacaacgcaccacgccgccgccgctcgccgcccacttctctcccaccttccctccactcttttgcctgtcgcggggttagaatccc

SEQ ID NO: 11721 - DNA, 1412 bp, Zea mays
gggtttaacaaaactaaaatatatacaatacatttaagagtatgacaaatatgtatgtaaaaaaataaaaaataaaaaagtctttaatataggtatttgcgtataaaggatgttgttggagagaaagaagatatagaggataaaatcttttagagaagattataaaaaacagatataaagaattgatatacagtacgttgctggagacagctttaagtcgcaagcgcaacgcatatacgatttggggcacatcatcaacacaagacgcattgatgggggctcggtaccgacactgcgcgtgctctggccttcgatgcccggggctaggaaaaaaaaagaagccattgatgccgctgaacgtgaagccaggcccaaaatgttgtagaataacttggcgagccccgaaatgttttagaatatcttgcttctacaaacttttgatggtacttgtgtacattgtttgtttgttctaaaccgaccgcccagcagggtttaataaaccgttcccccttaaaaaaccatcagtcatcgggaaccgaaaaccgctaatctcgaatggtttgtgattttaaatctgaaaacagttttcggtgcgactcgagcggttttctgttgaaaagaaccgatttttggtgcgactcgagcgggtttcggttaaaaactaaatataaacatataacaacactaaagagtttagtatttcattatgcttttacgatttttttataaagattttcaatttttttaaaataaaaggttgggaaaccgaccccggaccgaccggatcggtaaaacccactggttttcgccaaatcccgaccgagagttttaaccgcgccgcccgggcacttcaccacagaggcacacacatggcggcacggcaggctgtccatgccaaccgggcctcatcctcaactgtgccagtgccagactgccagcgcgagtgcgcgactctgcgagcgagcggtcgcctcgtgccccacgccgtgtgccggaaacaatctgcatggctggagcccaccgctccgacctccttcatgcaccgccccgaggcccccgacgccagccgtgcttggcagttggcatggcacggccaaaaatcacggcacttcctcccataaaaaacttggctggccgctgcccctgacgcatcggcatctgtctcggcacggccgtccgatcaaatcgggctagcacagcacagccagcacgcgccgcgctcagcgctgtacttgcacaaaatatcgccttgctcacgcgctgtctagcctgtctggactctggattagtatatccttgagcgcagacaaatcacccccttcctcctgttcatttcctcctgctcccctctcctcccttccccccctcctcgccgctcgccgttgaagaggtaggcccacgggccggcgaga

SEQ ID NO: 11722 - DNA, 970 bp, Zea mays
tacgtatgccgtataactttgaccacttaggagtaaagtatttttatatttttattttatcccatgagttgtttaattgtattttttaaacctaaccatggtatttttggagtattggaaactccactctaatctaaagtttttatgtaatgactagcttgtctaatattatggttttaataatgttgtatccaaataacatttcttaaaaccgtgatatttttagagcagccaaaactacagtagtaatactataaagtgtaatattataaaactatagtttcgagaaacgtttttgccaaatatatcccttcatgttgtcttagattgaatgaattgaggagagtaaagcggattaaattcttcctatttaaaatttaatagaaaaatatttaatttcacttctatctccatgtaagtgaataagggtgtgcacaacactatttaatggggtctcttgacgaatctctaatggcttaattggaaaagaaaaaaaatgagagaagaactcttcgcgaagagtctatctcttcatgattcttcgtatgtattgtctattaactatatttatgattcaaaggcttatgattatctatataatttcttgttgtgtcttatacttacaaaaccgttacacggtctcaagttttgtacgtgccataaggtctcaatgaaaaaaaccggcacggcctctcccgagaaaaaaaaacataaggtcgcaggtggcggcttggagcgataggtgcacagtggtgcgtgtgtgtgagcaacatttctttttcttaattgatcaccccacatgatttgtcaatgttactcggagccttaaatatgcttcttcccctacctcaatctgcctacaaatccatagtgacactattattatctcaccttcctacttgagttacctggcagctcgggcagcgcaggggaaccaattgcagagagcaagcatatccaacgcaattaa

SEQ ID NO: 11723 - DNA, 640 bp, Zea mays
cttaaaattcaggtaggtgaaatataaaataaaagaagtgtacatatatacacctgatcgatcagcgtataattaagggcgattgggaatttgtattataatatatagtccgtcctaattattttccgatcttggagagaagtctttctagaaaatgttgtagccttttccgcgcatgattcacaaatcacgagtcacgcgacaaccttttccgctcggagagaaggtgcaaaagggcacgatggggtgagagaaattaaaggagatcactcgagctgaaaaaatgaaggcggtggtcgagaggaggaagacagagaggggtggattgagttgagccagagtacagtgatgagtgatcacactcgcagacttgcacctacttgagagcgacccgccgcccgcccgcgcggccagccctctcttttatacccctaccttcttggatccccatcctctccctctcctcgctgtcgtcttccttcccagggccagcgagagcttcgttgttccggcgggcagttgcaagcaaacaactgccgcgcgcataacgcgccattgaggtaactggctagtgctagtctcccaccctttgcacggcagcttgctagctagcaagctacatacctcgggcgcgcgcggc

SEQ ID NO: 11724 - DNA, 1217 bp, Zea mays
ctcatcttaggatttaggacgggtgcattccgttatccagtcggagattttctctccaacatcaaacggaacattatagttatagatatattggacttgcccacgggcgagtttttcctttctttggggcaggcgcacagggttacagttgcaaattccgcggaagaacacacgcggcggtttcatgatcccttgattcgcttcgtttacctccatcagagccatcatctactccagacagtgctcctccccttaaacccctgcaccattcatttctccctgccccgctcccgacgccgaacccgcggactccgcttgcggactccgcttcctcccctttatcgcgtcgccggcgcccggccccgctattgcttcgctgtggagtccggtaaagtttatatttgtctcgatcaatgcggcattgcagttagcccctgccgttttcttctcccgtagtcccgtcccaccggcccccctccgccgcctccacacgccaggtgtagcctcgtcgatcccttcgccggcgaagagcccctactaggtatgccccctcccccttcctcctctccccttcctccctgctgtgcgaaactgggctcccgaaccgtaaccctgaactatctgggtatgtgtattcggatctgatctaatacaagtgtatctttctcgcaaaaaaaaaacacttttgtgcttgcatgtgtacacccatgtctttgactgggtctgcccctgattcatctggactacgtagcgtgattactccagctttgagatgcctaatttttataactgctgcgtcatataagtcgtgtgcaaagaagggaagtggagtaatgcagtgccaaaacgcttctgtgaatagtttggtgtgaaggggaaatctttatgtagactagagatgctggaacttggaatgagctcaacaaaacagcaactcttattaagacgcatagtcctgggaactgcagtggcttggcggttgccacatgctgtgagtgtgtcatgcctacttcatatagttggttataccgttacagtgtatctggtatctggtgtgtggtcgtaagatttgtttctttgtcatagttgtagatggtcgtagtaataccatgcttatgatgttttcttgtttcagacctaactttaaatgctaacagaactttttttatatacaaaaaaaagcaattgatacaacatttatacttccaggattcaag

SEQ ID NO: 11725 - DNA, 214 bp, Zea mays
agtgtttgttttatcccaggttatcgcagcaaggcgtctatagtgaggtctatcgtgtgctgaaacctgggcagtattgcactggatgaatggtgcctgactgaccgatttgatcccaacaacgctaagcatttgaccgtcaaggctgagattgagcttggcgatggcctgcctgacatccgtaccactcgccagtgtgtccaagctatgaaag

SEQ ID NO: 11726 - DNA, 1500 bp, Zea mays
ctgaataaataaacctaagtagttttacgggtcaagttaaatcaattttttagaaaaaataacaatatatattaaaaaaataagatcccatttagaatgcagtaattttataggaatcgatttattttcgaaaaaatacagaaaatagaaaaaaaattccacgttccaaatggaccttggataggccaaaaaaaaatttgaagctgaaaggcatgactattttccatggaaaatgtgcgtgccgtgcagacacattatttcatgaaacgggtcagcacgcagtttcctcgtctctttcttctattttccacgctgttccgttgctgtctgcctccagcctcctgccgttacgagcgcgtcagggtttttccttggccagccggcggcggccgttgcacctcctccatccacccctagtcgaaggtcgccagttcattcatccaggctgctgcgcccgagtccctggccaccgtcgctgggcacctgccgtcctcggaagtcgcaaccggaggtaatcttacgcagcggttcgtgaccgaccgtggcgattcgcgttctcttcctcgacgaactcctgcggaggcaatttgggtttcgtttcgggagaaagggtgggggtcggcggggctgccctggggcaggttagtagtatgggtggtggccgattgcgttggccgttggggactagttttctcgtaggtgggctttgctgcttcgaccggatccgtcattggagtcttctgcactccgaattccccaaatcaggattagctgatgcttgcatatttgttctgttcaatttgctgcgcgtcccgtgtggtgccagtattttgcattcctttgtgttgcggaaagctttctttcccatctgtaagttcatcgtggagtcgtgcttgctggtttcggcttgcaaggatgatggagaataatacttcctgtatttagatatctctctctcttagcatgtgttctgatagaacagatcaattgcatgctggacattatgtttgaaatatgctgtatggcatattggctacctaacgatcacaaaggaaccttgaattttatcgtctatgtggaagagcatatgcacatggtaacatggccatggatacaaatcattcacatgacatcgatgaaaactacaaaattacataatcagcgtacactttttttgttgcagtatgctgtaatctgttgtgctaactcagtctttgttatactcatttagcgtatgagataattgttccaaatcaggaatcggtattttgtcaccattggatgtgctaagaatatcttaccatatgatgccctgaggaaccatggctttggacaactgcgctagtatcctctatgttgttttttgggcaaacccatcattttgcaaatttctcagtttttacaatttgtattaaggtaagtgtaatgaacactacatttacggccatatattgtttggtctgttaaatcatgttaggtgggatttattaaatttctgag

SEQ ID NO: 11727 - DNA, 171 bp, Zea mays
gttttgttttcccctctctccgggactttatttaagtgctaacgcaaacctcagcttgtagtgtgtgcttaagtttataaatttcaaattccgcctattcacctcccctctaggcgactttcaactggtatcaaagcttggtgcttcattagagtctaacaactcgaagtg

SEQ ID NO: 11728 - DNA, 739 bp, Zea mays
tctgagttagaaatatatggtaagagagaatagtagacaaggcaggtagttacgaatcaatgttactttgggggatttattagctgagaatattaatgttttacctactaaagctaactcaatatcttatagtggtacatgctaagatgtcaatttataatatctcaatcaatcaaagaagcaaatcaggcatttatcatcagaacaatcaaccaacatttttaaatagagaaaatattattgattttttttgtcttaggcctcctatctcttagaaaggtcataaatgtaggattccaaagtgtgaaatccatcttgtctcagagtagaaaaggtaagaatgatcagagtagaacaacaaaaggtgagataggatctagataagatgagtatagaaagaatcaaagtaaggtaagtaggtaagggtttgtccagttctatctatgtttcatcctacagtcaacatttcatctgataccacttctatcacacccgggctttaagggacaaagccgggtgcatctcatacatgcgccaagaagtcaacatatataataaaagagtggtatagagataaatgtcacaataacatcagagtatttattacatagcagaagttttacaaaataaaagataaatataacaggatctaaaatccatccttggcaccagaaagtcaactgggagacgccacctagatcgaatcgaactcctcgatacgtggctccacttgaaccac

SEQ ID NO: 11729 - DNA, 978 bp, Zea mays
acgacacacaatcaaatttaatatccttaaaaggataaattaaaatcagcgtgaacatgtggccctagtatcaaatatccataaaaataaatttaacacatatgatccacgtatcagatattaaactgataagaacaaatattacatcttattttgccaaaagtccaagaaaagatataagttaaaaaagagtgactctttttttattaggttgctcaactcgtccaactctggctaacgaggtgatactatatgatgcaccacgctatgtttagctcaagacccatctgtgctgtgctgacgtgctgtaacggcttactgatatgtgagaagcgaagaagataaatagaccctacacgtttcacatgtcacacaagaaactgatattttaatatagtagagtttatatgctaaacactatcacaataaagattagtaataaatctttttaaataatacgagcaaaaagtcaaataagttataaaaaagaacatatgagtaaaaaattaaaaaattaaagctattttacttattctttaactttaagaaattttgatataaatacgcaacaatgtttatgacactaaataaataaattactaacatataatttatctaatgataccagtttgatgctagaaatataggttggctccttttttttaattttttatacataacaactataggaattgacttattattctggaacggatgtactcagaacgttcgttgttatttgagaagcggataagataattaaacctacacgcttcacacatgatacacgaaattgatattttaatatggtagagattatgtgctaaacaatatcacaataaaaattagtaataaatcttttgaataatacgagcaaaaagtcaaataagttataaattagaacatatgagtatataatatgttcttccgctcgcgccggccatcgaattttctctgacaaaccagctgcaacgatcg

SEQ ID NO: 11730 - DNA, 1238 bp, Zea mays
gcaaaaaagctcagcaagaaaaagaaaaaaaaacaccacctattgaactacctaagaagaaacactaaagctcccaactcacaacagtaaaacataaattttccgacggttaaatccgttggaaataagacctgaagccgtgtgacttgatgtttcactaatgaagatgctgaaacgaaacaagaggatgatgacaaggttcacaagaaggcaagcacatattcaatataattccctcaatagcctcaaaagacctttccagatgaagaaagaacgcattcgagtctttatcctcccgctaggttttccttcctcgttgggattgggattcggatttgggatgcgtatacacacactcgccatcatcgtgttagcttttgtgccggtctgtctttaattctcttcgcaaacacacacttatcttttttttaaacaagcgtgtatgatggtgtgtgtctgatgactgacgatgtacgagggaacttctaccggcaagtgtgtcacgtgctctccaatgataagaacatacaaatcgtggcatatatcgaagtctgcataatactgatgcttctaatggagtagtgaaacagctaaattaaaataacaaaatttatatatggccagaatcacaaatgaattataaaatattttattataacaatgtaagacacattttatatataaattatcatgatattatatgtttccgttataacgcacggacactcagctagtaaacactaaagcttccaactcacaacagtaaaagcataaaatttccgacggccaaagccgttgaaaataagacctgaaccgtcggagtaatcatatgttctcagtttcctgttgtgacttgatctttcactaatgaagatgctgaaacgaaacaataagacgatgataaggttcacaagaaggcaagcacatattcaatataattctcaatttctcatacatagctacaaaagacctttccagatgaagaaagaacacattcgagtttttatcctcccgctagggttttccttccttgttgggattgggattcgggatgcgtatacacgacctcgatcgagctagctggacccatgtatatatagtatcaaatcccgcgcagcaacagcatgcagctctcgggtagacagggccagggggcttcctattccattgttcttcgttaagatccaccaacacaccccaccatttggcggttaaatcgagctgatccataattaaca

SEQ ID NO: 11731 - DNA, 389 bp, Zea mays
tagggtaaaactcatcggatttcggatttcggatttcgggtacccattgccatctctagcacgaagtgctcgtcgactcgtcgtccaaaacgttttccacttcgctttgaaggaagggagtaaaaggatagtgggcccgtcagctgggcttgcggcttttggactaggcatgggcacacctggcttcaggattggcttgacggacgtgacgtgattgggccggtttttcctaaccaaataatgggccgcgtctgctgcaaacgagcccatttcagttgtattccgtgttccacttcgcttgcttgcaggttcctcttcttccgtcgctctcgctctcggtctcggactacggttgagcgaagtcgtcactgtaatctactgatctgcaa

SEQ ID NO: 11732 - DNA, 1500 bp, Zea mays
tacattagtgggttgctactatgacttgaggaacaaattttcgcccttttcttaatcgaaaggcgattaagtcgcaaacccaggatgcaatatctccagaatactaacaagtcaaccatcgaatttaatacatacgctgtcagcatttaaacactgcaagctggaaacgagcaaaatcccagagctgcaattcatagggtgggagatggcattagaggaggctgctcctatgtgcatcaaacaaagcgacattaatgagtttgcttatctcttagccattgtatcaagatgcgcaccgggcaatgcatgggtgcacaggccttgccttgcgccattcaaagacctaaatacctaatttcataagctacccagcatactccatccatattgaagagcctcatttattcaaataaacaagaaaattggctcaacattcaagcccatttagtgctctttcagcaatactgtgcccaataaattccattcatggccacatcaagttgtgaaataaattggaagccagtcaaatttcaactgtacaagctctacaaataatcaaaagcaaacaaaattagtggttccaacactcaactacacaacaaataatcattgtcataattatctaattggcccaaccaactttcctgtggcacataagatattgttcctaaaatctgtgggatgtcagtcattttaaaaattttggaacattttttaaatatagatagcaagtttaacctctcgcccaaatgcaataagaaagaagcctgaatccagaaaatgctgtggagcaaatactttgcattgctagcaggctaaaaatactgattaacaataaaaaaatacgaattaacttgttaagcaccaggtaaaagtttcccagtacctgttaatgttgtgtaaaaagcaacgagcgaagaagcaaatgctcaactgtaggcatgtgtcccaggtcctgtttttcctcgttcagatttgttgatcttttgcatatgacccaacagaccaccacaaaacctctcacctagcacttctcttccacccaacacatattcaatcctcttccttcgccactccccaaccatgaatatgataggcaataaaatgcgtacaattgtactattgctactactatgagatagtagtgagtaataattaaatgggagcgtagctcttatgtcacattaaagaaaaccaattgacctcccatcctcaccccctataaataccatctatcccttctccagcaacaccagagaaacacctctgagcattctaaagctcatagccctctccttccagagcatttcacatcgctctcatctccacctgcttgcatccagcgcctcgtcactctgcaaaacagtaagtcccctcactatctgtaattctgtatctaggcatctaatcctcgtgacagtatagcatccatcctgaagtgtgtatctcaatcagctgatccaacgtttgatggatgcagacagcacatacctccaaagg

SEQ ID NO: 11733 - DNA, 288 bp, Zea mays
ttatcagaatcactctaatgtttttcaagagaccatttaaagattaactaatcaaagccctgctgtattgtttgcgataaaatcaaaattattctgatgtttttaaaatgaccataaaagaaaaatttccatccattatttgagagttgtgttaatggagttctttattattgcctctattaggtggaacatgttagagccgaaagaaacttgttggcgtaagttgctagtcactgcattgtgaagctttactattctttccaagacaccgagtatctttacctaatt

SEQ ID NO: 11734 - DNA, 250 bp, Zea mays
taacaaataataaaaaaactggtatccaaataagtatcggcatatgatctgatgctgaattataaagcaaagatttaaaactaccttaaaaaaagagaactaaaattaaagccaaaaaatttgctgcatcgctcgcgtcgcaccggccaccgttcacccctgacccccatttcgttccttccagatctccccgcccccgcatctcgcccgccagctaccggcgagtgggcgcgcgcccgccgccgccgcg

SEQ ID NO: 11735 - DNA, 1018 bp, Zea mays
ctccaaaaaggaacaattcaatcaagtgtcgattggctacaccaaccaaaatccaaaggagttctttaggacaagcgatagtgttgggcacatatctagcaatgccggtgagcggcattgccgtgcaagatccatcagtgtcgcgtgtcagagcggtagtgtcgcttaacaaagaatgatccaattgacttcaaattttgcagacagcaagcgttgaagaagtgatttgtgaagtttgagtaaaaaagatcaaaactttccagacggatccaaaaacacagacacgattagggttttaatgtgtttttgacatttgatcaaaacgattagaaaccactacaagaacttaatcagttcatactagaagtttgcagtgatcacatgattgtttctaacccagagaaaatccccaaaacatctctccaacacttgaaaccagaaatgaacttaaaatcaactagaagrgttgagaagggaagaaacaaatcaaaacccaatccatcagatttgacatttctatatatgaagcgcggacgcaaagcttgcacctcgatgttccacgtcattctcttttttatggtcgttcgatcctatttcaacgtcaacaaactgctttatgtttccttcgttcagctaccatcggccgacaagcgaaaccggcctccatactacgcgatgcttgcagatgatgctggaagggagagaaaaaaaagttccacacctccaggagccttactttgtcgttggctgccaggagcgtccccactctccctcctccagtatccccatcaccttttctctcttcccatgaacacagccgcacgccgccaagatccccattccccttctgttacatgagcagcgcctcacaggcggctcttgacccttagacctggcacacagtcgtggcggccttctctcgggccatgggcagcgacgcagttccaccatctgcaaatgttgtaggaagacgaatgcacgccgggcttcatcgtcgaggtcgtcaccctcttctacg

SEQ ID NO: 11736 - DNA, 330 bp, Zea mays
atcacttaaaaaataaaattgccaaaatagccctacattattttttcggtaagtacctacgctattaggcgtgaaaaaacggaaataaaagagaaggccacaaagggccttgagtggccccttttttgtcaggccatctagtaggccttggtacaataagccggactcctccacacaggcctagcccaatgagagggttccatggaaaccctaatcctcgcggtatataaccttccgcgcggccgccactcttccctgacttgtgcgccatcacacacaagacacaaccccactcacccggcagggaggccctcttcgtcggcggaggcc

SEQ ID NO: 11737 - DNA, 128 bp, Zea mays
ggtatcggtgtctcgtctcggaccacgccctttccyttcccttccttctccgcacacgcagaaccagctgattctctttcttttgctttcctcctctcggcctacgttgatctggcgatgcgcttttc

SEQ ID NO: 11738 - DNA, 709 bp, Zea mays
actcccgaagatgttaggccaatgaaaagcgagccaaacaaacagaaaagttttgccttcccgagtctttgctaaaatatgttgggtttacctgaaataaaatgacgaagagtgttactgttctcacatcagttgaagtggaagaaatagaaagggaatggagaggcatagaagattctaattttagcttgggcatgtacttttataacttagtttttaaccaatcttgcccaacaaatgtgttcaaacaaattcagctgtacatgtagaaaatgtcaattagttcttgacaaaaaaaaattaaaatgtgtcttcaatttgcgtgccaatcaaaccagatacaagtgtagaaccaagcagcagaaaactgtgtaccataatgaaaggatgaggctgacgcaaatgtaaatagactgagagaagactaatagagtggacccaaagagtaccaataggctaagaagaaaaaatgagcatcgaattcaatcatacacagcaagacggcaacgtctagcaagataaaattcatagctttgtctcttgccaaatagtcatactaatgcctacacccatcagacatagcttatggctccagtgctcccttgctgtcctataagtacatgaagctagcgcatatcatcttcacaactcatcaaaaaactgaagcactagttcagtgcaccaaaagttcatatcatagaattacacc

SEQ ID NO: 11739 - DNA, 431 bp, Zea mays
tgcagctcggatccaccggccacacccgcctcgggtgggcgaccaacatggcggacctcgaccttgcctgcccatcggctgtggtggcgcctatggatatgggtaccacgacatcgatatggtgccaaggtgcgcatgtctcttgaaggggcaagtatggtgatgatgtgtacggaaaaggagatgtgctagggttgtacatgagtacatctctctacctcatggggagaggtttgagcttcaagtgtctgaacgacaagggcaagccttttcttgtaaagggcaggatgcacgggctcatattctaggtcagcactggctcatgttctaggatcatgttgcaacttgtaaccccttaatctagagaacctctgatcggataacctttgctagtaagggtacgtgcgtcctatatatggtcgtgtaaaata

SEQ ID NO: 11740 - DNA, 760 bp, Zea mays
gaccgataccgggaacaggaatttttagtggttaccggtaaaattaatcgatcgatatatctttcctggtgtacgggatctatcctaagagtaaaataggccatttgaactgaattgcgtttctgtggatctagaactgttgtgttagtcaaacggttccacggtgaatcttaggtcaaccaccagtgaaattgctctttgataaatcacaaatccagattcgttttttttctaagataaagctgtgccaatcatgctccaatattaatttgaagtaagtaattttaaaaagggttagcgagcatgccgagagatacgcgagcagaagtgttgccctgttgatgcagcggcgaggggccaggaggacgtacggataagcaagcagccaaaccgagctacggcagtgtgcagtgcagtacgagagcgtgcgtgtccggtattcgctagcccggagacagacaggggcagaaagggagaggttgagctggagcgaggattcagttaatccccccttctcctctcgctcagtcgcacggcccccctgccccagtgtggtagatttttggggagagactaaaggctcatcgccaatctataaataggctgccacctccctggcctttccttccaccccaacaccccatctcatctcttgctcctcgtccgtagttgcagttgcagtgtcctcggccgcctctagtcctagccgtttactccttcctttcaccgcatcaagcagagagcaagcgaggcaagagcc

SEQ ID NO: 11741 - DNA, 145 bp, Zea mays
ggtgcgtcattaaggaggctactaaaaaacccacgttttttcatcctgttttcgctgcaacttcccaccaccgcctatatccgcgttccccccgggcgatcgatcgatcgcggctaacctcgccgccgcccccatcgaggcagcc

SEQ ID NO: 11742 - DNA, 1500 bp, Zea mays
ttagttccgagaattaaaagttttaacacgctccaaaatcggttgtttctcgcgatcgattaactctgaattcggtgaacttccaagagaaagcctgataaacagagaaaggcacgatcgagaaatagaaatttttactgagcatccgagattaggattaatctcccgacatgacgcgaaatagacacctggggtgtcacaggaatattcccccttaggggccattacaggtcattacagcatggttaagtacaacctgaaccggcacaccatcaaccctaccccagaatggggcttacacatgggctcaaataagccagcagggcgccgcgtgggcccacttcgttgacacgtgtgggtattaactgtggtcttcgccacagggcgccaggtcctcggatcttgttgtggcctctgcctggactgaccgatccctttgcctccaagcctttgtggggttgaggtggactccgctctgcgactatcatgacatgttttgtttatgttataaataaaccgagcgaggggcgtagatggccttctctccaacaaataaagtacagggtctcttttgcaattgtctacggccgaaggagtatcttgtgttcgggacggcttgatcagaaaccaatggctcagattagtcctataatggttatgaaccggtatgctaccgtcacccttagatcccatatcaacggtccacacacgaccacgcctcgctccattcctgccctaccaatccaacatctacggttcaaatataatgtggtgaaggggtattttgcattctaatcctagccattaccgcctgatctgcctgtggccgacagcctctcttactgtctaggtgtcgagcggcgagccgctagcgcgcaaggcgatgcatcactggcgaggggagctcctggccctcaagtgcacggaaccccacgaatatgagcgcaaaaggtgggcaacacgattggcaagactattcgggtcttacctagagttgttcggacaatggtgacgcccggccacgacgtggggtggcacgaacgtgcacaccgaactaccgaagttcggtgagcaatccaccgcgacccgagactccttcccgctaggtgtggccacagaagcacacaatggacgccagcgagcccccagagccatgcgttgagacctcggcgacagtgaacatgtggattggcgccagcgaccaacatccctctcccggtgattctctgctcgattggtggtggcgctctggcgtgctcgggaccatggccgagacttgggattcaaggtgctaggcctcagattttatatcccggatagaggtagtaacaaccgaggaaatcttggtgtggagttgttaagatcgcatcccggtttgttgtgatcgcgcggagrggatggagctgccatgtgggtcccataggctatgttagtggcaccaagcgtgaggctgtgggtgggacccccctgtcagcgcttgatgtggatagctggtgcggg

SEQ ID NO: 11743 - DNA, 422 bp, Zea mays
tagggtaaaactcatcggatttcggatttcggatttcgggtacccattgccatctctagcacgaagtgctcgtcgactcgtcgtccaaaacgttttccacttcgctttgaaggaagggagtaaaaggatagtgggcccgtcagctgggcttgcggcttttggactaggcatgggcacacctggcttcaggattggcttgacggacgtgacgtgattgggccggtttttcctaaccaaataatgggccgcgtctgctgcaaacgagcccatttcagttgtattccgtgttccacttcgcttgcttgcaggttcctcttcttccgtcgctctcgctctcggtctcggactacggttgagcgaagtcgtcactgtaatctactgatctgcaaatggcggaggcggaggcgacggtggggcgactg

SEQ ID NO: 11744 - DNA, 1048 bp, Zea mays
agctagtaccaggtgcagcgagccgtgcggcaattactctgcgcgttcctccgtccatggtgggttcctgttcggcccggcccggaaggctgccccctccccatgcctttctgggcatctcctggctcttgctcgcccttctcttcacagcagcaccagcaacagcaccatgttcttggcttcttctttgtgcctcagggaccctacttaaatattccagctcaacagccaccagcatgtttttttccttcttctttttgggaaacyaaaaaaaccatccstatggatggttggccaagtatttcacgaaagaaatcatgtcaacaagaccgatgtgtaaagggcaggccgtgytagagtggtcactgcactggtggtaggttgtattgmtagtccgagcaccgagagagtggttggttggccgttatggcaatttcgccccttactcggaaaaaaagtttgctgttgtgaactttaaagcttgcaaaatttccactcatcatctgcctttgttgctatcttcatgtctgtttctttaggatatcgctttatccttcgtataattgtattgtcaaactggcacccaccggaatcatatagcctggataaccagcaagctgctctccgtctcctctcatcagtatgtatccagcttttaaaggtttgtctcatgttgcgattcttgtgctagtcgaatctcgatctagtaaaaaggtcgatgaataaatacctttactttatttggattctgacggatcacattagtattaggctgtgtcggaaagtaaagcctaactatacctttactttatttggttttcagcacggttagtggttgcaactgtagtatgttgtcttccattctatcttctaacttccatgtattcgcagcagaaatgccttgggtgctatgcatttaaataaaaatatcccaaaatcttgcttgctttcatgtacaaattgttgtggtccatcttacaaactttgattcgttctttgccatccaacttacaaatcaggtgataaatccaagattctgccagtaaag

SEQ ID NO: 11745 - DNA, 145 bp, Zea mays
tgattatggtttatcttcgtccctgattgatccactttcatttagtggaatactattgtatttggtttggaattcgaatatttcacacctttatgaaagtatatgtacaaatttattttaaattcatgggcatgagagaagtaac

SEQ ID NO: 11746 - DNA, 1125 bp, Zea mays
ctaaattttctggcgtcctcctctactattgggagatatgggtccaatagaagccccttgtggttatgtgaatgaggttctacttgcacgaagggagtcaatgaaaacatgagctaatatcaatggtcactacctctatcgtgaaatgtttggttgatgagtgacagattttaaactaggttaaattaatttttatttgaaaagtggaaatggtcccgtcgatgctcttggcattgatcctattagttgatacactttcgtcgttgatcggtatatctagcataattatttctacgagtagatcatatgtgcacctgtttatttagatatatttgtacatctttaaattataaattgtttctaaaatttcctaaatagacagtaggatttacaaaaacttcaataaacggtgaaaagtccatagcctggcatcgtgctgcggtgtccgagtgattcatcgtcttcccggaaccaacaggccgctgtttgactttgacccaaccacaccacgcgggacggggctccgcctccgaccccgcgccgacctaacgtgaccaactcactcaacctcgctgccgtgacgtgccgtaccgtgccgccctgtccatcgggtcaaatccctcgtcgcttyctctccgcctcctcgccacttctccgctaatccccaatccggaacctcaccgcggagaaccccagatcaaaccctttccccgcccattccccttcgcacttccactctcccagtcctccggtgcgattcgtttcttccttacttccctgcccgcccgagggagaagacgaaatcgggcgaggaatccggccgccagggtttcttgatccgggcgcgtgattcgtcgtgcccaggcaccagtgagaaatcaaatcaagaacacgccagcggaagtgagacgagggcgcggggaggaatcaagatcgcttctttgagctgccagttcccccgcgccaatgccggatccggttagcggcgccccccgctcccacggcgccgggctggcatgccccctctgagcgcccccgcctgcctccgcggctcccgatgctcgtgtggtcttcgggagcaggagagggagcagcggccgtcgtgggcggcggccaggagcgagg

SEQ ID NO: 11747 - DNA, 827 bp, Zea mays
cctgtttgtttggttgaaattgaattacattctaataatcataatttagacacaaactaattaagttattatatttgtatatgtaatttatttatatattatcttaaatcatatgagaaatatagttatacactacacttattctataaaaaaacaagtagaagaatgtggtataagttgtacattagaaaagtagcatgtaaatctatataatcaatttctatatctcactacattctagaaaatattgaaaagttatggaatgtcacattctaaaaaatagactgctccattagttagattttaattcctcaaaatcaagggaaacaaacaggccctaagggaattgaaaccattcttggcttggccaataactgaggcactttcccaccagttcataaagtcggaagtactaggctgcggtgataaattctgcagaccgaaaggttgcaaaagctggaaccaaaacacccttgacaaaacacaagagactagaaggtgatccaaggtttctacttcttgatcatagagggggcagctagctgtatgatccaaacctcttttagcaagtctgtcagccgtccaatatctcttatgagcagcgaaccagataaaaaacctgcattttggaggagcacatgttttccacaccctaatgtaggggacaaataaagttaagccctcataaacagcctttgccgagtagcaaccatctgatccaaggctgaaaatgtgtttatcatcttgatccggctgaagctcaacatctgaaagtagatcccacatctgaatataatccactaaacctccaaccaagagctccctta

SEQ ID NO: 11748 - DNA, 818 bp, Zea mays
ggtgcatacgagcggcagctgcggcagctgtgccagcgatatcctccccgccatcggcaacctctactatgctagcagccttctttccggttggtctctcttttgttagatagggttcttgggtcgagtttgttcgctcgtgcgacatgcgtgtgtgccgctcgctccccacctcgcgcgacgtttcttaggttgagtccatttgcattgcctgcttcttagcgcttgtcagcattcttctgcttacagcctccatgcaggggtgcaccgtcggcagcgatgacctgcttcttaccagattggcggctcgtgctcccatgaaaatgccatcgtgctgttgccggacttggacgccgccacctcttccagattcatgtcgttggtcgtgagcgagagatgcaacaggactcttggagttttatagcaacagcagaaggaggaggttggcatggtgggcagtagggatagcagtatttctttactctgaagaagggcacacacctcctgaaatgctagtctaatgcattttttgtggctaactgagtgtcaaatagtacaggcacctgaatttttctggttgtagtttgtttgataaggtagcacactattctgaacttttaatttgataaagttaccaccagtttaattatctaacaacttgtttttcagattgtccctgctccagtaagagtaggcgaggacgagcctcccccatcctgggtgttggtgcctgactcattttctcaaggtactagccaaaacctaaagaaattgaattatatgaactacataactagctttagtaattagttttcctt

SEQ ID NO: 11749 - DNA, 389 bp, Zea mays
tgatttttattttgtttgtattttaaaaaatgaacctggaagatgaattaacatagcctgcgccgtagtcccgccgtttggttccgacctccgactctgagtgctggccacacgcgccccacaccgtcgttctctccccccaaaataaatctcagcccaaccactcctcccataggcatagcgtacaccagcgcacaggccgacaggcgcaagggcagcgccaaggaaaacccgagctaccctgcggtacaacgccgctgctacaaaggctacaccaaaatccaaaacccaaccaacaaaccaaccaaccgcgctgctcctgtctcttgcgcctcgagatctgcctccgttccttcctttctccctcccggcgttatgagcgcagggag

SEQ ID NO: 11750 - DNA, 1500 bp, Zea mays
tggtggtgtgtgttcgacgtgtgtagtgtgtgagttcaaatacaactcgtatttggagggtgagacaataaaaaagggtgaaagaagggtccccttgaacaggggccatcttaggggaagtcgttgcacgtgatagaagtaggaatgaatctggatacttattcggatgttaattttttttgtcttattttttcattgtggataaataacacatataatttgctatgtaaatttagatttttatttataatattgagtctattaatattcataaaaaagtaatcctcaaatttgtcatatatatttttaaataattgatgtaaaattcgaatacagatacaaatatgatgttttcattttttgttgtagggagaaaataatgagcaaaaaatgtacaagattttactcctatacttcatgttattcttaataacatgactaaaaattaacaccaaattatatacatatctatgttgaaatattagatttgtcatataattcgaatctctctagatagagggagttgtagccttcgaatgaggagaggtggagggaaggcgctgacgtagtgacttggcagacagtcttagactatcatcaacagtttatccatctctatccccatattcaagctccactctacaaacatttataataaaaaaagtgcaagacgatgttttgggtgactatatagataaactgttggacatgctcttagatcttgggggtgtttggagagctcccacagctttgctcctagcgagaatcacttctagaaagccaaacggctagaaactgagttgcttcatggtggaagtgaagtgaatctactatccattttgtactagaaagtgggagccaaaaaaacttgtttcccgctgctcccaacctgctccccacaggccaacccctcaggaatcacttcacacacaatttgtcaaatgattttcgtcaaatagattcgcttctacttgagaatcatttggaatcactctattggagaattagccctcggagctagagaaccatggagcgaagctctgccaaacgagacccttatggaagcaagaaattggtttttatcttttagatatgagagaacaacttattcgttttaaagaaatgtgcatctattttttataaactaaggtataaattgttatatttggaaccgttcaatttctataaacagttttttttttagaaatttggtgttttcaaacatacccttagtctaggctcaaagtcaacggtccactgactgcatccttgagcaacatcagagaccgttcaagccgcggaggcagaacgtcacaggccacacgatctctcgacaaatccagcgcgcacccggcgaagaaaacgccctgctccggacccggaggagccagctgctgggctcgtgagtgtcggcgtgtcgggccacaacccgaacgctgaaccaaggctcgggaccgcgacactcgtgtgtccttctcctcagatctcgccggcgrcggc

SEQ ID NO: 11751 - DNA, 1269 bp, Zea mays
atatgtgctaagtgctaaagagatgcaaatcaagaatcaaggtatgactttagccttaaagaattgtttttggtactaatatatttctctaagtgctaggaatcctgtcaagtcaaatgagattggattgaagaagtttgctaccagcctgtggtgcaccagacagtgtccggtgcaaaggctggtccagcagcaaacatgctgctctcgggaaatcgacgagggcgctgcggctaaaattcaccagattgtctggtgtgcatcggactgtccggtgagccaacagcgcccacaccaacggtcggcagcacgatcagcggacgacacgtggccagagccaacggccacaagatcgcaccggactgtccgatgtgcaccggacagtgtccggtgtgccaagggaaccaaaggctcaacggtcggcttcgccagaaaaggaaagaaatcaggcactattcatgtccggtggtgcatcggactgtctggtgcaccaatcgacagaaggcaagaattgcctaccaaatggagatccaacggctcatagctaccttggggctataaaagggacccctaggagcatggagcacaacaccaaacctccattgaacatcctaagacgcctagactccgcaagcacgcatccggatcattgcgattgagatttgagcacttgtctagttgtgaactcgttgcactgtgttttgtgtgctcgtgtcttgacttgtgtgcatgactttgctgcgactctagcttttgcttgtgtttctttccctcccttactcttgttgttttcattaagatcaatattgtaagggtgagagactccaacttgtggagattcctaacaagggaaacatcaactaaggaagaaaatcgtggtattcaagtagatcactggatcgtttgaaaggggttgagtgcaactctcgtccattggaacgccacaacatggaagtaggcaagtgttctacttggccgaaccacgagataaaaatcattgtatcacctgtgtttttattcttgtgagatcttccactcacttgataattgctctaagtttaatactcactttgtaaagagcaattaagtgaagaagctatctctttctctctagacatagcaccttggttttggtttcactaacatttcataaaccaagtttgtgctatttagtgttgaattttataagatcacctattcaccccctctaggtgctctcaatgagtatcaaagtcgtactcttcattaagggactatccgcccgaagag

SEQ ID NO: 11752 - DNA, 708 bp, Zea mays
gaattcgtaacaaaagcaagtgaaggcgtctgttacgatttgggttacgagtcagacgtctcttcacggagagatagctccacgatttttttacccttttagacacctcaagagccatctatattaaacatcattgtaactttgtaagtgcccttaccatgctaggataacttgaagagttttaaatatatgtactgagttttaaatatatgtactgggttaactggtagagaatagaagaagtttgatatatatcttcacaaggaaccaacggagaaacaataataaactttgatttcgattttcttcaagaagttgttgaaatatagtatttgttatttctattcaagctgaatttactgtacaaacttaggccgcctttagaacaaagaaaaatttcttgaatcgtacgttttttttttgcctgtcgttccaaagaagcgcttagatggatgcggacgatccaatttttcttcaacctccttacaattaattgaggccgctgctttttcttgtgtctggcggtcctgtgaccaagttgtctccccaatcaacttggcagtaggtgatctttcgctgttttgacaaaatggatatgactggccatctgctgatccaataattcctttttaattcccgccctccttcgctcgcactcgcacactactggaggggggcagggcagagcagagcagagcagccgcagcc

SEQ ID NO: 11753 - DNA, 163 bp, Zea mays
tccctgccgctcgaaacagaccatcccaacccaaaccaacggatctgacccaatccagtcatggtagctattaacttggatttcttcttcttcagggtttactaatgtgtccgctcccaccgggtctgcgcatcagagaccgagaagactgggaaatccatag

SEQ ID NO: 11754 - DNA, 294 bp, Zea mays
ggtccttgtgttgtgctgccgggagaggaagcgtctagcgtcttgttagagaagcactagatggaagatgtgcacttgcagcttctcactgtgcttatattctgtctttgagagaaataggttctcttctaaggaaatgttttggagagtcaataacaaatgcgtcaccatctattttgtacgtcaatcatatgatgagtgcagggaggaactcggtgaaaactactgaggaagtgttagttcctgctcaatcttcatctccaggtgctagagagggcagtcaggacattgaaa

SEQ ID NO: 11755 - DNA, 97 bp, Zea mays
aactggatataacatatccaccatgagaattttccttgtttactcaaagcgacatgctccgtagttgttattatgtggtgagttttaggggttgctc

SEQ ID NO: 11756 - DNA, 574 bp, Zea mays
ggtatgtgttgcagtggggtccattttcaaaacacaaccactaatagaaatttgcagtggggtccattttcaagggcagctggtgcagctagtgccactgcatcgtctgctgctgctgctcaagctgctaatgtagttcatcagacatatgaaaaagttaggagggagagggaggaagcacaagcagcggcaagaagggaatgatggtggacccaattggaaacccaggcctctgatccacttaagtttagccaagaccttctctcagatggatcttaggggacttttgctggaaaaaacgaaaactgagcttaaaaacaagctaacagtaataaaaagtaaaacatcccaagttgcagatgaaaaaggcgatcaagaaaattgcggtcaaggaaaatggtggggataatgaagytcttggaccagaagatcctacagctattaaagattctcatgattcagaacagactggttctaataytagcacagatgatgaaaatgaagatgatgaccacttatcttataatgttcctgatccagatttccatgattttgacaagaatcgcactgagga

SEQ ID NO: 11757 - DNA, 68 bp, Zea mays
ggtacaaacaacaatgtcaatgaattgcagaaaaaaacattgatccaaatatagtgtcaacagtaggg

SEQ ID NO: 11758 - DNA, 358 bp, Zea mays
ggcgcgaaattaatggatcttgcatggcgtttaattaaggcagttaaagataatatcgaataagatgatgaatggattggtataaaaaaggtacggtataaatgttgcatatatagtatatatagaatggcgtaaaacgtcgaggcattgtgcgtaagaagttgtaatgttgttttgtattgaagttacactcctataatatcagtacggttacggaaattatggaaataccctagaaacgtgggtgcggttacttgtttagagtatcatccgtgatttccttgcattcgaaaaaaatatccgactactggagaactagttggcgatggagatggccggctctggacaatcgccggcg

SEQ ID NO: 11759 - DNA, 465 bp, Zea mays
gctaggatcacaaatggattatgaaacattttcttataacaatataagacacatcttgtatatatgttatcatggtattatatgtttccgttgcaattcacagctactcaccctcgcctagtaataacatgaaaacatccgtgattctcgcacagcaagtttggccgtttggttagtcgaaatccaacttcaattctttggcaactctgtttccttgttggtgaggtcgtgactcgtgaaggtgaggtggaaagccggtggaggttgacagcaccgtcagatcaacgggtctaccgttcatcactgatccaacgtctcatatcatttcaacgaacaggtcgttcgtctcacgcatgacacacgatataaaccatctcgtcaatgccgactcctccctccatactactacttcacgatctggtccaaagccccaactcaaatttacatccaggccattcgccggag

SEQ ID NO: 11760 - DNA, 214 bp, Zea mays
ggtatgtgtattcacttttatcaattaattgacactgtatctcacctaggtgatgtttgatgtggttttcttattctacaatggcaaattacaacaccgtttgtatttatgatcttggacatgtcacatgctatatacctacaatcttatactggtcttttgtggactatttaaaaacgaaatgtactatgctctgcaaatgtgatataaaagt

SEQ ID NO: 11761 - DNA, 373 bp, Zea mays
gcagcgtggcctgaagccggccgcagcacgcagaggcggttccccaacctacccgccctattcttcccacgtgtatcacacacctggaccaatctgctcgctgcccccgacctcgagtgagtcgtccgtcgctttccttgtggctcgttcatcgcctccatccaataggccgccccgcctgccttgctctcccagcgcgctcgtgtagtcgtcgccatcttcgcttctcttctccacatttctgcgctatcccggcgtacggctgcgatccatacacgcccaatccaaaccctacctaaaactccgcctcgtgcctccgggctcacactcgtaggcacggagtgccgttccgtggtgggtggaatcaccaaaa

SEQ ID NO: 11762 - DNA, 1500 bp, Zea mays
ccatggtaatcgcgtcttaggcctaagcacagtacagattggtccacatcgtaccgagcctgtccgaagtccatggtgcttgaacaaagtgcgaagaaaaatgagcaaaaagaggcttgtgtggggttcaaaccatggtgggacggcttcaaaagcttagctgcactactctagacaattgagtcatggttcatttgtgtttaagggggtgtttgggaacaaagtttttctgcagttttggaagaatactgcagtattctcaaatactgcagtattatatacataatggtgtttggcaagctgggtaaaatctctgctttcaaaactgaagtattgcaaatattatagttgttttaaggtattctaaacttaggtctggacctcagttttcaaaactgcggtattgtaaaccgcggtattgtcatgactaaagtatactgtagtattttaaaaaactgtggttttcaaaaactttgttcccaaacagggcctaagtgtgtgaacatgggtttggaggtaacaaacatagtatgaattctcatttgtgaataattttaggctttttaccatttaaatattggtgggtggggagagagataaatagaagggaaggagtgacacatgacgacggtgctttataatatagtcttttgtcaaaacaactgtaaaaggagtttttttaaaatttttgaaattttaaaagtagttaagtagaaaacaaaaagacaagaagccgagcctagaatactttgaaaaatatactataggaaaacaactaattataaaatagtaacatcttaaaaaatatctttgatcgagtttttggcttttgaaaacaaaaacaactgtaaaaccgcagtagaaacaaacgccagccaacttgcagctcccgcaatcaattcaggccagatccctcttcctctgtttcgcattcaatcccaagatgatctggatgggtttctgctgtgcgcctcagctctgacaggtatcccatgcagaatttaacccacatttccaccaccaccacggccccagcgcacgtgaaacgtcactcgtcactgccaacgggaccaccagagtgcggggcccagtatccagggacgtaacaaaaagagagcttacggtgccccaaagagccgaccccgcagccagccaaggtcgctgtctgcactccactggccccaccggtttcgtgccgcggttgctctgctcacgctcacgcgcacgccacgtccccccacgcttgctccgcttccggccagcccctgcgatttcgcgcacgtcgcaggggcagaaggggcaatccacgtgccccgtattaattaagtcaacatgagccgcggcctcctacccgacgattcccccgctaccaggcggggtccactttccccaaactgcccttcccaccatcccctctaggctccaaaaccaccacctagctgctcgtcgctccttgtctcgtccccccttcacactcacctccccccgcggcccccgcca

SEQ ID NO: 11763 - DNA, 1500 bp, Zea mays
gggtcggctctttggggcaccgtaagctctctttttgttacgtccctggatactgggccccgcactctggtggtcccgttggcagtgacgagtgacgtttcacgtgcgctggggccgtggtggtggtggaaatgtgggttaaattctgcatgggatacctgtcagagctgaggcgcacagcagaaacccatccagatcatcttgggattgaatgcgaaacagaggaagagggatctggcctgaattgattgcgggagctgcaagttggctggcgtttgtttctactgcggttttacagttgtttttgttttcaaaagccaaaaactcgatcaaagatattttttaagatgttactattttataattagttgttttcctatagtatatttttcaaagtattctaggctcggcttcttgtctttttgttttctacttaactacttttaaaatttcaaaaattttaaaaaaactccttttacagttgttttgacaaaagactatattataaagcaccgtcgtcatgtgtcactccttcccttctatttatctctctccccacccaccaatatttaaatggtaaaaagcctaaaattattcacaaatgagaattcatactatgtttgttacctccaaacccatgttcacacacttaggccctgtttgggaacaaagtttttgaaaaccacagttttttaaaatactacagtatactttagtcatgacaataccgcggtttacaataccgcagttttgaaaactgaggtccagacctaagtttagaataccttaaaacaactataatatttgcaatacttcagttttgaaagcagagattttacccagcttgccaaacaccattatgtatataatactgcagtatttgagaatactgcagtattcttccaaaactgcagaaaaactttgttcccaaacacccccttaaacacaaatgaaccatgactcaattgtctagagtagtgcagctaagcttttgaagccgtcccaccatggtttgaaccccacacaagcctctttttgctcatttttcttcgcactttgttcaagcaccatggacttcggacaggctcggtacgatgtggaccaatctgtactgtgcttaggcctaagacgcgattaccatggtctggcacatagtggcacaacctgttagctagtcagacctaaacgggtcgagcctaaacaagccgggccaaagacggattcgtgccgggttggtccgatctgtttggatttcaacatgtatagctagagatataggctaaaaaggctctaaaagggagagcgtcgagtgaacgcaagtgggcaaaggtggctagcaaattagcaacagcaagacagggagcgagggatggtagaaagcacagataccaattccccattgctcgccgtgtattaaacatactcgcactccagctccccatttctctcctcccctccccttccctaatcatctcagcgaatccaatcgatccgaaggcg

SEQ ID NO: 11764 - DNA, 1500 bp, Zea mays
atttcaagacatgaagtaaaaacgaaccaagcagatgtctagctcgttggcgacacttactgcagctttgttctgtttccctttgcttgcaataaaacaatgaccgcccaatcccttcccagcaaatcatgcgcgggcggtaccaaacggctgatggcaacaggtggacgaaacgaaaaccccggactgaaagccatggctgctcgtcaacggcgaccaatcacccccatccatcaccctccgcacaaaagaaaaaaatattagtgccaccacaactcgaccacttcttccaagcacccccaacccccaactaatcaaaacttcacaaacattaaaaaaaagtaccattatccttgttttttagttgggcacacggctacactcggagtctcagattataaaatggctctaaggagtcactgacacatctaactatttgattttcgaagcagcagctaatggcacatttttcatctaccatttcactgtagagagacgctaaccaccaatgtgcagtgatattcgggcagtaaaaagcgggggagggaagccaagagcaactccaagtgtgcgtgcgtgcgtgtgtgtgatgcgcgcacgcacataaatacatgcggcctatagcaacacgggtatcctagtgggagtagcggtggtatataaatactgcaaaagtcggccacaagctccaagccacggcccaatcgccggccgacactcacaagaacctgcctccctctggatcgctatctcttttctagtgcccagggaaagctagctagctcacagtcacagctgagctgagggaagaaagcaaggagagggagccagggaggaaggggaaaaacacgcggagagggtgagcaagaaagaaccgaggcggatcgccttctgttcctcctgccggctccgcgagaggaggcactgctcaggtgaaatttcgctttgttttggttgggtggggtctcgagttccctgtggcgtttggtggtgtgatttggagcgggattggaagggaaggtggttaggctctctgctagtttaggtgaggcggtttggttgtggcggtcaaattgttttcagggatgagcgattttggggtcacatggttcacgattccggctgtgttccgtgttcaggttcagttcagaggtgttcttgagtccagtctaattctttcgtaaaagtcgatccctttttcaggcaggtgctgcaactgattccagttttcacgcacaaagattccacctttctccaatcctatgttcatcgtatttgatctgcagcgacgataggagttcctgttcagagcaagagacagagaaatcgtttaataataatcgttacagtgctctcggaatctttatcgtgttcggactgagatgcccagaaaggcaaaaagaaatctaacctttctttcagtcccgtgattcctacaggggggaagaaagaggtggaacaacgccccggggcagagcagagatgatgcgggagacgtac

SEQ ID NO: 11765 - DNA, 1500 bp, Zea mays
ctgcaacttaattgctagatctgggcagtgattttcttgaaactagacactgttgcatcaaattattatggttctccaatttccatagagcttctaaactgtgtatattttctttactgttatctttaaactgtcaaactgcaaaataatttagaatttagtaatatatattatatataggcagcctgatcggcttttatatgtttggacgattaggaggtctgatcgaccgatcagaaagcgattaatcggcctgatcatccgattaatcgttctgattgacttgatcgctcctatggcgatcagaaacgatcaactgatcggaaaacattgggaggctacaatggaaaagtatttagtcaaaagatgtgtctaagattagtactggaaccaaaaagagccgtgtcgaagactagcatttggaattgatatcgtgatgttattcgttgttatatgtattagtgtgtgcctgtgcggtgtgtcactagtaagatttgcagtttttgattactcccatgaaaaagcataaagcaaaagccctcaagcaccgtttccttccccgctcctgccgctgctggatcacttcctcaaggtgccaccaccggctctcttccactgaatctctttgctgctgctggtcaattgttggttgatgtctgctctcagtagtttgtaaatgatggttaccggggtatgaaggcaggatgactatgggtgtgcttggaatctttactgctgttgctcgcctcaccttgtcccagccagcaaagcaaagtgagatttgctttctctgtttggttctacagctagcatcaggttgctgccttttcatcaggggcttcaaacagcgggatggaaatatgtgactgagcagccagytctttctcacgcgggtgagccgatttggctcccctgcatgagcaaggaaatgattgccaagccaagcgagattgctgggtaaacaaagatttcaagcacttgccaagcgcatgtcgttgccaagcaagagaacttccaggaacaaagcaagtccctatattgctgactaggcttgattgtacgatttgaaaacgttgcttgatgtgtatcaattccacattcgccaaacacattctactaggattctgcatgcaaattgaatggaccaaattcagctataggtcaggcaagagaacttccaggaactaaacagcccctatatttctgactaggctcgattgtacgatttgaaaacgttgcttgatgtgtatcatttcgacatccacgaccacattctactaggaatctgcatgcaaattgaatcgcccaaattcagttacataaggtcaaatgtgtgtgaaagtttctgggctctaatacactttttgttcttacacagattgattagcatctaccttcaaatcattctcttggtatttattgagcactgcaagtggttgaggacttgaggtaaacatrctgaagtgcatcttgagccagtcatggaagagaggagcacat

SEQ ID NO: 11766 - DNA, 1500 bp, Zea mays
tcaagcaggtacttcttcatttcaagacatgaagtaaaaacgaaccaagcagatgtctagctcgttggcgacacttactgcagctttgttctgtttccctttgcttgcaataaaacaatgaccgcccaatcccttcccagcaaatcatgcgcgggcggtaccaaacggctgatggcaacaggtggacgaaacgaaaaccccggactgaaagccatggctgctcgtcaacggcgaccaatcacccccatccatcaccctccgcacaaaagaaaaaaatattagtgccaccacaactcgaccacttcttccaagcacccccaacccccaactaatcaaaacttcacaaacattaaaaaaaagtaccattatccttgttttttagttgggcacacggctacactcggagtctcagattataaaatggctctaaggagtcactgacacatctaactatttgattttcgaagcagcagctaatggcacatttttcatctaccatttcactgtagagagacgctaaccaccaatgtgcagtgatattcgggcagtaaaaagcgggggagggaagccaagagcaactccaagtgtgcgtgcgtgcgtgtgtgtgatgcgcgcacgcacataaatacatgcggcctatagcaacacgggtatcctagtgggagtagcggtggtatataaatactgcaaaagtcggccacaagctccaagccacggcccaatcgccggccgacactcacaagaacctgcctccctctggatcgctatctcttttctagtgcccagggaaagctagctagctcacagtcacagctgagctgagggaagaaagcaaggagagggagccagggaggaaggggaaaaacacgcggagagggtgagcaagaaagaaccgaggcggatcgccttctgttcctcctgccggctccgcgagaggaggcactgctcaggtgaaatttcgctttgttttggttgggtggggtctcgagttccctgtggcgtttggtggtgtgatttggagcgggattggaagggaaggtggttaggctctctgctagtttaggtgaggcggtttggttgtggcggtcaaattgttttcagggatgagcgattttggggtcacatggttcacgattccggctgtgttccgtgttcaggttcagttcagaggtgttcttgagtccagtctaattctttcgtaaaagtcgatccctttttcaggcaggtgctgcaactgattccagttttcacgcacaaagattccacctttctccaatcctatgttcatcgtatttgatctgcagcgacgataggagttcctgttcagagcaagagacagagaaatcgtttaataataatcgttacagtgctctcggaatctttatcgtgttcggactgagatgcccagaaaggcaaaaagaaatctaacctttctttcagtcccgtgattcctacaggggggaagaaagaggtggaacaacgccccggggcagagcagag

SEQ ID NO: 11767 - DNA, 1500 bp, Zea mays; identical to SEQ ID NO: 11764

SEQ ID NO: 11768 - DNA, 1298 bp, Zea mays
tgtagtggtgaaacaattagattaaaataacaaaatttatgtatggctaggatcacaaagtgattatgaaacattttcttataataatataacacatattttgtatataagttatcgtaatatactggtattatatattcccgttgcaacgtacggacactcagctagtattgatagaagtgagtaaagtacaactgtacaagttgctggagagagcccgactgaagtagggctgcaggttcggttttttcagcgttcagaaaacttcggttctcaaaaaaatcaaaaccggccgagcggtagaaatcaaaagacgacgagtaaaatcgatgatatatatatgctgatacaagtaaagagcactagaaacaatctaaccaatagagagtacgtacgtgaaataggccaacaaacattattggcaaagaaacaagccaaatatgcacaagcttttggaggacgccgccgtcaacacatatttcaatctaacaaattgtaactattgccagtgtcagcacccacacagcaaccaacaatctaacaaattgtcttgtgtctcgcgcgccgccgtcggaaggagggagatatcaggtttgatatggatgcgtatgcgtctggtctggatcacctttcaactacgtgcatggtgttgggctgtccggctgggccgagctatcaagatgggccgaggccacaatcacgagggagcacacagggaagattaacttagttataggctaatgggtaggtttagaatctaggttgtataaccctttacgctagagatagcaacatttagttaaaactatagccgtacataagataatttatttatcatatatgttctgactaagaaaaatatatgccatagttttggagagatttgattgcctaattcatcctccgtcttaatgcaaaatgagtatagaggacgaggaggcaactcggtatagactatagggcaaaattgatcgaggtgtgccttgcatatatatatacacatgccgttagaatgaccggagcaagacactgatgatgagaccatgaccatgcatgccgcattgccacaattagagagagagaaacactttgtttcctagaggagagggaggccttcctttctaccacttcccgccatttgctgatctcttggacgccgtatatccatctaggaaggcaagccatggccattttttgaaactcgccgtcgtagctctcttgttccgccgcgccatttccctgtttcagtttctctgtggctttccgcgcgctgcatgacctggtagattgttgtgaag

SEQ ID NO: 11769 - DNA, 700 bp, Zea mays
tgctgacagacactcgtcaaaggaggctttgctgagtgtctttctatgccgagcgttgtgcccttgcaaattaggtttgtgcacatagtcttatttcactgagaatgatactcgacaaagctgctcgataaattgtattcggcaaagcgccgagcacacataaaataaatttgcattccatggaatcccgtagctgaaggaattatttagacaggcacaaaataaactaaggaattatttagacaggcacaaaataaactaatctaaaattcacttttatagagattcgtaatccggaatttaataaagtgttaatcagtgcgctgtgactgtgaccaactagactacaggtgccggtctctaattatgacatctttaaatgttatgaagtaggagtagacgtgggcttgggttgggacgttgggtacagttttgctaacagtaacttgtgcatgtgagcatgtctccatctacaagtagaaggcaactgtagagcgaaaaaatctcgtctcgattgacactgccaattagtaggcgcctttacaaaaacttgcatgacgggctagctcctcagtggaaattataaattcctcatagaggtagcaagttgtgcagctaagctagtgtttgtttcatcttagcacagccagctgcccagctgcccagcttctcttccctcatagtcgaagacgtcgtagcc

SEQ ID NO: 11770 - DNA, 626 bp, Zea mays
tctatccatacgattaaatacatgttatatatatagagacgtgatacccctcaggggtatattttatatttgtacatataaccttcattagggtttctaaaaaacaattgaatttgaaggaatagaaataatgagaggactgggaaaaaaggggtgggggtggctgggcagagagcaaaagccaacttctttacaggctatattaggatgtcggtggtccagcccaacttacagaagcccataaaatagtcatagcttctgtaactaccggcccaggaagccatccgctcctcttcgaacaatggatctacttctttacaggctatattagaatgtcggtggtccagcccaacttacagaagcccataaaatagtcatagcctctgtaattaccggcccaggaagccatccgctccctctcgaacattggatcctatgctctcctctccctgctcgcagtcagggcacagggactgcctccggagaccggagcaggccgcaagcgtccaggttcgagacgccagcacgctctcgcagtacagcagcattatcagggagcgtgccgtgggagtgggaggttgcctcaggtgcggagcagtcgccggcggcgaccatcggtgtctgag

SEQ ID NO: 11771 - DNA, 119 bp, Zea mays
ttcctcattctgttttgaagccgtcgggattatgcttgtaatcattgctgaagtttttgtgaacatatatttttttttcaatcgattttgctcgagccagtatcttttattgcaacacc

SEQ ID NO: 11772 - DNA, 163 bp, Zea mays
gggccgtgcctaggccgcggcagcggcacgccggcccatcttggcacggcacgcttcgctagccgggccgtgccggcccgtttggccatctatacgttgtccgcggcaggagctcatcgcgcctttaccctcgccaaaaccgcactgaagacgtgcgcgcctc

SEQ ID NO: 11773 - DNA, 1455 bp, Zea mays
gagaaaaacttctgtatatactttttgacacctactatttacgaacacgaaataattactcagcatgttctactttatttgagtatcttgtcccaacaggcaacagctacctacgtaccatcgaatttctagaattctgagctccgctcaactcttgctgtcatgccaataatgctgattatgtgccgacgaatttgaaaaagaagatataatccgactggaaaattgtcaacaatttcttttatcagatgcgataaccaagttataatgaaaatataaaccatagcggccaccgcgcagtctaaaaaacatacatattgtcgactgacaaaatgcatcgtatttggcgtgcaacatcaatcaattttggatttagaagaagaagagaaagattgaattatttttcaacgtaagggcctttcactccagtcgttaggtgccagcacggcggcacagcgaaccaaaagtccaaagcgtgagcccgggcgtctgctaggatccactcgtttccacgaggcggacaagcctgaccgtccacccagacgttcccgtcgctgggtgactcgccgccgacccacccccgcccgcggaaagaatcggacagccaccgaccgacgcttctgtcctgacgacgacgaattgaagcacgcgcgtgaacggcaggcaccatccgcggacaccgaggcaggcggagcgcgcgcggttggttggttgggacatgggagtacaggtacagtaccgtggactggaacggaaccgactgtgtggcttccactctccgccccagtccttgtgagtgctcattgttcacactgccacggacctgcagctgcagctgcatcctcgatcgagtcgacgagcgccgcgctcatggaccagctgatgctgtccccactaatcagcgaattttaattaaaataaaaactagcaagccattatataaccttagattttaaaataaaaagaattgggttaaagcttttttttttacatacgatcgaattcattatgattcccggttctcaatcccttccatacatatgaccaaattcactgaccactattagcccttattcgattatcctcgttacacatgaattagataagattaaaaaatatttaaaaaaagtttgacttgattggatttaaacccaaccaagctcactcaatccacaataggagaaccgaacaagcctgagttcagtttcatgtatctgatggcaggactaaaacgcgggcacgtgttataattcacctttgtctgtggaccgagtccaggcgttttgcgacactctctggctgccttgaaatctccagcgaccctgtctgtacttataaaaatgtcagagcagcgtccgcttgggcacgcagagagctgagagcggcaggcaatcgaagcagaagcaagcggctgggcgccaagctgaggtgcgcgggcggcagcagccagcaggg

SEQ ID NO: 11774 - DNA, 1500 bp, Zea mays
aacatacatagaaaggcttgacataaacactacgcgtgtgtgcgaatagttctgagcggtttctactgtttttataatattttcgtctttataaattgtagtgcaacagtttaaacggctgtctttattaatatgaaacgaaacagtcccggccgatggtacagactacagagacagaggaggctgtcgctttcggcgggcggggctatgtccccggcttgtagccctgcgccgtggcaggccggcctcgcgcgggcgcgtcaacaccgatccgtgtttgcgttgcgccccccggccgggtggatcaacaagtccccgtctttatgaccagcgcgcgtgcgcacgtagacccagctgcgccgcacgtacatggcaggaagccagccaaccatacagacagagccggccggtacgatcgggtgggtggttgcctggctatccatcgtactacgtactacgcatctccggctcgcttggtctccactgcacgccatgccggccggcgcgcggccctccgcaataactcgtgtgccggcccgggtttgcatgcgtgtacagcgacacgtatgtgtgcccagcggaagtcggaactgaccgcatcacgcattgattgatcatgaccggcgggggcggggttgttgtttgcacactgctgctggagcgagcgagcgtgcgcacatgattgcgtgcgtacgtgtcagtggactgcgagcggcatccatcgcgcaacatgaggcaggcaggcaggggagatttttggcggtggtggccgcatccccgcgcgctcgagtgcaccccgtaccaacccaacacgtccgctgtcatggggaggccggagggcgcaccatgataccattgttttctctttaactattgttctcttccttgattattattattattatcgttacaacagattaatcaccagctaatataatccccaacattgtgtcccacatatatgctcgctgagcgagaagcgtagagagcacatcgctcgttcatataaaaaaaatggaatgggctcgtgtaaaacgagaaggaaaaaaaaggaatcctctacatgcaattttttcactctctcaccttaatctgatcacagctaaccaagtcgtgtccaactatcacgaacgaaaacgatgcatatagtttttatactccaacgcatatattatatatatacaaaaataaagaagaaggcacaattattcatattcttcggcacacaactctcccccctactatactatacgccggccgatacgcgcatatgtttagctcaacccctttcttttatttggcttttgtcagccactaagccctctcatcgccacaccagctatataaacacagctgctctcctgctccctttcccttccccccttccgttccgttccttccgatttgacgagttggtggctgctatagattcactccacccctctccatttctgataagtatccagctagctaccagtgtatgcaccaggcagcagcagc

SEQ ID NO: 11775 - DNA, 927 bp, Zea mays
ggaaaatgagtaaaaaaggcacttaattctattttagagaagaggttaacttataagtactattttagagaagttaaatttgtagatactataagggttgatttggtgagaagtgatcacgggagattggagaagattgaggggaaaattagtttattttctcctcaattctctccaatcttccgtgatccacttgtcaccaaatcagccctaaagagaaacctgtttaaacgagtgttataataccaaatctctagcagacgggaacctgcgaacctgaaccctcaaaccccgcccgttggcctcccataccttccgcgccgaacacccgccgtcgccaaaactgacggctcctccccctctcccctctccccttttgtgattggactgaagtgggattcatatatcaggtgtttggattcttctcttycctctgctggcgtggacgtcggtcttcttctttttgtgctgtttcccccctttatcttctcattcagcgatcttcaaattcaatatgttgtctgtcggattggcgctctagtctggtgggtttgctttcagatttgccgagtatcaatccgggtccccattcggtggtggctgaagctcggtttctccatggcgctccgtgcagcttcatgaatccatgttctcaagtgtatttgatcatgattctataaacaaccatcttatattactaatctgtaggagttttttttacatgttggtggtccaagctgaaaaaaataacttasgacaaagctasattgtcttttacatttgtgattggaaggagtaggctttttcattatccagtggcagttatagacagttgttgcgctcgtgcagcttcaaatattttgggatgttgccatgttaaggtattagccttttgttgtttcagtatactagcttcctaaaggatcg

SEQ ID NO: 11776 - DNA, 280 bp, Zea mays
aagcatgttgattggcatactactactactacttgctactggggattttacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgcacttcagtgataaaattgtcatttggatactggtaatggtaccgtcttgtgaagttcgctccttctgcagtgtgtgaact

SEQ ID NO: 11777 - DNA, 658 bp, Zea mays
ggcacatgttaattgttttagttttttcacacgcttattgaccttggatagttggattacattacattatctacctccgatcttttttattcgtcatttgttagtgtaaaattcaactatccagcagacaaataaataaaaatggagggagtatcatataagctaaccataactaattagaaatagatttatcacattaataattcatcgcttattcaattagtttatgtttggtctttttagctagtatgtaaatatagtgtttaattttaggcgattgaatcaaaacgggcccgtttaagctgcaagtgcaaatgtatggccgtgggccgttttaggtagaatgacaacgaaacgatgatgtgggttcgtaaaaaacgtgaaaaatattaaaaaaatggagatgcggggtatcgatccccgtacctctcgcatgctaagcgagcgttctaccatctgaactacatccccagctgtgtttggttaaattatctactttatttaagtatgcatttgcgaagttttaagtagagaatttgaaatgcactaagtgacttctcccttcagtggtcagccggcagtcgaggagcaaaacagatcccaagtgctgccggcgagccagccggcctccagcttgtagcgaccgttcgtgacgtcg

SEQ ID NO: 11778 - DNA, 200 bp, Zea mays
acatgcttcctacgcaggcccacgagaaacgcagagaagagattagtgaaactggaggcggggccctgaaataatttggcgggagaatccccttccatctgatcagtccggcgttttccttcctctcggcccttgacggaaaattcgggtggaaaaagggaaaaaagtcaggcgtcgggtcctcagtcgtagcggcggcg

SEQ ID NO: 11779 - DNA, 886 bp, Zea mays
agactggttagatcgaggcctaacacatgatacaagaataaacaaggcttaagaagcttcagtaggaatgctgtttaggcagcagtggattgccggggttcagtaggtgaacctattgcggcttgtacagaaactaacattttacatcattgattttatttgggagtacgggacaccctgcctggtgctatggcctatgtaaagtttccggagcattcttttctgcttctttttttttccattgcacaagtggcagcccaacacctcatgttctcctcgcctttttactcggtttgatttacaataaagtacacttattagatcattgcgtcgaaccgctaagcatctcatctttgcatcagcgtttttttttttttggcgacggcaatataaaatccggcaccggaaaagtgtgtgctcagattctaggacggttatcatgccgccagttttctatggccaaggctaccacaggtggtgcccatttcgattccgacttctttgtgtgtgtgcacctaaagcatactcgaagctcatgatctagtccactccgatccttcccctctcgccagaaggtgtactaatacgcttgtttatctgagtacttgtagttttttacgcgctgcctttcccagtgacacctgcgctgtctcagggttttacagctaaaagttggctctggtggttggggtgattcgatcatggatctggtgctcctatactacgacattctttgcggctgcaggctgtgcatcagaaacaccagaagggctgcaccacactgcacagctaccaagagtggcgtccactgtataatgtatataaatctctgacccgagttgcttctaattaagggaactagcttggcttctgccctgccgtagcc

SEQ ID NO: 11780 - DNA, 794 bp, Zea mays
gaaaaaaaaggcgaaaagggcgaagctgccagctctcccacatgacatgacacaacgacccaggagcggcaccagcacagcatgccaaccacgtgtcctattggccgcttggcggagaagagaaggagaagctgcaccagccgtctcgtaaaatactacaacgtagtgctccctccttcgtaaatatatgataataaatatattatatagttgatttttttaaaaaaaattagccactcatctaatttaaaaaatgtgttatcatttatttttttaatttgttttatcacttaagatagtttagatttaacataaaattttatatttttaagataagtggtccaaattttcgaaaaaagataatgttgtcatatatttgtgagcgaatgtaagtacccattaataacttggatgtgaattttaagagtttggagacgtagtagatgacaatttctgctatctcccagacccccggcggccccacacggcagccaccaacctcgcttcgccgccagccacggccacgggcaggaaagaaaaagggctggcgcgaggttcgttggaccaggaaaccgcggtcggcggagctctcgctctcgctctcgcttcgttgaaggctcccctcttcctccaagtataaaggagcctcctttccctttgccgtgctgtgccgcgcctgccattctcctcccgagccttctcttccttcacgcctctttgccgcagcgcgggtgggtcgtcgtttgctgtttgttccgagatcaccggagccagccagccagccagaggcagag

SEQ ID NO: 11781 - DNA, 780 bp, Zea mays
taataataaagttttttataagtgtaaaagttagtcctgacactaagatatcttactctttgatctattcagatcacttcagtgtttgtttatatacgttgagatatactagggtataagctagtatataccaagactatccacatcgtactccttaatttaataagagagcatttatttaggattaaaatctatttagattatataatttaacaaattttgaactaagattatataatcaggataaattatagtctcaaataaacatgtgctaaatctaccactaaagctttatagacactctaaattcatatcaattgtctctaaagaatatcctaaatttttaggattaaatactcttatccctaagtctatgatatttttctttctttcttcctaatttttttatactctagtctacgaattaaacacataattaatatgcatgtattattttagactatgataaatacatatataaaacatttaatttaaaatatattagaatatgatgtatcgtgtatatgggtggatttagagagagtaaaatattttagatgtggtgaagaggtgaaatttaaggagatgatgaagaaaccttccggatagtctaatcatccgacagctcaaggtcatgcgcactgccacgccatccagcggcatccatatctgcgtgcgcgacggctatccaggctccagtcgtccccggattagttgtactgtacattgttcctgcgaagacactgggtcgtccgggtcaatcggcagcttgaaccagcc

SEQ ID NO: 11782 - DNA, 550 bp, Zea mays
ttgcctccttagttgttttatttcgtttccccttgcctccttagttgttttatttcatttcccatatgtggttttatgactggataaatgagtaagatagatgctgctattcattacgtagatggcctttcaattcattattccacaagtcttgcatcagcatagcatgctggttattctgttctgcagaagcataatgcctctttgattatctaatgcgtttatgaactagtatatactacagcttggtatctgtcatcttggacatcaacagtctacgaaacccacatttgaccattatcagtttttctaaatatatgttagtagaaaaaatcattctgaaacctactaataaactttcatatggcatatagatctttgtgcccaatttgtaaaaccaattaaaaattcttttgatggttgtcttgctctcatatacccccttttaagcctaaacctttatgtgtttggtatgttcaccaattctttgttcttgatgttattagcatgtatcaaatgatttttgccacatgaatattcatgatcttta

SEQ ID NO: 11783 - DNA, 1500 bp, Zea mays
attcctaatttcattctaaaaataaaataaagaacctatattataatatgggttctgtgattaatcgttattacttcgattcgttagaacagcttccattgagtctctgcacctatccttttcctttgggttctagtttaagaaccacttattttttaaaaaaaaacagatttggctcaggattgcccatttttcattccagggtttctctgaatttggaagttaccacttagcaggtttccataccaaggctcaatacaatcaagtccgtagcgtctaccgatttcgccatatccccattttacttttctttgaaaccaggattccttgtataatttaatccatctcttagttttttttgaatcattgaattcattattcgacgtagtctagcaactcatctctatttgagacaccccgctcgcttattgcaattcagaattgcattgattttatcgttgatatatttgcaattcaatcggaatgaatatatccaaaagtttttctctctcccgcctccctccttccttttttagagtattccaaatcatactataacgcttgatattcattctttttttctaaactgaattagaaatttcatttgctatgattctatcttctccttagtgaactatttatccttaaattattaacaaataaaaaaacaaaatatctcaaaaatgtatataatgatcaaatgaaaatgccaatctcttggcattttctctttattatattattcatatatattcttctttttcttcttttctatgtattagattattcctccgagccatatcaaattgaaaatatctgaaatcaaattcaatatagaatttggaatagattctattaaaaaaatccatttgcgaattagagaaataaaaagaaagttcaataaattctataatcctatttaagaatatcatttagttaagcatatcaagctaactttatctttatgaaattctagtatttttttttttctatctaagtggaacttccaatttagaactagttaataactaagattaataattaagatctgacattttacagattccctatatatatttttatttgttacactatttctgttatgtaagcccacttagctcagaggttagagcatcgcatttgtaatgcgagggtcatcggttcaaatccgatagtcggcttttttttctatcgatgttctatgaacaagaatttctctttttctccgaataaaatggggaatccagggtctattatgtcgttttaccttacaattttgctagatacaaagcataaaaataaataatatatatacaaaaaatccagatgttgatgaaattccattttttgtgttactccattttttgtgttactttagtagattttactctgtttatcctttagtttaattctgtttgaatttcgctgtattctgtaatgtaaatagaacgaaatttattgtgtaaaatgaaatttcaataaaataaaaaaggagtcttc

SEQ ID NO: 11784 - DNA, 380 bp, Zea mays
ctggcgccggagcccaccatgcatcgggtgggtcggggtgtggcctggagttggaaggccgaagggaaggcgagggccgaccggccgagcaggtttgaagtgcggtcgccgggaggcgttgacagatcagcagcctggttgggattgggctgatgggctccgctagaatggcccatgtggcccacatccgtgagtagttggatttggactctcggacaggacggttcgaaaggtcagatcggatccccatacttgctaatgctaggccacggctgacgtctgcgccgcttccgcgtcggcggcggacagctcggagccgctaggtctccgctctctgccgcattccgtggcatatcctataacaatttccccaacgccac

SEQ ID NO: 11785 - DNA, 199 bp, Zea mays
tccattacgtgcacccgtcgagtttcataatgtcaaatttctcccctgcgagacaagccctacctaccactaccactctcgagtctcgagcaccagccctctcgccttccgctcctccgtcctcgccgaaccccatggcccaaaaaccctgaactgagcccgccgccgcttctccagtccgcacgaagcgccccacaaa

SEQ ID NO: 11786 - DNA, 733 bp, Zea mays
acagccttcaactctgttctggttcgttccttcagaaactttatgcgtacggatacgtctgctttcttgtgcaccttcaacagtcgcaggtccgtcgagaataagtctgttcacttcatattaaaactaactatttaaactgctgcggatacaatctataaagataaaatattataaaagtattagaaaccggtatagattaaatcaaactaccwtgctgtaaattcgtacagattttacaatcgtgctgaaccctgtgctaggggctgcatactagcgctactttcagggcggggattattgttccaattcgtgaattggtaatttctgaatctaaataaaatctcaattataatatggtccttagaaatcagattcttcaacattttcaatcaaaatatccagaaccttcactatacgaattagcatgcgaaggttgaagagagaggcggtgcaataataatggaaaaccctccatacttggtgggcctgaaagaacgcaaggccaatggccacatgcgagtagccaatggccccaaggccgaaatggcagccactgcaacgaacgagtcaatgctccagactcgccggcttctaggcccatttcgaaccttccggaagcgcggcacggaataaatactccgctacccctaacctcactccccctctcgatycggaaacctctcaaaccctagccgcctcctgcaagtttcagagctcaggaatctgcgcc

SEQ ID NO: 11787 - DNA, 831 bp, Zea mays
tgcatgcctgcagatccaacttttcattgaggcctctattgattcaagtaactggtaaaggatccaatgcactattcacatgtctctctgacccattcacctaagcccctcctttacactcctatttgcaactcgacgtccacgacgccgccgagcacagctccggcgacccgcacctgatcgatcaaggtggcgcaacaccgacgacggcgaaggcaccgacacactccccagactacggcgaacacgggcatgtgcttaatttgaccacgacgttactggagcacagctactgacggcggctgtggaaccttgggttcggcgagcttgatcccaaaccatccatgcgatagagttctattaaaggtcgcggggagcatcagtggcatacctaggcttatgtgcttgcgctaattcggccagggacaacgcagttcgaagggtcgacgatgaagcatgtcagtggcgccaatctgcggtgacgagaccatgttccggctgaacaaccacactagagttcaagaactaacttgtgtgagcttcatcggccaacaaagattaccgaacaagcataacatgggcaaatacctgctggagttagtctggctacgacaaggtgaagaattgtgagcgtggtcagcactggcacttgatgctctggacagagcagacttggtggctgtgggagagggtcatcactagcaggaatacaagaaccccaacacccttgcagtggtctatgagtagagatcgaggtagagaggagatttccactgctccctgccctttaaatacctgaaatgggataggtgttccctgaacttggcaaac

SEQ ID NO: 11788 - DNA, 485 bp, Zea mays
gccatccgctcgttctttttttcgttggcattttgtttttcatgtctctagcacctatacatagattcatagaatacagaacacagagagaaaatacaaatacgaataagaccacaaaaaaaagtcctggtgtttttggctgttgttacttgttaccctttgtaaatgtatgcaatcccccacataatgtttccattcgttagccaggtgtcaccaattccgtttaataagttacattctacagaaaactacatgcgtttgcacggaaaacatagaaatgctagctttatggaatcaacctgccgaggaagctagaatggttcagatacagcaaagtgaaactcttccaatgcaagtctccattcgactactaatacaccggaaaaagttgaaatcgtgaacagtcatttctctctccatgaaggcacgagaatacatcgagtcatcaaccaaacatctcaggtcatataaagttttttccccct

SEQ ID NO: 11789 - DNA, 1500 bp, Zea mays
aaccaaatataatcttaaataaagtcaacgcatatgataattcaagatgagatggtgcgggtaaccggcggtaaatagcctataaactttttctacaaactcacaagtcactagagaagtttaaataatacaaaagctggcggtaaatagcctataaactttgtattaacacttctagtggyttggtatttagtttatatttaatggtacaagctacttacttagcaagagctattaatccaatccaattactatattacaagctacaatctacacaagacaagttgagcatgtatcaaacaacaagtacataaatataattacaacagtaagaatagtgagtaaaccgcacattgtgccagaaatgacactagatatatcctcgaggttcggttgcttgctgactaattacgtcatcattatgacgagtccaaactactccctccgatatcctattagttgctgttttagacaaggttcgagtcaaacttataaaattttgactataaataactattttattatctagttttgaaacctaatatttatatgcatcgatttatcataaaaagtacttttataaaagtataattgtattaaaagtttgtttgtattttaacagaaaaattggctgcagttatattttggaaaccgtgtcgttgtcctaaacggcaactaataggaaaccggagggagtagctttgtgcattctctgccttgcctaatgcaacatgtgtaattgtttatgtaccgaggttgttttcctttttttgttctatcatagaagtgcgatctgattgtgtgcttcaaatctgtcacaggatgctgcaaaagtcatcaaagctagaattgcagagaaccctaactcgatgaacttcaacgtcatggctctttcaaagaagtgaagtgtactgtgatggatggattttctttggcagaatacgggcctcttttcctttcgcttccgctgggctgcaccgagtggaaggtttgcatgggcaaacatagggggaaaaaactttatatgacctgagatgtttggttgatgactcgatgtattctcgtgccttcatggagagagaaatgactgttcacgatttcaactttttccggtgtattagtagtcgaatggagacttgcattggaagagtttcactttgctgtatctgaaccattctagcttcctcggcaggttgattccataaagctagcatttctatgttttccgtgcaaacgcatgtagttttctgtagaatgtaacttattaaacggaattggtgacacctggctaacgaatggaaacattatgtgggggattgcatacatttacaaagggtaacaagtaacaacagccaaaaacaccaggacttttttttgtggtcttattcgtatttgtattttctctctgtgttctgtattctatgaatctatgtataggtgctagagacatgaaaaacaaaatgccaacgaaaaaaagaacgagcggatggctacgactgc

SEQ ID NO: 11790 - DNA, 773 bp, Zea mays
tttgaaacaaaaaacaattcgatatttactgcagtactgtgtataaacgctaagatctcctttggatcagatgattatttcctgaatcatgtgtttttctgtgttttaaactaatatctataaaatttttaccattcctgtaaaccgcgacacttgatggcacattacttttgcatttagaaatgcaatcttttttttatctatttttacctggaaaagttccctcatttgtcctttattgacccttctcccttcccctgaaatgaaacgcacgcagacgcagcagcagagcctgattttttttcttatccatccacggcgccaccccgcattcacggaacgtaataataagccaaaagatgagagaaagagacagaagagtgacaaggaaaagcgaagaaaaagggaagagtagaaaccccccctttgagcctttcggtttttctctgtcttcatgtgtgtttgttatagagaccctgccttgtcggggcagcacacttgggacgcgagggggaggagttggtgagcgaactcgggatcagtgggtgaccgcagaggttgttgtctcggggggaattctttagcccctcctcctcctcctcttcttcttcttttcttccgcatgtctttggactcgctgctgttcttttgtttggtacccttggatctctgactccagcccgttccccgaaatttccagttcttgcttcttcctcttggaggaggagggctgcagcctgcaggggccggagagagcaggaggaggcggagac

SEQ ID NO: 11791 - DNA, 613 bp, Zea mays
ggtactactccgccttctcgacctcggcctccgcggtgcccgcctggcctgctgcggtaaccgttgccatgctcgaagcggatccagcaccccatcccaacatcttcctaaaatcctcggatctgcccccttcctccgcagcttgtgtcgcatcttctatctattcaccagcaaggtacctggcacagaacccagccgaatcctagaacccagccggatcctagaaatttcccattggcatctggtgaccgtatccggtggttgggcgtcagacgcagcggggcggtaccggtgcttggagttggaccacccgtgcaaggcaccgtggtgcgacgggccgctcggcgcgctggagagcaacgggtgggtgtactcggcgcactgctccttcaagctctttgtggccgatgcgtcgtggtggtgccttgacgggaagtggctcttcttctggggcgactctaaccacgtcgacaccatccggaacctcctcaccttcgtcctcggcatcacggacacgtctgctgtgacacgccagtttgatgcagtgttcaccaatcccattggtggggcagggactctaaggatcacaagcatcttcaacggccactggaac

SEQ ID NO: 11792 - DNA, 1359 bp, Zea mays
tgtaacaaatttttgttgggtcgagccacgagccacgttgactgcagcgagccgagccgagctagctcgctcttttcacgagccacaaaaataagctcggctcgggcttgttctaagcatcgagccgagccgatctgagctgctgcgagcctgagccagctcgagctttttttccagccctacaccaaggtgattagtgaatatcaatacgattttatcaaaggcagatttattatggatagtgtgatatttctgcataaaatcatccatgaagtcaagataaaaaaacaaagtggcttgattttcaaagtggactttgaaaaggcttatgataaggttaattggcaattcctgcacaatatgctggacaaaaaagcacaggggcctctaatttgtacaatcagaccagcacagcatagttgagtacttattccaattacaaataatctaaaaaaatgcagaggcaacttccacaatctaaatcatgaccaacaactagttaccctagaaatataaaacacaaatgtgagcaaagtttctttctaagacatatatctcaaccagtcacaatctcgaaacacagacattccacactccaatatttctagttgttgttggcatgtccttctggttcggctgtgtgccttgtaatgaactacttttcctatttcttaatgaaatagggggcttcgcccctttgtcaaaaaaagacattccacactaccacttctcagccccttatctaccaccatacaaaaatttaccaactgatgatgtatttccaaaggaaatgagatcagaatcacaacaatttgaaaactagcaacctgggaatgaattcgagtgaggctagggctgagtataaggagcaagccagcgggcgagagtggaaaagaacgaaatacctacagtacacggacaactaagagatcaactagtcggattcctcacctgtcgactgtcgtaccggcaccgcaaggagctcgggaggagagcgcctctgccgccgggagatacgccgatgcggaaacgaatgggggcaggaaggtggtcgtctgatgctctgatgggccgtccgaactcggatccgcccaggcggtctcggtcgtccgtttctaatcgggccgcggtcaaagcagaaggccgagtccttttacgccttcgcccctcccccaataggttattcaaaaagcgatcctgaccttccacttccgcagtcccgcaagaaagaaagagaaaggagaaggaacagggaagcaaagcacaagaggtggccgccgcagtccgcaccccctccccaatcacgccacccgacaccgcgctccgcagattcgtagtcgctgctaggcttccggcgag

SEQ ID NO: 11793 - DNA, 100 bp, Zea mays
agtaagatccgcctacgctatccccgcatttccaaacgcactcctttactttttgtcccactaggcaaaccaccggtttttttatggtgaagattataat

SEQ ID NO: 11794 - DNA, 1121 bp, Zea mays
gaggagctcacaagtttgttatacgtggttagacctaactacctaaggactacgaatctggtgctttctactgagctttggacatcgtggtggttcgcttcttggattcggcctccatggtcctttcagggtcttctggtgtggtcgttcgtctatacgtgtctttgtatgtctcttggtcaacctccctctttttataagcggtcaacctcctttttttataggctaaagtgagggtcagctatcgatagcttcgtaaggaaggagctatggggtcgtggtaaaacatgacattctatcttgataactgaactattagctgagatgtttggatgttctaagytaaaagtacataaagctaaattattagctgagttgtttatgtattttaactaaattttgtggctaactattagccatagcgtatccaaacaatgcgtaacttgtattaccgcataaccgttgaactgtacggatcgtgtggacatagtgggacaaatccaaaattcaaaagtaacgaactattatgaccgcttgtttttcgtgtacactaaaagtctaaaactattggctagtattgtgcaccatcattggttttttcgctagctcaagtgctcaacaataattcaagcaaattattatttttgtgctagtagtaaagttagaataaacccatgcatataccatgagttccccttgaattcacgagaagctcgttgagcaaacgtgatgaagcacgcttgggacttgggatacgcggaaattcacttgtaaccaccgaaaaggacaaggttgcctcctgaactcctggttcatggttggaccatgcttcagtcaaggattgatcgagggcaaatttgagtgattttccctacttttacaaaaaaatattaatcgaaaacagaagggggtttctacaagattgtcttcgacatgtctgccgctggccgcctggcccgctgccgcatccatataccacacccacacacacacgccgctcggaatcggagcttgcatccgaccgcgagcaagcggaccaaatcctcctccatattctatcgcgtgcacgcatctggccgcctcgaccctcggcggcggcggcggcgacggcgacgacgacg

SEQ ID NO: 11795 - DNA, 246 bp, Zea mays
ggtgcgcgcatcatttgtgaaaagcagccgcaaaaatacactcatgttcaggaatggacgcttgacaccatctgcccactccatgtccaggccggcgtgaagagggacacgaaggtgaggctgggagcgtggtcctgggacgcgtccaccggcgaggagctgcgcgtcggcgccggactcgccgaaccttacgacgcggtatggtgcgccgtggagtactacgagtccacgggctccatcctacgc

SEQ ID NO: 11796 - DNA, 447 bp, Zea mays
gataaaatttagcacctattatcttataagctacttgttaaaagtagctaaacgtgggccagagaaccctattttccaaccataccctccaacctcattctctctctccgcattaggggcatatgtgtctttttattccaatgtgctaaactttattagagtagtccaaacacccgaaggagctaatctttagcacttcaatttatatggctaaagtttagctggaagctaaaaattatcatgtgagatttaaacagggtcttagttagatatttggtagctagctaattgtgttatcaattttttagttaataactattggatctagtgtattaaacacccgtaagcttggctctggctcaaaatccagtcttagaatcgataaaatgaaaaaagttgggaaagaaacccagaaccctttccccccaacctagccggcacccacca

SEQ ID NO: 11797 - DNA, 837 bp, Zea mays
ccagccatctaattattacactgttcaggaaaaaaaaagatatagctagtctacgtaatatatacatgtcacatatgccaacaaacaccatgcagacaaagggatgtagattgtttaaaagccaagctatatatgcaaacatcagcgatacttaaccaaacttgaacaagctaaaacactacctatgttgttcttgccctagtttctagttcgccaaaaatctaattacaacactgttcatcaaaataccctttttatcattgcacaaataagaggactaataagatacactcaatctacttgcattatggaagagaatgcctcgtgatcactcacccactcatcggcccactcatccaccctcgagcatcagtaggcgccaatggtactagcgtcgctgtgcgttagctcggcgccaatgatgatgacgtcgagtttgagattcattttttgaaataaaactgtaaagaacataattatgcaaaaaaaactcaaaagagctaaaatgcaaaaaaaaatggtcgattcttggttctggactccttggtacgcaaggaaagccaaaacaaccggaattcaaatccacccctctctatttaattcaccacacgtacggtgctttttttcttctaatccaaccgtgtccccacacctctcctctcgcttttcaccttccctcactccacagtttctcaggcaggggtagccgtcccgtcccgtcccccactcctcccgttccgtgctgctctcagcaagaagaaccaagggagaaggaaacccaccacaccacccctgataaaagaaggggtcgcacgctcccgctcccgccgcgacgcc

SEQ ID NO: 11798 - DNA, 179 bp, Zea mays
ctgcaggctgctggtgatctttgtttacacaagctaggggcaaacctatacgaccgaatcaagaaagaatggtggaatacatataagctgaaaaaatatcagcattagtgggtcaaagcccagatctggttgtattcttgtctctggtccaaagaacatggcaagatttttgtgatcag

SEQ ID NO: 11799 - DNA, 853 bp, Zea mays
attccatttccactccgggggtggacatgagtctcatcgagggtgcagatagcctgctgaatcagagatatcatgcacaatagcaccacatgattgtttggaaaattggagtttcgacgcctatcccggcatttgggatgtgtgagctaccaccagcggtatatatcatgaatctggatcaatgtaccactatctgtaataccagatgatgtatagtttctgaatcaaacatgagcacttatcttgtacgccgtatctcgaacggaactgtgcaggacgcaaagtagaacctataaaatttgatatatcgggagagtaaataacaaagtacatcaatacattttttttgagaggtttgcatgagtcttgatagtttaattatacggaaagtttgataattagacagttatgattccagccgcttcaaaaatacagatactgagaatgaaactgttcttcattggtctcgtggatccagtcaagtcaagctatacaagatcagttgatccagtactgttttccttttaaacgtaaataaatttttttttataacacacctacattcgtttagttgttcgggaataaaattacaaacaccatctggtaggtaggtagtgacgaaaaccatacaagtgctgctaattaaagagcttctagcaaacctgtgtgcattaccaccgttggttctgcgattttcatgaacaaaccacctaccccaatccatatggattgagggggtttcaatccctagcaaatcaaaatcttctctaatccatatcaatcccctacaatatatatgaattgaaaataaccgaacaaaagccaaacggtgaaatggagcttctggacaaga

SEQ ID NO: 11800 - DNA, 439 bp, Zea mays
cctccgatcgacgatggccatcgctcaagctcagctgggccgacacaatcacacaagggtcggtccacccacattcgtacgcgtgcttgttgtctctgtcagccatcaactctccagtgagctgcgagcctacaaggctgtgggcagtgccagcctcaacctcgacctcccccagtcccccaccgaccaccggcctcctttcccgcaggcacgggtgcacggcacgcggtttccactcgcttcgtccgcgttcggatcgccctcaggtcaaccaccactcctcccctctgctcctctcagcatctcgcgcttcagatctcgcccaccgatctggaactggaattccctcccgatctgtatgtatctcacgcacgcttgctcgcgttcttggctttgctcccacctctctctagcagagtaacagtctagcagagcaagc
